United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 23

SEQ ID NO: 120392 - protein, 93 aa, Glycine max
  Coding DNA Sequence Number=SeqID_28707
MGPLQMQAFRKAYGKILDLTIAEIFMEGFDKRVGSCKANSKWHSGPTTEVLGRQGKGYGESRGVGPVCGHISIANLWGCPLSKRGRFGGPSRD

SEQ ID NO: 120393 - protein, 69 aa, Glycine max
  Coding DNA Sequence Number=SeqID_28708
  Homolog annotation: Hit_ID=UPI0000ECBAF8; Match level="QueryCoverage =59%, HitCoverage=48%, E-value=1e-16, Identity=100%"; Hit description= UPI0000ECBAF8 related cluster
MAACCTDPLSHVRKLSCMQAWHWPSFYNVVTGKTLALPNLIALQHIPLSPAGVIAKRPAPIALPNSCAA

SEQ ID NO: 120394 - protein, 237 aa, Glycine max
  Coding DNA Sequence Number=SeqID_28709
  Homolog annotation: Hit_ID=A7UQU7; Match level="QueryCoverage=51%, HitCoverage=20%, E-value=9e-20, Identity=45%"; Hit description=IMP dehydrogenase/GMP reductase, putative
MSHSRQLDGYITLLQCWVYEHFSSVAESTADQDYDEASPRACRWIATKKTVKSICMPSYRERLDRLRIPDVCWIPYGEHREVWDFHVRSCYSGLLRWGPVAVYYRPERAVRQFGYTQTIPAPPVDSWVSYDDIHDRWMHYEDHIVPAGEPRVVPQAPQTNIPRVPELGASSAEEPRHAVEVCEDIVERLERHLSLGVVTPGSSTHEVIEECLRLAKSVTQDHLVYVRCRRRRRTDQA

SEQ ID NO: 120395 - protein, 87 aa, Glycine max
  Coding DNA Sequence Number=SeqID_28710
  Subcellular localization annotation: CTP_CleavageSite=43; ConfidenceScore=5.56e-01
MPFLSVTCSRKCAKNHAPAVNVSPSTTANARGITPPFPSCDVAVKRVPRYFPYKLLESLFTLPKSPKNPMKLTVFATNRIPTDKIVM

SEQ ID NO: 120396 - protein, 127 aa, Glycine max
  Coding DNA Sequence Number=SeqID_28711
LISMMGNFSQDNWRWDLQWRINLFDHEHDLAMSFMEDITSICIQRNVKDIMMWKAEPNGVYSTKSAYSLMLKLNDSGSQDRLPTKGNLLRRHVDIQDAGCPLCGQGQEEGSTRGACISFIPVPLVLL

SEQ ID NO: 120397 - protein, 159 aa, Glycine max
  Coding DNA Sequence Number=SeqID_28712
MTRYWHRTSCFLSNWKILTETLGCTICVRLMKQTNVLPLKKHSRNHYMGNQQRQGILKEDFRLPTGVEARLRGELMTTKDDDKGDEQKPQRSKNKSSESKNISSESRTSQEFKNQEEFKTQEENLESGIKIQDSRSQESRSRFKTQDSRMKKRLNQDKY

SEQ ID NO: 120398 - protein, 65 aa, Glycine max
  Coding DNA Sequence Number=SeqID_28713
KVFYLVGPYSLLKRSPPPPSFEEAGCEATMESAFPDSDAVERRLVVKGTDDLGLDGFAPGDIIYR

SEQ ID NO: 120399 - protein, 74 aa, Glycine max
  Coding DNA Sequence Number=SeqID_28714
RDSNVSMTELVSVEDNAFHLTDSKKNVYTDNHSGISARQRDSNVSMTDLVSAEDDIAKKKAYTDNHSGISARQA

SEQ ID NO: 120400 - protein, 17 aa, Glycine max
  Coding DNA Sequence Number=SeqID_28715
MGKAIKHPDDGEDWFEA

SEQ ID NO: 120401 - protein, 168 aa, Glycine max
  Coding DNA Sequence Number=SeqID_28716
  Homolog annotation: Hit_ID=Q2HW90; Match level="QueryCoverage=45%, HitCoverage=16%, E-value=5e-09, Identity=37%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFCPSTTRVAKKEGRIQILSSCEGCPNVPLMGTRGCITYNLVLAIRQLGYPMRGVPSDESITPFIARRISDHNARVLQGSSQGMGCGVKKGQRA

SEQ ID NO: 120402 - protein, 176 aa, Glycine max
  Coding DNA Sequence Number=SeqID_28717
  Gene Ontology: Mol. function=helicase activity; Biological process =viral genome replication
  Homolog annotation: Hit_ID=Q9LW42; Match level="QueryCoverage=99%, HitCoverage=21%, E-value=2e-21, Identity=42%"; Hit description =Helicase-like protein
MARDRLQDVQVNNIKLKLIANREKDGRTYNVPTVPEVVALIVGDFDANSKRDIIIETQHGQLQRIHELHSSYLALQYPLLFPYGEDGYRPDILHSSRSDETPKKKLRGDKFCSFNSHWMMEVGRGLNKDEIDQIISAEIPSQQDDPELYSLVKKHMVHGPCGSLNPGSLCMKKGQV

SEQ ID NO: 120403 - protein, 76 aa, Glycine max
  Coding DNA Sequence Number=SeqID_28718
MAVEWRRKRERRCHFKEKMSLEEAHHHRSPWIRAWRKKEMNEGRGREEHGLLCSKRALKSEPTNPRSSPRFSTQCA

SEQ ID NO: 120404 - protein, 60 aa, Glycine max
  Coding DNA Sequence Number=SeqID_28719
MTPTHDVLLYYNGRWNMSCQHDFVGYSFTRKNPKRFDITLGCSIDGLKDVIKQLGHSEYS

SEQ ID NO: 120405 - protein, 145 aa, Glycine max
  Coding DNA Sequence Number=SeqID_28720
MASMMEAMLGMRQLMEKKVATVAAVSSAAEANPTLLATAHHPPPNAVGRGKSTLGHNSNPHLGYNRVAYPYGLLPNYTPPVMQDDAGDVEFYPPIPIEELAPNTLPQPNLTAQPIFLSTEGPPPATEERRKLDLLEERLRAVESF

SEQ ID NO: 120406 - protein, 119 aa, Glycine max
  Coding DNA Sequence Number=SeqID_28721
MMRHEDAVQGVFHIKAQNSGGDKDKKNNKWKNKKPAESSNKQQNDTFLPCPHYKKTNHSKKNVGGGLTSSAKNVIELDELESVSILSMTLAWDEFSFSTFQEAHYSLQDSLDQVPDMPF

SEQ ID NO: 120407 - protein, 70 aa, Glycine max
  Coding DNA Sequence Number=SeqID_28722
MEEFDAQVAWPEDQPSSSGGGGASTTQVLVTEEPPAPAPSPAVAEEETTPAQTPQPSPPSAPALEETQPS

SEQ ID NO: 120408 - protein, 200 aa, Glycine max
  Coding DNA Sequence Number=SeqID_28723
MGSSQKPSLKKRFYQVKIKSLEGRSLHGTDASLSQYYDSPKCSHSRLQLVPTVKEFKEIWDATGRKEAISFLWVLSLHDKSCQGSENLSTRVEPGEWASFIDILALLIFGVVLFPNMEGLVDLAAIDAFLAFHHGKESSVVAILAMYDTFDRGCPSIRYKVTARASKRERESRTSPIASQGQSSGGHLLRPRGDPRTSQL

SEQ ID NO: 120409 - protein, 62 aa, Glycine max
  Coding DNA Sequence Number=SeqID_28724
MSLSLQSQGFTSFPCPTPDQFRAKAGEAPAEAPAEAPDEADEARDDEEMTDLLDFLGGSGAT

SEQ ID NO: 120410 - protein, 55 aa, Glycine max
  Coding DNA Sequence Number=SeqID_28725
MSEIRRKPVRIVAFIFPQKPKTVSESHEDSTSGDFDLFSVSLTFENSIGAVEGKT

SEQ ID NO: 120411 - protein, 73 aa, Glycine max
  Coding DNA Sequence Number=SeqID_28726
MMTKVMNKKLKRSKNNSSESKNISSESRTSQEFKNQEEFKTQEESLQSRIKISRIKIKIQDSRFKNKERTESR

SEQ ID NO: 120412 - protein, 64 aa, Glycine max
  Coding DNA Sequence Number=SeqID_28727
  Homolog annotation: Hit_ID=A6FJQ2; Match level="QueryCoverage=59%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARRVLPSLALGCTKEN

SEQ ID NO: 120413 - protein, 189 aa, Glycine max
  Coding DNA Sequence Number=SeqID_28728
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
GRNRRAHEGASRGETPGILVVLSGFATSDLSVDFCDARQGGGAYGKTPATRPFYGSWPFAGLLLTCSFLRYPLILWITVLPPLSELIPLAAAERPSAANSPREDLGFDEPLKIQSRIVHHGFGETHQGKTLGLTSLGMQAWHWPSFYNVVTGKTLALPNLIALQHIPLSPAGVIAKRPAPIALPNSCAA

SEQ ID NO: 120414 - protein, 91 aa, Glycine max
  Coding DNA Sequence Number=SeqID_28729
MGSSILPKSLPTIFEVGRFICLRPDGSIGFTLATALNSGNYNRIGFHYLLHAHHGLYHCGHLLFYGLHFLAFIFSCTFSASPITLALARVR

SEQ ID NO: 120415 - protein, 65 aa, Glycine max
  Coding DNA Sequence Number=SeqID_28730
MGALCFRGFIQLLNHGSTESALSEMVERNQPLGYIYGPICPLAKETISSFNNNLEASTKMYLQNH

SEQ ID NO: 120416 - protein, 135 aa, Glycine max
  Coding DNA Sequence Number=SeqID_28731
  Subcellular localization annotation: CTP_CleavageSite=22; ConfidenceScore=5.66e-01
MGSPPASTPPPPPSPPSPPPPSDASASPFVVKRTRKASLVHVDPATGKADGPHRKKLRTYLGIVAHDKVDITNENWKEIPTAQKDLILGGYSDLTRKWALEADQDGVEDTVCDKYGINKEKWAQFCQTRRDPSWE

SEQ ID NO: 120417 - protein, 159 aa, Glycine max
  Coding DNA Sequence Number=SeqID_28732
ASLLRLPPQPLQRLSENGKGRRMSLRGDAISQAGANKAVRPPTGLGMRRPFLRKETGEIKSYAIDRPFRSDFESIAARPTEVLKAFEAYTPYYTTKKGGALLSINGKISVRGVIRNPRKDRLRLPPRSHEDLYVLVQSRTTEIFRSACVGAAQIKKSLV

SEQ ID NO: 120418 - protein, 147 aa, Glycine max
  Coding DNA Sequence Number=SeqID_28733
MEFLKGMVKLVVATAVVCLVVALSFYQKLGLELEMVVAIIGVGVVVTVFGLVFAFGDFVPSESVSPSEDNVVVNSKLSEEDKSYSSGCLDLLGFLLSLDFLAPTPTQLHTSLLVELLVAIEFFIGLLLYFWTVLLIITVFLLLVHCD

SEQ ID NO: 120419 - protein, 168 aa, Glycine max
  Coding DNA Sequence Number=SeqID_28734
  Pfam annotation: Domain name=G-patch; Domain location=1-42; Score =3.0; E_value=0.082; Accession=PF01585.14; Description=G-patch domain
MVARVMLRNGFERGMGLCKDGLGNADVVDINGNPYKYGLGYEPGMLGRRNVPSRLRADRVWPGCISQCFTSAGTVSEEEVAAVEEEYEGRFFEDPNNEGLTIDFDRDVSQIMNEEEEEDVLSPELERLIAQEEREMKPNQEKTELVNLGTTEEKKEVKVGTGMTAPIR

SEQ ID NO: 120420 - protein, 68 aa, Glycine max
  Coding DNA Sequence Number=SeqID_28735
MAKKGVVATYPSAGGRRVTRGMRVPRKEYARSRHQRLFEPNVGKIGKDAIYELLSERFGSCIYARGRC

SEQ ID NO: 120421 - protein, 146 aa, Glycine max
  Coding DNA Sequence Number=SeqID_28736
MARAGDNGGVYHQLDESQRLFLDAWTTQMQRLLTKSSLFTLKPLSPREVCDDQIRMGEKREEEKENSEAPQRNMKKKNESYVKQAHKKRKEVVLEHGDDPEHLRTNVFQEGGNDENHETGQIQAKGPSGEERRPKWRRTKPPSGEG

SEQ ID NO: 120422 - protein, 130 aa, Glycine max
  Coding DNA Sequence Number=SeqID_28737
MIEHVLAIKIAIPWDTGLNQAHAFTKRKGHALQRPYRTRARARVMGEAEEVQEKMKADMEAMKEQMATMMEAMMSMKKIMEANAVIVAATSAVALIFFNMHLFPFAPLFLWDLATYSIFLHTLSLAPLQP

SEQ ID NO: 120423 - protein, 137 aa, Glycine max
  Coding DNA Sequence Number=SeqID_28738
LAATHTRKECAGLREENATTVRALEQETKRARKEEYGRNKFRGALWGSNSELKLRREERDQSRAHSMVLKEELVACSRSKRSLSQRLCETETNMLAIVAKYQEELSLATAHEHRVADEYAQVYAEKVARGRVIDSLH

SEQ ID NO: 120424 - protein, 62 aa, Glycine max
  Coding DNA Sequence Number=SeqID_28739
MKTQLQTRKWRTHEQPKAIRFMWLRKKAIMKHSSKLESGGHMNNPNNNIHVAPEKGENGGLP

SEQ ID NO: 120425 - protein, 79 aa, Glycine max
  Coding DNA Sequence Number=SeqID_28740
MGTNQNGQRFYQVKIKGLDVTSLRELGWLMGPLQRKAFRKMYGKILDLTTTEVFTEAIVSLAQYYDQPLRCFIFGDFQI

SEQ ID NO: 120426 - protein, 202 aa, Glycine max
  Coding DNA Sequence Number=SeqID_28741
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
SEQESARGSFQGETPGIFIVLSGFATSDLSVDFCDARQGGGAYGKTPATRPFYADTARRSRTTERSESVSEEAEERPIRKPPLPAPDNNFTHGNSYDHDYEFELGTRQCIKSKKGRSEEGQSCADPRKTNRPITSSHLATTSEKREGSPGMQAWHWPSFYNVVTGKTLALPNLIALQHIPLSPAGVIAKRPAPIALPNSCAA

SEQ ID NO: 120427 - protein, 270 aa, Glycine max
  Coding DNA Sequence Number=SeqID_28742
  Gene Ontology: Mol. function=aminoacyl-tRNA ligase activity; Cellular component=cytoplasm; Biological process=tRNA aminoacylation for protein translation
  Homolog annotation: Hit_ID=Q1C827; Match level="QueryCoverage=92%, HitCoverage=43%, E-value=1e-110, Identity=78%"; Hit description =Arginyl-tRNA synthetase
  Pfam annotation: Domain name=Arg_tRNA_synt_N; Domain location=24-106; Score=104.0; E_value=4.6e-28; Accession=PF03485.7; Description =Arginyl tRNA synthetase N terminal do
  Pfam annotation: Domain name=tRNA-synt_1d; Domain location=114-270; Score=0.8; E_value=7.6e-12; Accession=PF00750.10; Description=tRNA synthetases class I (R)
  Pfam module annotation: Pfam domain module=Arg_tRNA_synt_N::tRNA-synt_ 1d; Domain location=24-106::114-270
MTTSARLSWRAFSAYEGNAVNIQALLSDKVSQAMVAAGAPADCEPQVRQSAKVQFGDYQANGIMAVAKKLGQVPRQLAEQVVQHLDLAGIASKVDIAGPGFINIFLDRQWLAQQAAQALQLPRLGVSEVTPQTIVIDYSAPNVAKEMHVGHVRSTIIGDAAVRTQEFLGHHVIRANHVGDWGTQFGMLIAYLEKQQNEHHEDIALADLEAFYREAKRTYDEDEAFAERARGYVVKLQGGDEYCRAMWKKLVDITMSQNQQVYDRLNVTLT

SEQ ID NO: 120428 - protein, 26 aa, Glycine max
  Coding DNA Sequence Number=SeqID_28743
MQEAIGRNPETEEKVGDAKQNENEDK

SEQ ID NO: 120429 - protein, 260 aa, Glycine max
  Coding DNA Sequence Number=SeqID_28744
WIPFDVDALSQFLGDPLVLEEGQECEFSQRRNKADGFNEEAIAQLLCTLGQDFARTAAGRRVRIMHTSMTTLTQIWMRLLLSNVLPSDHNSDLPLLKCQLVYAILTRMSVHVAPLIADAIYLFEGMPPTRHPLDPDKSNRALGFPALITGLCQSFGGDAPQAADAPPPPHQADPAGSLGMERYLQHLVCQQAANHRGLSQQGQGFAPFACLTPEQFRAEVTWPEAQVGEAPAGSPDDAEEARMDEEMSDLLGFLGGSEAT

SEQ ID NO: 120430 - protein, 81 aa, Glycine max
  Coding DNA Sequence Number=SeqID_28745
MSGKNHLGGDQSGSRCFVRMLQPYEISIGLKEHSNPVTPKAYTPKGSSGPLPPDSSPTPKIILHADTAHELYNTHDLTLVF

SEQ ID NO: 120431 - protein, 228 aa, Glycine max
  Coding DNA Sequence Number=SeqID_28746
MERSMIDAANGGALGDMTHVEARNLIEKMASDSQQFSARNDAIVIKGVHEVATNSSSSAETKNLEGKLDALVNLVTQLAMNQKSTPVARLCGLCSSVDHHIDLCPSVQQSEAIEQPEAYAANIYNRPPQPQQQNQPQQNNYDLSSNSNNNNSLIFQNVAGPSRPYVPPPIQQQQQQQLQPHKQQTIEAPPQPSLEELVRQMTMQNKQFQQETKASIQSLTNQMGQLAT

SEQ ID NO: 120432 - protein, 65 aa, Glycine max
  Coding DNA Sequence Number=SeqID_28747
MESPTVATCPMAGGQREGSRVRLPRKENARSRHQRLFEENLGKTGKGCFPCSYVLLNCDKKIRPT

SEQ ID NO: 120433 - protein, 499 aa, Glycine max
  Coding DNA Sequence Number=SeqID_28748
  Gene Ontology: Mol. function=catalytic activity; Cellular component =integral to membrane; Biological process=carbohydrate metabolic process
  Homolog annotation: Hit_ID=Q1H2I6; Match level="QueryCoverage=66%, HitCoverage=83%, E-value=3e-99, Identity=52%"; Hit description=L -sorbosone dehydrogenase, putative
LKIEQFSDVSAWGAPRMLALDTQGRLLVSLTDTGRILRLNQQGEAEVIAQGLNAPHGLALLGDDLLVAEQTGVVKLPKQGDGWGAPQPLIRNLPSGGHSLKTVKVSPDGYIFINVGSSCNVCLEDNPLRATLLRYTTEGRPAGAVLTVGRHAQSAIWSTGLRNTQGFTWHPETGDMFATNNGADNRSAIKNGKTDDDLPPEHLNKIEAGKHYGWPYCWGDPGQPGQLFQDPNFTGEPDICKQAQAPALTMPAHSTPIGMTFLQHSRLPTQIQQDAIIALHGSWNRKQPSGYALLRVQFRNQLPVAAVPFISGWLQGQKAWGRPVDVIVGADGWLYVSDDLTGWIYRIRSAQPSLVIQVPEAFYQHPVRLLNPYLNYWHNRAEAAETVGLSSFQSKNYTTSSCEAEAKGQALVVIEPNMFYNPQTGIFYSEITAKVYNQPAADSALGKPLMTVKGQGQSRGWLTYNVEYFTHQSYQQAFDQVIQQLQQSPAFQQSVEQAP

SEQ ID NO: 120434 - protein, 83 aa, Glycine max
  Coding DNA Sequence Number=SeqID_28749
MNPKRIKVIPKWPTPPSIRKIWGFHDLTNLYKRFVPYSSILGEDAQDMAIEEKSLEFQEPWDLRSNPFQGEGNDAILPRKGIG

SEQ ID NO: 120435 - protein, 368 aa, Glycine max
  Coding DNA Sequence Number=SeqID_28750
  Gene Ontology: Biological process=Mo-molybdopterin cofactor biosynthetic process
  Homolog annotation: Hit_ID=A6TBV0; Match level="QueryCoverage=51%, HitCoverage=47%, E-value=3e-90, Identity=87%"; Hit description =Competence damage-inducible protein A
  Pfam annotation: Domain name=MoCF_biosynth; Domain location=185-351; Score=182.1; E_value=1.4e-51; Accession=PF00994.15; Description =Probable molybdopterin binding domain
  Pfam annotation: Domain name=YfaZ; Domain location=1-160; Score =230.1; E_value=4.9e-66; Accession=PF07437.2; Description=YfaZ precursor
  Pfam module annotation: Pfam domain module=MoCF_biosynth::YfaZ; Domain location=185-351::1-160
MALAGVMMVSSSAHAISVTGEAGEHYTNLGVGFGTESTGLAISGNWLHSDNDGDAAGLGLGLNIPLGPFLATVGGKGIYTNPKQGDEGYAAAVGGGLQWKIGDSFRLYGDYYYSPDSLSSGIDSYEEANVGASWTIMRPLSIQAAPASNPPARPSAAPNFFVASPRLCAIVIRLIRLEFIMLQVEMLSTGDEVLHGQIVDTNAAWLADYFFNQGLPLTRRNTVGDDLDALVAILRERSEQADVLIVNGGLGPTSDDLSALAAATAKGEGLVLNAEWLETMTRFFAERGRPMAESNRKQAEIPASAEMINNPVGTACGFAVQLNRCLMFFTPGVPSEFKVMVEQEIVPRLRARFTLPSPPVCLRLTTFG

SEQ ID NO: 120436 - protein, 121 aa, Glycine max
  Coding DNA Sequence Number=SeqID_28751
  Homolog annotation: Hit_ID=B0HC01; Match level="QueryCoverage=27%, HitCoverage=70%, E-value=3e-11, Identity=100%"; Hit description =Putative uncharacterized protein
VSGKRQARNRRAHEGASRGKRLGGGAYGKTPATRPFYGSWPFAGLLLTCSFLRYPLILWITVLPPLSELIPLAAAERPSAARNSYDHDYEFELGTLGRRTRESRVALPPKGRLRHTAIELF

SEQ ID NO: 120437 - protein, 136 aa, Glycine max
  Coding DNA Sequence Number=SeqID_28752
  Homolog annotation: Hit_ID=A5BEV8; Match level="QueryCoverage=50%, HitCoverage=8%, E-value=1e-11, Identity=46%"; Hit description =Putative uncharacterized protein
MNCLKNLPGVRMSTWTSFGGTERFEQLKLSLLVDGFSKVSVDKWMDITDMGYVIASRYNVILVSLSQQQSMTFFPLRSQPPPDSFGHRIICVGHVFGNHFVQVYLKDHPLDVPFLEELCVQTNWLCEAEVKASGRD

SEQ ID NO: 120438 - protein, 103 aa, Glycine max
  Coding DNA Sequence Number=SeqID_28753
HASDPLPHGHAPQPRVVPQAPQTDIPHVPELGASSTSAKEPRHAMEVCDDIVERLEHHLSLGVVTPGSSTHEVIEECLRLARRVTQDHLVYVRSRRRRRTDQA

SEQ ID NO: 120439 - protein, 110 aa, Glycine max
  Coding DNA Sequence Number=SeqID_28754
  Pfam annotation: Domain name=Transposase_23; Domain location=26-96; Score=-4.8; E_value=0.004; Accession=PF03017.5; Description =TNP1ENSPM transposase
MQSQGLALPPELKGSCVDPSVTDLDTGDSDKCGLYIKENPSRLVTLGRVYEGSTAVHNIPLLHGQVKVGVEEVEDVDAPVPVPTDEINLVGQTLNTFLAWSTHLVKRLSE

SEQ ID NO: 120440 - protein, 52 aa, Glycine max
  Coding DNA Sequence Number=SeqID_28755
MAGIFFKEKNSLEVMSDLKEMNPNRVGVSSTVLVDYREPAGSLKILLEYTFV

SEQ ID NO: 120441 - protein, 59 aa, Glycine max
  Coding DNA Sequence Number=SeqID_28756
MVGYTPSSFADLVFAGEMIKDENEGETHAVAAIPIWPSFPPTQQCHYSANNNPSPYTPP

SEQ ID NO: 120442 - protein, 68 aa, Glycine max
  Coding DNA Sequence Number=SeqID_28757
MCTYAIFDSQSALSMHEMAPRKLASKRSRKDKAAEGTSSAPEYDSHRFRSAVHQQQFEAIKGWSFLRE

SEQ ID NO: 120443 - protein, 113 aa, Glycine max
  Coding DNA Sequence Number=SeqID_28758
MTEREMITIMVDTLPTFYYEKLIGYMPTNFADLVFAGERIESGLRKGKFEYASNAGPNSNRRALVVGTRKKEGDTHAVTTAPTWMKTPQNAQNSYQHNHPNFSIRAKVPSQLK

SEQ ID NO: 120444 - protein, 90 aa, Glycine max
  Coding DNA Sequence Number=SeqID_28759
MARTNKTGQMTSEAAKEIAEKISTLVVSMQYFGSTPQTSRSSSFMSPEDLQQLTQQIRDQLEELIIEKVTRQLMTSFNQMQSQFKSQMQS

SEQ ID NO: 120445 - protein, 322 aa, Glycine max
  Coding DNA Sequence Number=SeqID_28760
  Gene Ontology: Mol. function=hydrolase activity, acting on ester bonds; Cellular component=outer membrane; Biological process=lipid metabolic process
  Homolog annotation: Hit_ID=A8G7T5; Match level="QueryCoverage=100%, HitCoverage=48%, E-value=8e-82, Identity=47%"; Hit description=Outer membrane autotransporter barrel domain precursor
  Pfam annotation: Domain name=Autotransporter; Domain location=47-308; Score=108.0; E_value=2.8e-29; Accession=PF03797.10; Description =Autotransporter beta-domain
MIADYIQSILDAPAQVAALARAPLMLSRDMQNTLDGHLQQQRQQPASAGQVSVFGGYAGQHIDYRGDSLLNGDANTGSLTLGLGYHFTDNWQAGLLLSSTAQHQHPSAHYDYKLRGNLLALYSQLTLLEQGWINADVHYADLDFDSIERRINIGPATRIEQGSSSGKMLGLRVQTGWDLPIGEHLSTGPVASYALDYVRPGGYSENGDSSTAMRFSDQTLHSQIGALGWRIDSKQWPVNPWAQLSYNHQFGDTQNAVRAGLKSTQTGFVRSVSAGDKDWLDISLGASVPLGETVNAFAGVSAVGGNSAYHQLSWNIGLNATF

SEQ ID NO: 120446 - protein, 78 aa, Glycine max
  Coding DNA Sequence Number=SeqID_28761
MPGQVKVGVEEVKDPDAPVPVPTDEAAVSPAKPPQKSYPKIDDPLYLMTLTILELFLRPYQVTWDATMFGVFNPDFPL

SEQ ID NO: 120447 - protein, 110 aa, Glycine max
  Coding DNA Sequence Number=SeqID_28762
MLPTRHPLDPDKSNRALGFPALITGLYQSFEVPVILSKVIRLPITGAFIEKYCTPRQAQGGDPAEVAWPGDWPKAQAGEAPAEAPGDADEARMDEEMTDLLNFLGGSGAT

SEQ ID NO: 120448 - protein, 172 aa, Glycine max
  Coding DNA Sequence Number=SeqID_28763
  Homolog annotation: Hit_ID=A5BSR3; Match level="QueryCoverage=70%, HitCoverage=39%, E-value=2e-12, Identity=36%"; Hit description =Putative uncharacterized protein
QHCPPTFCLRGGYEYLEQNLLVEKTKKKLEEAAQSGSVDGVIDPLSLVRCHMKWKMARTKKTGEMTTKAAKEIVEKIDSFKEQASQGSFVPHGRQDVLTAAIGCPEHPGRVRAAGAGVTIKQYFGSAPRTSLSSSSLPPKELQQLTQQIRDQLEESITEKVTRQLMASFSQM

SEQ ID NO: 120449 - protein, 63 aa, Glycine max
  Coding DNA Sequence Number=SeqID_28764
MDTRLRVIGDPMNGVQRGEGHNSLFEDSPSECGGGAATVRYRLISKGHSRNKIQAQGRVTRYH

SEQ ID NO: 120450 - protein, 167 aa, Glycine max
  Coding DNA Sequence Number=SeqID_28765
NPSDLQPFDPEIDKTFHRLVRHHFIPFDHSEHSITGESVHSVIGDFEHPDLEHYNFEHSDSEHSDFAHSENMAQPPPHQVKNWFQSNPEFLKPADPETSLFLNQKSQLAAFLASSKSKESLAQNLKEVLQLLQQEVEEEPSKKEAESSETNDDQEDDPFYQNEDDCF

SEQ ID NO: 120451 - protein, 212 aa, Glycine max
  Coding DNA Sequence Number=SeqID_28766
  Homolog annotation: Hit_ID=UPI00006A2D9E; Match level="QueryCoverage =83%, HitCoverage=85%, E-value=1e-09, Identity=19%"; Hit description =UPI00006A2D9E related cluster
AKHLAFIRLHTFAFRGLHVLTFRGLHALAFEGLHAFGFIGLHAFAFRGLHILPFRELHALAYRGLHALSFIGLHALAIRGLHVLSTRGLHDYTHSPLEGYMPSPSGSFTPSPYEGYTPSPFLQRATRPLLSFRRLPTLTFRGLHILAFRGLDALAFRGLHVLTLRGLHVLAFRGLHVVAFRRLHALAFKGLHVLAFRRQQALALRGLHVLAF

SEQ ID NO: 120452 - protein, 137 aa, Glycine max
  Coding DNA Sequence Number=SeqID_28767
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=5e-15, Identity=31%"; Hit description= UPI00006A17C9 related cluster
  Subcellular localization annotation: CTP_CleavageSite=30; ConfidenceScore=5.51e-01
MCSPLKVRTCSPLKARTCSPFKARTCSPLKAKAYSPLEARTCSLQKVRTSSPLKTRTCSPLKARACSPLRPGHARTCSPLKARTCSPLKARTCSPLKARMSSPLKVRTCSPWKVRMCCLLKARACSPQKARQGRVAL

SEQ ID NO: 120453 - protein, 371 aa, Glycine max
  Coding DNA Sequence Number=SeqID_28768
  Gene Ontology: Mol. function=motor activity; Cellular component=cell projection
  Homolog annotation: Hit_ID=P15305; Match level="QueryCoverage=99%, HitCoverage=95%, E-value=1e-17, Identity=18%"; Hit description =Dynein heavy chain
GLHALAFRGLHVLAFRGLHVLAFRGLHALAFRGLYILSFRGLHALALRGVHVLTFRGLDFLAFRGLHLLAFRGLHILAFRGLHVLTFRGLHVLAFRGLQALAFRGLHVHIFRGLHALAFRGLHVFVFRGLHDLAFRGLHVLAFKGLHILVFRGLHALDFRGLHILAFIGLHTLTFRGLHDLTFKGLHAIAFKGICVLAFIGLHAHALMQSYPARALDRKLQVDWAKDAREGPRVLMSLRAYKLQWSLHHAFRRLHAFAFRGLHVLAFRGLHNLAFRELHILAFRGLHALGFRGLHALAYTGLYYLTFTGLDILAFRGWHVLGFRGLHVLAFRGLHILTFRGLHFLTFEGLHALAFRGLHVLIFRCLHALAF

SEQ ID NO: 120454 - protein, 484 aa, Glycine max
  Coding DNA Sequence Number=SeqID_28769
  Gene Ontology: Mol. function=motor activity; Cellular component=cell projection
  Homolog annotation: Hit_ID=P15305; Match level="QueryCoverage=94%, HitCoverage=87%, E-value=2e-17, Identity=18%"; Hit description =Dynein heavy chain
LHILAFRRLHALAVRGMHVLPFRGLHALANRGLHILAFRGLHALAFRRLHILSFKGLHPLNFRGLHVLTFCVQHAFAFGGLHILTFRGLHALIFRGLHALAFIGLHALAIKGLHALACRGLLTLAFIRLHALTIRGLHILAIRGLHVLAIRGLYTLTFRGLHALTSKGQHVLPFRGLHALTYRGLHVHSTRGLRGLATRGLHVLGTSGLPVLGTRGLHSATRPRHAFREVHTLTFRELHVLAFTGVHALAFRGLHVIAFRRLDVLTLRGQHDLTLRGLHVLTFRGLDILAFRGLHVLAFRGLHLLTFRGLHLLTFRGLHALDFRGQHVLAFIGLDTLAFVGLHPLDFRGLHVLTFRGLNILASRGLQVIAFRGLHVLAFRGLHFVAFRGQHALAFRRLHVLDFRGLHALTFRGLHFLAFRGLQTINFRGLHIFAFRGVDALPFRGLHVLAFSGLHALAFRWLEALALPSEGYTPTPSDGYMHSP

SEQ ID NO: 120455 - protein, 382 aa, Glycine max
  Coding DNA Sequence Number=SeqID_28770
  Gene Ontology: Mol. function=nucleotide binding; Cellular component =intrinsic to membrane; Biological process=defense response
  Homolog annotation: Hit_ID=Q2YE88; Match level="QueryCoverage=99%, HitCoverage=31%, E-value=0.0, Identity=86%"; Hit description=NBS-LRR type disease resistance protein Rps1-k-1
  Pfam annotation: Domain name=LRR_1; Domain location=136-158; Score =2.4; E_value=1.1e+02; Accession=PF00560.24; Description=Leucine Rich Repeat
  Pfam annotation: Domain name=LRR_1; Domain location=160-181; Score =17.3; E_value=0.059; Accession=PF00560.24; Description=Leucine Rich Repeat
  Pfam annotation: Domain name=LRR_1; Domain location=183-205; Score =12.1; E_value=1.7; Accession=PF00560.24; Description=Leucine Rich Repeat
  Pfam annotation: Domain name=LRR_1; Domain location=207-228; Score =11.8; E_value=2; Accession=PF00560.24; Description=Leucine Rich Repeat
  Pfam annotation: Domain name=LRR_1; Domain location=342-369; Score =2.5; E_value=1.1e+02; Accession=PF00560.24; Description=Leucine Rich Repeat
  Pfam module annotation: Pfam domain module=LRR_1::LRR_1::LRR_1::LRR _1::LRR_1; Domain location=136-158::160-181::183-205::207-228::342-369
MAEDLLKKPRNGRTLEEVGHEYFDDLVSRSFFQRSSTNRSSWPFGKCFVMHDLMHDLATSLGGDFYFRSEELGKETKINTKTRHLSFTKFNSSVLDNSDDVGRTKFLRTFLSIINFEAAPFKNEEAQCIIVSKLMYLRVLSFRDFRSLDSLPDSIGKLIHLRYLDLSHSSVETLPKSLCNLYNLQTLKLFDCIKLTKLPSDMCNLVNLRHLDISWTPIKEMPRRMSKLNHLQHLDFFVVGKHQENGIKELGGLPNLRGQLEIRNLENVSQSDEALEARIMDKKHISSLRLKWSGCNNNSNNFQLEIDVLCKLQPQYNIESLDIKGYKGTRFPDWMGNSSYCNMISLKLRDCDNCSMLPSPGPLPSLKDLLISRLNRLKTIDE

SEQ ID NO: 120456 - protein, 74 aa, Glycine max
  Coding DNA Sequence Number=SeqID_28771
MAIWWEYLSWVKEDKVFHCRPLDNFIQHYSSATSKVSNTRRTMWWIAATDLSNFYNGFGIHRMKMDESVRNEKR

SEQ ID NO: 120457 - protein, 222 aa, Glycine max
  Coding DNA Sequence Number=SeqID_28772
  Homolog annotation: Hit_ID=UPI00016621D1; Match level="QueryCoverage =97%, HitCoverage=41%, E-value=1e-18, Identity=32%"; Hit description =UPI00016621D1 related cluster
LHVLAFRGLHVLTFRGLHALAFRGLHALIFRGLHVLAFRGSCTFIFRGLHVLAFRGSCTFTFRGLHILASRGLPVLTFRGLHILTFRGLHALTFRGLHALTFRGLHALAFVGLHALTFRGLHVLASRGLHVLAFRGPHTLFFRGLHVLTFRGLHVLTFRGLHTLAFRGLHALAFRGLHAFAFKRRHVLNFRGLHALAFRGLCVLTFSGLHIHTLREFKVFCP

SEQ ID NO: 120458 - protein, 85 aa, Glycine max
  Coding DNA Sequence Number=SeqID_28773
GSSRCGFSMENNDGLWWLMVAVGDGESSWNFRNGFGRKKEEEMTFFLSYTRAKAELPPEASLRGFLQKLLRGFFEKLSQEDSLRS

SEQ ID NO: 120459 - protein, 167 aa, Glycine max
  Coding DNA Sequence Number=SeqID_28774
LLSIFILLFPRKDDDVDLNASPQALDRLLGCFLAFKVKVQPRFRNVVVLKYSDESNLINVVLDMLPDSEPCCKIESSILESTDPTELEYQSVSVTADDDRSMLDSTEPTELESQSVSITADHDPLLRIPLTPTKRVSSDELDDEPKNFEISLAQVSSNNLAKHCQAE

SEQ ID NO: 120460 - protein, 197 aa, Glycine max
  Coding DNA Sequence Number=SeqID_28775
LHALAIRELHVLVNGGLHALTLRGLHVLAIRGLHALTSRGLHILALRGLHALTFRGLRVLIFRRPTVRAQPEREAITQLLCILGQDFTRAAAKRRGIAPTRHPVDPEKSNRALGIPTLVTGLYQSYRVPVPPRQGYVIIGIAPARHPVDPKKSNRVLELSSSNYGKGIRPPTNRAFIKKYCVPRQAQGETPQQHWDG

SEQ ID NO: 120461 - protein, 224 aa, Glycine max
  Coding DNA Sequence Number=SeqID_28776
  Subcellular localization annotation: CTP_CleavageSite=68; ConfidenceScore=5.26e-01
YKPGWRNHPNLRWASPPQQQQPVPPFQNVVGPSKPYVPPPIQQQQQQQSQQRQQATEAPPQPSLEELMGQMATQLNQAQSQNSDKFPSQTVQNPKNVSAITLRSGNQIQVPPPVATPTPEPVKLHSTPEKKDEIVAQKRRLPNNNFHAGGPSSSNSDLPQPPIPLPFPPRAIPNKKNGRSRKGDIGDLQESRGEHTSVRCHQVDSKICQVSKGVVHPQKDAQRQ

SEQ ID NO: 120462 - protein, 236 aa, Glycine max
  Coding DNA Sequence Number=SeqID_28777
  Homolog annotation: Hit_ID=A5BSR3; Match level="QueryCoverage=44%, HitCoverage=31%, E-value=4e-07, Identity=37%"; Hit description =Putative uncharacterized protein
QDVRKKAQAIQKQNTAPHVLSRGGYDYLDQKFLAEKTKKKLEEVAQSGSVDGVIDPPSPVRGHVKWKMARTKKIGEMTTEAAKEIAEKIGSFVPHGRQDVLAAVIGRPEHPGRVRAAGAGVTIKQYFGSTTRTSRSSSSLPPEELQQLTHQIRDQLEESITERVTRQVMASFSQIQYQLQSQMQSQGLALPPDPLVGPSGPRVSTKGSCVDPSGNDPETDDSDRCGLYIEADHARL

SEQ ID NO: 120463 - protein, 142 aa, Glycine max
  Coding DNA Sequence Number=SeqID_28778
MASLNQFAIYHTKEHVLVERLLSKIMNHILQAISHFYIKRFRLGPILHVYQFTMPYPCCIILLNPITQQMLSYVIKYLLSPFQTIYARTKKISILIRLTSFKSKLQELFHAFLISRAHATFIHPTSIHLNNNSMILKKLFDA

SEQ ID NO: 120464 - protein, 226 aa, Glycine max
  Coding DNA Sequence Number=SeqID_28779
  Homolog annotation: Hit_ID=UPI0000ECBAF8; Match level="QueryCoverage =18%, HitCoverage=48%, E-value=3e-16, Identity=100%"; Hit description= UPI0000ECBAF8 related cluster
VGTGERTRELPGGHACLWKNASNAAFLRFLAFCWPFAHMFFPALSPDSVDNRITAFEKRKSAQYANRLSPRVGRFINAAGTTGFPTGKRAVSATQLIYDHDYEFELGTLIAQFMQYVEQLLNIGEVQTGVHAPASRAGLHRLKGWLRTAPVECTSGQRPSTFAAYAPVQSRPAGMQAWHWPSFYNVVTGKTLALPNLIALQHIPLSPAGVIAKRPAPIALPNSCAA

SEQ ID NO: 120465 - protein, 114 aa, Glycine max
  Coding DNA Sequence Number=SeqID_28780
MTLLLSNIMPSDRNVDLPLRKYPLGSCPQDTQWTRRSPTGLWGFQLWLQASISPTGCPFPPARSHHRDIGKDRAHKTPSGLGGAQQGPRVSSSGYGPLCQSYKVPIPPSKVTPS

SEQ ID NO: 120466 - protein, 263 aa, Glycine max
  Coding DNA Sequence Number=SeqID_28781
  Homolog annotation: Hit_ID=Q6WAY6; Match level="QueryCoverage=35%, HitCoverage=16%, E-value=1e-11, Identity=39%"; Hit description =Putative uncharacterized protein
LAAIDAFLAYHHSKESPVVAILADLFDTFDRRKSRLGPTFGWDRGQRDQLVSSLEGRQGKVLFSCGDYPNVPLIGTRGCINYNPALAIRQLGYPMRGAPTEESLSPFLVRDLGAQSLKVIQRIHKAWRSPLRKDKELRGIRNGVIGGYHGWLRIHTRGLDWLSKLKVIDEENFEAPEEDEEVRALKLELGKARLAKEKFKSAATHIRKECTELQEENAATARALEQETKRARKEEYGREKFRGALWGSNSELKLRREERDRSR

SEQ ID NO: 120467 - protein, 45 aa, Glycine max
  Coding DNA Sequence Number=SeqID_28782
MLVSARQRARLPPVDERSGRKKVSETMLVSARQRARLPPVDERCG

SEQ ID NO: 120468 - protein, 122 aa, Glycine max
  Coding DNA Sequence Number=SeqID_28783
SQTHGQAGRAQHGDQAGRLHAEAREHRDHREDAHRPDHGAVEHGHDSGIDLAGTRGRAAHPAAQQGRHPPADDEDQQGDKQIEAQVHQPGSPGAKFFQGFFHGYSCAKVEAARRPRDGRLAA

SEQ ID NO: 120469 - protein, 275 aa, Glycine max
  Coding DNA Sequence Number=SeqID_28784
  Homolog annotation: Hit_ID=Q84VH5; Match level="QueryCoverage=75%, HitCoverage=29%, E-value=1e-71, Identity=72%"; Hit description =Envelope-like protein
  Subcellular localization annotation: CTP_CleavageSite=21; ConfidenceScore=5.40e-01
MATSPKETSSPVSPSVPSSPSSSKTPSNQEQPALNIQSIQMIPGPGPVPEKLHLKNASVPDADKDVPTSSTPNAEVLSSSSKEKSTEEEDQATEETPALRAPEPAPRAPEPAPGDLIDLEEVESDEEPIVKKLALCIAERLQNRKGKTPITRSRRIKTIAQKKSTPITPTTSRWSKVAIPFKKRKEISSSDSDDDVELDVPDIKRAKKSGKKVPGNVPDAPLDNISFHSIGNVERWKFVYQRRLAVERELGRDALDCKEIMDWTAENSHQVGRLL

SEQ ID NO: 120470 - protein, 203 aa, Glycine max
  Coding DNA Sequence Number=SeqID_28785
MDFQAGAVGGAAQQLDRLVTLAGGHQQAGHTLVDHALQVTFDLHAAQGGQGFFVLAGVDLGLGQLQRREVAVDAGRAGFKRLDRLGGVVELVLLQANERLLVLDIGRGQLAALILLVPLPAGNGTDGDDYATEDAGAILPQPAADAFTLFVLVEQIVDRHAYSRPAHREGPLGLIEGGEPRLSAKPGLRSLQRIPESVPRWLA

SEQ ID NO: 120471 - protein, 69 aa, Glycine max
  Coding DNA Sequence Number=SeqID_28786
MAIGDKSSSCNHKSPRSGTRQAMDIVRGRTIRGARQGKARADKRIPASRGEHKPLARWFILNLTSSGST

SEQ ID NO: 120472 - protein, 256 aa, Glycine max
  Coding DNA Sequence Number=SeqID_28787
MTAEPNRICEEGEEKKLNAGYVTGTIYTIQNYYLPSLRKSLRLLLVGEARASTAKRNLSVLSVTKESSRASISGPHTKCKISALSATVVFSQAQRTTNAKLKSLTRPRREGGAKRNVAVPIMGKELWRQQEEQLLQRYLEVAATTEEEPRSSEESSSFPIIGHSHIEPIEDPTMGEESRRVTLEDCSNSTVPQFFTSIAQPEVQAQTIIYAILSCWLAGVPVDAIRLSLFSFSLAGEAKKWLHSFKGNSLKSWDEV

SEQ ID NO: 120473 - protein, 67 aa, Glycine max
  Coding DNA Sequence Number=SeqID_28788
MSLHVLYLYAFLDFPQGFPDHLELPSGVGTKHGQQKPIKERMQVGMGSRPTDRCPFSALDKQRTSLQ

SEQ ID NO: 120474 - protein, 144 aa, Glycine max
  Coding DNA Sequence Number=SeqID_28789
  Homolog annotation: Hit_ID=UPI00016621D1; Match level="QueryCoverage =95%, HitCoverage=42%, E-value=8e-10, Identity=33%"; Hit description =UPI00016621D1 related cluster
MPSPSEDYTSSPSEDYTALHVFAIRGLHALTFRGLHVLAIRGLHALTFRGLHVLAIRGLDVLTYRGLHVLAIKELYALTFRGLYALTFRGLNVLAIRGLHVLTIRGLHVLTIRGLNVLAIRGLHVLAFRGLHVLTFRGLNVLAI

SEQ ID NO: 120475 - protein, 159 aa, Glycine max
  Coding DNA Sequence Number=SeqID_28790
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=72%, E-value=2e-33, Identity=91%"; Hit description=LacZ protein
MASNDDSLHMFFFPFLAHGHMIPLVDMAKLFAAKGVRATILTTPLNAPIISKAIEKTKTHQGKGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 120476 - protein, 43 aa, Glycine max
  Coding DNA Sequence Number=SeqID_28791
MAEPSKKRKGTSSRSQRHFGSQEMPIPSSIPSGSLFSSDEQRI

SEQ ID NO: 120477 - protein, 68 aa, Glycine max
  Coding DNA Sequence Number=SeqID_28792
  Homolog annotation: Hit_ID=A6FJQ2; Match level="QueryCoverage=55%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARTWVVALELPGGGPGIVPR

SEQ ID NO: 120478 - protein, 100 aa, Glycine max
  Coding DNA Sequence Number=SeqID_28793
MARAGDNGGVYHQLDESQRLFLDAWTTQMQRLLNRNKEEPYRRIVKSSLFILLNLYPLEKNLKMSFPRRFLMDCLPSRSIVHPVDLLLEASLPNKPTYYS

SEQ ID NO: 120479 - protein, 109 aa, Glycine max
  Coding DNA Sequence Number=SeqID_28794
MSVCSLGLYGSDHIYPPHGKGPRCGQYIQWQGRSVDIVCKRLAFVTLPYMEATVAFHGEPIIARPQDLPSHGVPVSVGTKRALMDLLQHASSFLSVHASKQHHVMVSLV

SEQ ID NO: 120480 - protein, 253 aa, Glycine max
  Coding DNA Sequence Number=SeqID_28795
  Homolog annotation: Hit_ID=Q6WAY6; Match level="QueryCoverage=71%, HitCoverage=29%, E-value=1e-16, Identity=33%"; Hit description =Putative uncharacterized protein
MGQLQRQTFCKAYGKIWNLAMVEVSTEAIASLAQYYDQPLRCFTFGDFQLSPMVEEFEEILAIDAFLAYHNHKEIPVVAMLADLYDTFDRRIEKSNTRIVCCTPTLYVWLVSHLFRQEVRHACPLESHHSCTEKGGANWDQLLASKEEASVNWFLRWKEGRTGVLISCRGFPNVPLMGTRGCISYNPVLAIRQLGYPMRGVPLEDELTPVISRGFNKTNVETLQKVRKAWEVLQKTRNSGAITMGPSVAIVSG

SEQ ID NO: 120481 - protein, 134 aa, Glycine max
  Coding DNA Sequence Number=SeqID_28796
  Homolog annotation: Hit_ID=UPI0000ECBAF8; Match level="QueryCoverage =30%, HitCoverage=48%, E-value=1e-16, Identity=100%"; Hit description= UPI0000ECBAF8 related cluster
MTMITNSSSVPPPRNRRVNEAVSDEASAQPQDVAPRGRGRDRGRGRGRLGRGGGMPEVEVPRATRNNRQGQQQPVSEIGQEGMQAWHWPSFYNVVTGKTLALPNLIALQHIPLSPAGVIAKRPAPIALPNSCAA

SEQ ID NO: 120482 - protein, 72 aa, Glycine max
  Coding DNA Sequence Number=SeqID_28797
MHMTQMHFMNMGAREIVPFLDTTFGQPGARRMHLRRRHGPSVGLTKCERHNTGMYIVRQYPQTTISKGVHDI

SEQ ID NO: 120483 - protein, 45 aa, Glycine max
  Coding DNA Sequence Number=SeqID_28798
MATARPNVSKYVFISSMHHHPISVIRKINSSISPLFPEDAFALYE

SEQ ID NO: 120484 - protein, 102 aa, Glycine max
  Coding DNA Sequence Number=SeqID_28799
  Gene Ontology: Mol. function=chitin binding; Cellular component =extracellular region; Biological process=chitin metabolic process
  Homolog annotation: Hit_ID=UPI000069F178; Match level="QueryCoverage =81%, HitCoverage=22%, E-value=6e-08, Identity=36%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=85; ConfidenceScore=5.06e-01
MARTCSPLKVRTCSPLKVRACSPTKVKAYDPLTARTCSPLKLKVHDPLKARTCSPLKVKVRACSPLMVRTCSPLKARTCSPLTVRVTSTQGEGVQPSQGEDM

SEQ ID NO: 120485 - protein, 62 aa, Glycine max
  Coding DNA Sequence Number=SeqID_28800
MAVKQLFLRGFIRDRWRTRLPNRLRLWASFWSAAVSSEAALAESDDCRGFQGLPAIGDQSGQ

SEQ ID NO: 120486 - protein, 83 aa, Glycine max
  Coding DNA Sequence Number=SeqID_28801
QSGPLGPSRFFLQKAVASGGSNLARLGELGGKLLPYFAINRGRSEEGRGSAFLALLILSKLLRKIVSVKKIQAECFVFFSLQL

SEQ ID NO: 120487 - protein, 97 aa, Glycine max
  Coding DNA Sequence Number=SeqID_28802
MEIYVRDRLGKTVIIKKGDIVEAKLHDESRLIQRCFDDNKDDDKGDDKNLKGQSKNEFKMFKKESRTLQDSRGKLKNTSRFKRKVDFKNQNSRIKLP

SEQ ID NO: 120488 - protein, 39 aa, Glycine max
  Coding DNA Sequence Number=SeqID_28803
  Homolog annotation: Hit_ID=O64438; Match level="QueryCoverage=92%, HitCoverage=15%, E-value=3e-13, Identity=94%"; Hit description=ARG10
CFYPTAVGGLRCYENPKNKITAVPAEEEEIWGAFFKETR

SEQ ID NO: 120489 - protein, 166 aa, Glycine max
  Coding DNA Sequence Number=SeqID_28804
  Homolog annotation: Hit_ID=A7QL08; Match level="QueryCoverage=22%, HitCoverage=50%, E-value=3e-10, Identity=91%"; Hit description =Chromosome undetermined scaffold_116, whole genome shotgun sequence
MVGAGLKKDLRVSRVVPGGSLNAFLFLLIGVISQRLAMESIDSLPIGWTVGAMIYFTGEVSAQLVELRSCNWVVAITGWMSNCPGGNDSILRAVKNVEEGFLIWDPGEEDQAGPCEQLDALSPFNPLSEMWQKEKESMDRPHRLHPVGTTRSPQGRLRHPGVADRP

SEQ ID NO: 120490 - protein, 132 aa, Glycine max
  Coding DNA Sequence Number=SeqID_28805
MNTRIVSKLNLTIIPYPKPNKLQWLNEQGEMIVNQQVKVAKDQVQIKLKWDEGKNRKRKEEQPLMVKKECKEVSVSSKRLTKMESHFAIKKNFKETSLLKQPSHLLLCKRTLVSTAKPLELEAIPQVKDHFA

SEQ ID NO: 120491 - protein, 85 aa, Glycine max
  Coding DNA Sequence Number=SeqID_28806
MKDWLTCIPWEVPYKLLQTNLHSKKHENVSQRALRGRARAKLTGALSKGGKMHEVATNVYLWKTLEKPKETGQNKNSKFGSCIYA

SEQ ID NO: 120492 - protein, 99 aa, Glycine max
  Coding DNA Sequence Number=SeqID_28807
  Gene Ontology: Mol. function=aspartic-type endopeptidase activity; Biological process=DNA integration
  Homolog annotation: Hit_ID=A5AV98; Match level="QueryCoverage=96%, HitCoverage=13%, E-value=1e-20, Identity=49%"; Hit description =Putative uncharacterized protein
MLEEKLVTIIDASSNEEKVHYKTWERSNRLSLMLMRMTVANSIKTTLPKIEKCSQTTDKSVAGTLMSTLTTMKFDGSRTMYEHVIEMTNIAARLKTLGI

SEQ ID NO: 120493 - protein, 25 aa, Glycine max
  Coding DNA Sequence Number=SeqID_28808
DATFYTVSKSVKVFRRSSSVLRSST

SEQ ID NO: 120494 - protein, 95 aa, Glycine max
  Coding DNA Sequence Number=SeqID_28809
SAKVDVSLSELNALSECHPLSEASTRLADRRNLEGNLSRRHALSASSAHSVSRLSPFRLSASLALSENSLTRAKRDVEELPCYGRLNPQLGILAE

SEQ ID NO: 120495 - protein, 277 aa, Glycine max
  Coding DNA Sequence Number=SeqID_28810
MVCTNQADITGRLFASSLAFECCIMHYLIVCILLPKSSNLAQVSEEDLIIMWVFLTDRQIDWALLVRYPMHKALRSNAPLPYPHLITLFLQHFNVPLDSEPFVKVKRSFSIGANVVSFFGYRKERDGSWVKKDAPVQAAEDHSPSPYSQRDDSSSLMHSILDKLDGLQTFIGEHFDSLDSRIDAMDARFVGMDTRITKLEEDDYYHQKGGDCGSNAFQDYFDDAKESRVKQVSRIKIKIQDSRIIKIKIQDSRIIKIKIQVKNQESRIKRKLNQDKY

SEQ ID NO: 120496 - protein, 48 aa, Glycine max
  Coding DNA Sequence Number=SeqID_28811
MHEMAPKKLSTKRSRRDTVAEGSSAAPEFDSHRFRSAEHQQCFEAIKG

SEQ ID NO: 120497 - protein, 166 aa, Glycine max
  Coding DNA Sequence Number=SeqID_28812
  Homolog annotation: Hit_ID=A5B4G8; Match level="QueryCoverage=63%, HitCoverage=13%, E-value=1e-10, Identity=35%"; Hit description =Putative uncharacterized protein
MTRGNPSDLQSFDPEIDRTFHRLVRHHFIPFDHSEHSITGESVHFVIGDFEHPDFEHYNFEHSDFEHSENMAQPPPRERTLREMAAPDFTYESLCIQYPDEDVPYVFKTGLIHLLPKFHGLAGEDPHKHLKEFHIVCSTMKLSDVQEDHIFLKAFPHSLERVAKDW

SEQ ID NO: 120498 - protein, 55 aa, Glycine max
  Coding DNA Sequence Number=SeqID_28813
MNVLPSAVHMSSLVKREVSEEKKKEWRRESSSQKGQDGRKQCPIFAFLLSPMRGK

SEQ ID NO: 120499 - protein, 164 aa, Glycine max
  Coding DNA Sequence Number=SeqID_28814
MEEPPWKSIHRDQGGQSTRPQQQGPSLYDRTTKLEETLAQFMQVSMSNQKSIEFAIKNLEVQVGQLAKKFADRSSSSFIANTEKNPKEECKAVMTRSRMPIHVDKSEAEKKMEEHKQQLAPKPALEPVSNFVELEEINEEAKDDKEEETPIKEKEEKKKKKKKS

SEQ ID NO: 120500 - protein, 86 aa, Glycine max
  Coding DNA Sequence Number=SeqID_28815
MFGSKSKSLGSTNAEALQKVRKAWEMVEKKDKELRGSSNGGYHRWLKAYTQVLDWLPNLRTTKGVAVEAPEEGKEVQALRAELQKA

SEQ ID NO: 120501 - protein, 69 aa, Glycine max
  Coding DNA Sequence Number=SeqID_28816
MAKFGRPASEIEGLVAANRLSPSITWVFHSFKQLHVDDTVDMLVELLEVNAVEAKDKMIQCHGSYVRLL

SEQ ID NO: 120502 - protein, 330 aa, Glycine max
  Coding DNA Sequence Number=SeqID_28817
  Homolog annotation: Hit_ID=Q84VI1; Match level="QueryCoverage=100%, HitCoverage=51%, E-value=1e-137, Identity=76%"; Hit description =Envelope-like protein
MATSPKETAASGSPAVPSSPHQEQPEFNIQPIQIIPGQASVPEKLVPRRQQGVKIAENPSLATSPREVDTEMDKKICSIVSSILKDASVPEADEDVQHRPPQMFLCLIKERSTEEDDQAAEETPAPRAPEPAPGDLIDLEEVESDEEPIANRLAPGIAERLQSRKGKTPIKRSGRIKTMAQKKSTPITPATSRRRKVAIPSKKRKEISSSDSDDDVELDVSTSKRAKKSGRKVPGNVPDAPLDNISFHSIGNVEKWKYVYQRRLAVERELGRDALDCKETMDLIKAAGLLKTVTKLGDCYEGLVREFIVNIPSDISNRKSDDYQRVFVRG

SEQ ID NO: 120503 - protein, 26 aa, Glycine max
  Coding DNA Sequence Number=SeqID_28818
MMGDESKFTHISPKKSGHVTYEDNNK

SEQ ID NO: 120504 - protein, 179 aa, Glycine max
  Coding DNA Sequence Number=SeqID_28819
  Subcellular localization annotation: CTP_CleavageSite=46; ConfidenceScore=5.11e-01
MPPTRHPLDPDKSNRALGFPSLITGLYQSFRVPVTPSNVIRSPITRAFIKKYCTPRQAQGGAPQAPDALLPPHQADPAGSFDTERYLRHLVRQQAANHRAHVQTHDYLYQLSLSLQSQGFAPFPCPTPDQFRAEVAWPGDWPEAQAGEAPIEAPDDADEARMDEEMTNLLDFLGGSGAT

SEQ ID NO: 120505 - protein, 99 aa, Glycine max
  Coding DNA Sequence Number=SeqID_28820
MLESFQQQNQMSVLELYVKKDVVGGSMFHSANSLTSCGNNLSNNEAQPPTNVSNLHGDEDDDDDDYLMSNSYVEESLDKDDSVDGISDTDDEVADMIQP

SEQ ID NO: 120506 - protein, 62 aa, Glycine max
  Coding DNA Sequence Number=SeqID_28821
MAFLINSHAGEGVEGFRTEGIEEKAQKEKKERERINETLGLIRILVVDLKRANKAALTLVNF

SEQ ID NO: 120507 - protein, 24 aa, Glycine max
  Coding DNA Sequence Number=SeqID_28822
MEEGYSTSKPPSFKGVNQWMDEQK

SEQ ID NO: 120508 - protein, 145 aa, Glycine max
  Coding DNA Sequence Number=SeqID_28823
  Gene Ontology: Cellular component=chloroplast
  Homolog annotation: Hit_ID=A7QL08; Match level="QueryCoverage=33%, HitCoverage=64%, E-value=1e-10, Identity=75%"; Hit description =Chromosome undetermined scaffold_116, whole genome shotgun sequence
MVGAGLKKDLRVSRVVPGGSLNAFLFLLIGVISQRLAMENRSRKGSIDSLPIGWTVGAMIYFTGEVSAQLVELRSCNWVVAITGWMSNCPGGNDSILYLNRSSMDRTWTVVGVGGSPRVSSFGILGKRIKLALANSLMHYLPSTL

SEQ ID NO: 120509 - protein, 40 aa, Glycine max
  Coding DNA Sequence Number=SeqID_28824
MGFSQLRVLAFHGKEAPSYTKEEESREIACLQRSGDVSST

SEQ ID NO: 120510 - protein, 117 aa, Glycine max
  Coding DNA Sequence Number=SeqID_28825
  Homolog annotation: Hit_ID=A7QKQ2; Match level="QueryCoverage=35%, HitCoverage=11%, E-value=1e-13, Identity=80%"; Hit description =Chromosome chr2 scaffold_113, whole genome shotgun sequence
RQGASAGVAGVRGWLNYAASEQIVLRVHHMRAIGAGLFAITPAGERGMCCKAIKLGNARVFPVTTLSIFQLFDESFQEVDEFDSFYKGNMQDLGYSSIYMKRSGQKRDGCGLFYKHN

SEQ ID NO: 120511 - protein, 203 aa, Glycine max
  Coding DNA Sequence Number=SeqID_28826
  Pfam annotation: Domain name=G-patch; Domain location=45-89; Score =29.9; E_value=9.1e-06; Accession=PF01585.14; Description=G-patch domain
MGEIDIPIQIGPHTWQCGFSSDGHKSRLQLPFGETSPLLPRLSNAALMVARVMLRHGYEPGMGLGKDSHGNADVVDIRGNPYKYGLGYEPGKPGRRNAPLRLREDRAWPGHVSQCFTSAGIMFEEEEVYTADSMCEGRFFEDPNNEGLIIDFDREVSQTINEEEEEDVLSPELERLIAQEERKIKPHQEEIELINLETREGKK

SEQ ID NO: 120512 - protein, 105 aa, Glycine max
  Coding DNA Sequence Number=SeqID_28827
MKGQIRVSFSTETASQVGRFRSNRRVPLVGEFQWRTTMLRAHSRDLLKDPNGQIVEKCLVKLQTKVREDPTVNKGWAAFLPRQLHVAFSRSFIKRLPPEASSWLL

SEQ ID NO: 120513 - protein, 100 aa, Glycine max
  Coding DNA Sequence Number=SeqID_28828
  Gene Ontology: Mol. function=structural constituent of ribosome; Cellular component=intracellular; Biological process=translation
  Homolog annotation: Hit_ID=Q32703; Match level="QueryCoverage=38%, HitCoverage=90%, E-value=3e-11, Identity=84%"; Hit description =Putative uncharacterized protein
MVRYSGVLGVEEPHQSIPNLVVKLYCGDDTVGEDTPGEQISSGDDGVGPVAQRIRARGYEPRCRGFESLLAHNRPKKGRIFPSGGRKIMIGLADPKLWNL

SEQ ID NO: 120514 - protein, 88 aa, Glycine max
  Coding DNA Sequence Number=SeqID_28829
MGVQIATRPTWALQNIPPEGEEVRRKRVQPLSTSLSFEFAWKIVSVKKSKLRRFRNVSVTFSVRNFAKVSTVLRRSSFVLHRSSIFNG

SEQ ID NO: 120515 - protein, 60 aa, Glycine max
  Coding DNA Sequence Number=SeqID_28830
MAILIANTSTTFHRDERLENTHAMHGKCNYEIEMPEETSFLNQPRIRNGFMIPTWLAHGT

SEQ ID NO: 120516 - protein, 212 aa, Glycine max
  Coding DNA Sequence Number=SeqID_28831
  Gene Ontology: Mol. function=glucose-6-phosphate dehydrogenase activity; Cellular component=cytosol; Biological process =carbohydrate metabolic process
  Homolog annotation: Hit_ID=P0AC54; Match level="QueryCoverage=67%, HitCoverage=29%, E-value=2e-76, Identity=95%"; Hit description =Glucose-6-phosphate 1-dehydrogenase
  Pfam annotation: Domain name=G6PD_C; Domain location=1-142; Score =69.5; E_value=1.2e-19; Accession=PF02781.7; Description=Glucose-6 -phosphate dehydrogenase, C-terminal domain
VVYFKNPELNLFKESWQELPQNKLTIRLQPDEGVDIQILNKVPGLDHKHNLQTTKLDLSYSETFNQTHLADAYERLLLETMRGIQALFVRRDEVEEAWKWVDSITEAWAADQDAPKPYQAGTWGPVASVAMITRDGRSWNEFDSVWIHPRSFFYYTAGSDFAPELRTASVSALLTTASDFVTPEPGQINERSFYESDIVTRNTTHYRALERD

SEQ ID NO: 120517 - protein, 83 aa, Glycine max
  Coding DNA Sequence Number=SeqID_28832
MSGLLRDSPQILASPHQLDLTPYASGPYNAQWNTPGLLHDKHTLRSSRILREMGVDDPWLGLWLPLNYQVDMGASQHRTPKLG

SEQ ID NO: 120518 - protein, 44 aa, Glycine max
  Coding DNA Sequence Number=SeqID_28833
MPIPPHHHCQDIGVSGIFMLKTPILNSHIFGTPQGAGTAILTLL

SEQ ID NO: 120519 - protein, 117 aa, Glycine max
  Coding DNA Sequence Number=SeqID_28834
MARAGDNGSVYHQLDESQRLFLDVWTTQMQRLLNRNKEEPYRRIAKSSSFTLKPLSPREVCDDQIRMREKREQEKENSEAPQRNMKKSDTPKDKSDTHKRESDTHERKFNYFAEASE

SEQ ID NO: 120520 - protein, 59 aa, Glycine max
  Coding DNA Sequence Number=SeqID_28835
IVSDSSESENSESTQGSSSNFMTPFEDCQSPTNQPVINTEGNDYNSDFLFQMLQYMFLN

SEQ ID NO: 120521 - protein, 127 aa, Glycine max
  Coding DNA Sequence Number=SeqID_28836
MTRGNPSDLQPFDPEIDRTFHRLVRHHFIPFDHPEHSITSESVHSVIDHFEHPDFEHYNFEHSDSEHSDFEHFENMAQPPPCDRTLREMATPDFTYKSLCIQYPDEDVPYVLKTGLIHLLPKFHGLA

SEQ ID NO: 120522 - protein, 170 aa, Glycine max
  Coding DNA Sequence Number=SeqID_28837
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPEAFFMVHRGEWMNEQESFEWHGVRNGTKIATFVGRLNDSVTPILRPKSPS

SEQ ID NO: 120523 - protein, 83 aa, Glycine max
  Coding DNA Sequence Number=SeqID_28838
MIHLIQRNLFHGLPNEDPYAHLATYIEICNTVKIAGVPDDAIRLSEKKAKFIAKCSSWAKRISTAKRSFSAVSAKENLVEHQH

SEQ ID NO: 120524 - protein, 102 aa, Glycine max
  Coding DNA Sequence Number=SeqID_28839
  Subcellular localization annotation: CTP_CleavageSite=91; ConfidenceScore=5.31e-01
MLVCTIRTRLFVAARVKSCPGMHSSYAIASSSGCARIVGRPPGSGGQKTLNSLKVRMWSPLKVRACSPLKARVCSPLEGEGVQPSEGEGVLSSEDEDVQSSE

SEQ ID NO: 120525 - protein, 109 aa, Glycine max
  Coding DNA Sequence Number=SeqID_28840
MSKVVFQWGLLSWEPNLDIWGETNLGVKVSISGRASILFHEARVTMMIRKQRAKLVMATARWALKHPVYGIVILRLGIYTNRPNVSKLCSFISLMNSSILISVIPEINS

SEQ ID NO: 120526 - protein, 44 aa, Glycine max
  Coding DNA Sequence Number=SeqID_28841
MENKMNNKELKMNGSGMEKEEREETPLQGEDESRKKLTTIGDHG

SEQ ID NO: 120527 - protein, 87 aa, Glycine max
  Coding DNA Sequence Number=SeqID_28842
MCKIRMLRIRMLKIIMLKIRMFKITNNRMHKFTSYGMLRMIKRIAFFGRWRPQPAYGRLPQCRKFYSTPNAYIIIAILITGAKVMAV

SEQ ID NO: 120528 - protein, 102 aa, Glycine max
  Coding DNA Sequence Number=SeqID_28843
MTIVDKCCGSDHGRGGLFLKNLELSYWVLKKKGIMWMNGRVPLNFKGRGNGRNYMCEGPAWFTKKMPSGAVKNNGDLFYSASLMNYEVKHGCVWSFGKTFWG

SEQ ID NO: 120529 - protein, 150 aa, Glycine max
  Coding DNA Sequence Number=SeqID_28844
  Pfam annotation: Domain name=Dehydrin; Domain location=2-82; Score =23.7; E_value=2.5e-06; Accession=PF00257.10; Description=Dehydrin
MSGIIHKIEETLHVGGHKKEEEHKGEHHGGEHKGEQHGEEHKEGFADKIKDKIHGEGEKKKKEKKKREHGHEDGHDSSSGKLVHNHEWDAEALLAAYPSSNFTITSSSCAVAAKKTLKDEGFMQKNTQKTEDIVVENPLESRVCVDLVWP

SEQ ID NO: 120530 - protein, 202 aa, Glycine max
  Coding DNA Sequence Number=SeqID_28845
  Homolog annotation: Hit_ID=A5BZW3; Match level="QueryCoverage=97%, HitCoverage=42%, E-value=5e-35, Identity=61%"; Hit description =Putative uncharacterized protein
MAMKLKYLSSIAEDVIKRCSQKLDTSVEKLVEDFEGGWNPEMGNYCRKLVEFCSGKGVNEMCHNIEGNINDSSFSRLTYDMMLAWERPSYYDEEPMKHATPNGVELAEDEYILHVDGTASTQRVVRHIGTTSWPGQPLRLSDRRLTLTNYSLYFEASGVIRYEDALKIDLSKNVEQSVKPAATGPWGAQLYDKAIIYDSTDL

SEQ ID NO: 120531 - protein, 340 aa, Glycine max
  Coding DNA Sequence Number=SeqID_28846
  Gene Ontology: Mol. function=polyribonucleotide nucleotidyltransferase activity; Cellular component=cytoplasm; Biological process=mRNA catabolic process
  Homolog annotation: Hit_ID=A7QRH7; Match level="QueryCoverage=100%, HitCoverage=40%, E-value=7e-60, Identity=42%"; Hit description =Chromosome chr8 scaffold_150, whole genome shotgun sequence
  Pfam annotation: Domain name=KH_1; Domain location=73-115; Score =10.3; E_value=0.056; Accession=PF00013.20; Description=KH domain
  Pfam annotation: Domain name=RNase_PH_C; Domain location=20-93; Score= 51.6; E_value=2.7e-12; Accession=PF03725.6; Description=3' exoribonuclease family, domain 2
  Pfam module annotation: Pfam domain module=KH_1::RNase_PH_C; Domain location=73-115::20-93
MASVCGGCLALQDAGVPIKCSIAGIAMGMVLDTKEFGGDGTPLILSDITGSEDASGDMDFKVAGNGDGITAFQMDIKVRPDRINLIIGSGGKKVKSIIEESGVDTIDTEDDGTWEDGWKEDGVPLLEKYPRLYCISKQQQHYIQQMGLVSSGVWEWQLKWRRLLMEGEMDVAAHFLEDIDGMAVQVQHQDSGSWEGDPGGEYSVGSAYRALNEYAIEEDDERAFSILWKLKIPSKVNEKGQLRLSHRALLPDTEASPKDGLVEEKTEQSKDKSSTPNVTASSKRSSEDDSVLPSKKFVRRLVSSSQDKPFTNKDKRKKSSNKAVGSVSGEDESSLVSGEA

SEQ ID NO: 120532 - protein, 213 aa, Glycine max
  Coding DNA Sequence Number=SeqID_28847
  Homolog annotation: Hit_ID=Q1SKZ9; Match level="QueryCoverage=16%, HitCoverage=7%, E-value=7e-07, Identity=58%"; Hit description=Zinc finger, CCHC-type
MRMSFQDKVWDQQVPFPRKERGLWRIIGGYNVIDIGHGFFMVKFDLAQDREKVILGEIDLSKPVVRKVWFKNHWFHVEYEGLYLLCKTCGLYHKDWPKLKKGDMLVVGKSKCGGDREDFYGDWLVVTKEEEGRYSHGRASVTVSEHHMESQWQENEGQGKMHMVEVTSNQDGRLKKEKPLDITQNEMMVEGVIGDATLLSRGSGDDDEGGGTR

SEQ ID NO: 120533 - protein, 282 aa, Glycine max
  Coding DNA Sequence Number=SeqID_28848
  Gene Ontology: Mol. function=hydrolase activity
  Homolog annotation: Hit_ID=Q2HVC5; Match level="QueryCoverage=97%, HitCoverage=96%, E-value=1e-119, Identity=76%"; Hit description =Cupin, RmlC-type
  Pfam annotation: Domain name=DUF1637; Domain location=48-281; Score =375.9; E_value=6.5e-110; Accession=PF07847.3; Description=Protein of unknown function (DUF1637)
MEATSLVERGRERVGHVNKVSYVRRVIAKKKKQLYRRLRRPELSVSKTLQQLFDSCREVFKGPGTVPSPQDVQRLRHILNNMKPEDVGLSRDLQFFKSGNKVKEKQRVTYTTVYKCNNFSLCIFFIPEGGVIPLHNHPDMTVFSKLLLGLMHIKSYDWVVHEASDDNLLQPQSQLRLAKLKADKVFTSSCDTSVLYPTTGGNIHEFTAITPCAVLDVIGPPYSKEDGRDCSYYRDHPYASFPNERIIGEAKEENDSYAWLEEIEMPENSEMDGIEYLGPTPF

SEQ ID NO: 120534 - protein, 136 aa, Glycine max
  Coding DNA Sequence Number=SeqID_28849
  Gene Ontology: Mol. function=polyribonucleotide nucleotidyltransferase activity; Biological process=mRNA catabolic process
  Homolog annotation: Hit_ID=O24288; Match level="QueryCoverage=68%, HitCoverage=10%, E-value=1e-20, Identity=62%"; Hit description =Polynucleotide phosphorylase
MVVWIETEASGNVQAIAGDELVKVLQIRNKIPRRKALSSLEEKVLKILTENGFVSNDSTLRSNSETIAEILEVEDEDEEVIVDGEVDEGDVHIKPTPRKPALLWCIYGILGSVLSVHGYFLWVFLGKSRKQTGLLK

SEQ ID NO: 120535 - protein, 591 aa, Glycine max
  Coding DNA Sequence Number=SeqID_28850
  Gene Ontology: Mol. function=lithium ion binding; Cellular component =integral to membrane; Biological process=calcium ion transport
  Homolog annotation: Hit_ID=A7QRH9; Match level="QueryCoverage=93%, HitCoverage=94%, E-value=1e-150, Identity=50%"; Hit description =Chromosome chr8 scaffold_150, whole genome shotgun sequence
  Pfam annotation: Domain name=Na_Ca_ex; Domain location=113-248; Score= 104.7; E_value=2.8e-28; Accession=PF01699.15; Description =Sodiumcalcium exchanger protein
  Pfam annotation: Domain name=Na_Ca_ex; Domain location=438-581; Score= 119.3; E_value=1.2e-32; Accession=PF01699.15; Description =Sodiumcalcium exchanger protein
  Pfam module annotation: Pfam domain module=Na_Ca_ex::Na_Ca_ex; Domain location=113-248::438-581
  Subcellular localization annotation: CTP_CleavageSite=8; ConfidenceScore=5.07e-01
MAAFILISKSKLQSTVLVLVLNLSFFFLFCLLLKAYYLHPPNSNSQSNGPLKTFNHERLFRDVSVEGCTDLHKYSDYESKCLYVKSHLDCSFGKFQILGQTILALWLVVLFYLLGDTASNYFCNSLEGLSNILRLSPTIAGVTLLSLGNGAPDFFASVVSFTGSSSNGAVGLNSILGGSFFVSCAVLGIISILVGPNQVQVDKASFIRDVLFFLFSLLILLIILYIGKITLLASICYVSIYFLYVCAVSATHLIYGGDKMINERQYQYSDDESSSSSLEASIPLLGYVDEEKQSLAEIVVVVEEKDQNQNQKQDSHSSSTFFGGNNSLFDCIYLGKILQVLELPLGLPRRLTIPVVSEEKWSKPYAVISVTLAPVLLAILFNTQSENVGSRSGIVTYIVAALIGIVLGNMACVTTERCNPPRKSLFPWLAGGFAMSVTWTYIIAEELVSLLVSIGSIIGVSPSILGLTVLAWGNSLGDLIANGAMAMNGGPDGVQMAISGCYAGPMFNTLMGLGLPLVLSAWSEHPEPYVTPKDTSLYETLLFLMGGVLWALVILPKKNMRLDKSLGAGLLSVYMCFLVIRIAMAVGIVKF

SEQ ID NO: 120536 - protein, 22 aa, Glycine max
  Coding DNA Sequence Number=SeqID_28851
MVAAQGVEVVAARIWKMAMKVA

SEQ ID NO: 120537 - protein, 184 aa, Glycine max
  Coding DNA Sequence Number=SeqID_28852
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q5BM97; Match level="QueryCoverage=92%, HitCoverage=42%, E-value=3e-82, Identity=84%"; Hit description =Secondary cell wall-related glycosyltransferase family 14
MNQPSNILLVSCNCSAWTILSRSFAEYCIVGWENLPRTLLLYYTNFVSSPEGYFQTVICNSEDYKNTTVNHDLHYITWDNPPKQHPRSLGLKDYRRMVLTSRPFARKFKRNDPVLDKIDRELLKRYHGKFSYGGWCSQGGKHKACSGLRTENYGVLKPGPSSRRLKNLLTKLLSDKFFRKQQCR

SEQ ID NO: 120538 - protein, 103 aa, Glycine max
  Coding DNA Sequence Number=SeqID_28853
  Pfam annotation: Domain name=BRF1; Domain location=21-95; Score= -10.9; E_value=0.0048; Accession=PF07741.4; Description=Brf1-like TBP- binding domain
MLSGANVEYDLPIPIKDESETLSDIDDAELDVYIHNEEEKNMKKTLWERAYREYLEELLAAEKAAAAAAGIGTDRYGPLAKRLTKQGVMAVMAVFLPTAIGNL

SEQ ID NO: 120539 - protein, 1540 aa, Glycine max
  Coding DNA Sequence Number=SeqID_28854
  Gene Ontology: Mol. function=nucleic acid binding; Cellular component= brahma complex; Biological process=response to water deprivation
  Homolog annotation: Hit_ID=A5B1Q9; Match level="QueryCoverage=99%, HitCoverage=67%, E-value=0.0, Identity=70%"; Hit description =Putative uncharacterized protein
  Pfam annotation: Domain name=DEAD; Domain location=971-1133; Score= -16.8; E_value=0.00076; Accession=PF00270.20; Description=DEADDEAH box helicase
  Pfam annotation: Domain name=Helicase_C; Domain location=1328-1407; Score=90.1; E_value=7.3e-24; Accession=PF00271.22; Description =Helicase conserved C-terminal domain
  Pfam annotation: Domain name=QLQ; Domain location=420-457; Score =51.5; E_value=2.8e-12; Accession=PF08880.2; Description=QLQ
  Pfam annotation: Domain name=ResIII; Domain location=967-1127; Score=- 27.7; E_value=0.01; Accession=PF04851.6; Description=Type III restriction enzyme, res subunit
  Pfam annotation: Domain name=SNF2_N; Domain location=973-1276; Score =353.1; E_value=4.8e-103; Accession=PF00176.14; Description=SNF2 family N-terminal domain
  Pfam module annotation: Pfam domain module=DEAD::Helicase _C::QLQ::ResIII::SNF2_N; Domain location=971-1133::1328-1407::420 -457::967-1127::973-1276
MVSFQQQLLRKPEGNEAFLAYQAGIQGVFGSNNFSSPSAMQLPQQPRKLHLGSNQDIQLRGQGVEQQMLNPVHQAYLQYALHAAQQRPTLGIQSQQQTKMGMLSSASLQDQEMRMGNLKMQDIMSMQAANQGQGSSSRNSSERGARGDKQMDQGQQMTPDQKSEGKPSTQGPTIGHLIPGNMIRPMQGPETQQGIQNVVNTQIAVSAQLQAMQAWARERNIDLSHPANAHLMAQLIPLMQSRMVSQSKVNESNIGAQSSPVPVSKQQVTSPAVASESSAHANSSSDMSGQSGSSKARQTAPSSHLGSITNAGIAGNSSDMATQQFNVHGRESQAPPRQPVVVGNGMPSMHSQQSSANTNLGADHPLNAKTSSSGPEPPQMQYTRQLNQSAPQAGGPTNEGGLGNPAKSQGRPAQMPQQRTNFTKQQLHVLKAQILAFRRLKKGEGTLPQELLRAIVPPPLEMQAQQPNHSARGQNQDKPAGNIAAEQISPIESSAKEPQSIPSINGQSSLKHESFARDEKSIVPPVHVQAVAPPVSKESAPTLSAGKKDQKSIGCSVKSNQDGECVNNTTVRNELALDRGKAIAPQAPVSDTMQIKKPSQTSTGPQPKDVGPTRKYHGPLFDFPFFTRKHDSFGSSMMLNNNNNLSLAYDVKDLLFEEGMEVLNKKRTENLKKIEGLLAVNLERKRIRPDLVLRLQIEEKKLRLVDLQARLRDEIDQQQQEIMAMPDRPYRKFVRLCERQRMELARQVQASQRAVREKQLKSIFQWRKKLLEAHWAIRDARTARNRGVAKYHEKMLREFSKRKDDDRNKRLEALKNNDVDRYREMLLEQQTSIPGDAAERYAVLSTFLTQTEEYLHKLGSKITAAKNQQEVEEAAKAAAAAARLQACFIKLPPPSPLLFFQCFEKSLYGLSEEEVRAAAACAGEEVMIRNRFLEMNAPRDSSSVNKYYNLAHAVNETVIRQPSMLRAGTLRDYQLVGLQWMLSLYNNKLNGILADEMGLGKTVQVMALIAYLMEFKGNYGPHLIIVPNAVLSEFYNWLPSVSCIFYVGSKDHRSKLFSQEVCAMKFNVLVTTYEFIMYDRSKLSKIDWKYIIIDEAQRMKDRDSVLARDLDRYRCQRRLLLTGTPLQNDLKELWSLLNLLLPEVFDNKKAFNDWFSKPFQKEGPTQNVEDDWLETEKKVIIIHRLHQILEPFMLRRRVEDVEGSLPPKVSIVLKCKMSAVQSAIYDWVKSTGTLRLDPEDEKHKLHRNPAYQVKQYKTLNNRCMELRKTCNHPLLNYPFFSDLSKEFIVRSCGKLWILDRILIKLQRTGHRVLLFSTMTKLLDILEEYLQWRRLVYRRIDGTTSLEDRESAIVDFNSPDSDCFIFLLSIRAAGRGLNLQSADTVVIYDPDPNPKNEEQAVARAHRIGQKREVKVIYMEAVVDKIASHQKEDELRSGGTVDMEDELAGKDRYMGSIESLIRNNIQQYKIDMADEVINAGRFDQRTTHEERRLTLETLLHDEERYQETVHDVPSLQEVNRMIARSKEEIELFDQMDDELDWI

SEQ ID NO: 120540 - protein, 185 aa, Glycine max
  Coding DNA Sequence Number=SeqID_28855
  Gene Ontology: Mol. function=DNA binding; Cellular component =intracellular
  Homolog annotation: Hit_ID=Q2HUC6; Match level="QueryCoverage=89%, HitCoverage=23%, E-value=4e-19, Identity=37%"; Hit description=ELM2; AT-rich interaction region; Homeodomain-related
MPDREVNESVNGNLGGGNDAMEAGEEFDGGKMSKEQVVDVLDGANYSVAGLLSGGEKCGDNDGKGLVMDPPGGDSDDRKRKRDMLDLSDGDSDSSDCKRMRESALDMLSWVTGAAKNPCDPEVGSIPEKAKWKSQSNQEVWKQVLLFREAAFLKRGSDTSSEQRSWQCFYVELPSKEYLHISEKG

SEQ ID NO: 120541 - protein, 1200 aa, Glycine max
  Coding DNA Sequence Number=SeqID_28856
  Gene Ontology: Mol. function=binding; Cellular component=nuclear pore; Biological process=protein import into nucleus, docking
  Homolog annotation: Hit_ID=A7PW36; Match level="QueryCoverage=94%, HitCoverage=99%, E-value=0.0, Identity=70%"; Hit description =Chromosome chr8 scaffold_34, whole genome shotgun sequence
  Pfam annotation: Domain name=Arm; Domain location=471-514; Score=2.1; E_value=6; Accession=PF00514.14; Description=Armadillobeta-catenin -like repeat
  Pfam annotation: Domain name=Arm; Domain location=518-556; Score =14.1; E_value=0.18; Accession=PF00514.14; Description=Armadillobeta -catenin-like repeat
  Pfam annotation: Domain name=HEAT; Domain location=137-173; Score =16.4; E_value=0.095; Accession=PF02985.13; Description=HEAT repeat
  Pfam annotation: Domain name=HEAT; Domain location=225-261; Score =7.9; E_value=1.8; Accession=PF02985.13; Description=HEAT repeat
  Pfam annotation: Domain name=HEAT; Domain location=371-407; Score =7.7; E_value=1.9; Accession=PF02985.13; Description=HEAT repeat
  Pfam annotation: Domain name=HEAT; Domain location=438-473; Score =27.3; E_value=5.6e-05; Accession=PF02985.13; Description=HEAT repeat
  Pfam annotation: Domain name=HEAT; Domain location=479-516; Score =10.1; E_value=0.83; Accession=PF02985.13; Description=HEAT repeat
  Pfam annotation: Domain name=HEAT; Domain location=522-558; Score =15.1; E_value=0.15; Accession=PF02985.13; Description=HEAT repeat
  Pfam annotation: Domain name=HEAT; Domain location=745-767; Score =1.8; E_value=15; Accession=PF02985.13; Description=HEAT repeat
  Pfam annotation: Domain name=HEAT; Domain location=785-822; Score =7.5; E_value=2; Accession=PF02985.13; Description=HEAT repeat
  Pfam annotation: Domain name=HEAT; Domain location=941-977; Score =32.0; E_value=2.2e-06; Accession=PF02985.13; Description=HEAT repeat
  Pfam annotation: Domain name=IBN_N; Domain location=38-111; Score =8.5; E_value=0.014; Accession=PF03810.10; Description=Importin-beta N-terminal domain
  Pfam module annotation: Pfam domain module=Arm::Arm::HEAT::HEAT::HEAT: :HEAT::HEAT::HEAT::HEAT::HEAT::HEAT::IBN_N; Domain location=471 -514::518-556::137-173::225-261::371-407::438-473::479-516::522 -558::745-767::785-822::941-977::38-111
MASDPMQQVALILGPDSAQLESLISQLMSSSNHHRSQAESLFNLCKQARPEALLLGLAHLLHSSPNPESRTMSAILLRRHLTRHHDSFLWPLLSPPARSSLHSLLLSSLHNEPLKSITKKLCDTVSELAAATLPDDAAAWPDLLPLLFQWVTSPDPRLQEISLLIFAQLAHYIGQTLLPQISTLHSVFLRSLHSSTPSDVRIAALAAAINFIQCLTNSSDRDRFQDLLPLMMQTLTEALNSGQEAVAQEALELLIELAGTEPRFLRRQIADVVGSMLQVAEAEALEEGTRHLAIEFVVTLAEARERAPGMMRKLPQFVRKLFGVLMNLLLDIEDDPAWHGAEDEEEDAGETSNYGFGQECLDRLSISLGGNTIVPVASELLPTYLSAPEWEKHHAALIALAQIAEGCSKVMITVCDSWRRLPLTWNAARGMVNLVMIKNLEQVLSMILNSFHDPHPRVQWAAINAIGQLSTDLGPDLQVKFHHLVLPALAGAMDDFQNPRVQAHAASAVLNFTENCTSDILTPYLDGIVSKLLVLLQNGKQMVQEGALTALASVADSSQEQFQKYYDAVMPYLKAILVNANDKSNRMLRAKAMECISLVGMAVGKEKFRDDAKQVMDVLMSLQQSQLDADDPTASYMLQAWARLCKCLGQDFLPYMGFVMPPLLQSAQLKPDVTITSADSDTEFDEEDDSIETITLGDKRIGIKTSVLEEKATACNMLCCYADELKEGFFPWIDQVAFTLVPLLKFYFHEEVRKAAVSAMPELLSSAKSAVEKGQSQGRDKTYVKQLSDYIIPNLVEALHKEPEVEICASMLDALNECIQVSESHLDEKQVRSIVDEIKQVLTASSSRKHERAERAKEEDFDAEERELLKEENEQEEELFDQVGDCLGTLIKTFRASFLPFFDDLSSYLTPMFGKDKTSEERRIAICIFDDVAEHGREAALKYYDSFLPFLLEACNDEYPDVRQAAVYGVGVCAEFGGSVFKPLVGEALSRLDAVIRHPNALHSDNIMAYDNAVSALGKICQFHRDSINAAQVVPAWLNCLPIKGDLIEAKVVHDQLCSMVERSDRELIGPNNQYLSKIVAVFAEILCAGNNLANEQTVSRMINLLRQLQQTLPPSTLASTCFGSSPSEDACLLSWDVIVTFSEAALSGQIHSFGIFGVSFFEAAVSGSCFMIVESILGFASQDLSKALLQRQSSVELVG

SEQ ID NO: 120542 - protein, 531 aa, Glycine max
  Coding DNA Sequence Number=SeqID_28857
  Gene Ontology: Mol. function=nucleoside-triphosphatase activity; Cellular component=nucleus; Biological process=hermaphrodite genitalia development
  Homolog annotation: Hit_ID=A7PC52; Match level="QueryCoverage=74%, HitCoverage=93%, E-value=1e-151, Identity=67%"; Hit description =Chromosome chr2 scaffold_11, whole genome shotgun sequence
  Pfam annotation: Domain name=WD40; Domain location=371-410; Score =21.2; E_value=0.0038; Accession=PF00400.23; Description=WD domain, G- beta repeat
MALLKTIGWVKELNADRTKSNNNIVMPSTPLMDLRAHALTLPRERARKNVDMHSRERKDIHLVLLISYIVKLNNLHSKLKMPRTSTLECSGCPPLRALTFDALGLIKVVEARDKQRGAPQVVERWGDLESSKCVMAVSMIDRESHPLLAVARKNNQIEVLSPVNGDIQATITDANDLDVQSEVNNIVGLHLFAKQNSELASRDCTLLTCTTKGNASIRSIELVDSSTVSSCIDSPKIWNVCSGGNILCCKVDGNEKFALFGGKGVEMNIWDLNNFTKIWNSKPPPKDNLGIFTPTWFTSATFLMKDDHRKFVAGTNSHQVRLYDMSAQRRPVLSFDFRETPIKALAEDIDGYSIYVGNGSGDMASVDIRTGKMLGCFSGKCSGSIRSIVRHPELPVIASCGLDSYLRLWDTKTRQLLSAVFLKQHIMHVLFDSNFDVKANISSGVDSLPCKEQTPTEILVSEEVEESPLKRKKSSRNKEHIPDGGERKKRSKQSKERKKSEGNDGGEKIASRDEGSRSASKKRNKRSIPVL

SEQ ID NO: 120543 - protein, 357 aa, Glycine max
  Coding DNA Sequence Number=SeqID_28858
  Gene Ontology: Mol. function=oxidoreductase activity; Cellular component=integral to membrane; Biological process=electron transport
  Homolog annotation: Hit_ID=Q5XMI8; Match level="QueryCoverage=99%, HitCoverage=49%, E-value=1e-106, Identity=55%"; Hit description=Iron reductase
  Pfam annotation: Domain name=Ferric_reduct; Domain location=180-301; Score=108.5; E_value=2.1e-29; Accession=PF01794.10; Description =Ferric reductase like transmembrane component
MPQETVVKRSPFQENCGRLQFAIRLLVVVLLLGWIFIRIMSPTNTFRQTWLPRYKAKTNNTTYIGSKGAYLLLYTFPILLLATLGCVYLHIGKKVIHSNTESCNAKKCGVTIWKRPVLIKGPLGIVSGTEIAFLFLFIALLAWVFSTSVQNSFATITPQFAAKDGQKIWEEKLDRVAKRLGVVGNICLAFMFFPVARGSSVLPLLDLTSESCIKYHIWLGNIAMTLFTSHGLCYIILWAVTDHTSNMLEWKKNDISIVAGEIALLSGLFLWIATIPRIRRKVFELFYYTHHLYILFIVFFIFHVGITYACIMLPGFYLYLVDRYLRFLQSRCQVRLVSARVLPCEAVELNFSKGYGN

SEQ ID NO: 120544 - protein, 349 aa, Glycine max
  Coding DNA Sequence Number=SeqID_28859
  Gene Ontology: Mol. function=protein serine/threonine kinase activity; Cellular component=cytoplasm; Biological process=protein amino acid phosphorylation
  Homolog annotation: Hit_ID=Q40353; Match level="QueryCoverage=99%, HitCoverage=99%, E-value=0.0, Identity=85%"; Hit description=Mitogen- activated protein kinase homolog MMK2
  Pfam annotation: Domain name=Pkinase; Domain location=39-301; Score =219.5; E_value=7.9e-63; Accession=PF00069.16; Description=Protein kinase domain
  Pfam annotation: Domain name=Pkinase_Tyr; Domain location=39-301; Score=-42.3; E_value=8.2e-10; Accession=PF07714.8; Description =Protein tyrosine kinase
  Pfam module annotation: Pfam domain module=Pkinase::Pkinase_Tyr; Domain location=39-301::39-301
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIMSIKDIIRPPQKENFNDVYLVSELMDTDLHQIIRSNQQLTDDHCRPSNLLLNANCDLKIADFGLARTTSETDFMTEYVVTRWYRAPELLLNCSEYTAAIDIWSVGCILGEIITRQPLFPGKDYVHQLRLITELIGSPDDASLGFLRSDNARRYVKQLPQYPKQNFSARFPTMSPGAVDLLEKMLIFDPNRRITVDEALSHPYMSPLHDINEEPVCTRPFSFDFEQPSFTEEDIKELIWRESVKFNPVPPVY

SEQ ID NO: 120545 - protein, 493 aa, Glycine max
  Coding DNA Sequence Number=SeqID_28860
  Gene Ontology: Mol. function=transferase activity, transferring glycosyl groups; Cellular component=integral to membrane; Biological process=metabolic process
  Homolog annotation: Hit_ID=Q9ZWQ5; Match level="QueryCoverage=95%, HitCoverage=98%, E-value=0.0, Identity=75%"; Hit description=UDP -glycose:flavonoid glycosyltransferase
  Pfam annotation: Domain name=UDPGT; Domain location=12-478; Score= -40.1; E_value=1.4e-08; Accession=PF00201.9; Description=UDP -glucoronosyl and UDP-glucosyl transferase
MERVASVSRPLKIYFLPFFSPGHLIPLVQLARLVAARGQHVTIITTPANAQLFDQNIDKDTASGHHIRVHIIKFPNAHVGLPEGIEHLSAATNNETAYKIHMAAHLIMPQLESLVKHSPPDVFIPDILFTWTKDFSQKLSISRLVFNPISIFDVCMIHAIKTHPEAFASDSGPFLIPDLPHPLTLPVKPSPGFAALTESLLDGEQDSHGVIVNSFADLDAEYTQHYQKLTGRKVWHVGPSSLMVQKTVKSSTVDESRHDCLTWLDSKKESSVLYICFGSLSLISDEQLYQIATGLEGSGHCFLWVVHRKNKDGEEGDSSSSSGKWLPEGFEEKIAKENRGMLIKGWAPQPLILNHPAVGGFLTHCGWNAVAEAISSGVPMVTMPAFGDQYYNEKLITEVHGFGVEVGAAEWSISPYEGKKKVVSGERIESAVKRLMDDGEKGKRMRSKAKEMQEKAWKAVQEGGSSYDSLTALIHHFKTLVPNHVNGNGNIDH

SEQ ID NO: 120546 - protein, 56 aa, Glycine max
  Coding DNA Sequence Number=SeqID_28861
MGNGFYCQEMYLNEDGQLSWFNAGVRVGVGIGLGIYVQVDLQICISCKFYLILGQQ

SEQ ID NO: 120547 - protein, 904 aa, Glycine max
  Coding DNA Sequence Number=SeqID_28862
  Gene Ontology: Mol. function=transferase activity, transferring glycosyl groups; Cellular component=integral to membrane; Biological process=metabolic process
  Homolog annotation: Hit_ID=A7PZL5; Match level="QueryCoverage=99%, HitCoverage=98%, E-value=1e-161, Identity=59%"; Hit description =Chromosome chr15 scaffold_40, whole genome shotgun sequence
  Pfam annotation: Domain name=UDPGT; Domain location=7-466; Score= -99.5; E_value=1.4e-05; Accession=PF00201.9; Description=UDP -glucoronosyl and UDP-glucosyl transferase
MAENAIHVVMLPWSAFGHLIPFFKLSIALAKAGVHVSFISTPKNIQRLPKIPSNLAHLVDLVQFPLPSLDKEHLPEGAEATVDIPSEKIEYLKLAYDKLQHAVKQFVANQLPNWIICDFSPHWIVDIVHEFQVKLIFYNVLSAPALTVWGPPGTRKTPLSPESLTAPPEWVTFPSSVAYRIHEAIALCAGANPVNASGVSDFERLHKVFNASEAVIFRSCYEIEGEYLNAYQKLVGKPVIPIGLLPADSEERGREIIDGRTSGKIFEWLDEQASKSVVFVGFGSELKLNKDQVFEIAYGIEEYELPFIWALRKPSWAINDEDFLPFGFIERTSNRGVVCMGWIPQQEILAHPSIGGSLFHSGWGSVIETLQFGHILVVLPFIIDQPLNARFLVEKGLAIEVKRNEDGSFTRNDIATSLRQAMVLEEGKKIRINTGEAAAIVGNLKLHQDHYIAEFVQFLKNGIRKVETDEMAENEIHVVMLPWSAFGHLIPFFKLSIALAKAGVHVSFISTPKNIQRLPKIPSNLAHLVHFVQLPLPSLDKEHLPEGAEATVDIPSEEIEFLKLAYDKLQHPVKQFVANQLPNWIICDFSPHWIVDIAQEFQVKLIFYSVFSAASMNIFAPSTRKFPVTPESLTVPPEWVTFPSSVAYRIHEAIPFCAGANDVNASGVRDYERMATVCCASKAVIFRSCYEIEGEYLNAFQKLVGKPVIPIGILPADSADREREIIDGSTSGKIFEWLDEQASKSVVFVGFGSELKLNKDQVFEIAYGIEESQLPFLWGLRKPSWATNDEDFLPVGFIERTSNRGVVCMGWIPQQEILAHPSIGDQPLNARFLVEKGLAIEVKMTEDGSFTRNEIAKSLRQAMVLEEGKKLRINTGEAAAIVGNLKLHQDHYIAAFVQFLKNGS

SEQ ID NO: 120548 - protein, 167 aa, Glycine max
  Coding DNA Sequence Number=SeqID_28863
  Gene Ontology: Mol. function=metal ion binding; Biological process =metal ion transport
  Homolog annotation: Hit_ID=A7PZJ1; Match level="QueryCoverage=75%, HitCoverage=79%, E-value=6e-10, Identity=84%"; Hit description =Chromosome chr15 scaffold_40, whole genome shotgun sequence
MKKFVLKLDLHDDKDKQKALKTVSTLSVQTDQLCSNFNQDKGIDAIAMDMKEKKLTVIGTVDPVTVVSKLRKNWKADIVAVGPVKEPEKKEDPKKVEAKKEGEKKEEGKKEEGKKEEKKEDEKKKDPPPVPDPVLEWVKAYRAYNPYMTTHYYAPSMEENPNACVIC

SEQ ID NO: 120549 - protein, 209 aa, Glycine max
  Coding DNA Sequence Number=SeqID_28864
MEINVAGVEPFCGVKDEGERVVELFAAAKVLLADPKNGDPAMVEGHVGVAVGNEGNNHNGKRTRRGAVPTRGGGAELVWVQSMETAKDSGGRVAKAVGGEGRPPLKLRLAMSSVGGGSGRWKFRTASGSHGGQSWKLRLVVAKMKEGFSRDQTSSAIIGGYSQNQSQGIELDVQREEGCAATKMCGDGDKDTSIRGLVLPPATTKEEEN

SEQ ID NO: 120550 - protein, 234 aa, Glycine max
  Coding DNA Sequence Number=SeqID_28865
  Gene Ontology: Mol. function=nucleotide binding; Biological process =defense response
  Homolog annotation: Hit_ID=A5AYS8; Match level="QueryCoverage=100%, HitCoverage=56%, E-value=2e-23, Identity=32%"; Hit description =Putative uncharacterized protein
MDAVSSALIEPVTNSVLDLVKKHVDYIRYRQNVGELYECVEQLELDKERVDHQCNRAVKNGHNIHVKAREWSRKVGEFKTEVENYKNDEGHRKAGLTNCLFPYFRYRLGRLAKKKAVEGKKLIDGCPKPDEIAFRGNVTFNDAILSNTDLMEFDSRKSIMEDIMEKLEDPTVKMIGVHGPGGVGKSTLIKAIAGSAQVKKLFNVVAFSEITANPNVKKIQEDIAYVLGLTLEGE

SEQ ID NO: 120551 - protein, 322 aa, Glycine max
  Coding DNA Sequence Number=SeqID_28866
  Gene Ontology: Mol. function=sequence-specific DNA binding; Cellular component=nucleus; Biological process=response to desiccation
  Homolog annotation: Hit_ID=Q9XER5; Match level="QueryCoverage=47%, HitCoverage=100%, E-value=2e-79, Identity=100%"; Hit description =Seed maturation protein PM22
  Pfam annotation: Domain name=DUF1511; Domain location=196-318; Score=- 21.6; E_value=0.01; Accession=PF07427.2; Description=Protein of unknown function (DUF1511)
  Pfam annotation: Domain name=LEA_2; Domain location=172-321; Score =354.5; E_value=1.8e-103; Accession=PF03168.4; Description=Late embryogenesis abundant protein
  Pfam annotation: Domain name=WRKY; Domain location=104-158; Score =19.5; E_value=3e-06; Accession=PF03106.6; Description=WRKY DNA -binding domain
  Pfam module annotation: Pfam domain module=DUF1511::LEA_2::WRKY; Domain location=196-318::172-321::104-158
MESQDPQNSPPFLFTPMSMMQNPNLEPQGLHDDIDWVSLFSGQSNFLADANAMMECASSSSSSSSSSCALMAEKSDKETMKGGRLRKTTRPRFAFQTRSEDDILDDGYRWRKYGQKAVKNNMHPSDDHCQKGGHVRHVSSRVGMREATVNTCEEQHPRIDIVGYKVCRLKMSQLLDKAKNFVSEKVNDMAKPEASVTDVDFKRVSKDNVEYLAKVSVRNPYSTSIPICEINYSFKSASREIASGKIPDPGSLKAKDTTMVDVPVKVPYSILMSLAKDIGADWDIDYQLDLGLVIDVPVIGIFTIPLSQKGEIKLPTLSTMFA

SEQ ID NO: 120552 - protein, 578 aa, Glycine max
  Coding DNA Sequence Number=SeqID_28867
  Gene Ontology: Mol. function=cysteine desulfurase activity; Cellular component=chloroplast; Biological process=cysteine metabolic process
  Homolog annotation: Hit_ID=A7PZP5; Match level="QueryCoverage=38%, HitCoverage=78%, E-value=5e-73, Identity=63%"; Hit description =Chromosome chr15 scaffold_40, whole genome shotgun sequence
  Pfam annotation: Domain name=SufE; Domain location=323-442; Score =118.6; E_value=1.8e-32; Accession=PF02657.6; Description=Fe-S metabolism associated domain
MALLIHSLEMSVAPQISQNPNPKLSKLHSFKPYPKGKAIGSTRGVRISCKVKDCVVLDENVNSYGQFSVPVKQGSKQSKEEEEEKQNYYVNVGYAIRTLREEFPDLFYKELSFDIYRDDIVFKDPMNTFIGIENYKSIFWALRFHGMMFFKALWVEISSVWQPVENVIMVRWTVHGIPRVLWESRGRFDGTSEYKLDKQGKIFEHRVDNIAMNSPPRFKDLGEIRDVRNMDLTAIIAQPVIGYPCVFNDGYEFDYLILLPNSLNQNPSLSLLQNLTFPYIPHKSLSQNPSPSTDFNHHHHPHHHHHQHPFNPSKTFLPSSKGQSVPEPKAKYEQLIFYGKNLKPLEPQFKTNDNKVQGCVSQVWVRAYLDPNRNVVYEADSDSGLTKGLAALLVQGLSGRPVNEIIRVTPDFVTLLGLQQSLTPSRNNGFLNMLKLIQRKALMLYVEAEKGGESDGIVKNSSSGGESSELGGDSKIPLLELGGRGKRGIVENSSGGESYELGGESEIPSVSASRGDENLELGGRGKRHAGHAGVRGSDGETHFNVRVVSIEFAGKSLVKRQTYLWPATRAVGCWTAHD

SEQ ID NO: 120553 - protein, 999 aa, Glycine max
  Coding DNA Sequence Number=SeqID_28868
  Gene Ontology: Cellular component=Golgi apparatus; Biological process= biosynthetic process
  Homolog annotation: Hit_ID=A7PZP8; Match level="QueryCoverage=99%, HitCoverage=99%, E-value=0.0, Identity=58%"; Hit description =Chromosome chr15 scaffold_40, whole genome shotgun sequence
  Pfam annotation: Domain name=Glycos_transf_1; Domain location=317 -505; Score=9.4; E_value=0.00011; Accession=PF00534.11; Description =Glycosyl transferases group 1
  Subcellular localization annotation: CTP_CleavageSite=62; ConfidenceScore=5.46e-01
MGSLESGIPLKKGSLFGSQFSRKEKNPFSHRFRSSFSRLLFKKLDYVQWICTVVVFLCLVVVFQMFLPGSVVQNSGEEFLKDVRMRSDNFLQYGDIHKVLLDIGEDAVFLPKISEKFSRGSGGRDVDFFNHTVQHYGYRKPQLALVFGELLVDSQQLLMVTVASALQEIDYEIQVFSLADGPGHNVWRNLRVPVIVLRACDKRNNIVDWLNYDGIIVSSLEAKGAFSCFLQEPFKSIPLIWAVHENALAYRSRQYTTNGQIEVLNDWGRVFNRSTVVVFPNYALPMIYSAFDAGNFYVIPGSPAETLEAEAFMALQKDNLRVNMGYGPEDVIIAIVGSQFLYKGLWLGHAIVLRALEPLLADFPLNKDNSSAQLRIIVHSGELTNNYTVALKTMAHSLKYPRGIIEHIAGDLNVDSVLGTSDVVIYGSFLEEQSFPEILIKAMSFEKPIIAPDVPMIRKYVDDRVNGYLFPKDNIRVLRQILLEVISKGKISPLARNIASIGRSTAKNLMVSEAIDGYASLLENVLRLPSEVAPPKAVSEIPPSAKEQWQWHLFEAVPNMTFQNRVLRSNTFLDKYEGQWNHSQKTRSTPSVAANDIFVYSIWEEEKYTQLAITKKRREDEELKDRTEQSHGTWEDVYKSAKKADRLKNDLHERDEGELERTGQPLCIYEPYFGEGSWSFLHQKSLYRGIGLSGKGRRPGRDDVDAPSRLPLLNNGYYRDLLGEYGAFFAIANRIDRLHKNAWIGFQSWRATARKASLSITAENALLDAIQSKRLTFSKAMRRMYGVKDAVDSLPPMPVDGDTWSVMQSWALPTRSFMEFVMFSRMFVDALDAQMYDEHHSTGRCSLSLSKDKHCYSRLLELLVNVWTYHSARRMVFVDPETGLMQEQHKFPSRRGQMWIKWFSYSTLKSMDEDLAELSDSEDPARHWLWPSTGEVFWQGIFDRERSLRQKEKEKRKQKSIEKQNRMRKRHRQQVIGKYIKPPPDEESSNSSMLAVTAS

SEQ ID NO: 120554 - protein, 214 aa, Glycine max
  Coding DNA Sequence Number=SeqID_28869
  Gene Ontology: Mol. function=dihydrodipicolinate reductase activity; Cellular component=chloroplast; Biological process=lysine biosynthetic process via diaminopimelate
  Homolog annotation: Hit_ID=O80574; Match level="QueryCoverage=89%, HitCoverage=55%, E-value=2e-91, Identity=86%"; Hit description =Dihydrodipicolinate reductase 1, chloroplast precursor
  Pfam annotation: Domain name=DapB_C; Domain location=67-208; Score =93.5; E_value=6.7e-25; Accession=PF05173.5; Description =Dihydrodipicolinate reductase, C-terminus
DWESFMQIVIALEIFMNACSYAGNAELYSKVGVPFVMGTTGGDRDLLHKTVLDSNIYAVISPQMGKQVVAFLAAMEIMAEQFPGAFSGYSLQVLESHQASKVDASGTAKAVISCFNKLGVSYDMDQIKLIRDPRQQLEMVGVPEEHLSGHAFHMYHLTSPDDTVTFEFQHNVCGRSIYAEGTVDAVLFLAKKIETKDPKRLYNMIDVLREGNMR

SEQ ID NO: 120555 - protein, 320 aa, Glycine max
  Coding DNA Sequence Number=SeqID_28870
  Gene Ontology: Mol. function=structural constituent of ribosome; Cellular component=ribonucleoprotein complex; Biological process =translation
  Homolog annotation: Hit_ID=A9PB43; Match level="QueryCoverage=87%, HitCoverage=100%, E-value=1e-125, Identity=77%"; Hit description =Putative uncharacterized protein
  Pfam annotation: Domain name=Ribosomal_L18p; Domain location=67-210; Score=232.3; E_value=1.1e-66; Accession=PF00861.13; Description =Ribosomal L18pL5e family
MAQNNSLQPTHPNLIKHCLIALTLSLNPKETQALLPFSPSAMVYVKSQKSKAYFKRYQVKFKRRREGKTDYRARIRLINQDKNKYNTPKYRFVSNKDIVAQIISASIAGDIVLAAAYAHELPRYGLEVGLTNYAAAYCTGLLLARRVLKTLEMDEEYEGNVEATGEDYSVEPAESRRPFRALLDVGLIRTTTGNRVFGALKGALDGGLDIPHSDKRFAGFDKEKKELDAEILAEDEPEKYQSHFSEYIKRGIEADGIEALYKKVHAAIRADPSLKKSEKQPPKEHKRYNLKKLTYEERKAKLIARVAAINSAADNDEDDE

SEQ ID NO: 120556 - protein, 295 aa, Glycine max
  Coding DNA Sequence Number=SeqID_28871
  Gene Ontology: Mol. function=dopamine beta-monooxygenase activity; Cellular component=integral to membrane; Biological process =histidine catabolic process
  Homolog annotation: Hit_ID=A7QYJ4; Match level="QueryCoverage=83%, HitCoverage=67%, E-value=5e-69, Identity=51%"; Hit description =Chromosome undetermined scaffold_248, whole genome shotgun sequence
  Pfam annotation: Domain name=Cytochrom_B561; Domain location=88-281; Score=-54.3; E_value=0.0085; Accession=PF03188.7; Description =Cytochrome b561
MGTWWVLSAIVGWMPSAGAGGMKLSYLGGKSQDEVVHDKGDLYIMNASFVPASAKLGYFIFQLKTTQPSSNLIFAIGPNGQFPDYPNYALPQHIDQTSITIDYSKGSTSGNSNLNLLRSHGVLNIMGWSILMIIGSIIARYFKQWDPTWFYFHASIQAFSFVAGVIGIICGLVLSKKLNTKVTHHKNIGIVIIILGFLQVLAVVFRPGKESKIRKYWNWYHHNVGRILIIFAVLNTFYGLHLGGEGSKWFLAYGVIIAVLVIIVVILEIRMRIIARRETPSKDNSSYPQAVELPY

SEQ ID NO: 120557 - protein, 64 aa, Glycine max
  Coding DNA Sequence Number=SeqID_28872
MGRKSHRCKRFQLHICSLTGNRSSFLGDPSIPTPDGKGKNSYPRSRFIANELRFRLKRLVEGRA

SEQ ID NO: 120558 - protein, 80 aa, Glycine max
  Coding DNA Sequence Number=SeqID_28873
  Homolog annotation: Hit_ID=A2Q246; Match level="QueryCoverage=100%, HitCoverage=32%, E-value=3e-27, Identity=77%"; Hit description=CENP -B protein
SDVAINLDESTFDEETQDLETMINQCGYRNKMDINNLMNYPGENQACLEVQSLEDIVGTIIDNNAEDDDEDDTVSLEPVT

SEQ ID NO: 120559 - protein, 298 aa, Glycine max
  Coding DNA Sequence Number=SeqID_28874
  Pfam annotation: Domain name=Transposase_23; Domain location=5-75; Score=13.7; E_value=3.8e-05; Accession=PF03017.5; Description =TNP1ENSPM transposase
NNPETGDSDRCGLYIEADPARLVAVGRVYEGSTLVHNTPLLPGQVKVSVDEVKDADVVVPVPTAEVSLVGQALHTFLAWPTHLIKSLSNQVAMSPPKPPLKPDPEVDNPLYLMTLTIPELFLRPYQVRWDATVFGVVNPDFPMYIKHEDLSEIAHGGQCLSISVLQLWIMHLTETCMRAGNSDIYGFLEPQSIQRSGQSQFESESYIKSWMQSSQRDVYLGAYLNGFHCSGHWQMVVILPKEHLVVWFCSLHNRPDNYLKGIINRLVFFSIHLHSTPLPRTTPVFKLLLIWNSAIKGS

SEQ ID NO: 120560 - protein, 166 aa, Glycine max
  Coding DNA Sequence Number=SeqID_28875
MGVELVPFLVKHITRALGVRGTFFFFRLHANLWFFLPSFGHFEMPPVHEPLKQFFHRGTGRSQCCVRGLHYGTHTWHPSCTTWGMVAGRPSRVLATTKSFSNNEGHNSEYAMGIGEKSSFGGELPARIEKFGRLGWYEFWIFRGAFIHVGAVVTRVGISYLPRAHY

SEQ ID NO: 120561 - protein, 89 aa, Glycine max
  Coding DNA Sequence Number=SeqID_28876
  Homolog annotation: Hit_ID=A5C1K9; Match level="QueryCoverage=55%, HitCoverage=3%, E-value=3e-08, Identity=57%"; Hit description =Putative uncharacterized protein
MGKKIGNYISDELSPRIKGKNKFQSKFFLFFDNLAGNTYVHMRCGECIITLQDFSVLLGISVDGLPLVGPTNLDWADLCEELLGVRLQE

SEQ ID NO: 120562 - protein, 115 aa, Glycine max
  Coding DNA Sequence Number=SeqID_28877
MALEWWSQRKHPVPIGVPGLWDLHLPYEEKVGPQARLPSLETAQWKEWILEAPPPVNSEAKLMTGLRRSKVRLSKTTPLARHRAVIRVGNPSLEELDWAIEVIWPEMSAPMFISM

SEQ ID NO: 120563 - protein, 238 aa, Glycine max
  Coding DNA Sequence Number=SeqID_28878
  Homolog annotation: Hit_ID=A4W9N4; Match level="QueryCoverage=99%, HitCoverage=100%, E-value=2e-97, Identity=74%"; Hit description =Putative diguanylate phosphodiesterase
MIITLDNAYQSELLLQPARNSAGELKGLDIVVNFTGVGSEVRIPTELVIPRLSEAEELALFNEKLQLLDTCKLFFIQHQLIAWINITPVIVEFLLSNGNAVSILERYPFLEFTVNENYPGLNNGKDDLQLARMAIHFPLVLANFGAGAASLKAVYDGLFKRVILDKGFIQQRAQELSFEPFMRAILWQITPHCQSVIVSGIDDHALLQRVLSFNFGAMQGALWPAVSAEHVTTLVQQR

SEQ ID NO: 120564 - protein, 112 aa, Glycine max
  Coding DNA Sequence Number=SeqID_28879
MVQKKDEELRGSSNGPIGGYHKWLKAYAQGLGWLPNLRATKEVEVEAPEEAKRKYKEELDLATAHEHKVAEEYTRVYVEKEAKRRVIDSLHQEVTMWMERFAFTLNRSQDVP

SEQ ID NO: 120565 - protein, 191 aa, Glycine max
  Coding DNA Sequence Number=SeqID_28880
  Gene Ontology: Mol. function=DNA binding
  Homolog annotation: Hit_ID=Q2L1N8; Match level="QueryCoverage=72%, HitCoverage=98%, E-value=2e-24, Identity=42%"; Hit description =Putative phage excisionase
MCLRSQRSRRDGWPARAAPGRWPLLPPPHNPQSLPHIAFHGTIGSTWFSSSVMSPVLLTVDQAAQQLRLHPKTVLRHIRSGQLRATRIGKSYRITAEDLDVFTGTVREPSAARPQLTTVVDIPGCGAARAADLVRALHARVTGREADDEPLRMETIYSPEHDVLKLIVIGGLAGSAALLVSLQRLLQDRSA

SEQ ID NO: 120566 - protein, 450 aa, Glycine max
  Coding DNA Sequence Number=SeqID_28881
  Gene Ontology: Mol. function=transporter activity; Cellular component= membrane; Biological process=transport
  Homolog annotation: Hit_ID=Q6KAY9; Match level="QueryCoverage=36%, HitCoverage=34%, E-value=3e-75, Identity=90%"; Hit description=Outer membrane protein
ADQPFRMVPEDFDLWSVKNDKGEMVPFSAFATKHWDYGSPRLERYNGVSAMEIQGEPAPVGQAAAGGLRHRVDGDVLPGTPGRLADAAAVHAVADDRVPVPGRDVRKLERADRGAAGGPAGYPRRRAGQHLQGPGTRHLLPGGDADHGGPDQQERDPDRRVRQGEPGEGRQPDRVDHARRARPLASDRDDLAGLRHGRGTAGGLHRCRFRRQAGDRYRRARRHDRRHRARCVLRAAVLRGGAARVQAQIRDCRPLAGIASCHPAVPMEVIPMKSASLFLSIAAALALAGCSTLVPKNTAVAPAIPAQWPAEAVQGQVADVAAVGWRDFFTDARLQQVIEQSLQNNRDLRVAVLNVERARGQYRVQRADRVPGVAVTGQMQRQGTDAGVTEQFTAGVGVAEFELDLFGRVRNLSEAALQQYFAVAANRRNAQLSLVAETATAWLTYGADAQ

SEQ ID NO: 120567 - protein, 20 aa, Glycine max
  Coding DNA Sequence Number=SeqID_28882
MVSGTSATSGSTSRKISENL

SEQ ID NO: 120568 - protein, 144 aa, Glycine max
  Coding DNA Sequence Number=SeqID_28883
GYTPSPWVLVTLTVERTTRPRLERTTRPHHQRAARPHLQRTTCPRLERATRPHLGGLHVLAFKGSCTFNFKRTTRPRRQRVMCLHLVGYMPSPSEDYTSSPLEDYTSSPSEATCSLTFSKGACPSPCRGLRPCHHRTTLPRLEG

SEQ ID NO: 120569 - protein, 249 aa, Glycine max
  Coding DNA Sequence Number=SeqID_28884
  Gene Ontology: Mol. function=chitinase activity; Biological process =cell wall catabolic process
  Homolog annotation: Hit_ID=A1FRY2; Match level="QueryCoverage=100%, HitCoverage=74%, E-value=1e-102, Identity=78%"; Hit description =Glycoside hydrolase, family 19
MYGGRMGNDAPGDALKYHGRGYLPLVGKENYERAGKALDLDLVNQPELAAQPEHAGRIAVWQGQTRVPEAAREDVREATHALNGALNGIEARRQRFEVWQQKLTPDVMARLERGEVGAPAQSVARDMSQTGEPGNPLFEDARRRLQQMGAQSGLRSIQELDNTAGALALGAHKAGLSRIDHLLAGNDGRTLFAVQGGLGDPAMLRASVDREQAAQQPLAQSSQQLAASVAQQDPAATLAREQEQRSRSL

SEQ ID NO: 120570 - protein, 102 aa, Glycine max
  Coding DNA Sequence Number=SeqID_28885
  Subcellular localization annotation: CTP_CleavageSite=39; ConfidenceScore=5.29e-01
MKSGDMRGYLMVTRTFRPPRANEPVDAQRLTSSSATFVVLTREGNIMVTRTFRQLGENEPGDAQRLTSSSATFVVLTREVWWHTWLPYGYPHHSSTRGRRVY

SEQ ID NO: 120571 - protein, 138 aa, Glycine max
  Coding DNA Sequence Number=SeqID_28886
MTLLLSNILPSDRNADLPPVEGSHPQRHPVDLKKSNRALGFPALVTGLCRPYRVPVPPSKFMSSWHRDRARKTLCGPGEVQQGLGVASSKYGSLSVIGSACRPQQGHQPPPTNRAFIKKYCVSRQAQGETPHQHWDGR

SEQ ID NO: 120572 - protein, 195 aa, Glycine max
  Coding DNA Sequence Number=SeqID_28887
  Gene Ontology: Mol. function=hydroxyethylthiazole kinase activity; Biological process=thiamin biosynthetic process
  Homolog annotation: Hit_ID=A4WCE6; Match level="QueryCoverage=50%, HitCoverage=38%, E-value=3e-30, Identity=65%"; Hit description =Hydroxyethylthiazole kinase
  Pfam annotation: Domain name=HK; Domain location=11-194; Score=38.9; E_value=1.1e-13; Accession=PF02110.6; Description=Hydroxyethylthiazol e kinase family
  Subcellular localization annotation: CTP_CleavageSite=35; ConfidenceScore=5.07e-01
MQPDLLDLHVLHHFRTRSPLTHLQWRQANPGRWTRCRGRPGVPHSFLPSNSCPETGGHSWQCLRNPGSCRDERPAGAASIRPIPPPAAVPAAQALARQINTIVVVTGEVDYITDGQRTRTVTGGDQLMTRVVGTGCALSAVVAASCSLPGDRLDNIAAACGWMKRAGTVAVAQSRGPGSFASAFLDALYTLEEHA

SEQ ID NO: 120573 - protein, 191 aa, Glycine max
  Coding DNA Sequence Number=SeqID_28888
  Subcellular localization annotation: CTP_CleavageSite=34; ConfidenceScore=5.01e-01
MASFSHMQSQLQLQMQSQGLVVPPEPLVDPSGPRVSTKGSCVDPSGNDPEMGDSDRCSLYIEADPAHLVAVGRVYEGSTVVHNTPLLPGHVKVSVVEVTDADAPVPIPTDEVTVSPAKPPPKPDPEVDDPLYLMTLTFPELFLRPYQVRLDATVFGVFNPDFPLYIKHEDLSEIAHGGQCLSISVLQLWIL

SEQ ID NO: 120574 - protein, 133 aa, Glycine max
  Coding DNA Sequence Number=SeqID_28889
MESIMSIKEIMEVNAAAIAATSTIAEVDLTPPYGLNQINHPTSDMVGMEGKELGGALISPPTTTLLWKMVGYTPSNFADLVFTDERIKVGLEKGKSDHPALMNAKTGANEKDKNEGETLAMTAIPTQSNFPSA

SEQ ID NO: 120575 - protein, 44 aa, Glycine max
  Coding DNA Sequence Number=SeqID_28890
  Homolog annotation: Hit_ID=A0ST23; Match level="QueryCoverage=72%, HitCoverage=65%, E-value=1e-11, Identity=100%"; Hit description =Putative reverse transcriptase
MGVFLSYSEDDEVGKPVVPAALMNRPTRGERRFAYWALFRFLAH

SEQ ID NO: 120576 - protein, 118 aa, Glycine max
  Coding DNA Sequence Number=SeqID_28891
MVMGDFINILSFPENTETFSSLTSYPELRRSEFLIGGYVGARASLLSTTPLFVTMTQKLSLRRHLTVIRVSSFSDPKCPIGAQRQYGHLHPLSPEMHISGRQNFSAPLHSDTSRVPMA

SEQ ID NO: 120577 - protein, 295 aa, Glycine max
  Coding DNA Sequence Number=SeqID_28892
  Pfam annotation: Domain name=Transposase_23; Domain location=144-214; Score=8.1; E_value=0.00015; Accession=PF03017.5; Description =TNP1ENSPM transposase
KTKKKLEEAAQSGSVDGVIDPPSPVRRHVKWKMVRERKTEEITTEAAKEIAEKIDSFEEQATQGSFVPHARQEVLVAAIGRPEHPGCVCAAGAAADPADQGPARGVHHRESDEAVPPEPLVGPFVPRVSTKGSYVDPSGNDLETGDSNRCGLYIEADPARLVAMGRVYKGSTIVHNTPLLSGQVKVSVEEATDADAPVPVPTDEVSLVGQALHTFLAWPTHLVKSLSQQVVVSPAKPPPKPDPKVDDPLYLMTLTILELFLRPYQVRWDATVFGVFNPDFPLYIKHEDLSEIAHG

SEQ ID NO: 120578 - protein, 260 aa, Glycine max
  Coding DNA Sequence Number=SeqID_28893
MRGAPTEEGMSPFLVRDFGAQNSKTIQRIHKAWETPLRKDQELRGIRNGIIGGYHEWLKVHIRGLDWLAKLKVVSEESFEAPEEDEEVQALKENATTARALEQETKRAHKEEYGRNKFRGALWGSNSELKLRREERDQARAHSMVLKEELVACSMSKRSLSQRLCETETNMLAIIAKYQEELGLATAHEHRVADEYAQVYAEKEARGRVIDSLHQEATMWMDRFALTLNGSQELPRLLAKAKAMADTYSGPEEIHGLLGY

SEQ ID NO: 120579 - protein, 68 aa, Glycine max
  Coding DNA Sequence Number=SeqID_28894
  Homolog annotation: Hit_ID=A6FJQ2; Match level="QueryCoverage=55%, HitCoverage=84%, E-value=3e-11, Identity=92%"; Hit description=50S ribosomal protein L5
MQLPGDGHSLSVSGCREQTSPSGRVSGCWRMRKEKIPHQAPFAIQAAQLLGRAIGAGLFAITPAGERG

SEQ ID NO: 120580 - protein, 178 aa, Glycine max
  Coding DNA Sequence Number=SeqID_28895
MTKARQKGVRKVNEMKIKNELKKLDFGNLPVKDRRTRRTNEKRRKIFTELPTETFQTRYRRKWGRSLPPSSPRQARRPKWAWLLFAPPCLLNTPPVFFADSFSVTLHKFMNSVTDEDMTKSKGKDPLEGLGGPMTRARARKAKEALQQVLSILFEYKPKFQGEKSKVVSCIMAQMEED

SEQ ID NO: 120581 - protein, 162 aa, Glycine max
  Coding DNA Sequence Number=SeqID_28896
MGEVEEIQEKMKADMEAIKEKMATMMEAMMSVKKIMEANAVAIAATSVVAKEVRMTPRCANSKQARLPAIWLASQNYTPPNVAYIPNEDTHEIPHHNLADFEPWLEYTTEGQAVGGIPLQNPLEGPQYHPQLHLLHSTAVKNPHDYGRNGKGGSSKGKAQGH

SEQ ID NO: 120582 - protein, 43 aa, Glycine max
  Coding DNA Sequence Number=SeqID_28897
GEIFQENFIVKCSLNNSWANTCKSIKSSSKNSSYSKRLIKGLR

SEQ ID NO: 120583 - protein, 139 aa, Glycine max
  Coding DNA Sequence Number=SeqID_28898
  Homolog annotation: Hit_ID=A6FJQ2; Match level="QueryCoverage=27%, HitCoverage=84%, E-value=3e-11, Identity=92%"; Hit description=50S ribosomal protein L5
MTVKPLTHAAPGDGHSLSVSGCREQTSPSGRVSGCWRMRKEKIPHQAPFAIQAAQLLGRAIGAGLFAITPAGERGMCCKAIKLGNARGIEANLNKYTTILEMHSLTNIQEVHKLNGRLASLSRFLPKLAGKAKPFYKLL

SEQ ID NO: 120584 - protein, 95 aa, Glycine max
  Coding DNA Sequence Number=SeqID_28899
  Subcellular localization annotation: CTP_CleavageSite=42; ConfidenceScore=5.41e-01
MAVLKVALSSVRIYCFRIIMANSHKSRKSSPSHLLPRTQSSRSSQDPNTNNKLGGDQSGSLKPDDPQGLHSEESVRPLPPDSGPTPKIILAHRHC

SEQ ID NO: 120585 - protein, 305 aa, Glycine max
  Coding DNA Sequence Number=SeqID_28900
  Gene Ontology: Mol. function=unspecific monooxygenase activity
  Homolog annotation: Hit_ID=Q9AVH2; Match level="QueryCoverage=61%, HitCoverage=72%, E-value=5e-52, Identity=54%"; Hit description =Putative senescence-associated protein
HVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGHRIPLVRTSSELTVRRPGKRPEGPVPIRPPTGTRRPALAAEAARAVHRQPTGSGLGPPCPALRANPFPEYDRAWEALGPPDFQGPPGAHRTPRDVRCSSSRWTLPPAEPFPGWAGC

SEQ ID NO: 120586 - protein, 148 aa, Glycine max
  Coding DNA Sequence Number=SeqID_28901
  Homolog annotation: Hit_ID=UPI0000ECBAF8; Match level="QueryCoverage =27%, HitCoverage=48%, E-value=8e-16, Identity=95%"; Hit description =UPI0000ECBAF8 related cluster
MKARVIGGQITLVGVTGTPNDWQRPVINAENPRALLDLSGSRGCLDGIHQLALEQREIRVMIARQDIAEQQCHPRLGQSGHAGAHDPYPPPCSGPGMQAWHWPSFYNVVTGKTLALPNLIALQHIPLSPAGVLAKRPEPIALPNSCAA

SEQ ID NO: 120587 - protein, 55 aa, Glycine max
  Coding DNA Sequence Number=SeqID_28902
METISRQFKNVLRAIMKRARWKTNGDGLRVGRVSRRFSSIVRCFASSKLSPYSKW

SEQ ID NO: 120588 - protein, 130 aa, Glycine max
  Coding DNA Sequence Number=SeqID_28903
MGEVEEIQEKMKADMEAIKEKMATMMEAMMSMKKIMEANAVIVAATSAVAKVNPMLPSGLKQMNHPTSNMAHISQTMGGTHEIPHHNLADFEPCLGYATEGQAVGGIPLQKHFGGPLVSPTTTTLTFHNG

SEQ ID NO: 120589 - protein, 66 aa, Glycine max
  Coding DNA Sequence Number=SeqID_28904
MDKSEKKNHSEKKLKKAYITWDENDLESSDDSENEEINLCLMAKSYESDEEKRTWHINLLLQEKLQ

SEQ ID NO: 120590 - protein, 328 aa, Glycine max
  Coding DNA Sequence Number=SeqID_28905
  Gene Ontology: Mol. function=nucleoside-triphosphatase activity; Cellular component=signal recognition particle; Biological process =SRP-dependent cotranslational protein targeting to membrane
  Homolog annotation: Hit_ID=Q1H3D6; Match level="QueryCoverage=98%, HitCoverage=99%, E-value=1e-107, Identity=61%"; Hit description =Signal recognition particle-docking protein FtsY
  Pfam annotation: Domain name=APS_kinase; Domain location=121-254; Score=-104.8; E_value=0.075; Accession=PF01583.11; Description =Adenylylsulphate kinase
  Pfam annotation: Domain name=MobB; Domain location=123-238; Score= -32.0; E_value=0.022; Accession=PF03205.5; Description=Molybdopterin guanine dinucleotide synthesis protein B
  Pfam annotation: Domain name=SRP54; Domain location=121-327; Score =385.0; E_value=1.2e-112; Accession=PF00448.13; Description=SRP54 -type protein, GTPase domain
  Pfam annotation: Domain name=SRP54_N; Domain location=28-109; Score =57.2; E_value=5.7e-14; Accession=PF02881.10; Description=SRP54-type protein, helical bundle domain
  Pfam module annotation: Pfam domain module=APS_kinase::MobB::SRP54::SR P54_N; Domain location=121-254::123-238::121-327::28-109
MFNPFAKKSEPVTPSAPEATSLSWTQRLKNGLSKTRQQLGGQLSALFGGGKINEEIYEELETILLTSDVGVNATQYLLEQLRNRVKKHDLQDTVALKQALKETLLELLGPLESPLDVSNHQPYVMMMVGVNGAGKTTTIGKLAKYLQAQGHSVLIAAGDTFRAAAREQLQVWGERNDVHVIASESGDPAAVIYDAVNSAIAKKIDVVIADTAGRLPTQLHLMDEIKKVQRVIDKALPGAPHEILLVLDANTGQNAVNQLKAFHEALGVTGLALTKLDGTAKGGVIAAIAYLSQQSSSKTPVRFVGVGESIDDLRPFNANDFIDALIDD

SEQ ID NO: 120591 - protein, 158 aa, Glycine max
  Coding DNA Sequence Number=SeqID_28906
MRQFGYTQTILLRLPIHGCRLMIYTTGGCTIRTIWLQQVTSALCQRLHGLILPHFASIRDTGPAIRSSGRWSCYAAQSCPSGSRHRYPSGHEASSTVDICKVRCGRAETCSGSLLCDCGEVGEPSQPRGGHARHIDTCADRRMPQDCQECHTRPASIC

SEQ ID NO: 120592 - protein, 408 aa, Glycine max
  Coding DNA Sequence Number=SeqID_28907
  Homolog annotation: Hit_ID=Q6WAY6; Match level="QueryCoverage=24%, HitCoverage=17%, E-value=9e-12, Identity=37%"; Hit description =Putative uncharacterized protein
DAGSRQARQGASAGVGGCRGWLNYAASEQIVLRVHHMRAIGAGLFAITPAGERGMCCKAIKLGNARVFPVTTLSTLEDPQEGKEGVLFSCGRYPNIPLVGTRGCINYNPALAIRQLGYPMRGAPTEESMSPFLVRDFGAQNSKTIQRIHKAWETPLRKDQELRGIRNGIIGGYHEWLKVHIRGLDWLAKLKVVSEENFEAPEEDKEVQALKSELGKAKLAKEKFKLAATHVRKECAGLREENAITARALEQETKRARKEEYGRNKFRGALWGSNSELKLRREERDQSRAHGMVLKEELVACSRSKRSLSQRLCETETNMLAIIAKYQEELGLAAAHEHRIADEYAQVYAEKEARGRVIDSLHQEATMWMDRFALTLNGSQEFPRLLAKAKAMADTYSAPEEIHGLLGY

SEQ ID NO: 120593 - protein, 202 aa, Glycine max
  Coding DNA Sequence Number=SeqID_28908
  Homolog annotation: Hit_ID=B0HC01; Match level="QueryCoverage=16%, HitCoverage=72%, E-value=5e-11, Identity=97%"; Hit description =Putative uncharacterized protein
LGHHFKNSVAPPTYLALLILLPVAAASGDKSCLTGATLPEGRKADRYPVSGRVGTGERTRELPGETLGGGAYGKTPATRPFYGSWPFAGLLLTCSFLRYPLILWITVLPPLSELIPLAAAERPSAATGTTGFPTGKRAVSATQLMYNKTEESKNFLSLQTHAFVKWWTQFDVSKVEPEQVKLWFIAHLEPLKAADPETSGIL

SEQ ID NO: 120594 - protein, 146 aa, Glycine max
  Coding DNA Sequence Number=SeqID_28909
GLGNYPFSYLADLCLVPNIVIPPKFKVPDFDKYKDNLAGAIVAWYTNLEASQIRSWKDLATAFIRQEMITIMVDTLPTFYYEKLIGYMPANFADLVFAGERIESGLRKGNLNMLPMWPPTTTEDTPVVGARKRKEMPMRSPPPQHG

SEQ ID NO: 120595 - protein, 113 aa, Glycine max
  Coding DNA Sequence Number=SeqID_28910
MASMMEAMLGMKRLMESNVATATTTSMAAEADPALSTVAQHPVPNIVGRGRSTLGHVNNPHLGYNRGAYLYGLPPNYTPLAMHEDAGHVTPFILEGEPPQHPDGVHEDPQEHT

SEQ ID NO: 120596 - protein, 271 aa, Glycine max
  Coding DNA Sequence Number=SeqID_28911
YQGSVWRKGQRPWQIKANGLSFIDILALLIFGVVLFPNMEGLVDLAAIDAFLAFHHGKESPVVAILAMILSSCEGCPMRGVPSDESITPFIAQGFSDHNARTVRDDEVKASEESDEVQALKAELERAWVVEREVQESSRVKGMILKDELKACLRSKRNLSQQLSKTEGNMWAIIDECKEKLNLATTHEQRLEDEYAKISAESEARERVIDSWHQEATMWTDRFALTSNRSQELPRPASQSQSNGGHLLHPQGDPRTSQLLSAYDRLNGPYD

SEQ ID NO: 120597 - protein, 360 aa, Glycine max
  Coding DNA Sequence Number=SeqID_28912
  Homolog annotation: Hit_ID=Q6WAY4; Match level="QueryCoverage=77%, HitCoverage=59%, E-value=2e-27, Identity=28%"; Hit description =Putative uncharacterized protein
MGTNQNGKRFYQVKIKGLDVTSLKELGRLMEPLQRQAFRKVYEKILDLTTAKVFTEAIVSLAQYYDQPLRCFTLGDFQIVPTVEEFEEILGCPLVGKKLYLFSGFLPSLSKIVAMIRDSARELDCMKQTRNDVVGLPRKYLEGKARDMASQEEWVLFADILALLIFGVVLFPNVDGARRTTHGLSAAYPFFVCVDWDQYLAGIGGSTINWFPRWKEGKEGVLFSCEDYPNVPLIGTRGCINYNLALAIRQLGYPMRGAPTEESLSPFLLRDFGAQSFKIVQRVHKAWENPLRKDKELRGIRNGIIGASEEDEEVQALKSELGKARLTKEKFKLVATDIRKECAGLREENAATARALERET

SEQ ID NO: 120598 - protein, 74 aa, Glycine max
  Coding DNA Sequence Number=SeqID_28913
MASYGGELLLDSSLLEVASPLSLPFSIPLPFIFQEAKESIDEEDPRPTSSNGAYIMWYQEHLHLGSMVPTLYQS

SEQ ID NO: 120599 - protein, 129 aa, Glycine max
  Coding DNA Sequence Number=SeqID_28914
MEETHGMPYHNLADFEPWLGYATEGQAVGGIPFENTLEGPQFRPQPQPLHFAVGRAPPAMAEKGKADHLEERLRAIEGGCNYRTFAKRGTDLSKNTPLKVEGSGGPGGTPNDGKGDDDRDGRDIIDTLL

SEQ ID NO: 120600 - protein, 239 aa, Glycine max
  Coding DNA Sequence Number=SeqID_28915
MSPIVVITLCKSLSEELRDYYEGRHRSHLRPHSHRREKERKPQDVNINLPYFHRKDNVEANLVWEIRVEQQLKKKSTSKSYGSHSYPKKDQGQGILGVTPSKPKDDKGKTIEKQAPKAMVKEKCKEVSISSKRLAKKETHYTIKTNIKEAFPLRQPPHFLFCKKTLASISIPLGLEFIPQVKKLLDEGLVRKSLNPCALLVPKIGIVRHQVPKIGGMMNVLNGATLFCKITCAPNIFME

SEQ ID NO: 120601 - protein, 107 aa, Glycine max
  Coding DNA Sequence Number=SeqID_28916
MKNGGKSSRNRPRKREKKEVVAAQLAQASWVAPTRRHRLLLEHPGRPKTLRIAQQCFLSTFGMSRNSMDCLKMGVKYLEAVKRGSHAIKQWSPDEIRRRVKSCPCSG

SEQ ID NO: 120602 - protein, 92 aa, Glycine max
  Coding DNA Sequence Number=SeqID_28917
  Subcellular localization annotation: CTP_CleavageSite=73; ConfidenceScore=5.14e-01
MALSYFVTIFATYHFCAFFVHLVVRHFASQVINAQRQILRPLSFKSSKLSDKRAETNVFCALCHSGAASSDKRAETNYGHSAPFVIQISQVK

SEQ ID NO: 120603 - protein, 364 aa, Glycine max
  Coding DNA Sequence Number=SeqID_28918
  Gene Ontology: Mol. function=oxidoreductase activity, acting on NADH or NADPH; Cellular component=membrane; Biological process=ATP synthesis coupled electron transport
  Homolog annotation: Hit_ID=A8GH11; Match level="QueryCoverage=100%, HitCoverage=40%, E-value=1e-139, Identity=67%"; Hit description=NADH- quinone oxidoreductase
  Pfam annotation: Domain name=Molydop_binding; Domain location=258 -363; Score=-1.5; E_value=0.0043; Accession=PF01568.12; Description =Molydopterin dinucleotide binding domain
MGGQSLDSALEQLDKGEAEALVVLENDLYRHAPKATVDAALHNTAHVIVVDHQRTATLEKAGLVLSTASFAESDGTSINHEGRAQRFFQVYDPAYYDDSVVMLESWRWLHSLHSAVESRQIDWTQLDHVIDAAIVALPQLKGIKDAAPDASFRIRGQKLARSPHRASGRTAARANISVHEPRQPQDKDTMFAFSMEGNNQPSAPRSQIPFAWAPGWNSPQAWNKFQAEVGGKLRHGDPGVRLFEASESALDWFSQVPARFVGGSQYRVAPYYQLFGSEEMTQRSPTFQKRMAPATLVINPADAEKLGVNNGASVELVCAAPTLRLPVRFSAALQAGQVGLPLGMPGVPPFLAGAQIDKLQEAAQ

SEQ ID NO: 120604 - protein, 58 aa, Glycine max
  Coding DNA Sequence Number=SeqID_28919
MVQYKLKELEMELMRLNQHEENDKKKKGITLKALSSIQEESDKEDLNEIEEMMILVSS

SEQ ID NO: 120605 - protein, 119 aa, Glycine max
  Coding DNA Sequence Number=SeqID_28920
MAGAGDNGGVYHQLDRFQRLLLDTMTTQMQRLLKRNNEELYRRIKGLKHQMNPNVGRPYGGNRRVNDGSNRIEGKDRIEGVKLNVSSFKGRCDPDAYYLTWEMKIQHAFSYNDYPEEQK

SEQ ID NO: 120606 - protein, 388 aa, Glycine max
  Coding DNA Sequence Number=SeqID_28921
  Homolog annotation: Hit_ID=Q84VH5; Match level="QueryCoverage=99%, HitCoverage=61%, E-value=1e-163, Identity=73%"; Hit description =Envelope-like protein
SWSPAVPSSTKAPSIQEQPEFHIQPIQMIPGQAPVPEKLVPKRQQGVKISENPSIATSPREVDPEMDKKIRSIVSSILKDASVPDAGEDVPTSSTPNVSVPDVDKDVPTSSAPNAEALPSPSEEESTEEEDQATKKTPAPRAPEPAPGDLIDLEEVESDEESIANKLAPGIAARLQSRKGKTPIKRSGRIKTMAQKKSTPITPTTSRRSKVAIPSKKRKEISSSDSDDDVELDVSTSTEGQEIWEKELGRDALDCKETMDLIKAAGLMKTVTKLGDCYEGLVREFIVNIPSDITNRKSDDYQKVFVRGKCVRFSPAVINKYLGRPTDGVIDIAVSEHQIAKEITAKQVQHWPKKGKLSAGKLSVKYAILHRIGAANWVPTNHTSTVAT

SEQ ID NO: 120607 - protein, 32 aa, Glycine max
  Coding DNA Sequence Number=SeqID_28922
MDTRLRVIGDPMNGVQRIQAQGRVGALPLIRT

SEQ ID NO: 120608 - protein, 110 aa, Glycine max
  Coding DNA Sequence Number=SeqID_28923
MTRGNPSDLQPFDPEIDRTFHRLVRHHFIPFDHSEHSITGESVHSVIGDFEHPDLEHYNFEHSDSEHSDFAPSEHMAQPPPRERTLREMAAPDFTYESLCIQYPDEDVPY

SEQ ID NO: 120609 - protein, 59 aa, Glycine max
  Coding DNA Sequence Number=SeqID_28924
MGVPFLFPCAYHWGSFIVVGGNIGGIFELAFSQSGLDSFSGEDEAIQCGLNKAKRVATR

SEQ ID NO: 120610 - protein, 105 aa, Glycine max
  Coding DNA Sequence Number=SeqID_28925
MLLTFMLRQSLYATGNRSVESVASLSSEPRIKVLSPCPLGVCLSKERARSHVIGLVLLITWRPAKTALQLVSSCAPSFQYPFAVFVTAVRVGAQAVAAARLAALE

SEQ ID NO: 120611 - protein, 73 aa, Glycine max
  Coding DNA Sequence Number=SeqID_28926
HLTETSMRARNSDVCGFPKPQSIQRSGQSQFESESYMKNWMQNSKRDVYLGAYLNGALKGLDDTPQPKSKAGA

SEQ ID NO: 120612 - protein, 103 aa, Glycine max
  Coding DNA Sequence Number=SeqID_28927
  Homolog annotation: Hit_ID=Q51617; Match level="QueryCoverage=38%, HitCoverage=57%, E-value=1e-11, Identity=85%"; Hit description =Putative uncharacterized protein
  Subcellular localization annotation: CTP_CleavageSite=44; ConfidenceScore=5.31e-01
VSRGPFVSRVSVITVKTSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 120613 - protein, 287 aa, Glycine max
  Coding DNA Sequence Number=SeqID_28928
MRGAPTEESMSPFLVRDFGAQNSKTIPRIHKAWETPLRKDQELRGVRNGIIGGYHEWLKVRIRGLDWLAKLKVVSEENFEAPEEDEEVQALKSELGKAKLAKEKFKLAATHPLNKRPRGLARKSMAGTNFAGALWGSNNELKLRREERDQSRAHSMVLKEELIACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 120614 - protein, 139 aa, Glycine max
  Coding DNA Sequence Number=SeqID_28929
ATLPEGRKADRYPVSGRFGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLLFLNNLTACHEYT

SEQ ID NO: 120615 - protein, 134 aa, Glycine max
  Coding DNA Sequence Number=SeqID_28930
MGDLEEVQEQMKADMSALKEQMASMMEAMLGMKQLMESNTATVVAVSSAAEADPTLPTSTHHPIPNMVGRERSTPGHISNPHLGYNRGTYPYGLPPNYTPPVIREDTGHVPPLILEEEPSRHRDEVHEDHQEHA

SEQ ID NO: 120616 - protein, 204 aa, Glycine max
  Coding DNA Sequence Number=SeqID_28931
MRGAPSEETIVPFIARGFNGANTKILQKIHKAWNKVGKKDKELRGRSNGVIGGYHKWLESRMQGIAWLKKLKGLNREEAKVLKENEEVQALKAELEKTKVAKGKLKVVVTRVRKECDRLKDINMSVAEALEHEMKKARKEDWSRNKFWGALLGSSNELKLRKAERDKSMMENVMLEDKVKELSEVKGKFEREIEQDGREYVDNH

SEQ ID NO: 120617 - protein, 416 aa, Glycine max
  Coding DNA Sequence Number=SeqID_28932
  Homolog annotation: Hit_ID=A5B5G7; Match level="QueryCoverage=48%, HitCoverage=14%, E-value=4e-12, Identity=28%"; Hit description =Putative uncharacterized protein
GFSQAPCRAYTRGSVNWDTSRFTSEIAWHRYQDNIQLRNILPERNVELGPGMFDEFLQELRRRRWDQVLTHLPEKRIDVALVKEFYSNLYDPEDHSPRFCRVRGQVVRFDADTINDFLDTPVILEDGEEYTAYTRYLSTHPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALIAALCDIQGVVSDTLIFESLSPAINLAYVKKNCWNPADPSITFPGPRRTRTRASASASEAPLPTQSPSQPSQRPRHPPASTSASMDMHGQMLRSLHVGQQLIMENMHRLSLHLQMDPPLTTPEAYRQRVAWPGDQPSTDRGEEPSGATEDPAVDEDLIADLATADWGPWADLGGGS

SEQ ID NO: 120618 - protein, 211 aa, Glycine max
  Coding DNA Sequence Number=SeqID_28933
  Homolog annotation: Hit_ID=Q6UUU1; Match level="QueryCoverage=34%, HitCoverage=50%, E-value=2e-19, Identity=70%"; Hit description =Putative uncharacterized protein
GLHVLAIRWLHALTFKGLHVLAFVGLHALTFRGLHVLAFIGLHALTFRGLHVLSFRGLHILALTFRGLHVLSFRGLHALTFRGLHASSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGRRFPGDARKILNR

SEQ ID NO: 120619 - protein, 42 aa, Glycine max
  Coding DNA Sequence Number=SeqID_28934
MTVDVGQERLPIEMNGSGMENGRETEETPLQEEDESRRSSPP

SEQ ID NO: 120620 - protein, 207 aa, Glycine max
  Coding DNA Sequence Number=SeqID_28935
  Subcellular localization annotation: CTP_CleavageSite=41; ConfidenceScore=5.43e-01
MRGANTFLKRKYNSLIWNILYNRFPLVFPTFSTNKRWWRLRAFSSFGRRTREPRLARPQKELKRFNLHKCLTNLQEGSIDVAVVKELYANLYSSEDQSPKQVRVRGHLIRIDADSLNSFLETPIVLEEGETLPTYSRFSRMRIDPQEWAAHLCIPGRGFVLNAGGHPWKLLRKDLTTLAQTWSVLSYSNPTPTSHTSDLNMDRASLV

SEQ ID NO: 120621 - protein, 112 aa, Glycine max
  Coding DNA Sequence Number=SeqID_28936
MAILCVILKLEWAMAPKKLSAKRARKATAGEGSSATPQAKIEFVGHHFRSKEHQRHFKAIKDWSFLKERWVQLAEGEYTEFQAEVARRHWTQLTEPMAKYDLEIVMEFYGNA

SEQ ID NO: 120622 - protein, 101 aa, Glycine max
  Coding DNA Sequence Number=SeqID_28937
  Homolog annotation: Hit_ID=A5AJ42; Match level="QueryCoverage=42%, HitCoverage=4%, E-value=6e-10, Identity=72%"; Hit description =Putative uncharacterized protein
VTEACKGFLGPDGDWPSSAKAEGSLTARPTRRAGTKVGLSDPTADLPQELTSTGRFGTSMSDIRHLERRVTFGSIYGVGVRARAGPFHFMRGPRGMHVVSA

SEQ ID NO: 120623 - protein, 183 aa, Glycine max
  Coding DNA Sequence Number=SeqID_28938
  Homolog annotation: Hit_ID=A6H595; Match level="QueryCoverage=38%, HitCoverage=80%, E-value=5e-28, Identity=85%"; Hit description =Putative 23S ribosomal RNA
MLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPMSRRLIGSGLVKGNHRSRSESESSQGKLSLLYGPEPGSEPTDVEESADELWLGVKCHSNPELAGSPRNALRRSS

SEQ ID NO: 120624 - protein, 31 aa, Glycine max
  Coding DNA Sequence Number=SeqID_28939
MLAMIGDGEGVDVGTGDGPHASTKDGDGVDA

SEQ ID NO: 120625 - protein, 57 aa, Glycine max
  Coding DNA Sequence Number=SeqID_28940
MTKCKCKDPLEGLGGPMTRARARKSKEALQQVLSILFEYKPKFQGEKSKVVNGIKLF

SEQ ID NO: 120626 - protein, 81 aa, Glycine max
  Coding DNA Sequence Number=SeqID_28941
MRSFNGGFPPWRCSRRQRRRGERRHHPLGNKPWKKELHHQDEPWIRSLERMLQWRKRKREKKERGGGGGSTKFEGRKRERS

SEQ ID NO: 120627 - protein, 107 aa, Glycine max
  Coding DNA Sequence Number=SeqID_28942
MTSIPHMENGQGEDITFRGCGGTLTLSVATYPSAGGRRVTRGMRVPRKEYARSRHQRLFEENVGKTGKDAIYELFSERFGSCIYAQGRVFPFAPTYSSIWDEKIRPT

SEQ ID NO: 120628 - protein, 67 aa, Glycine max
  Coding DNA Sequence Number=SeqID_28943
MVKAHQKGVRKTNEMKMKARETRKKREVVVAQLAQASWVASTRRHRLLLEPPRRPKWAWLLFARPFY

SEQ ID NO: 120629 - protein, 296 aa, Glycine max
  Coding DNA Sequence Number=SeqID_28944
MIHSEVHGISMIIDQSLFFSLTKLPCQGAPFEGTIIDDWKFDYSSHDARRMVCNDQADMTGRLLVGSLTFDYRIMHYIIVRILLPRSSNLAQASEEDLILMWAFFTGRQIDWAHLVRDRMLKALRANAPLPYPQLVTLFLHHFQIPLDDEPFVQVKRSIAISVSAVTSFGYCKDRDGQWLKKDAQPLQDERTPSPPPQRDDSSALINEVLSELRGLRTYVSERFDSLDGRFEGMDTCITQLEEDELNCHHQKEGDCRSKSKDFDYDVLMMPCGHALLKFNSRQKSKKYKIHHQEDL

SEQ ID NO: 120630 - protein, 51 aa, Glycine max
  Coding DNA Sequence Number=SeqID_28945
MGASHHRTPELGWVFIVDLGMAFVDNWVVGKEKGCYWLSNDIVGLVGNLVV

SEQ ID NO: 120631 - protein, 126 aa, Glycine max
  Coding DNA Sequence Number=SeqID_28946
SEQESARGSFQGETPGIFIVLSGFATSDLSVDFCDARQGDGAYGKTPATRPFYADTARRSRTTERSESVSEEAEERPIRKPPLPAPDNNFTQETAMTMITNSSSVPIVVVVVMVYSVCTVGARAYE

SEQ ID NO: 120632 - protein, 252 aa, Glycine max
  Coding DNA Sequence Number=SeqID_28947
  Homolog annotation: Hit_ID=Q6WAY6; Match level="QueryCoverage=41%, HitCoverage=18%, E-value=2e-12, Identity=34%"; Hit description =Putative uncharacterized protein
DWDQHLAGIGGSAINWFPRWKEGKEGVLFSCGDYPNIPLIGTRGCINYNPALAIRQLGYPMRGAPTEESLSPFLVRNLGAQSLKAIQRVHKAWRSPLRKDKELRGIRNGVIGVIDEEDFEAPEEDEEVRALKLELGKARLAKEKFKSVATHIRKECTELQEENTATTKALEQETKRARKEEYGREKFRGALWGSNNELKLRREERDRSRVHDMILKEELVACARSKRGLAQHLEAMEQSMLAIIGQYKEELN

SEQ ID NO: 120633 - protein, 63 aa, Glycine max
  Coding DNA Sequence Number=SeqID_28948
MSVKNLVERLGVHDKTNHTINAPTMWDRNMLRGALKLGVFTPKAYTLKSPSGPLPPDSGPTQK

SEQ ID NO: 120634 - protein, 182 aa, Glycine max
  Coding DNA Sequence Number=SeqID_28949
MDVKITLILHHEGRFTPRASDGKVEYIGGEFDVWEDISADYMNTFILCDLVQAYPILEEVPLMLDLKCHPIPEASNEDDLDDVPVAGHEEDVGGGEKVINVDVGGGEERDVGGGEEKDVGNPDDEDDNDEDEWFIDFSCMRKEVEVEYETDGYHSEELKNPISSDDEDEDVHKVYPQYNESS

SEQ ID NO: 120635 - protein, 128 aa, Glycine max
  Coding DNA Sequence Number=SeqID_28950
  Subcellular localization annotation: CTP_CleavageSite=29; ConfidenceScore=5.30e-01
MDMNVGGPRKARGKRSEVPTTSAPKTPVPSSSTASLPPTQIPIIPPVPLQIPLTAPLSAEHPQGQSIIMQSLQGLGLPSIMSMEEFDAQVACPRDQPSSFGGGRASAAQEPPAPTPPAAAEEEETTPD

SEQ ID NO: 120636 - protein, 139 aa, Glycine max
  Coding DNA Sequence Number=SeqID_28951
  Homolog annotation: Hit_ID=UPI0000ECBAF8; Match level="QueryCoverage =29%, HitCoverage=48%, E-value=1e-16, Identity=100%"; Hit description= UPI0000ECBAF8 related cluster
GETPGIFIVLSGFATSDLSVDFCDARQGDGAYGKTPATRPLYGSWPFAGLLLTCSFLRYPLILWITVLPPLSELIPLAAAERPSAASMQAWHWPSFYNVVTGKTLALPNLIALQHIPLSPAGVIAKRPAPIALPNSCAA

SEQ ID NO: 120637 - protein, 127 aa, Glycine max
  Coding DNA Sequence Number=SeqID_28952
MRSLKNFQTGCGHAFLVFNWETGKSWNDPKFPWRAQCNALVLTLQLGLGFRVLSLLRSDDESCEGTNTEDPAIDFEREANRPEVEEDEAMEFPPELERMVAQEDREMKPHQEETEVVNLGVGNEKKE

SEQ ID NO: 120638 - protein, 72 aa, Glycine max
  Coding DNA Sequence Number=SeqID_28953
  Gene Ontology: Biological process=transposition, DNA-mediated
  Homolog annotation: Hit_ID=Q1J7G7; Match level="QueryCoverage=47%, HitCoverage=48%, E-value=7e-12, Identity=97%"; Hit description =Transposase
MVKVGTLTCRSTSHFAKKLAQGFPVLQWLLFLSAVPPVQLLTGWCVTAKAPPDISAGKCSGHAARNHHTRRA

SEQ ID NO: 120639 - protein, 148 aa, Glycine max
  Coding DNA Sequence Number=SeqID_28954
  Gene Ontology: Mol. function=aspartic-type endopeptidase activity; Biological process=DNA integration
  Homolog annotation: Hit_ID=A5AEB7; Match level="QueryCoverage=91%, HitCoverage=13%, E-value=8e-45, Identity=56%"; Hit description =Putative uncharacterized protein
MDIDYAIRKDEPPAITDESSPADVALYEWWERSNRLSVMFIKTKISAGICGSIDQHEKFQDLLKAIDDWFIPSDKALASTLIMKFSSFWLTSVKEYGSFKISYNTHKDKWSINELMTMCVHEEERLVMKMSESALLTTACGKNKAVKS

SEQ ID NO: 120640 - protein, 68 aa, Glycine max
  Coding DNA Sequence Number=SeqID_28955
  Subcellular localization annotation: CTP_CleavageSite=41; ConfidenceScore=5.27e-01
MILQKIRRPNSLKIVPSGVTNCRNLPFGGRATRGSRERLPREEGARSRHQRLFEENVEKTGKGVVYEL

SEQ ID NO: 120641 - protein, 131 aa, Glycine max
  Coding DNA Sequence Number=SeqID_28956
MGLCQSYGVPVAPSKVIWPSISRAFIEKYCTPRQAQGQAPQQPKEDQQLVADAPLPPQEEVPSLRSISDRLQRIELQMHRYMHHVTSQQAANHRGQRHLNETFYRYNLHQQSQDPSPFHWPTPKQFEATVA

SEQ ID NO: 120642 - protein, 180 aa, Glycine max
  Coding DNA Sequence Number=SeqID_28957
PRDRQEHVQRVAGVLEHRGAEVDAQQIAGLALLVARGDAHRTHLFAVPVQLLIGAGHAGAAIELEVLQPGVIARFALRQVVGQIGNLVGGQIVDHHFRIREKQRRDAVGDRAQKFELRRRVRHAGGSPYSPVWFAVQPLSIPQLPPLAEWMALASPSPTAAPQAPLLSLPGIGHPSVSGE

SEQ ID NO: 120643 - protein, 180 aa, Glycine max
  Coding DNA Sequence Number=SeqID_28958
  Homolog annotation: Hit_ID=Q2QUR6; Match level="QueryCoverage=26%, HitCoverage=4%, E-value=3e-07, Identity=56%"; Hit description =Retrotransposon protein, putative, Ty3-gypsy subclass
MAGAGDNGGVYHQLDAMTTQMQRLLNRNKEELYRRIVKSSLFTLKPLSPREVCDDQIRMREKREQEKENKASEVRKVLPAHEPLYLQGIEHQVDLLPGASLPNRPTYESNPQETQRKDAHAKVEYVKGLYDQVKVQIAKKNDSYAKQANKKRKEVVLESGDDPRHLRANVYQEGGTDEQS

SEQ ID NO: 120644 - protein, 38 aa, Glycine max
  Coding DNA Sequence Number=SeqID_28959
TRTSCNRLQGLVIDYRSNKPSGNRLQDVVIDYRLPVLV

SEQ ID NO: 120645 - protein, 162 aa, Glycine max
  Coding DNA Sequence Number=SeqID_28960
  Homolog annotation: Hit_ID=A7QZ64; Match level="QueryCoverage=59%, HitCoverage=25%, E-value=3e-30, Identity=62%"; Hit description =Chromosome undetermined scaffold_265, whole genome shotgun sequence
  Pfam annotation: Domain name=DUF821; Domain location=5-156; Score= -201.0; E_value=9.6e-09; Accession=PF05686.3; Description=Arabidopsis thaliana protein of unknown function (DUF821)
MFMKIKIGMLVYLPSIGFENHKRGSTNQTCQVNALIDIRCTLKVLFGQSVKNTFCHVTLPLYVYDYMFHLLNSYAKLFRYKPSISANATELCVESMVCGAEGSVKKFMMESLVKVPANTDPCTMPAPFDPPTLYATLERKESSIQQVESWEKSYWDNQTITS

SEQ ID NO: 120646 - protein, 304 aa, Glycine max
  Coding DNA Sequence Number=SeqID_28961
MRGAPTEESLSPFLVRDLGAQGLKVIQRIHKAWRSPLRKDKELRGIRNGVIGGYHGWLRIHTRGLGWLSKLKVVDEEKLEAPEEDEEVRALKSELGKARLAKEKFKSAATHIRKECTELQEENAATARALEQETKRSRKEEHGREKFRGALWGSNNELKLRRDERDRSRVHGMILKEELVACARSKRSLAQHLEATEQSMLAIIGQYKEELNQSMAHEQKLVEDFAQVYAEKEARGRVIDALHQEATMWMDRFALTLNGSQDLPRLLAKAKAMAEVCTGPKEIHGLINYCQHMIDLMAHIIRNR

SEQ ID NO: 120647 - protein, 118 aa, Glycine max
  Coding DNA Sequence Number=SeqID_28962
MAGAGDNGGVYHQLDGSQRLLLDPMTIQMQRLLNRNKEELYMQIVKSSLFTLKPLSPREVCDAQIRMREKREQEKENSEAPQRNRKKKSDTPEGKSDTHKRESDTHERKFNYYAEASE

SEQ ID NO: 120648 - protein, 403 aa, Glycine max
  Coding DNA Sequence Number=SeqID_28963
  Gene Ontology: Mol. function=ribonuclease activity; Cellular component=ribosome; Biological process=RNA metabolic process
  Homolog annotation: Hit_ID=A7MM96; Match level="QueryCoverage=81%, HitCoverage=39%, E-value=1e-166, Identity=88%"; Hit description =Putative uncharacterized protein
  Pfam annotation: Domain name=HTH_12; Domain location=97-160; Score =78.7; E_value=1.9e-20; Accession=PF08461.1; Description=Ribonuclease R winged-helix domain
  Pfam annotation: Domain name=OB_RNB; Domain location=162-219; Score =105.2; E_value=2e-28; Accession=PF08206.2; Description=Ribonuclease B OB domain
  Pfam annotation: Domain name=OB_RNB; Domain location=229-288; Score =18.3; E_value=0.00012; Accession=PF08206.2; Description=Ribonuclease B OB domain
  Pfam annotation: Domain name=Rrf2; Domain location=1-145; Score=47.7; E_value=4.1e-11; Accession=PF02082.11; Description=Transcriptional regulator
  Pfam module annotation: Pfam domain module=HTH_12::OB_RNB::OB _RNB::Rrf2; Domain location=97-160::162-219::229-288::1-145
MASLPDGKMTSISEVTEVYGVSRNHMVKIINQLSRAGYVAAVRGKNGGIRLGKPAQSIRVGDVKISTGADNGGTDMSHDPFQEREAEKYANPIPSREFIIEHLTKREKPANREELAVELNIEGEEQTEALRRRLRAMERDGQLVFTRRQCYALPERLDLLKGTVIGHRDGFGFLRVEGRKDDLYLSSEQMKMCIHGDQILAQPLGADRKGRREARVVRVLVPKTSQIVGRYFTDAGVGFVVPDDSRLSFDILIPPEEVMGARMGFVVVVELTQRPTRRTKAVGKIVEVLGDNMGTTMAVDMALRTHEIPYIWPKAVEEQIESLREEVPEESKVGRVDLRSLPLVTIDGEDARDFDDAVYCEKKRGGGWRLWVAIADVSYYVRPHTPLDNEARSRGTSVYFPSQ

SEQ ID NO: 120649 - protein, 78 aa, Glycine max
  Coding DNA Sequence Number=SeqID_28964
PHSNKKKLARAFITRCIVGTKQGVPSVVELTILAAVSLLQPILWREGDAGLTGASFMGGKCVESPPTFIREKRWKNRK

SEQ ID NO: 120650 - protein, 124 aa, Glycine max
  Coding DNA Sequence Number=SeqID_28965
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=65%, E-value=2e-33, Identity=100%"; Hit description=LacZ protein
MTFSHLGRNITLHADAPPSLSPASAHQLGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 120651 - protein, 368 aa, Glycine max
  Coding DNA Sequence Number=SeqID_28966
  Gene Ontology: Mol. function=coproporphyrinogen oxidase activity; Cellular component=cytoplasm; Biological process=porphyrin biosynthetic process
  Homolog annotation: Hit_ID=A9CIV7; Match level="QueryCoverage=95%, HitCoverage=77%, E-value=0.0, Identity=91%"; Hit description=Oxygen -independent coproporphyrinogen III oxidase
  Pfam annotation: Domain name=HemN_C; Domain location=306-368; Score =3.8; E_value=0.00028; Accession=PF06969.7; Description=HemN C -terminal region
  Pfam annotation: Domain name=Radical_SAM; Domain location=50-224; Score=89.0; E_value=1.5e-23; Accession=PF04055.12; Description =Radical SAM superfamily
  Pfam module annotation: Pfam domain module=HemN_C::Radical_SAM; Domain location=306-368::50-224
MNTELLHKYSGAVPRYTSYPTAPHFHEGIDNGTYRRWLGALGHRNRLSLYLHIPYCDRLCWFCACHTKHTLKYEPIAVYLEALKQEIEAVGALVSPDAVVGAVHFGGGSPTMLKPEDMQSLMDCLRRHFTFGLAPEISVEMDPNDLDDSRYDALAAIGMSRASLGVQDFDDKVQKTINRIQSFEQTRSVVDAVRARGVHSVNCDILYGLPFQTCETLKRTVDQIVSLAPDRIALFGYAHVPWMKKHQSLIPEHALPDVAERYRQMTMAGEMLRQAGYSQIGIDHFARPTDTLSQAAEAGALRRNFQGYTTDTADALIGLGASSIGRLPQGYVQNMVATGEYQRMVGEGGLCRRERHLSCRRTIICALM

SEQ ID NO: 120652 - protein, 30 aa, Glycine max
  Coding DNA Sequence Number=SeqID_28967
MPCKYGMAPKKLSTKRSRKDATGEGFSATS

SEQ ID NO: 120653 - protein, 114 aa, Glycine max
  Coding DNA Sequence Number=SeqID_28968
MTGPLDGPIACFLIKVDPWVLVPITFRGPYVIAIRGLHILACRGLHALAFRGLRVLIFSVLHTHTLEEYKGSRPQDAQWARRSPTGPWGFQLWLRASVSPTGCSFPQRGHAIVT

SEQ ID NO: 120654 - protein, 169 aa, Glycine max
  Coding DNA Sequence Number=SeqID_28969
  Subcellular localization annotation: CTP_CleavageSite=32; ConfidenceScore=5.66e-01
MATPPSSPHPPPKSAAPSSSTLKKTRKATWLRSLATRSVGVERLVVHVDPTTGKVDDVKESDDDKVCGNYNISKEKWNQFCQSHRDPSWEDIQKKAQAFQKQNTAPHVLSRGVMIIQKKNSLEEQASRGSFVAHGHQDVLTTVIGRPKHPGHVRATGANVTIKQYFGLA

SEQ ID NO: 120655 - protein, 131 aa, Glycine max
  Coding DNA Sequence Number=SeqID_28970
MKVMRIMKLAKYRLKAQVEKDEGPEAETLSRLLIVAEGPSNPCGVYPDLSSFTGSGVYPDLSSFTGSGVYPDLSSFTGSGVYPDLSSFTGSGVIQKLYSLYQVIRPVRFTSSGIRASALDTGSILSYYFSL

SEQ ID NO: 120656 - protein, 16 aa, Glycine max
  Coding DNA Sequence Number=SeqID_28971
MSRNSNGHNTSYRCPI

SEQ ID NO: 120657 - protein, 192 aa, Glycine max
  Coding DNA Sequence Number=SeqID_28972
MTSRDQVWSFCTHDTRRYLMVIRTLLSSRGGGPDDKQRPSLVILHPVMIRGDTLWLFAPFCHPEAAGPMTSRDQVWSFCTHDTQRYLTVIAPFCHPEAAGPMTSRDQVWSFCTLYHPEAGPMIRGDTLRLSAPFCHPEAAGPMTSRDQIWSFCTLVSSRGGGPDDTRKYPSGYPYKHSFAICKTERLIACRG

SEQ ID NO: 120658 - protein, 92 aa, Glycine max
  Coding DNA Sequence Number=SeqID_28973
MDKDQWMYNSVMFEEVDMSEQNEGEAGVKSEHVDCFDVFNTSHVFATHDDVLNWAQAITYETGFVVVIMRSDTNTSMRGRTLFVLIGCESSG

SEQ ID NO: 120659 - protein, 1091 aa, Glycine max
  Coding DNA Sequence Number=SeqID_28974
  Gene Ontology: Mol. function=pyridoxal phosphate binding; Cellular component=cytoplasm; Biological process=amino acid metabolic process
  Homolog annotation: Hit_ID=B0J9P8; Match level="QueryCoverage=40%, HitCoverage=94%, E-value=1e-167, Identity=67%"; Hit description =Cystathionine gamma-synthase
  Pfam annotation: Domain name=Aminotran_1_2; Domain location=227-605; Score=-94.1; E_value=0.014; Accession=PF00155.12; Description =Aminotransferase class I and II
  Pfam annotation: Domain name=Beta_elim_lyase; Domain location=231 -512; Score=-111.4; E_value=0.004; Accession=PF01212.12; Description =Beta-eliminating lyase
  Pfam annotation: Domain name=Cys_Met_Meta_PP; Domain location=191 -597; Score=386.4; E_value=4.5e-113; Accession=PF01053.11; Description=CysMet metabolism PLP-dependent enzyme
  Pfam module annotation: Pfam domain module=Aminotran_1_2::Beta_elim _lyase::Cys_Met_Meta_PP; Domain location=227-605::231-512::191-597
MAVALCVIDTEADHELIRNGKADKLDRHLNFTTLRLIQQRADRQRFWLTQLQNFTHFAQGVTGVDDVFDDQHIFAANVFIEIFEDFHVARGGHAAAVAGGGHEVDFVRDINGAAQVSHKHEGAAQQADQHHFAAAVAVVLADLLAQFGNTGCDLLLRDHHVDASCPLSLEIPMAASSGKKTQIGTRELHPETQMLNYGYDPRLSEGAVKPPVFLTSTFVFNSAEEGKEFFDFVAGRQQPPAGKSGGLVYSRFNHPNSEIVEDRLAIYEGAESAALFSSGMSAIATTLLTFARPGEVILHSQPLYGGTETLLSKTLHDLEIKAVGFSDGNDENKVYEAAKLAWQRGRVAMILIETPANPTNSLVDIQLMRQVAEVITQQQGSRPILACDNTLLGPLFQRPLQHGADISLYSLTKYVGGHSDLIAGAALGSRALINKVRSLRSAIGTQLDPHSSWMIGRSLETLSLRMEKAASNAEQVAAFLRDHAQVAKLHWLPYLDASSPAGETWQRQCSGAGSTFSFDIEGGQAAAFRFLNALALFKLAVSLGGTESLASHPASTTHSGVPQEVRERIGITDATVRLSIGIEHADDLIEDIRLTLEAAMAVRHIGIFSIGDVVEAHQHFTAPAVDADHIFPAGAMRRRRLAVLGQNTELRAVNVERMQHGVAFAGDGPFFIFAQRHGKHGLFHDCPDPSPYRRAPYCHDPSRHGPCSCCRDPSLCPRRAGYPSLWHRSAAAAPACPADPAADPSSAAASGSAALPLPAAAAHPPVGPAAYRWPSRAAAESAPAAAADRTAPAIHQHFKALARQQRQALHLHRFSQQATVARHHVQRTFIAGGDVQRARVAAVEQAQAQPAARHRVLRIRHAVGQHQIAKPAHGGAHDIQLIIDTRAVLSELLILENQRHIIFAPLHRQPQLAGRLIFQQYQPCQPLRHLIAGFAMLMRMEPAGRRRLIGGKTHLTRGAGRNQRLRTAIHRAGNFQPVPVQRGGFRQAIMNIDGDAFLTLQPQRRAEQATVVTPGWDGFAVPLAAAGHGGQRVLAVCIGLQQRRDGQQRARSGHQRATPEGQRAGCTEGGGQLEKMTTLHIHILIVNRGTA

SEQ ID NO: 120660 - protein, 492 aa, Glycine max
  Coding DNA Sequence Number=SeqID_28975
  Gene Ontology: Mol. function=adenosylmethionine decarboxylase activity; Cellular component=cytoplasm; Biological process =spermidine biosynthetic process
  Homolog annotation: Hit_ID=Q1C3U7; Match level="QueryCoverage=50%, HitCoverage=84%, E-value=1e-122, Identity=82%"; Hit description =Spermidine synthase
  Pfam annotation: Domain name=AdoMet_dc; Domain location=261-392; Score=272.3; E_value=1e-78; Accession=PF02675.6; Description=S -adenosylmethionine decarboxylase
  Pfam annotation: Domain name=Methyltransf_12; Domain location=82-188; Score=12.6; E_value=0.03; Accession=PF08242.3; Description =Methyltransferase domain
  Pfam annotation: Domain name=Spermine_synth; Domain location=6-249; Score=419.6; E_value=4.5e-123; Accession=PF01564.8; Description =Sperminespermidine synthase
  Pfam module annotation: Pfam domain module=AdoMet_dc::Methyltransf _12::Spermine_synth; Domain location=261-392::82-188::6-249
MAEKETWHETLHSGFGQYFSVDNLLYRDKTAHQDLVIFENAAFGRVMALDGVVQTTERDEFIYHEMMTHVPILAHGNARRVLIIGGGDGAMLREVARHQRVEHITMVEIDAGVVNFCQTYLPNHSAGAYDDPRLQLVIDDGVNFVSQTQERFDVIISDCTDPIGPGESLFTSAFYAGCKQALNPGGVFVAQNGVCFLQQDEAVNSHRKLSHYFADVSFYQAAIPTYYGGIMTFAWASDNPALRQPDLATLHEAERDGYIAYIDEQYNANRLTEILTETCSIIGANVLNIARQDYEPQGASVTILVSEEPINPQDIDNSEHPGPLPSSVVAHLDKSHICVHTYPESHPEGGLCTFRADIEVSTCGVISPLKALNYLIHQLESDIVTVDYRVRGFTRDVNGVKHFIDHEINSIQNFMSEDMKAMYDMVDVNVYQENIFHTKMLLKEFDLKYYLFNTKPEELSPQEHKRITNLLWKEMREIYYGRNIPATGLKLL

SEQ ID NO: 120661 - protein, 303 aa, Glycine max
  Coding DNA Sequence Number=SeqID_28976
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=Q65EJ6; Match level="QueryCoverage=65%, HitCoverage=62%, E-value=2e-50, Identity=51%"; Hit description =Putative uncharacterized protein
  Pfam annotation: Domain name=2-Hacid_dh_C; Domain location=102-267; Score=241.6; E_value=1.8e-69; Accession=PF02826.10; Description=D -isomer specific 2-hydroxyacid dehydr
  Pfam annotation: Domain name=DHDPS; Domain location=4-239; Score= -109.5; E_value=0.00028; Accession=PF00701.13; Description =Dihydrodipicolinate synthetase family
  Pfam annotation: Domain name=NAD_binding_2; Domain location=127-247; Score=-89.3; E_value=0.084; Accession=PF03446.6; Description=NAD binding domain of 6-phosphogluconate dehydrogenase
  Pfam module annotation: Pfam domain module=2-Hacid_dh_C::DHDPS::NAD _binding_2; Domain location=102-267::4-239::127-247
MSNNIQGVLTAIVTTFDRDGAYNPAAQREQIRRQLSAGNGIFCGGTNGEFFVLNEQEKLAVTETCVDEVNGTAPVVAHIGEISTPGNRAHAGSASPNTSPDWLEITTAAIETRAGHWPRIFATDVYGKTLGIIGLGNIGKQVALRAKGFNMRILAFDFYPDDAFAAEHGVTFVSLDQLTEHSDFITLHMPLTDQTQNLFDAARLKRMKKSAFLINASRGGVVNEQDLYQALQDNVIAGAAADVFVQEPLAQHPLFTLSNFIPTAHLAGYTDGAISAIGERCVTQIVQCIKQGERPMNVMNGLA

SEQ ID NO: 120662 - protein, 32 aa, Glycine max
  Coding DNA Sequence Number=SeqID_28977
  Homolog annotation: Hit_ID=A8GID8; Match level="QueryCoverage=100%, HitCoverage=3%, E-value=2e-08, Identity=93%"; Hit description=Outer membrane protein assembly factor yaeT precursor
MAMKKLLIASLLFSSATVYGADDFVVKDIHFE

SEQ ID NO: 120663 - protein, 239 aa, Glycine max
  Coding DNA Sequence Number=SeqID_28978
  Gene Ontology: Mol. function=structural constituent of ribosome; Cellular component=ribonucleoprotein complex; Biological process =translation
  Homolog annotation: Hit_ID=Q83SL4; Match level="QueryCoverage=95%, HitCoverage=95%, E-value=1e-122, Identity=95%"; Hit description=30S ribosomal protein S2
  Pfam annotation: Domain name=Ribosomal_S2; Domain location=9-225; Score=441.9; E_value=8.7e-130; Accession=PF00318.11; Description =Ribosomal protein S2
MATVSMRDMLKAGVHFGHQTRYWNPKMKPFIFGARNKVHIINLEKTVPMFNEALAELNKISSRKGKILFVGTKRAAAEAVKESALSCDQFFVNHRWLGGMLTNWKTVRQSIKRLKDLETQSQDGTFDKLTKKEALMRARELAKLENSLGGIKDMGGLPDALFVVDADHEHIAIKEANNLGIPVFAIVDTNSDPDGVDFVIPGNDDAIRAVSLYLTAVATTVREGRSQDLAEQAEEAAEA

SEQ ID NO: 120664 - protein, 305 aa, Glycine max
  Coding DNA Sequence Number=SeqID_28979
  Gene Ontology: Mol. function=2,3,4,5-tetrahydropyridine-2,6 -dicarboxylate N-succinyltransferase activity; Cellular component =cytoplasm; Biological process=lysine biosynthetic process via diaminopimelate
  Homolog annotation: Hit_ID=A4W6R1; Match level="QueryCoverage=48%, HitCoverage=54%, E-value=5e-64, Identity=82%"; Hit description=2,3,4, 5-tetrahydropyridine-2,6-dicarboxylate N-succinyltransferase
  Pfam annotation: Domain name=Hexapep; Domain location=21-38; Score =5.3; E_value=34; Accession=PF00132.15; Description=Bacterial transferase hexapeptide (three rep
  Pfam annotation: Domain name=Hexapep; Domain location=39-56; Score =13.3; E_value=0.92; Accession=PF00132.15; Description=Bacterial transferase hexapeptide (three rep
  Pfam annotation: Domain name=Hexapep; Domain location=65-82; Score =11.4; E_value=3.5; Accession=PF00132.15; Description=Bacterial transferase hexapeptide (three rep
  Pfam annotation: Domain name=Hexapep; Domain location=83-100; Score =14.4; E_value=0.42; Accession=PF00132.15; Description=Bacterial transferase hexapeptide (three rep
  Pfam module annotation: Pfam domain module=Hexapep::Hexapep::Hexapep:: Hexapep; Domain location=21-38::39-56::65-82::83-100
VRQGAFIARNTVLMPSYVNIGAYVDEGTMVDTWATVGSCAQIGKNVHLSGGVGIGGVLEPLQANPTIIEDNCFIGARSEIVEGVIVEEGSVISMGVYIGQSTKIYDRETGEVHYGRVPAGSVVVSGNLPSKDGSYSLYCALIKYAVSVRFVALITQPNDDDNPARSLTLRWNINAMYDNLKSLGISNPEDIDRYSLRQEANNDILKIYFRKDKGEFFAKSVKFKYPRQRKTVVADHTTQGYKEIQEISPNLRYVIDELDQICQRDQVEVDLKRKILADLRHLENVVSNKIAEIESDLDQLTRNGR

SEQ ID NO: 120665 - protein, 471 aa, Glycine max
  Coding DNA Sequence Number=SeqID_28980
  Gene Ontology: Mol. function=hydrolase activity, acting on glycosyl bonds; Cellular component=membrane; Biological process=nucleoside catabolic process
  Homolog annotation: Hit_ID=A7MGS5; Match level="QueryCoverage=42%, HitCoverage=87%, E-value=4e-83, Identity=77%"; Hit description =Putative uncharacterized protein
  Pfam annotation: Domain name=PNP_UDP_1; Domain location=1-215; Score =272.3; E_value=9.8e-79; Accession=PF01048.11; Description =Phosphorylase family
  Pfam annotation: Domain name=Peripla_BP_2; Domain location=223-442; Score=83.5; E_value=6.7e-22; Accession=PF01497.9; Description =Periplasmic binding protein
  Pfam module annotation: Pfam domain module=PNP_UDP_1::Peripla_BP_2; Domain location=1-215::223-442
MEQEVTLLRDKIENRQTLTLAGCEIYTGTLNGVEVALLKSGIGKTAAALGTTLLLELCKPDLVINTGSAGGLAPTLQVGDIVVSDEVRYHDADVTAFGYEPGQMAGCPAAFVADSALIAAAEQVIKQLDLNAVRGLVVSGDAFINGAAPLERIRSTFPQAIAVEMEATAIGHVCHQFKVPFVVVRAISDVADKASHLSFEDWRVAKYLLLGLWLLCHSLLAAPRVITLSPHLTELAFAAGITPVAVSAWSDYPAAARQLEQVANWQGIRVERIVQLRPDVVLAWRGGNPLRQVEQLQRLGIHVEWIDPQSLDQMIDALAALQRWSPQPQRATAAAQALHQQLQTLRQRYQQQTPVPLFLQFGQQPLFTAARSTLQNEVITLCGGRNIFADSSVSWPQVSREQVLMRHPQAIVTGGDASRAASVARFWQPQLNVPVIALNDDWLSRPGPRLMLAAKQLCEALHPTKNKALPD

SEQ ID NO: 120666 - protein, 296 aa, Glycine max
  Coding DNA Sequence Number=SeqID_28981
MADHVRGSADAVRRGGAGGRQRVADALDLVGRGQAGRDGRAHRARHHVRADLAHATFAQQVDRADLPLAGAATGTGDQAGTQIADLIGAEPGIGDGIAHGQIGEGRCIAHEALLLAVDQRVQVEVDAAADLAAQARFGVVARAVDFAVIHVHARVRLGHHQLAVDDTADIDLVAHQLGVRQHLAGELHFATAQRAALAGGAQPGQEEAGQLPHGIQAQASGHHGVADEVAAEEPQVRADIQFGAYHAFSMRSAVLADVGDAVEHQHRIVGQTAGGGAEQFTACAGQQLFAVERVET

SEQ ID NO: 120667 - protein, 124 aa, Glycine max
  Coding DNA Sequence Number=SeqID_28982
TVSTAFSRCDSGLRKTLKQLTSRQRRACHLLAEPLSSAFINPEVLCKAQGKTPGMMIVMSLYAGLIYQALMTMDGKNVTDGMVFIAAITGGQCTITGGSCGDSGAAWTPPGRAQQYGRCRRDAG

SEQ ID NO: 120668 - protein, 400 aa, Glycine max
  Coding DNA Sequence Number=SeqID_28983
  Gene Ontology: Mol. function=nucleoside-triphosphatase activity; Cellular component=chloroplast
  Homolog annotation: Hit_ID=Q2PMM5; Match level="QueryCoverage=100%, HitCoverage=17%, E-value=0.0, Identity=99%"; Hit description=Protein ycf2
MNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMYAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLKERSILCWDPSFLQTERTEIESERFPKILSGYSSMCRLFMEREKQMNNHLLPQEIEEFLGNPARATRSFFSDRWSELHLSSNPTE

SEQ ID NO: 120669 - protein, 63 aa, Glycine max
  Coding DNA Sequence Number=SeqID_28984
MRASGNRLPRGCNRLPGLERGLEHCGGLCGYETYCAAAQLDSCERVYPFLFFLVDRDGGAANP

SEQ ID NO: 120670 - protein, 158 aa, Glycine max
  Coding DNA Sequence Number=SeqID_28985
GQNPSTHKEEPVGTNITRRLVGTEQVVPFVVKLMRQANAFPLTITLKKFISWGIKRGKGTLKEGFQVSSKVLIINKDSGGHTLATSSIKTKMGQLAKQIADKSSNSFGANTENNPKEECKAVMTRSKRFVEAEDEENEVDKEQLSEKTGVEVKKNDVK

SEQ ID NO: 120671 - protein, 88 aa, Glycine max
  Coding DNA Sequence Number=SeqID_28986
MTRNATCACHGGAPGHSIEHCMTPKHKENRLLNPNIDKQHHTWGNSGSCCYDSSGLMQSYPARALGRRLKVDWARDPREGPRVLMSLR

SEQ ID NO: 120672 - protein, 72 aa, Glycine max
  Coding DNA Sequence Number=SeqID_28987
  Subcellular localization annotation: CTP_CleavageSite=36; ConfidenceScore=5.01e-01
MGARDKSIMHKRFMQKPLLTASRSLTIKDHTLTGLRLMHSFTINLTNQLTFSVIILIPCFFSSNNCMLMQGI

SEQ ID NO: 120673 - protein, 114 aa, Glycine max
  Coding DNA Sequence Number=SeqID_28988
  Pfam annotation: Domain name=G-patch; Domain location=2-41; Score =19.5; E_value=0.00083; Accession=PF01585.14; Description=G-patch domain
MARVMLGNGYEPGRGLGKDYGGITSLINAKGNRGKYGLGYKPTQADYKEKHRGKEERSNEESLEGTNTWDPPINFKQETNQTEDEGNEDVGLPPELERIVAHEDQEMGPHQEET

SEQ ID NO: 120674 - protein, 197 aa, Glycine max
  Coding DNA Sequence Number=SeqID_28989
TSVVIEEGESLPSYSRFCRWRPDPQALAAYLCIPRSGFELNADWLLLKILRKNLTTLAHTWSVLSFSNLASTSHTLDITLDRAKLIYGLVMQMNMNLGSLISELLESRARGSKAPSTLAPPTSAPSTLAPSTSPLPPPPTAPVLPGPSAQSLEPASAPAPDHAEFAGCGPAAASYERRGVSSKHGLARSPAFSFGRG

SEQ ID NO: 120675 - protein, 98 aa, Glycine max
  Coding DNA Sequence Number=SeqID_28990
  Homolog annotation: Hit_ID=A2Q1D6; Match level="QueryCoverage=89%, HitCoverage=13%, E-value=3e-08, Identity=37%"; Hit description =Ovarian tumour, otubain, related
MKKNVVFDNREDVLRWARSVLHENGFVVVIIRSDTNTGSRGRTSFVLIDCERSDEYRCRKKEFVRRDTRTRKCGCPFKLHGKPIVGGQGWMVKLMWDS

SEQ ID NO: 120676 - protein, 141 aa, Glycine max
  Coding DNA Sequence Number=SeqID_28991
LEDELAPVISRGFNKTNVGTLQKVRKAWEVLQKKDKGLDWLPSLRTAKREEVEASEEDEEVQALRAELEQAQTVKERFKSAVLKIRKETTELRDVNVATAKALKRENKRACREEHGQNKFRGALWGSTSKLKLRREERDQS

SEQ ID NO: 120677 - protein, 306 aa, Glycine max
  Coding DNA Sequence Number=SeqID_28992
  Homolog annotation: Hit_ID=Q6WAY6; Match level="QueryCoverage=83%, HitCoverage=41%, E-value=1e-16, Identity=28%"; Hit description =Putative uncharacterized protein
MTPSTEDVKRVMQGLSVVLQLFIYEKGRANWDQLLASKEGASVNWFPRWKEGRTGVLISCRGFPNVPLMGTRGCISYNPVLAIRQLGYPMRGAPLEEEIVPVISRGFNKTNVETLQKVCKAWEVLQKKDKELRGSNNGPIGGYHKWLKAHVQGLDWLPSLRTAKREEDEAPKEDEEVHALRTELKQTQMVKERFKSAALNIRKENAELRDVNMATTKALEQETKRAHWEEHGRNKFRGALWGSNSELKLRREERDQSRVDSLILKDELKACSRSKRSLSQRLCETETNMLAIITKYQEELSLATAH

SEQ ID NO: 120678 - protein, 99 aa, Glycine max
  Coding DNA Sequence Number=SeqID_28993
QKNVYTDNHSGISARQRDSKVSMTDLLSAEDDVNLRVSTGLSAAIDEGCRMTIICLCVPSDTTVSEWQKGPPPLDDKRRRMTIICLCVPSDMTVSGWRK

SEQ ID NO: 120679 - protein, 404 aa, Glycine max
  Coding DNA Sequence Number=SeqID_28994
  Homolog annotation: Hit_ID=Q6WAY6; Match level="QueryCoverage=72%, HitCoverage=60%, E-value=2e-31, Identity=28%"; Hit description =Putative uncharacterized protein
ELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARGLDRIKQTRNGIAGLPWRYLEDKARGMANQGDWVPFMDVLALLIFGVVLFPNVDGLVDLAAIDAFLAYHHSKESPVVAVLADLFDTFDRRRIDWDQLLAEIGGYPNIPLIGTRGCMNYNPALAIRQLGYPMRGAPMEESMSPFLVRDFGAQNFKAIQAIHKAWETPLRKDQELRGIRNGIIGWYHEWLKVHIRGLDWLAKLKVISEESFEAPAEDEEVQALKSELGKAKLAKEKFKLAATHIRKECAGLQEENATTARALEQETKRARKEEYGRPNLRGALWGSNNELKLRREERDQSRAHSMVVKE

SEQ ID NO: 120680 - protein, 80 aa, Glycine max
  Coding DNA Sequence Number=SeqID_28995
MSHHSSSVNGEGTTHKNPLSRILDELSSLKLWKEKLERKEKGKERKDIGHILDLTPIGEKKKESLKRLTLTSHTSMGRIM

SEQ ID NO: 120681 - protein, 70 aa, Glycine max
  Coding DNA Sequence Number=SeqID_28996
MLVRMIRTRLFAAARVKSCPGMHSSCVIASLSGCAHTVGPPPISGGGPGTIKRKLLMWSTLKMRTRSPLK

SEQ ID NO: 120682 - protein, 130 aa, Glycine max
  Coding DNA Sequence Number=SeqID_28997
MPLRDRIASVDLNILDGVEMKLLGLTRQPSIGKFICNGVDYTFDLLGRLIFLLMLRLVFVSLLVMPLSPSVLCYVPPSINIMVFVLMLLCPPAFGSIYFGSGGSGGGSFMGTSVLKASSRIVVQLVVRGV

SEQ ID NO: 120683 - protein, 155 aa, Glycine max
  Coding DNA Sequence Number=SeqID_28998
  Pfam annotation: Domain name=zf-CCHC; Domain location=74-91; Score =29.8; E_value=1e-05; Accession=PF00098.14; Description=Zinc knuckle
MAAGNTTIEKPREEWSEEERRLVQYNLKAKNIITFALGMNEYFRVSNCKSAKDMKSKKQNFKSKRRTEESSQIPKCFECNQPGHLRADCPIFKKKIEKSEKKTIGDKKAKKAYITWDDNDLESSDDSEKEMVNLCLMGKDYESDEEVTSSNKSIL

SEQ ID NO: 120684 - protein, 72 aa, Glycine max
  Coding DNA Sequence Number=SeqID_28999
  Gene Ontology: Mol. function=translation release factor activity, codon specific; Cellular component=cytoplasm; Biological process =translational termination
  Homolog annotation: Hit_ID=A4C1T6; Match level="QueryCoverage=87%, HitCoverage=17%, E-value=5e-15, Identity=58%"; Hit description =Peptide chain release factor RF-2
MGSEKTPIIEDLHKYLQIEKKKIEISNDDEKTAAPEFWDHPKEAEAFLKQLRSKKRWVEDYQEIATQFEDLQ

SEQ ID NO: 120685 - protein, 198 aa, Glycine max
  Coding DNA Sequence Number=SeqID_29000
  Homolog annotation: Hit_ID=Q84VI1; Match level="QueryCoverage=100%, HitCoverage=26%, E-value=5e-56, Identity=63%"; Hit description =Envelope-like protein
MDKKIRSIVSSILKDASVPDAEKDVPTSSTPDVAVPEADEDVPTSSTPNVSVPDVEKDVPTSSAPNAEALPSPSEEESTEEEDQATEKTPAPRAPEPAPGDLIDLEEVESDEEPIANKLAPGIADRLQSRKEKTPIKRSGRIKTMAQKKSTPITPTSSRRSKVTIPSKKRKEISSSDSDDDVELDVSTSKRAKKSGRK

SEQ ID NO: 120686 - protein, 286 aa, Glycine max
  Coding DNA Sequence Number=SeqID_29001
MEESMSPFLVRDFGAQNFKAIQRIHKAWETLLRKDQELRGIRNGIIGGYHEWLKVRIRGLDWLAKLKVVSEESFEAPEEDEEVQALKSELGKAKLAKEKFKLAATYIRKECAGLREENATTARALVQEAKRARKEEYGRYKFRGALWGSNNELKLRREERDQSRAHSMVLLSQRLCETVTNMLAIIAKYQEELGLATAHEHRIADEYAQVYAEKEARGRVIDSLHQEATMWMDRFALTLNGSQELPRLLAKAKAMADTYSAPEEIHGLLGYCQHMIDLMAHMIRNR

SEQ ID NO: 120687 - protein, 74 aa, Glycine max
  Coding DNA Sequence Number=SeqID_29002
MMIGCGITWMLWKLGRIDGDLALRGTRIRATWEYVSSVGGGQQGMVGLVVPRDMSRGSGDLGDIRWGAIAQNQA

SEQ ID NO: 120688 - protein, 63 aa, Glycine max
  Coding DNA Sequence Number=SeqID_29003
MQEGAGSARSGHAGGNHHPYWWFAFGEGIASLASVTLSEQLTAGAKRGVKHEGAETVTRTKPS

SEQ ID NO: 120689 - protein, 22 aa, Glycine max
  Coding DNA Sequence Number=SeqID_29004
MPLKDSTETRRLSERRGVGWAV

SEQ ID NO: 120690 - protein, 129 aa, Glycine max
  Coding DNA Sequence Number=SeqID_29005
MTVAVSRKPPSKPDPEVDDPLYLMTLTIPELFLRPYQVTWDATLFGVFNSDFPLYIKHEDLSEIAHGGQCLSISVLQLWILHLTDTSMRAGILISMDSSSHSPFREFKMRGLSWSLPKWRTLADGDHPT

SEQ ID NO: 120691 - protein, 85 aa, Glycine max
  Coding DNA Sequence Number=SeqID_29006
MTIEESIHVSFNESNVISPRKDVLDDVSDFLEEMHTHERDSKRKRDESNKDFQDYETKANNDLPKEWKASRIHFLDNIISNISKE

SEQ ID NO: 120692 - protein, 93 aa, Glycine max
  Coding DNA Sequence Number=SeqID_29007
VDSRGSPGPSGEGRRPKWRRTKAQVEKDKAPEWRRTYQGNPCGVYPDLSSFIGSGVYPDLSSFTGSGVYPDLSSFTGSGVIQTFVAFIKRSAP

SEQ ID NO: 120693 - protein, 34 aa, Glycine max
  Coding DNA Sequence Number=SeqID_29008
MKKYEKSHKLAGNWKEDWCHPLKNLSPEARGQPP

SEQ ID NO: 120694 - protein, 360 aa, Glycine max
  Coding DNA Sequence Number=SeqID_29009
  Gene Ontology: Mol. function=hydrolase activity, hydrolyzing O -glycosyl compounds; Cellular component=cytoplasm; Biological process= carbohydrate metabolic process
  Homolog annotation: Hit_ID=A8GKU9; Match level="QueryCoverage=63%, HitCoverage=34%, E-value=1e-108, Identity=82%"; Hit description =Glycogen debranching enzyme GlgX
VLGRTPGFDRDAPLFQAMLADDVLSRCKLIAEPWDVGPGGYQVGAFPGRFAEWNDHYRDDMRRFWLQSGVSLGQFARRFAASSDLYNQRGRAPYATVNMLTAHDGFTLQDVVSFNEKHNQPNGEGNRDGSDRNFSNNHGVEGLVADDAIVQRRRASQRAMLATLLLSQGTPMLLAGDEQGHSQQGNNNAYCQDNAITWLDWATADDALTDYVAALIALRRQIPALQQDRWAAARRAAVGARRSAHADPAVAALAAAGQRHAANGGDEVAGRRLAGCRPVHSGRLTGGVTRLAPGRALALRSALILAGGRGSRLKDLTSTRAKPAVHFGGKFRIIDFALSNCLNSGIRRIGVITQYQSHTL

SEQ ID NO: 120695 - protein, 137 aa, Glycine max
  Coding DNA Sequence Number=SeqID_29010
  Homolog annotation: Hit_ID=Q6WAY6; Match level="QueryCoverage=62%, HitCoverage=15%, E-value=6e-07, Identity=35%"; Hit description =Putative uncharacterized protein
MGTRGCINYNHVLAIRQVGYPMRGAPLEEDLTPIIARGFNSTNAEALQKVRKAWEMVQKKDKEFRGSSNGPIGGYHRWLKAYMQGLDWLPNLRTTKGVEVEAPEEDEEVQALRTELEKAQTVKEKFKSTALRIRKEN

SEQ ID NO: 120696 - protein, 97 aa, Glycine max
  Coding DNA Sequence Number=SeqID_29011
MAKFDPKVVLELYANAWPTEEGVRDMRSWVRGRPGVRVQSEEEQGRRVRRGGHCPAIVHTRAGFRPDCCREAGADHAHQHDHLDPDMDDIAAQQCLA

SEQ ID NO: 120697 - protein, 79 aa, Glycine max
  Coding DNA Sequence Number=SeqID_29012
MALANFLFPEGNSMKHEIELQRLNQNEIEEANVCLMTKNHESDEEEPLKKKWYIDNGFSKHMTRDASKFTTISPKKSGH

SEQ ID NO: 120698 - protein, 116 aa, Glycine max
  Coding DNA Sequence Number=SeqID_29013
MATNKNLTCLETFGNGTSMSIPYMEKDQGEFRLCRLSRGVIQFGSTSSPAMTSLMSMVSAWSVFWMMMVLRMMLADVAPCGACRPWIFFINGFLFFLRSDCSKMEKEKDEWRCHFK

SEQ ID NO: 120699 - protein, 112 aa, Glycine max
  Coding DNA Sequence Number=SeqID_29014
MVNESGVIVLLGHLVEAKLPEILILGTDVVQDVTTSRFRTCRLYMTGNIKVAHKTLKSQNSQNNSSISDLVENSCSLHVYIAVCVSGLQQLALDKIYHSPEKSALKDLKDKV

SEQ ID NO: 120700 - protein, 201 aa, Glycine max
  Coding DNA Sequence Number=SeqID_29015
  Homolog annotation: Hit_ID=Q6WAY6; Match level="QueryCoverage=79%, HitCoverage=25%, E-value=1e-18, Identity=38%"; Hit description =Putative uncharacterized protein
MGWLEYQENVWRQKQESWQGVLFPNVDGLVDLAAIDAFLVYHDRKESPIVAILADLYDTFDRRCEKSSTRIVCCTPALYVWLVSHLFRQEVSHACPLESHRSCTEKRGANWDRLLASKEGASVNWFPRWKEGRIGILTSCGGFPNFPLMGTRGCISYNPVLAIRQLGYHMRGAPLEEELAPIIARGFNKTNVEALQKVRKA

SEQ ID NO: 120701 - protein, 86 aa, Glycine max
  Coding DNA Sequence Number=SeqID_29016
MGGANSNFDILKLGLREYFRSWIASGGSNPARLGELGGNLLPLFPINRLKGAVLRVSDPPGDVSVSKYVKDFLRYSPFFIRSSFFN

SEQ ID NO: 120702 - protein, 98 aa, Glycine max
  Coding DNA Sequence Number=SeqID_29017
MKGITGAPYRARCDALTITDVSWLPYTEHRGFRAFEVISSFQARPERVVRRFGYIQSIPPSPVSANYMEWFFRISHSFMIPTQAGDQPRDAPAADPEE

SEQ ID NO: 120703 - protein, 151 aa, Glycine max
  Coding DNA Sequence Number=SeqID_29018
MLNTPPPPTTQDASRDNIWSLDTKYRNRIVVWDFYQQEPFTRLLKQENGPTLTNPLLITGRLKADLVLLKERALSIPSWPAPVLSYSIRKLMILEQVTSISNPPEVMLNRKVIKKCHSTIAIDRTFTIALPEWNGSSLLSPNPCAFKNKPI

SEQ ID NO: 120704 - protein, 224 aa, Glycine max
  Coding DNA Sequence Number=SeqID_29019
MGEAEEVQEKMKADMEAMKEQMATMIEAMMSMKKIMEANAVIVAATSAVAKVNPMLPSGLKQMNHPTSNMHAFPPYGLPPKLYTTNVVYIPNEDVNNSTPILIKSQQPQSDHAHVSRPMEETHEIPHHDLANFEPCLGYAAEGQAVGGIPFENTLEGPQFRPQPQPLHFAVGRAPPAMAEKGKADHLKERLRAIEGGEDCAFANLEELFLIPKHGHSQVQGAGP

SEQ ID NO: 120705 - protein, 106 aa, Glycine max
  Coding DNA Sequence Number=SeqID_29020
MQSSQRDVYLGAYLNGFHYNGHWQMVVILPKEHLVVWFCSLHNRPDNYLKGIINSALKGLDDAPQPKSKASARWIVVKMSTIILGTFRNNWEAYFNDPRPLEPKRL

SEQ ID NO: 120706 - protein, 194 aa, Glycine max
  Coding DNA Sequence Number=SeqID_29021
MGSSQKPSLKKRFYQVKIKSLEVTSLRELGQLMGQLHGKPSAKPMDFQLVPTVKEFEEIWDAHWEEGSHIFSLGSIPPRQELPRPWQIKANGLSFIDILALLIFGVVVFPNMEGLVDLAAIDAFLAFHHGKESPVVAILAMYDTPVYPLQGHRSCVEKGKANWDKLLASMEGRLLIGSLARRKEESGFYLHAKD

SEQ ID NO: 120707 - protein, 230 aa, Glycine max
  Coding DNA Sequence Number=SeqID_29022
MTTLTQIWMTLLLSNIQPSDHNSDLPLPKCQLVYVILTRMSIHVAQLIADAIYLFAGMAPTRHPLDPDKSNRALGFPALITGLCQSFGVPVAPSKVIRPPITRAFIEKYCTQRQVQGDAPQAADMPPPHQAGLDGPFDSEQYLRHVVRQQAANHRAHVQTHDCLYQLSLSLQSQGFTSFPCPTPDQFRAEVAWPGDWSEAPAEAPDEADEAREDEEMTDLLDFLGGSGAT

SEQ ID NO: 120708 - protein, 174 aa, Glycine max
  Coding DNA Sequence Number=SeqID_29023
  Gene Ontology: Mol. function=NAD(P)+ transhydrogenase (B-specific) activity; Cellular component=cytoplasm; Biological process=cell redox homeostasis
  Homolog annotation: Hit_ID=A8GL77; Match level="QueryCoverage=100%, HitCoverage=37%, E-value=4e-94, Identity=99%"; Hit description =Soluble pyridine nucleotide transhydrogenase (EC 1.6.1.1) (STH) (NAD(P)(+) transhydrogenase [B-specific])
MSDSLSYHFWNNGVVIRHNEEFEKIEGTEDGVIVHLKSGKKVKADCLLYANGRTGNTDSLGLENVGLESDSRGLLKVNSMYQTALSHIYAVGDVIGYPSLASAAYDQGRIAAQAIASGEASGHLIEDIPTGIYTIPEISSVGKTEQELTAMKVPYEVGRAQFKHLARAQIAGMN

SEQ ID NO: 120709 - protein, 73 aa, Glycine max
  Coding DNA Sequence Number=SeqID_29024
MYDGQLVRSSMDRTWTDQAGPCEQLDALSPFNPLSEMWQKEKESMDRPHRLHPVGTTRSPQGRLRHPGVADRP

SEQ ID NO: 120710 - protein, 242 aa, Glycine max
  Coding DNA Sequence Number=SeqID_29025
  Homolog annotation: Hit_ID=Q2HS67; Match level="QueryCoverage=94%, HitCoverage=60%, E-value=2e-16, Identity=31%"; Hit description =Cyclin-like F-box; F-box protein interaction domain
  Pfam annotation: Domain name=FBA_1; Domain location=74-220; Score= -52.2; E_value=0.1; Accession=PF07734.4; Description=F-box associated
  Subcellular localization annotation: CTP_CleavageSite=34; ConfidenceScore=5.10e-01
MPGYHLLGSSNGFHFGFSEIPEVYRVCFWNNSTRVISRESSTLSFSPGIGRRTMFGWRNLKGFPVLWTLPEVGGVYLSGTINWVVIKGKETIHSEIVIISVDLEKETCRSLFLPDDFCFFDTNIGVFRDSLCVWQDSNTHLCLWQMRKFGDDKSWIQLINFSYLHLNICPYEEKSMILPLCMSNNGDFFMLKFTRNADDEYQTILYNQRDCKSQVSVAPSGSFRTLLWRNHKLFTKSLVIPY

SEQ ID NO: 120711 - protein, 85 aa, Glycine max
  Coding DNA Sequence Number=SeqID_29026
  Homolog annotation: Hit_ID=A6FJQ2; Match level="QueryCoverage=44%, HitCoverage=84%, E-value=2e-11, Identity=92%"; Hit description=50S ribosomal protein L5
MTVETSDTFSSLRRSQLVCKRMPGADKPMRKEKIPHQAPFAIQAAQLLGRAIGAGLFAITPAGERGMCCKAIKLGNARVFPVTTL

SEQ ID NO: 120712 - protein, 124 aa, Glycine max
  Coding DNA Sequence Number=SeqID_29027
MILKDELKACLRSKRNLSRQLSKTEGNMWAIIDEYKEKLNLAATHEQRLEDEYTKISAEREARERVINSLHRGAMVWMDRFAFTLNGSQELPRLLAKAKAMADVYSAPEEIHGLLNYCQHMIDL

SEQ ID NO: 120713 - protein, 202 aa, Glycine max
  Coding DNA Sequence Number=SeqID_29028
  Homolog annotation: Hit_ID=A5BSR3; Match level="QueryCoverage=71%, HitCoverage=46%, E-value=6e-12, Identity=32%"; Hit description =Putative uncharacterized protein
QFKSDLTRKWALAVHQDGVEDTVCDKYGISKEKWAQFCQTRRNPSWEQKLLAEKTKKKMQEAAQSGSVDGVIDPPSPIRRHVKWKMVCTKKTGEMTTKAAKEIAEKIDSFEEQATQGSFIPHGRPDVLAAAIGRPEHPGRVRAAGAGVTIKQYFGSAPWTSRSASSLPPDELQQLTQQIRDQLEESITEKVTRQIMASFSHL

SEQ ID NO: 120714 - protein, 161 aa, Glycine max
  Coding DNA Sequence Number=SeqID_29029
  Homolog annotation: Hit_ID=A5B939; Match level="QueryCoverage=47%, HitCoverage=54%, E-value=2e-23, Identity=67%"; Hit description =Putative uncharacterized protein
TGEARLIALCARTPKGNRVKFLNRLPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 120715 - protein, 162 aa, Glycine max
  Coding DNA Sequence Number=SeqID_29030
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=13%, E-value=9e-82, Identity=89%"; Hit description=NBS -LRR type disease resistance protein Rps1-k-1
MPRGMSKLNHLQHLDFFVVGKHEENGIKELGGLSNLRGQLEIRNLENVSQSDEALEARIIDKKHINDLWLEWSGCNNNSTNFQLEIDVLCKLQPHFNIESLQIEGYKGTRFPDWMGNSSYCNMTRLTLSDCDNCSMLPSLGQLPSLKVLEISGLNRLKTIDA

SEQ ID NO: 120716 - protein, 56 aa, Glycine max
  Coding DNA Sequence Number=SeqID_29031
MGARDKSIMHKSPWHAHSNPVQECLMMNPKEGAGLTLVQMTQAEKKTCPALQWKAL

SEQ ID NO: 120717 - protein, 145 aa, Glycine max
  Coding DNA Sequence Number=SeqID_29032
MGKGGLADEGRGGASTLKGEEFCYARLDEIVDAVAVDEDDNLMVQRAQKTKCLWRRSAFHGVQTYLRDQRGGDYETTCHRSGSTTPIHGRLPSPPLVNGESKNCAGHDGGPASYLPGVVRDRSPEEEKEGAELELPGEVPKSTLG

SEQ ID NO: 120718 - protein, 108 aa, Glycine max
  Coding DNA Sequence Number=SeqID_29033
MTIRGLGLNGLDDIYSPHGERPRGGHDIQRMWWGIDIIRECLTFVALSLTWTQQSISMGEGSSSHLLVGAVVRDNLPWQTISADDLFLNEPDHHTPRDIGIGAPRPNW

SEQ ID NO: 120719 - protein, 208 aa, Glycine max
  Coding DNA Sequence Number=SeqID_29034
MVSGNRLPRGVIDYQALKTRSGSHEGFLVIDYQGSVIDYQALERGTGTLWSPLRDGSLVIDYQIVMAAQLIRDRVEMECLEGAWETLEGNTRCRFRGTIRFTATSLVHPDEPTRTLQHTVEWILPTPTPYRLVEPVQVIEVTSSEEDPEEDLEELPLEPAMDALDFLEGDEDPLLEVDSPEEVMSASEVDSMEDSGPGEMAISGGSST

SEQ ID NO: 120720 - protein, 109 aa, Glycine max
  Coding DNA Sequence Number=SeqID_29035
MGRNPPIKKLLEFATIPMSYRDLLLSLIANLLAVVTPGMIYQSPLPKWYNPNATCVYHGGTPGHSVAMHGPQAQGPELNQGGMVDIPRRRAKCKDKPAHQPWRIGCKCN

SEQ ID NO: 120721 - protein, 107 aa, Glycine max
  Coding DNA Sequence Number=SeqID_29036
  Homolog annotation: Hit_ID=A5BFN6; Match level="QueryCoverage=53%, HitCoverage=11%, E-value=2e-08, Identity=39%"; Hit description =Putative uncharacterized protein
MPSFYKEKTKKFHDSMIIKKDFMVGQKVLLYNSKLGLMSVEIKSDSTKKSFKVNGHQLKPFLTNPSLVGRSGGRDFLTPPYSSFYHDLRSFSFLSPSLLLLHLSDSI

SEQ ID NO: 120722 - protein, 254 aa, Glycine max
  Coding DNA Sequence Number=SeqID_29037
  Gene Ontology: Mol. function=sugar:hydrogen symporter activity; Cellular component=integral to membrane; Biological process =carbohydrate transport
  Homolog annotation: Hit_ID=Q1WEL4; Match level="QueryCoverage=99%, HitCoverage=85%, E-value=7e-47, Identity=36%"; Hit description=Sugar transporter intracellular portion
  Pfam annotation: Domain name=BPD_transp_1; Domain location=64-250; Score=1.8; E_value=0.0061; Accession=PF00528.13; Description=Binding- protein-dependent transport s
MTTLQIAFFSFLVIAGVGPILWLAKAALSTTQDTISEPFAWFPSGVQWGNLAAAWEQIQVGRYLANTAVMALGSTVATVLVTASLAYVISILRPRWAPILSGAILVTLFVPGVISLVPLYLTVVDLPIVGGSIVDTYWAVWLPAAANAFAVLVVTRFFDEIPREIIEAARVDGVGPFRMFFAIVLPFSKSILGVIAVLTILNSWKDFLWPMLVLPSSELQPISVALARIAGKTDLSLQMSAMLLGLLIPIAVFL

SEQ ID NO: 120723 - protein, 69 aa, Glycine max
  Coding DNA Sequence Number=SeqID_29038
MDKSLKEGENEWREREKRSTKFCASNKPWPEIYPKAHRTLGPLLHLWHNLLGVFYSIPLRGRIASFPPP

SEQ ID NO: 120724 - protein, 86 aa, Glycine max
  Coding DNA Sequence Number=SeqID_29039
MGEGCCTQPYPCICKEAVSGFEPMTNKSPRHNFTAAPGLALKKNCFREENPSRGVSVMLSRRFRDQIREGFPSFFTVLHPFFVLQR

SEQ ID NO: 120725 - protein, 309 aa, Glycine max
  Coding DNA Sequence Number=SeqID_29040
MAKFDPEIVLEFYANAWPTEEGVHDMRSWVRGQWIPFDADAIGQLLGYPLVLEEGQECEYGQRRNRFDGFDEEAIAQLLCIPGQDFARTAAGRRVRIMRTNMTTLTQIWMTLLLSNILPTDHNSDLPMPKCQLVYAILTRMSIHVAQLIADAIYIFADMAPTRHPLDPDKSNRALGFPALITGLCQSFGVPRCTYQGAPPPPHQVGQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 120726 - protein, 78 aa, Glycine max
  Coding DNA Sequence Number=SeqID_29041
MAAEWRRKRERRRHFKEKMSLEEAYDHRRPWIRAWRKKEMNEGRGREEHKILCSKRALKSEPTNPRSIPRFSTNCAWV

SEQ ID NO: 120727 - protein, 333 aa, Glycine max
  Coding DNA Sequence Number=SeqID_29042
  Homolog annotation: Hit_ID=Q2HW90; Match level="QueryCoverage=44%, HitCoverage=29%, E-value=1e-15, Identity=35%"; Hit description =Putative uncharacterized protein
MGSVLIPIVNKPTEGPCRLLKNVLWGISLPLDVVSKEGTNSPDPRIPRLHLCHMHSIMHSSIPPMRYRSFDLHQLLSHFSKHGNKSNRQEVLPSQGQKPRYHQHQGIRAVDGTPQNASLPQDLRKDLRVDHSRGVHRSHCITYPYYDQPLRCFTFGDFQLVPTIEEFEEILGCPLGGRKPYLSSGCLPSLSRIATVVKDSARGLDRIKQTRNGIAGLPQRYLEDKVRGMANQGDWVPFMDVLALLIFGVVLFPNVDGLVDLAVIDAFLAYHHSKESPVVAVLADLFDTFERRCENPQRADHLLLTRPLCLVGFALIPTRHKTSMSAPEPSLVY

SEQ ID NO: 120728 - protein, 259 aa, Glycine max
  Coding DNA Sequence Number=SeqID_29043
MATSDMLFLRDRAHIPTKKSLLELASQDALLAQNNASVHTSYASILQVAGCTICGGAHESGFCIPIEEHLTREVDYMGNQPINNFNAGGFSGFQHGQQYNQQQGQWRNHPGNQFNRDQGGPSIRPQQQGPSLYDRTTKLEKTLTQLMQVSMSNQKSIESAIKNLEVQVEQLAKQLADRSSSSFTTNTEKNPKEECKAVMTRSRMAIQGDDSDAGKKMKEHKQQLAPKPALELDSDFVELEEINEETEDDKEEETPMGIL

SEQ ID NO: 120729 - protein, 57 aa, Glycine max
  Coding DNA Sequence Number=SeqID_29044
MGIQKNSQAEEGRHKRIQAVILSFFENGRRETKEFRRLSSWEFFLGKGKGGNGKKMR

SEQ ID NO: 120730 - protein, 34 aa, Glycine max
  Coding DNA Sequence Number=SeqID_29045
MEVFHSKLGEALVASNPMVLLGWLTSKTKKSSFK

SEQ ID NO: 120731 - protein, 110 aa, Glycine max
  Coding DNA Sequence Number=SeqID_29046
MDTPRNPADSSTCLSSKEEESEYGSKVSGIICTYRGMKENESKSRCPEASTSDHFQGAEELLHMDLMGPCRLKALEERALEPRCHNISLDIMERSRKGAKERSGGVTTVA

SEQ ID NO: 120732 - protein, 210 aa, Glycine max
  Coding DNA Sequence Number=SeqID_29047
  Gene Ontology: Cellular component=chloroplast
  Homolog annotation: Hit_ID=Q49KT9; Match level="QueryCoverage=40%, HitCoverage=92%, E-value=3e-25, Identity=63%"; Hit description =Putative uncharacterized protein ORF113
GGKVRMTSSHHAPYALGDTRATMDGTKDRDPARAATRLHEAGIASNRRSAIRRRNKVAVLEGAAGSPPFQGELMLVGKERDGVSLAFGIAGPAGGPHDGLLAQWALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFIL

SEQ ID NO: 120733 - protein, 35 aa, Glycine max
  Coding DNA Sequence Number=SeqID_29048
MFVFNSALKGLDDTPQSKSKAAARWIVVKTLQQIC

SEQ ID NO: 120734 - protein, 110 aa, Glycine max
  Coding DNA Sequence Number=SeqID_29049
MVWGDILAKFDIPEAENAKKKEIRKKAKESKKYNDCPHVLSRGGYDLLEKKLLDEKTKQSQQQTLLTENPLFDLEEPPSPIKRHVKWKMARTKRYGQMTSKAAKEILDRI

SEQ ID NO: 120735 - protein, 195 aa, Glycine max
  Coding DNA Sequence Number=SeqID_29050
  Gene Ontology: Mol. function=nucleoside-triphosphatase activity; Cellular component=mitochondrion; Biological process=DNA replication, removal of RNA primer
  Homolog annotation: Hit_ID=Q5AAF1; Match level="QueryCoverage=98%, HitCoverage=30%, E-value=8e-48, Identity=52%"; Hit description =Putative uncharacterized protein PIF1
MATRKLYMKFLEQYVYIDAEDQAALAEMRFVCNRIGESGGFTDQEKAFFDNIPLQRQSFIQSCCHLASQEFESTVLPVVNFSITGRGKQVVMVEKEEFKIEKAGQKSTTSSFENTGNELVREQLPLILSWAMSIHKAQGQTLDRVKIDLGRSFANGQAYVALSRATCKSRLEIKNFRKDKVKTSEHVRKYYESLG

SEQ ID NO: 120736 - protein, 84 aa, Glycine max
  Coding DNA Sequence Number=SeqID_29051
MLDKQAIVSPAKPIDGPDPQVMWDATVFGVFNEHFPLYIKHEDLSEIAHGDQCLNISVIQLWILHLTETSMRSGNSDVYGFLEP

SEQ ID NO: 120737 - protein, 302 aa, Glycine max
  Coding DNA Sequence Number=SeqID_29052
  Gene Ontology: Mol. function=nucleoside-triphosphatase activity; Cellular component=chloroplast
  Homolog annotation: Hit_ID=Q2PMM5; Match level="QueryCoverage=100%, HitCoverage=19%, E-value=1e-86, Identity=83%"; Hit description =Protein ycf2
  Pfam annotation: Domain name=AAA; Domain location=92-300; Score= -30.4; E_value=0.0092; Accession=PF00004.20; Description=ATPase family associated with various cellular activities (AAA)
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPSSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPALIAPNKLNTCIKIRRLLISQQRKHFFTLSYTRGFHLEKKMSHTNGFGSTTMGSN

SEQ ID NO: 120738 - protein, 134 aa, Glycine max
  Coding DNA Sequence Number=SeqID_29053
  Homolog annotation: Hit_ID=A0ST23; Match level="QueryCoverage=33%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTLFEIWTDVASADFLEKGTELEFVIMVIAVSFGKPVVPAALMNRPTRGERRFAYWALFRFLAH

SEQ ID NO: 120739 - protein, 201 aa, Glycine max
  Coding DNA Sequence Number=SeqID_29054
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
MGTNQNGKRFYQVKVKSLDVTSLKELGRLMGSLQRQAFRKVYGKILDLTTAEVFTEAVVSLAQYYDQPLRCFTFGDFQMVPTIEEFEEILGCPLGGRKPYLFSGFLPSMSKIAAVVGDSAKELDRMKQTRNGIVGLPRKYLEGKSRPAGMQAWHWPSFYNVVTGKTLALPNLIALQHIPLSPAGVIAKRPAPIALPNSCAA

SEQ ID NO: 120740 - protein, 72 aa, Glycine max
  Coding DNA Sequence Number=SeqID_29055
MRGVATNVYLWKTSEKPKETGQSENSKFGSCIYALRKVDKSRAFAPTYPHLEKKSDLRSSFLCVNQVIDFFT

SEQ ID NO: 120741 - protein, 152 aa, Glycine max
  Coding DNA Sequence Number=SeqID_29056
MNCVFVHASSTFEFGAMRSDCLVEFSILNPFWEPMNCVFVHASSIFEFGAMRSDCLVQLSILNLFRSPMNCVFVQASSTHEFGAMRSDCLLQFSILNPFSEPIVATYPSAGGRRETRGMRVPRKEYVRSRHQRLFEENVGKTRKRRDLRTFK

SEQ ID NO: 120742 - protein, 258 aa, Glycine max
  Coding DNA Sequence Number=SeqID_29057
  Pfam annotation: Domain name=zf-CCHC; Domain location=129-146; Score =22.6; E_value=0.00058; Accession=PF00098.14; Description=Zinc knuckle
GTSFVVQVEGTSTWVIVTENKRGYISCGSVLVEGTSTRLFKENKGGYIPYGSLLVKEFTRLKRNLKDRRPLDPTKRKSTSKSYGSHSYPKKDQVQDILGATTSNPKDDKGNTIEKQPLKASMQEKTSSIKCFKCLGRGHITSQCPTKKTMIMRGQDIYSSRGEATTSPSSSESEEAKGKESSEETYPQEEGQPLMVKEKCKEVSVSSKRLSKKESHFAIKTKIKEISPFRQPPHLLLYKKTLVSTATPLGLEVIPQVK

SEQ ID NO: 120743 - protein, 140 aa, Glycine max
  Coding DNA Sequence Number=SeqID_29058
MVSPQGRNTWTVDDLVPYMEKITILSEEQERIIEPVAHGPASERRFPPQEFHMFQSSVETRGFGRHRQAVEAEEFSQQMEERGHGMYYTPPTFSQYPSQMYQYPFEGHDTDMSASEHSFGGVAETHPHYFMADYDPFTAT

SEQ ID NO: 120744 - protein, 290 aa, Glycine max
  Coding DNA Sequence Number=SeqID_29059
  Gene Ontology: Mol. function=transferase activity; Cellular component= chloroplast; Biological process=metabolic process
  Homolog annotation: Hit_ID=A7NVI4; Match level="QueryCoverage=98%, HitCoverage=29%, E-value=1e-158, Identity=91%"; Hit description =Chromosome chr18 scaffold_1, whole genome shotgun sequence
  Pfam annotation: Domain name=NAD_kinase; Domain location=11-264; Score=190.6; E_value=4e-54; Accession=PF01513.12; Description=ATP -NAD kinase
MVASFLYHQEKMNVLVEPDVHDIFARIPGFGFVQTFYSQDTSDLHEKVDFVACLGGDGVILHASNLFRDAVPPIVSFNLGSLGFLTSHDFEDYKQDLRQVIHGNNTRDGVYITLRMRLRCEIFRKGKAMPGKVFDILNEVVVDRGSNPYLSKIECYEHDRLITKVQGDGVIVATPTGSTAYSTAAGGSMVHPNVPCILFTPICPHSLSFRPVILPDSAQLELKIPEDARSNAWVSFDGKRRQQLSRGDSVRISMSQHPLPTVNKFDQTGDWFSSLIRCLNWNERLDQKAL

SEQ ID NO: 120745 - protein, 779 aa, Glycine max
  Coding DNA Sequence Number=SeqID_29060
  Homolog annotation: Hit_ID=A7NVI6; Match level="QueryCoverage=86%, HitCoverage=78%, E-value=2e-92, Identity=54%"; Hit description =Chromosome chr18 scaffold_1, whole genome shotgun sequence
MEIEEQGAPQTNRFSAVIEKIERLYMGKDSSDEEDALDVPDDQYDTDDSFIDDAELDEYFEVDNSSIKHDGFFVNRGKLERMASLGATLRLLPCGLEVTSLSPGNSLFTSGAKSVYIFPPQIPLGWNLMHWQAKKRRRKDVPKNPGEHIDSHVSNKHVKVGKTAAGKTASLPVKNTISSSHNLGVPGEHYEDMTFQNQLDVSGISLKRKTADTRPMLDPPVCSKVSTNAPAAAEDAEKQKTRVLQSKNTSDKYKDASGLLDTSRQKYHEKSASAKSKSQPGKISISVDNLEKAGRSKDKNDIHELPDLNLYVGKSAIQAPKSENVLKKDGSSARPKTTTLEKAIRELEKIVAESRPPTMENQEVDTTPQGVKRRLPREIKLKLAKVARLAASQGKVSKELLNRLMSILGHLIQLRTLKPGGSGTGPRWTQPGRCSSAAGRLGIVSAVEAVDGEEGEGSLLVAVGQLLQNQTREAQRQWRVRVTVVGELMGRERRVRLLQVEVLRWKVAREKDVRFQLIKKEVIEMIKMQAPTIESKLQQQAAASGEQELGPDGKPITKKNFSMDTALEDKICDLYDLFVDGLDENSGPQIRKLYAELAELWPNGYMDNHGIKRAICRSKERRRALYSRHKEKIKRKKLLAPRPEENVQVDPSPITLQQPLRERLATDSSGHPHASVNKTVSNTVTTARVHNPVNGPKQEKAKGSSGGSLDDVKGADGVLIKKKVKRKLEQGLEGTHFRPEKIGASLQGEEKTRSLKQSAGVPPKSNLQPTSLPGLEQSS

SEQ ID NO: 120746 - protein, 566 aa, Glycine max
  Coding DNA Sequence Number=SeqID_29061
  Gene Ontology: Mol. function=heat shock protein binding; Cellular component=nucleus; Biological process=protein folding
  Homolog annotation: Hit_ID=UPI00001971A6; Match level="QueryCoverage =67%, HitCoverage=93%, E-value=1e-125, Identity=62%"; Hit description= DNAJ heat shock N-terminal domain-containing protein
  Pfam annotation: Domain name=DnaJ; Domain location=6-68; Score=114.8; E_value=2.5e-31; Accession=PF00226.22; Description=DnaJ domain
MVKETEYYDILGVSPSASDDQIRKAYYHKAMQVHPDKNPNDPHAAEKFQILGEAYQILSVPVQRNAYNQNGKHSVSRETMLDPMAVFALLFGSELFEDYIGHLAVASMASSELADETEDPDKLNEKLKARMFYIHFSAVQKEREEKLARILRDYLGQYVRGNKKGFFQRAESETRRLSRAAFGVDMLHTIGYIYSRQAAQELGKKAIYLGVPFLAEWVRNKGHFWKSQFTAAKGAYQLLQLQDDMRKQFKMDGSSVPENDVDSHIRLNKDTLMNSLWKLNVVDIEVTLVHVCQMVIVFIVAYPDTMKLLVLRENNVKKEELRLRATALKILGKIFQDKYPKGETLKKKIAADSDDEESSSESSDDESSRAISYRTPFFTQQHAAQHDQIPEVFQNLAAKLIIVEVKVFQALSVRFRTVRHENLLTSAGISPESLLPMRSRMRWEGSAVMQAGISLAMSFQSATTRVVRVSMPQIAGESFPVTLPAEVDVGDAAGGGVAADVVPIEAAIGACPRVEEAKTTGGRREPPLLAVGPPLQEEHFSRSGILRILLEDSMEKTPQSSISKFL

SEQ ID NO: 120747 - protein, 289 aa, Glycine max
  Coding DNA Sequence Number=SeqID_29062
  Gene Ontology: Mol. function=receptor activity; Biological process =protein amino acid phosphorylation
  Homolog annotation: Hit_ID=A7QEN8; Match level="QueryCoverage=80%, HitCoverage=34%, E-value=2e-35, Identity=36%"; Hit description =Chromosome chr16 scaffold_86, whole genome shotgun sequence
MWRQRALLVFLLLLVHQICATSEQEHACPPSSCGKITHITYPFRLKSDPKGCGNRYELACENNVTVLYLYSGKYHVQAINYNNFTIRVVDPGVQQPNCSSLPRYFLSPTNFSDVYSFFDNEVDPYLAFQNRDYSWEHVFQHIVFLNCRHAVIDNEKYVETDPCIKWHSKGYIYAIAGDLIAKDFEVGCEVKLVAPTSWWGLDTNNSSYTQMHRALLYGFELSWMNLACDHHCGYSTCALDTSSQMLQCSRGNFLGREYPPKYPPEYPTERGKLSKLLSYAEGKDFITLN

SEQ ID NO: 120748 - protein, 137 aa, Glycine max
  Coding DNA Sequence Number=SeqID_29063
MTRRLLARSLAFECRIMHYLIVCMLLPRSSNLAQVSKEDLVVIYRKERDGSWVKKDVPAHAVDDRSPSPPPQRDDSSSLMKSVLDRLDGLHTYVGERFDSLESRIDTRFADMDTRIDRLEEDVSFIRQCFDLPPPPS

SEQ ID NO: 120749 - protein, 101 aa, Glycine max
  Coding DNA Sequence Number=SeqID_29064
  Subcellular localization annotation: CTP_CleavageSite=62; ConfidenceScore=5.89e-01
MAKPNSNPNHSNGDMNYSRPYTTHTPLTASSSSAPRSPWRMVRYSRSSIRFSMLPPRSLALKLATKWRRSWRRTGWTPNMSKSSIISLIQVFVFDITYGDG

SEQ ID NO: 120750 - protein, 71 aa, Glycine max
  Coding DNA Sequence Number=SeqID_29065
MSLVESPIVATYLSTGGRGAMRNSNLRSVEAMPSKIILMMPKNQESNKFQESRFKNNQDSRFKNQEKTQSR

SEQ ID NO: 120751 - protein, 138 aa, Glycine max
  Coding DNA Sequence Number=SeqID_29066
  Subcellular localization annotation: CTP_CleavageSite=44; ConfidenceScore=5.51e-01
MCPLTQHLSAFLSHSSLLITISPPRRPVSLRARIRLLGITPRILSFSVSHSFQTLAYKIASIQGCSCTECHEASRLGTTWKEVKEEVASHYLGQGGIGLVSTYVAYSPKIASRYLDSSCNYWLNYSTVVLSLCKRMVK

SEQ ID NO: 120752 - protein, 271 aa, Glycine max
  Coding DNA Sequence Number=SeqID_29067
  Gene Ontology: Mol. function=receptor activity; Biological process =protein amino acid phosphorylation
  Homolog annotation: Hit_ID=A7QEN8; Match level="QueryCoverage=87%, HitCoverage=35%, E-value=3e-39, Identity=36%"; Hit description =Chromosome chr16 scaffold_86, whole genome shotgun sequence
MWRQSALLVFLLLLVHQICATNEQEHACPPSSCGKITNITYPFRLRGDPKGCGDNRYELACENNVTVLYSYSGKYHVQAINYNNFTIRVVDPGVQQPNCSSLPRYFLSPTNFSDSDNFYLDRYQIQNRCYPWKRAFQKHIIFLNCRHAVIDNEKYVETDPCIKWHSKGYIYAIAGDLIAKDFEVGCEVKLVAPTSWWGLDTNNSSYTQMHRALLYGFELSWINLACVDQCGNPDCAFDAYSQKLQCSMYFCRNFLGGRRYFIEGAKGCKNC

SEQ ID NO: 120753 - protein, 51 aa, Glycine max
  Coding DNA Sequence Number=SeqID_29068
MEIQVEQEIERKIPQVQLAIKAMTICYHLGKSIRITYACPHKCTLFRICME

SEQ ID NO: 120754 - protein, 77 aa, Glycine max
  Coding DNA Sequence Number=SeqID_29069
MSMTLCKKYGISKEKWAQFCQSHRDPSWEDVRKKAQAIQKQNTAPHVLSRGDLLEEQASHGSFVPHGRQDVLTAAIG

SEQ ID NO: 120755 - protein, 230 aa, Glycine max
  Coding DNA Sequence Number=SeqID_29070
  Pfam annotation: Domain name=Transposase_23; Domain location=45-115; Score=-4.0; E_value=0.0033; Accession=PF03017.5; Description =TNP1ENSPM transposase
MQSQFQSQMQSQGPALPPEPEFGPSAARVSTKGSCVDPSGNDLDTGDLDKCGLYIEENPPHLVALGRVFERSTTVHNISLLHDQVKVSVEEVKDADALIPVPTDEVILVGQTLNTFLAWPTHLVKHLSDKGAVGPAKPADRPNHKVDDPLYLMTLTIPQLFLKPLQIMWDATVFGVFNEDFPLYIKHEDLSEITHGGQCLNIYVIQLWILHLTETSMRAENFDVYGFLEP

SEQ ID NO: 120756 - protein, 263 aa, Glycine max
  Coding DNA Sequence Number=SeqID_29071
  Gene Ontology: Mol. function=transferase activity; Biological process= aromatic compound catabolic process
  Homolog annotation: Hit_ID=A7NVJ1; Match level="QueryCoverage=92%, HitCoverage=91%, E-value=6e-84, Identity=63%"; Hit description =Chromosome chr18 scaffold_1, whole genome shotgun sequence
  Pfam annotation: Domain name=GST_C; Domain location=138-232; Score =38.0; E_value=3.4e-08; Accession=PF00043.16; Description=Glutathione S-transferase, C-terminal domain
  Pfam annotation: Domain name=GST_N; Domain location=1-74; Score=45.3; E_value=2.2e-10; Accession=PF02798.11; Description=Glutathione S -transferase, N-terminal domain
  Pfam module annotation: Pfam domain module=GST_C::GST_N; Domain location=138-232::1-74
MQLYHHPLDLDSQRVRFALEEEGVDYTSHHVNPITGKNLDSSFFKMNRHGRVPVFQNGSHIIYNTIDIIQYIERIAVVSSGVESISASSREVVEWMQKIHDWDPKFFTLSHIPEKYRLYVSKFIRQVAIARMSESPELASDYHRKLKEAYETEEKLKEADVLRRSKEHLVILLDEVERQLSETPYLAGQEFTMADVMLIPVLVRLKLLDLENEYITGRPNIAEYWILVQQRPSYKKVIGMVMLGAGKRRDACQNGQSAKDLLA

SEQ ID NO: 120757 - protein, 61 aa, Glycine max
  Coding DNA Sequence Number=SeqID_29072
MGCLNTSDWVSNGFEGRYFVKEVGETWSGRDTWWTRQSSSARLTGDTAGTRGSAGSAFRQS

SEQ ID NO: 120758 - protein, 2048 aa, Glycine max
  Coding DNA Sequence Number=SeqID_29073
  Gene Ontology: Mol. function=nucleic acid binding; Cellular component= nucleus; Biological process=mRNA processing
  Homolog annotation: Hit_ID=A7NVJ3; Match level="QueryCoverage=30%, HitCoverage=98%, E-value=1e-180, Identity=54%"; Hit description =Chromosome chr18 scaffold_1, whole genome shotgun sequence
  Pfam annotation: Domain name=zf-CCCH; Domain location=1767-1794; Score=17.8; E_value=0.0062; Accession=PF00642.15; Description=Zinc finger C-x8-C-x5-C-x3-H type (and similar)
  Pfam annotation: Domain name=zf-CCCH; Domain location=1795-1819; Score=1.1; E_value=0.99; Accession=PF00642.15; Description=Zinc finger C-x8-C-x5-C-x3-H type (and similar)
  Pfam annotation: Domain name=zf-CCCH; Domain location=1822-1846; Score=9.8; E_value=0.07; Accession=PF00642.15; Description=Zinc finger C-x8-C-x5-C-x3-H type (and similar)
  Pfam annotation: Domain name=zf-CCCH; Domain location=1899-1925; Score=12.4; E_value=0.032; Accession=PF00642.15; Description=Zinc finger C-x8-C-x5-C-x3-H type (and similar)
  Pfam module annotation: Pfam domain module=zf-CCCH::zf-CCCH::zf -CCCH::zf-CCCH; Domain location=1767-1794::1795-1819::1822-1846::1899- 1925
MDQHHFLHHHHYHHPQEHRNRYTSLTPQSHLHSHHHNNLPPPPPNPSPPLSYHRTPQPYTPPTPQPQHQQQQFPYTPLPDRPLEEEPQPQRHIPYDLLPRRTTTLPWNPNPNPNPRIPDDFDRDYHHKHHRPLPPPPLPIESHRYDPDRHHHPVDPYEQNPREPLAWGGGGYHAPGQGDVDPTSYVRVYTVESDADVAGRTTSKRWVMSDRDRGREMHESSSGLVSSNGNSEKYYHGSENNMMGRYSRGNSRECGHTHEFERTPPKKQVQKKSALLRIQTVKPNNNHRNRENREVEQLRYPGYGSENGNGFYRGKEQYFGHGVKGEEREESPVEIDISFESNSLVAKAKAVVAPLPPPSSSVSVPDLNVMPVSDSDLVYGERSKRVSGSEGDYSGMQLPQPVRMSSVVVDLNRSPCKGNDSSGSRKEVIRSNKKNVDDGSSRSRTREADGSRGKKEVPNFVKVGNVVSGKLTSKIVKKKKIVKRVVKKGTASSKSSASNSLPAKTLPGTVKAESVARISLTASGPEKIEANLDEKSNTVIQSNTVDEEAKPDCLPPLPKEGNVLKEDAEVGLLQLSLGPDSRSQECKSDKDSGIGKVSRFERDGNISNSLSCASISEDKKSDSDCLDANDSVHDIGNTISVHDNANTSDCLDANNSVLNTYKVTKSLSGSNISVVTNIDYDNKQLCQNEVSLSPGKYSNVGSPQNRNLEDVGDELLKSSDTFSCSGKTRIQDGLDCLQHASALKHSSDNGSSNLEDSTCVDCSGIMHCAGKQVSPGDVVISPENWDTEKAFPNSNISAGSGEGDTNKIKKRRARTLLNFLSSEMECLSSNHVNPDSLANNVDGGSSLLLKDPSPSEVLEQPVQSLDFNSLSGVNGVTALHGKGGVLEAQFCVGHIDNDDANEVSPASKRKKVTANPNFTKCQSELSAVIVPSTTSEAPMSFSDNQEHQKEVAFESMGMIILSSAQSMPYSEDITKMPENVLAGGSFESIDANKETMSSEHLELWHSDIVSFSPCEDLAFPNVQFSSLEGECKENTTPIVPTSNIQTDILAVGNIAGEKTDLQAVEENYQYREHVQRSPRADMEPNDHNMKNDLLAQWNLMSCPASGDEVTTNNSNDEVIEDAPGLSDMFSQGMVSEVPDRRVLEFTAINDENIFGVQENPDNISMVGHDSNLNTSSIQQTKKNMKSDHAIEHSNLITKKTMSEQSQVSSKVTTQALNSYCFGLSGTKNQSGSIIPKTFPGHSFTFSKTSASSPHVSKPRTWHRTGNNPPASLPRIKPSLGTVPPKKPILEMKGNFQNTSYVRKGNSLVRKPTPVSTLPHISSVNQTSLGIDEIPKSIKSGGRADVTDKQMYLRTGATNAPQQRTPPLPIDTKSEENTSSSLVEPPSGGCCENASDLRKFIETDNIAPNSSEDALKHYETLENQPGPSDNGDSQGEAIDGNVFPLNTKRIVYIKPKTNQLVATSNSCDVSVSTDDNLQTAFSDGYYKRRKNQLIRTTFESHINQTVAMSNNTAYSGGQGTSNALCNRRFSKRRTHKVGRSSCKRSRASLVWTLCSKNSSENDRDSQHYQRALPQLFPWKRPTFASSLNNSSLSAISKKLLQLRKRDTVYTRSIHGFSLQKSRVLGVGGCSLKWSKSIEKKSKLANEEATLAVAAVERKRREQKNAVCISSQSKRERIFRIGSVRYRMDPSRRTLQRISDDESLSSASTCSGLASKRAYIPRRLVIGNDEYVQIGNGNQLIRDPKRRTRKLANEKVRWSLHTARQRLARKQKYCQFFTRFGKCNKDGGKCPYIHDPSKIAVCTKFLNGLCSTPNCKLTHKVIPERMPDCSYFLQGLCSNRNCPYRHVNVNPKASICEGFLKGYCADGNEAVFQIPMTNRSPKNNFTAVPGLSLAFFLCRKKHSYVCPTFEATGTCTQGTGCKLHHPKKQSKGKKRKRTADQNNSRGRYFGFIPADVSKSGMMVAPKRHRQNGELEEELSDYISLDVVNEEVADVVDQSFEPAAFCDNDSLDLQLDDFDGLIKPVLLLKTKFTLQSPQSSSLQAFRQVAET

SEQ ID NO: 120759 - protein, 59 aa, Glycine max
  Coding DNA Sequence Number=SeqID_29074
MPRQNEFVGYSFTGKNPQKFDIPSRCTMDELKDLIKQLAPHGIPPYGIHETQMLNQEIG

SEQ ID NO: 120760 - protein, 139 aa, Glycine max
  Coding DNA Sequence Number=SeqID_29075
MVIDQSLFYDLTQLSSEGVPFEGTLIDDWKYEFSVHDARRLVCTNQADMTGRLLAGSLAFESRILHYLIVRILLPRSSNLAQILDRFDGLQTFVGERFDTLELQVDMRFNEMESRITKVEGDVSYIHTSFDLPPPPPSS

SEQ ID NO: 120761 - protein, 250 aa, Glycine max
  Coding DNA Sequence Number=SeqID_29076
  Homolog annotation: Hit_ID=Q2HTA0; Match level="QueryCoverage=46%, HitCoverage=18%, E-value=6e-16, Identity=41%"; Hit description=IMP dehydrogenase/GMP reductase, related
  Pfam annotation: Domain name=DUF1723; Domain location=149-198; Score =54.5; E_value=3.7e-13; Accession=PF08330.1; Description=Protein of unknown function (DUF1723)
DRDDSNDAPQRRRPTASARRQRVLVTVVDDEPVVLATKADGASVEADVYADEPMAGGDVQDTGADTLADTGAHAAEDELEGFPGGPRDPSVLTEYADHVAGNIWTGDRPELKLFSHGRKVHSLGRPVLAIEGLVAGTELSPLIACLIDTGDRGLLSSFVERWHRETCSFHLPVGEVTITLDDVMSLLHLSVVGDLHAFQPVHVDDAAFRDLSQTGRYAWGVTALVHMYDHLNDASISTSRQLGGYITLLQ

SEQ ID NO: 120762 - protein, 462 aa, Glycine max
  Coding DNA Sequence Number=SeqID_29077
  Gene Ontology: Mol. function=phosphoinositide phospholipase C activity; Biological process=intracellular signaling cascade
  Homolog annotation: Hit_ID=A7UQU7; Match level="QueryCoverage=64%, HitCoverage=65%, E-value=1e-24, Identity=40%"; Hit description=IMP dehydrogenase/GMP reductase, putative
  Pfam annotation: Domain name=DUF1723; Domain location=252-298; Score =21.1; E_value=0.0017; Accession=PF08330.1; Description=Protein of unknown function (DUF1723)
AGFMSTFPRSRSPPLIRTTTRLPASAQVDCDEEDREEHSHVGVQGAPGPTLDSGCLLDPLWGASGGPELPRQIMLFWSLVLERVVAKMFEVECHDTGRGVGRGDRDDSNDAPQRRRPTASARRQRVLVTVVDDEPVVLATKADGASVEADVYADEPMAGGDVQDTGADTLADTGAHAAEDELEGFPGGPRDPSVLTEYADHVAGNIWTGDRPELKLFSHGRKVHSLGRPVLAIEGLVAGTELSPLIACLIDTGDRGLLSSFVERWHRETCSFHLPVGEMLVELLMVTAEAARAETTQCCGPYVRLQWAFRDLSQTGRYAWGVTALVHMYDHLNDASISTSRQLGGYITLLQCWIYEHFPLVTESTADSNYDEDSPCACRWIATKKIVKSIRTPTYRERLDRLRIPDACWIPYGEHRPVRDFHMISCYSGLLRWGPVAVYYRPERVMRQFGYTQTIPAPPADS

SEQ ID NO: 120763 - protein, 158 aa, Glycine max
  Coding DNA Sequence Number=SeqID_29078
MAVHGGKSKIRHKNMADGVAENDGCHGGQKKGVSNSKNSMPPFVTGALLPELVAAVRAGASLPELVTAACACGLQVSQLHARADCGCHGCGWVRRGAGGTRLGSGEARDVSCAKKEDARELHTPEKKRVGALAVADGSMPLEVLVARKGRRWLEVPTR

SEQ ID NO: 120764 - protein, 63 aa, Glycine max
  Coding DNA Sequence Number=SeqID_29079
MTILTLTMTTLKPTSTTDDMAKRGASDIVVKLKGRGEEMREKGRRIMEGDAATENRLRRLQMA

SEQ ID NO: 120765 - protein, 144 aa, Glycine max
  Coding DNA Sequence Number=SeqID_29080
MIQVVAPTLNTLPIAQDQQNPTFARESIPTTPIGDASPLALDYSLTPKFQPTYECSNIISDIISWLKVLVDLHDRWFGEFKGPTNFLDKSSTAKANRSVNRGALTYCGGSISTAVHFEKQSKEFQGPPTAWEMMEKTMKLKSGE

SEQ ID NO: 120766 - protein, 628 aa, Glycine max
  Coding DNA Sequence Number=SeqID_29081
  Homolog annotation: Hit_ID=A5BLZ2; Match level="QueryCoverage=20%, HitCoverage=10%, E-value=1e-08, Identity=32%"; Hit description =Putative uncharacterized protein
  Subcellular localization annotation: CTP_CleavageSite=46; ConfidenceScore=5.57e-01
MATPPTSPPHLENPLKVTSKRTRRSTRLRRLTTRSLNNPTPVVNINPATGRGSGPYKEKFHSYLGVVTREKILIVHANWNVVPNDLKNLIWEDILLVLKESFTYCYITPFVVQRKFDIPECKQISDPTVKYSLHPATWAKFAKSRQTPNWQGIRKKVQEIQKFNDFPHVLSRGGYELLENKLMDEKRKRRDQQDEFTENPTLNLDPLSPVSRHLKWKMVRTKCFGQMTSKAAQQIADKIDSLEEQATTGVTISQYFGQASCASTTSSPPISQQQLAEIIDGIKDEIRKEVEEEHKQQQEAWRRAIEEQHNRNLEIMKQELKQALKIELSHIASHQSAPIEPPKMQALVARVTTKGSCAAPEAQGLPKEPYDVDVDLMGLFKVEDEITLLVALGKMYNNSSTIHNVRYADDVVRVNVVTYYHPDAEVPFPASEPPLKSVEQPDRANVVATIDPLGELVKKLYVVYQKSMELSWDKAKFGIPNSTNGFFITHSHVQAGAYECGYYVMHWMWCIVTSGLKNEWNKCFSNGTPLDSDTMTTLRKKWPAYFLQVGKMDVCISHTIYGRPFQSLSNKKTISSSKQFCLYNHSLICKLGGTRTMEVMITVGKIVPKLQDDPVILERLHAPTKAPL

SEQ ID NO: 120767 - protein, 223 aa, Glycine max
  Coding DNA Sequence Number=SeqID_29082
MAQGVTSDSLTFESLSPAINLVYIKKNCWNLDDPTVSFSGTHKVRARGFEGLSSVAYQPSTAPAPIPSTPPVLATSGSSTQSTNLMMAMLQSIHQGQILVMQSLHNLAQHQPIMEEFSLQVAWPRVHPSSHGEGEAFAAQEPQPDPKTTPTAQEDDSEATSPESFVPKTDPEVDPMIAEASPQASPVSTPVLKLNTPQGSPAGTPVLHLTDDEAMDQDPPQDQ

SEQ ID NO: 120768 - protein, 102 aa, Glycine max
  Coding DNA Sequence Number=SeqID_29083
MGDQATSMHNISIDRNIEHIKLKKSFLFAKAQSIQICAKRTSTNKATYLSLKSDLKREFGTFLEKLCMHEGSRERKVQVLESSERFCSVKICRDASSKRKPF

SEQ ID NO: 120769 - protein, 287 aa, Glycine max
  Coding DNA Sequence Number=SeqID_29084
  Homolog annotation: Hit_ID=A7P7E6; Match level="QueryCoverage=67%, HitCoverage=36%, E-value=5e-21, Identity=35%"; Hit description =Chromosome chr9 scaffold_7, whole genome shotgun sequence
  Pfam annotation: Domain name=DUF1723; Domain location=148-197; Score =58.0; E_value=3.2e-14; Accession=PF08330.1; Description=Protein of unknown function (DUF1723)
MVRTKGLGHALDRVIGRALGREDRHNSDDAPQRRRPTASARRQRESAPIAEDKPVVPADEPVVGTYEIVVVADVHAPGAEATANEPKGFPGGPSDPSVLTEYAEHERLELKLSSHGRKVQKLGRLVPAIEGLVVGTGLSPLIVCSIDTGNRGLIFSFVERWDRETSSFHLPVGEVTITLDDVASLLHLPIVGTFHTFQPLHVDEVVLMLVDLLLVSREVRDIYQRRCQAGHWTTASHAYLLHILGCTLFAKKSATYVHVVFLDTLHDLSQTRRYAWGAAALVHMYDH

SEQ ID NO: 120770 - protein, 89 aa, Glycine max
  Coding DNA Sequence Number=SeqID_29085
MEHIKIAPAKVSFGEGEGADVHYCGGWIDVGGKRMDENQWIYDTIMSEEVDMDDQNEQECGVNERQVDCLDAFNTSQVFDSRDDVLQWA

SEQ ID NO: 120771 - protein, 55 aa, Glycine max
  Coding DNA Sequence Number=SeqID_29086
MASNPSRAQKKLKSSKRKQGEYSQTALNRLDIGFTIEKCENTQVFGLGVVLSVRV

SEQ ID NO: 120772 - protein, 137 aa, Glycine max
  Coding DNA Sequence Number=SeqID_29087
MENNSLRCLQCNGEKSAKGFTEKKKAREARVNEEERSATEIGHFKYNLKWSLSYVWGSSLDEHRVTSFSSPPSVDECCLVSGVVALTNVRVASRCGLSSPRAGTCVVRATSIKLFVIDLSLACQVRSLFNNRSSNTS

SEQ ID NO: 120773 - protein, 102 aa, Glycine max
  Coding DNA Sequence Number=SeqID_29088
MGSGDDFLRGNVVEIYLYGGRIYVRISRYLPRNKSLSSSTCQRRMNLMPVMMIMMRKRMDYDEDITKDHEALEGPMTRDRLKQAQHVIETRLVICIAAIDDD

SEQ ID NO: 120774 - protein, 111 aa, Glycine max
  Coding DNA Sequence Number=SeqID_29089
  Homolog annotation: Hit_ID=A5BKB9; Match level="QueryCoverage=44%, HitCoverage=5%, E-value=2e-07, Identity=40%"; Hit description =Putative uncharacterized protein
  Pfam annotation: Domain name=zf-CCHC; Domain location=54-71; Score =19.3; E_value=0.0018; Accession=PF00098.14; Description=Zinc knuckle
MRLKNQGSHSVHYASHQGNQGAEKKFVKKHDKGKGSLKINDDSLQIQKKVSKGNSCQFCRKSGHFQKDCLKCKSWFEKKGFLTIQTLSPNEKFVFMGNRVKLQCKQSRLIV

SEQ ID NO: 120775 - protein, 113 aa, Glycine max
  Coding DNA Sequence Number=SeqID_29090
  Subcellular localization annotation: CTP_CleavageSite=52; ConfidenceScore=5.21e-01
MTWMPPLLPTGKLVPPLTTTGTRIPPLATAGLSLNRQYERRDRLSRRERDCTAAGASGTRRDGAMPPFLLAGHANVAVPPLPPAEHVDGTQAFERLRLVHMHPPLALTLLDWI

SEQ ID NO: 120776 - protein, 171 aa, Glycine max
  Coding DNA Sequence Number=SeqID_29091
MYNLSKEDALSGIAAESVCRVDGIFPCTNSNATSQYMFDDGDYAPPSLSASPLHVPRINPSMPPLKTSEAYKHCAPCTGPAMANDAGMKARLKGISSGEGISPIKASHQVVHPIHAEVPVFSHHIGTRSSGSGVGCGGGGDGGCGASSTVGEMPLVAGESGGGGGVGAELA

SEQ ID NO: 120777 - protein, 90 aa, Glycine max
  Coding DNA Sequence Number=SeqID_29092
MSRQNNFVGYAFTGKNPQKFDIPKGCTIDELKDLIKQVAPKGNPPHGIHEAQLVLVESNYRKQFVPIEILALFSKPVMENEDEVVTSLQD

SEQ ID NO: 120778 - protein, 91 aa, Glycine max
  Coding DNA Sequence Number=SeqID_29093
MDKSLEVGEEEWREKERGSTKFVPQKSPKSTLRLMRTLGHSLASLAQSTWSLLPNALAGCKSLPSHRLWGQMMMVSAHRTLYLKRCSLNSG

SEQ ID NO: 120779 - protein, 98 aa, Glycine max
  Coding DNA Sequence Number=SeqID_29094
MKGYRYKVCLDRRVPVMNIKDKSTEYKKRKKLKTVGKEFPYNFAYSFCEYTSVLSRYLPLPIISFPGPSKTPRPQGVGLQTMASKVESGSQIKMGEGK

SEQ ID NO: 120780 - protein, 46 aa, Glycine max
  Coding DNA Sequence Number=SeqID_29095
AALGFVIGGDAILPRKGPITRTMSKRLQEDWARVAEEGPRVLMNLR

SEQ ID NO: 120781 - protein, 88 aa, Glycine max
  Coding DNA Sequence Number=SeqID_29096
MYSFAFQKTSMSSVIYVEAKLHGESKNNSRVQDKNQEEFKTQEESLESRIKIQGSRSQESRSRFMAQDSRIKRRLNQDKYEKFFSKIE

SEQ ID NO: 120782 - protein, 142 aa, Glycine max
  Coding DNA Sequence Number=SeqID_29097
  Homolog annotation: Hit_ID=A7Q652; Match level="QueryCoverage=46%, HitCoverage=18%, E-value=2e-07, Identity=36%"; Hit description =Chromosome undetermined scaffold_55, whole genome shotgun sequence
MAEITSSLTQLQLSSKPKLNAPDYYDAPSQKAVVGHHYHAGLYSASDDEIPTVDYSLLFSNNPVQRFLTLENLRQACQEYGFFYLVNHTIPDEVLDSVLKGFADYVDPKTIDERKVYRKNGPSDKIRWDLNSSAGENREYLK

SEQ ID NO: 120783 - protein, 75 aa, Glycine max
  Coding DNA Sequence Number=SeqID_29098
MAKINHQAWPTKTYHPMKCSKGLSKELIQGRLIWLEAYKNKMPKSSPNMHVKQEVSTRVKPRLLCKQSMGAKHTE

SEQ ID NO: 120784 - protein, 164 aa, Glycine max
  Coding DNA Sequence Number=SeqID_29099
MERSMIDAASGGALGDMTPAEARNLIEKMASNSQQFSAKNDVIVIRGVHEVATNSSSSAETKKLEGLLDALVNLVTQLALNQKSEPVARVCGLCSSTDHHTDLCLEGKLDALVNLVTQLALNQKSVPVVRVCGLCSSTDHHTDLCPSVQQSGAIEQLEAYAGNI

SEQ ID NO: 120785 - protein, 31 aa, Glycine max
  Coding DNA Sequence Number=SeqID_29100
MTQSHVIGGGTKNCEATTFSTHTWRTLLERA

SEQ ID NO: 120786 - protein, 190 aa, Glycine max
  Coding DNA Sequence Number=SeqID_29101
  Gene Ontology: Mol. function=transferase activity, transferring nitrogenous groups; Cellular component=cellular_component; Biological process=amino acid and derivative metabolic process
  Homolog annotation: Hit_ID=Q4ZJF7; Match level="QueryCoverage=93%, HitCoverage=41%, E-value=7e-78, Identity=79%"; Hit description =Tyrosine aminotransferase
IAETAKRIATIVIADEVYGHLAFAGKPFVPMGIFGSIVPVLTLGSFSKRWIVPGWRLGWFVTNDPSGTFRNPKVDERIKKYFDLLGGPATFIQAALPQIIAHTEEVFFKKTIDNLRHAAYICCKELKDNPYIICPYKPEGSMAMMVRLNLSLLEDISDDIDFCFKLAKEESVIILPGPIGRKGNSKNKEC

SEQ ID NO: 120787 - protein, 38 aa, Glycine max
  Coding DNA Sequence Number=SeqID_29102
WSPPISGGAQELIKGNYWPLNRERKSRLSIYGERPYIF

SEQ ID NO: 120788 - protein, 217 aa, Glycine max
  Coding DNA Sequence Number=SeqID_29103
  Homolog annotation: Hit_ID=A5C3T9; Match level="QueryCoverage=62%, HitCoverage=5%, E-value=1e-07, Identity=28%"; Hit description =Putative uncharacterized protein
EDSKALSSKAKGKEKEEKVSSKKIVKKENHFATKGDIKIALLLKQSFYLLLSRETSLSTTIPLELEVIPQVKELLDEGLVRKSLNPCALLVPKIGIIRHQIPMIGGMMNVLSGATLFGKITHAPNIFMICVHRGSLGRNNLHENKEKGMLYSITFLNFLNSDQGLPMDPKRIKDIPEWPTPPSVEERNNEFQEPLDLRSNPFQGGGNDAILPRKGIG

SEQ ID NO: 120789 - protein, 87 aa, Glycine max
  Coding DNA Sequence Number=SeqID_29104
MFLRASQFHNCIFHASHTYSRVFHLYEMLSKYWQSNCHSLDYGVEPNSCFYEKVHQVKLKHGSNHLAKIGAKDESSYITASSTAKHI

SEQ ID NO: 120790 - protein, 121 aa, Glycine max
  Coding DNA Sequence Number=SeqID_29105
MSKSFEFGMTGSLDESISCFLIRMDPWLPSPLRGLHVLALRGLHVLTIRGLHALTSRGLHVLALRGLHTLTLGTSYPHRQRTTRPRLERTTRPHHQRAARPHLQRTTCPHLERATRPHLGY

SEQ ID NO: 120791 - protein, 117 aa, Glycine max
  Coding DNA Sequence Number=SeqID_29106
  Homolog annotation: Hit_ID=A5C7Z4; Match level="QueryCoverage=96%, HitCoverage=40%, E-value=2e-07, Identity=29%"; Hit description =Putative uncharacterized protein
MVVILPKENLVVWFCSLHNRPGNYLKGIINSALKGLDDTPQPKSKAAARWIVVKCSKQKGSTKCGYYVMHWMSTIILGSFRNNWETYFNEVRPLEAERFKAFRIQWAQHYLKVKNQI

SEQ ID NO: 120792 - protein, 78 aa, Glycine max
  Coding DNA Sequence Number=SeqID_29107
MVHNIPLLHGQVKVGVEEVKDAKALVPVPTNEVTLVGQALNTFLAWLTHLVKRLSEQAVVSPTILQKAQIMRSMIPYI

SEQ ID NO: 120793 - protein, 180 aa, Glycine max
  Coding DNA Sequence Number=SeqID_29108
MWQALNTFLAWPTHLVKSLSEQAVVSPAKPPESPDHEVDDPLYLMTLTIPQLFLKPLQVMWDATMFGVFNQNFSLYIKHKDLFEIAHGGQCLSISVIQLWILHLTETSLQAGNSDVYGFLDPQSIQRSGQSQFESKSYIKSWMQSLKRDVYLGAYLNGGHWQMVVILPKENLVGLVLFFT

SEQ ID NO: 120794 - protein, 334 aa, Glycine max
  Coding DNA Sequence Number=SeqID_29109
  Gene Ontology: Mol. function=oxidoreductase activity; Biological process=electron transport
  Homolog annotation: Hit_ID=A1G204; Match level="QueryCoverage=79%, HitCoverage=21%, E-value=1e-120, Identity=82%"; Hit description =Pyruvate ferredoxin/flavodoxin oxidoreductase
  Subcellular localization annotation: CTP_CleavageSite=64; ConfidenceScore=5.45e-01
MPPNWPPRCWETPSPPICSSSAMRGSRAWPSPGVAWPWSTRRPCSRRPAWCATATPIPNPPRARCTQLPPGEWEGNEWGATAAPRNTGDERELRGLPSHGGDVAFLPLDDARLSRSLDEMIERRAAFLVEYQDAAYANRYRSLVERVRTAEADRIGGSTAMTETVARYLFKLMAYKDEYEVARLYTSGDFQRRLQQQFEGDYQLRFHLAPPLFAKKDEQGRLLKKEYGPWMFKAFGLLAKLKFLRGGRLDVFGRTEERRMERKLIGDYEATVQLLLDGLDDDRLALAVEIASVPEHIRGFGHVKEAHFAQAKAREAALLAQWRNPKALHIVQVA

SEQ ID NO: 120795 - protein, 155 aa, Glycine max
  Coding DNA Sequence Number=SeqID_29110
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINGIGQRAGRGGLRMGALPLPRSLTRCARSFGCGERYQSSKAVYGSTESGDNAGKN

SEQ ID NO: 120796 - protein, 97 aa, Glycine max
  Coding DNA Sequence Number=SeqID_29111
MGCPCVPIPLKIIEATRFQQKNGKIRQDEFQREERKERIYHLGRLMQAPLELVGLGSSSSMDSFASWKMNGSGMEKGREREETPLQEEDESRRSSPP

SEQ ID NO: 120797 - protein, 132 aa, Glycine max
  Coding DNA Sequence Number=SeqID_29112
  Subcellular localization annotation: CTP_CleavageSite=47; ConfidenceScore=5.04e-01
SFGIPFRASRYITGLNQTSNSELRSSISSVSTYYGTQSDIRVKSYCRLNLLKASTFNFEHLDILRDSIRHPSKELLSFEFAQSFDIQVSSVSIYYGTQSTSSKKLLSFEFGQSFGIPFRASRHITGLNQTSE

SEQ ID NO: 120798 - protein, 122 aa, Glycine max
  Coding DNA Sequence Number=SeqID_29113
ANINLPYFHGKDNVEANLDWEIRAEPSKPKDDKGKTIEKQPPKASMQEKTNSINSQDEATTSPSSSENEEAKGEESSEEIYPQEEGQPLMVKEECKETFVSIAIPLGLEFFPQVKELLDEDL

SEQ ID NO: 120799 - protein, 37 aa, Glycine max
  Coding DNA Sequence Number=SeqID_29114
MWTPRKIGGEACHPARPGEQGCFLQKQQPSGGRVWKA

SEQ ID NO: 120800 - protein, 113 aa, Glycine max
  Coding DNA Sequence Number=SeqID_29115
MIESFQQQQMSVLELYVEKDVAGGSMFHAANSVTSCGHNASHHESELPRNISNLHDEDDDDDYLASNSYVEESFDEDDSVDGISDTDDEVIDIVEPVSIVHPIEGVPGIQNPF

SEQ ID NO: 120801 - protein, 88 aa, Glycine max
  Coding DNA Sequence Number=SeqID_29116
MIGTSKPYTGAMRGTVHEPQVNIGADQKFTPVDVFKQEKKRETSPGNFNRLIKHQTTPFPSLQNGQVTKSNISHTLREFSERFAKDRI

SEQ ID NO: 120802 - protein, 42 aa, Glycine max
  Coding DNA Sequence Number=SeqID_29117
MGDKSKRQKVLSRSRVKGLDVTSLKELGTIGWGPLQGKAFLQ

SEQ ID NO: 120803 - protein, 295 aa, Glycine max
  Coding DNA Sequence Number=SeqID_29118
  Subcellular localization annotation: CTP_CleavageSite=56; ConfidenceScore=5.51e-01
LSSLGTDVWGANTFAVRKYNSRTFHLKVRRSRLFRFFRRFPQINVGGDSTRIPFVEHASRESRVALPPKGRLRHIGTRGCINYNPAFAIRQVGYPMRGAPAEESLSPFLMRDFGVESPLRKDKELRGIRNGIIGGYHEWLKVRTRGLDWLSKLKIIKEENFEAPEEDEEVRALKTELGKARLAKERFKLVATDIRKECAELREENTATARALEQETKRARKEEHGRDKFRGALWAELAACSRSKRSLSQRLCETETNMIAIVSKYQEELNLATAHEHKVADEYARVYAEKEARGR

SEQ ID NO: 120804 - protein, 71 aa, Glycine max
  Coding DNA Sequence Number=SeqID_29119
MEEVEDSSPFSECRKLRLWIREESWSERLKIKRKGVKEREGLSINKESRTDRRAIKKEREREEGLRSKRES

SEQ ID NO: 120805 - protein, 218 aa, Glycine max
  Coding DNA Sequence Number=SeqID_29120
  Gene Ontology: Mol. function=chitin binding; Cellular component =extracellular region; Biological process=chitin metabolic process
  Homolog annotation: Hit_ID=UPI00006A17C9; Match level="QueryCoverage =91%, HitCoverage=100%, E-value=3e-20, Identity=28%"; Hit description= UPI00006A17C9 related cluster
  Subcellular localization annotation: CTP_CleavageSite=87; ConfidenceScore=5.10e-01
MLVRMIRTRLFAAARVKSCPGMHSSCVIASLSGCARTVGPPPISGGGPGTVWIWSPLKVRTRSPLKARVCSLLKFRTCRLLKARECSPMMARTCNPLKVRACSPTKVKVHDPLKARTCSPLKARTCSPLKVRACSPLLVRTCSPPKVRACSPTKVTTCSPLMARACSPLKVRTCSPLMARACSPLKVRTCDPLKVRACSPTKVRTCSPLMARACSPLK

SEQ ID NO: 120806 - protein, 70 aa, Glycine max
  Coding DNA Sequence Number=SeqID_29121
MSVKNQVGRLRVHDKTNHTLASQCFARMLQPYGINIGLKEHSNRVTPKAYTPKSSLGPLPPDSGPTQKTF

SEQ ID NO: 120807 - protein, 236 aa, Glycine max
  Coding DNA Sequence Number=SeqID_29122
  Subcellular localization annotation: CTP_CleavageSite=27; ConfidenceScore=5.12e-01
MAGSPQEQVQEMAHGLGGVSSSSPSAVAATAGSSGAGSWAAKASPPPEGEGWAPGQATCASKTSMLIMDGKPKPCRLCMMMDCPLWMLWSMECSICGVNIKSEDPAYKGAGRTNVDAYGVDGIGAGAEEGEGASVSSAVEVVGTSDLLPLAFLGPLNVTVGSSRFQQFFLIYTKLMAGLKFSRDLESDWTPLALHRAMIKAGNPSMDVSCCAIREIWWEMWYPKFISDVSSFSHIS

SEQ ID NO: 120808 - protein, 39 aa, Glycine max
  Coding DNA Sequence Number=SeqID_29123
MKTKNLSQQCWALLVCNEIMVLNQEPVEGDTTGNNVRKS

SEQ ID NO: 120809 - protein, 115 aa, Glycine max
  Coding DNA Sequence Number=SeqID_29124
  Subcellular localization annotation: CTP_CleavageSite=80; ConfidenceScore=5.27e-01
MASMDTSAMVNSKIFPCNLRIRGSGEFVTFLDTTSRGSEMPQRTFLRRRHGPSVGLFTVGIKTEPICNAYPSAGGRRETRGMRVPRKEYARSRHQRLFEENVGKTGKDAIYELFK

SEQ ID NO: 120810 - protein, 95 aa, Glycine max
  Coding DNA Sequence Number=SeqID_29125
  Homolog annotation: Hit_ID=A5C2U3; Match level="QueryCoverage=41%, HitCoverage=3%, E-value=9e-09, Identity=69%"; Hit description =Putative uncharacterized protein
MSIRCDSQATLAKAYSQVYNGKSRHLGVRHNMVRELIMHESLTCRDWNTSSKVLPKPEVFGSGKKEKDYHISMKFSRFKKLRLGFDMLMKDRDTG

SEQ ID NO: 120811 - protein, 50 aa, Glycine max
  Coding DNA Sequence Number=SeqID_29126
MDTSEPYTGTMKGKEYHEHCTCIVAYEVCIYRISRQRLHASGSPKIMLTA

SEQ ID NO: 120812 - protein, 88 aa, Glycine max
  Coding DNA Sequence Number=SeqID_29127
MNLIIVIKRKDHALRRPYRTHARARVMGEVEEVQKQMKSDMEAMKEQMATMMEAMMSMKKIMEANAVAIAATSAVAKVNPMPHLASTK

SEQ ID NO: 120813 - protein, 99 aa, Glycine max
  Coding DNA Sequence Number=SeqID_29128
  Homolog annotation: Hit_ID=UPI0000ECBAF8; Match level="QueryCoverage =41%, HitCoverage=48%, E-value=1e-16, Identity=100%"; Hit description= UPI0000ECBAF8 related cluster
MAGVTKEDESGSPSWGASFFTQTTEDVARAVAAAMNSPRPSVSRPAGMQAWHWPSFYNVVTGKTLALPNLIALQHIPLSPAGVIAKRPAPIALPNSCAA

SEQ ID NO: 120814 - protein, 220 aa, Glycine max
  Coding DNA Sequence Number=SeqID_29129
MSKSFEFGMTGSLDESISCFLIRMDPRRAARPHLQRTTCPHFQRTAYPQLQRATRPRHQRTACLHLLGLHALTFRGLHVLANKGLHALTLRGLHVLANRGLHALTLRGLHVLANKGLHALTLRGLHVLANRGLHALTLEKATRPRQQRTARPHLERTTRPRLERTTHPHHQRAARPHLIFRGLHVLTFRGLRSLAFVGLHALTFRGLHVLTFRGLRALTF

SEQ ID NO: 120815 - protein, 162 aa, Glycine max
  Coding DNA Sequence Number=SeqID_29130
MIRGDTLRLSAPFCHPEAAGPMTSRDQVWSFCTLVSSRGGGPDDTRRYLTVIRTLLSSRGGGPDDTRRYLTVIRTLLGGGPDDKQRPSLSFAPCIIQSAGPMIRRYLRLFAPFVIQSAGPMTTETKFGHSAPLYHPERGPDDTRNTRVVIRIHSFAICKTDA

SEQ ID NO: 120816 - protein, 227 aa, Glycine max
  Coding DNA Sequence Number=SeqID_29131
  Gene Ontology: Mol. function=nitrate transmembrane transporter activity; Cellular component=plasma membrane; Biological process =nitrate assimilation
  Homolog annotation: Hit_ID=Q1H4I9; Match level="QueryCoverage=99%, HitCoverage=52%, E-value=1e-119, Identity=88%"; Hit description =Nitrate transporter periplasmic component
MQDVKTIVVPPPQMVANMRIGNMDGYCVGEPWNARAIYDKVGYSVATSQDIWTDHPEKVLGTTAEFVAKNPNTALALTKAILEACRYIDATKNRPEVAKLIAGKAYVNAPEEVIEGRFLGHYDNGIGKKWEDPNYMKFFNDGKVNFPYLSDGMWFLTQHKRWGLLKSDPDYLGVAKKVNRIDIYTEAAKSLGISVPADVMRTSKLIDGVVWDGKDPKAYANSFKVKA

SEQ ID NO: 120817 - protein, 228 aa, Glycine max
  Coding DNA Sequence Number=SeqID_29132
MDGRFSVERRVQLRDDEYTDFQEEIGRRRWAPLVTPMAKFDPEIVLEFYANAWPTEEGVRDMRSWGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPELITGLCQSFGVPVAPTKVIRPPITRAFIEKYCTQRQGQ

SEQ ID NO: 120818 - protein, 220 aa, Glycine max
  Coding DNA Sequence Number=SeqID_29133
  Gene Ontology: Cellular component=mitochondrion
  Homolog annotation: Hit_ID=A5B536; Match level="QueryCoverage=61%, HitCoverage=94%, E-value=4e-67, Identity=93%"; Hit description =Putative uncharacterized protein
  Subcellular localization annotation: CTP_CleavageSite=75; ConfidenceScore=5.80e-01
MDQKGGLGSISGPGGRGVYSTHSPVFRTAQVSVRLRMRTSFPSAHSPFTRFSKQRRKGGQQVPRALCPTHLSRSKCSSPVPPNAPISRQRSCECAVMLRMLRHRIDRPSSRSFPVHSLYISDTQGRTRWEGSSPSLCPADHSAGILHSRLRLTAARGWSCRYVSLSGSLAPPVISFYDMLLSSPYSICNLVISASLRVSTSERNGGLHSVTPRSPSKRSE

SEQ ID NO: 120819 - protein, 153 aa, Glycine max
  Coding DNA Sequence Number=SeqID_29134
  Homolog annotation: Hit_ID=Q8I5D4; Match level="QueryCoverage=94%, HitCoverage=12%, E-value=5e-09, Identity=30%"; Hit description =Putative uncharacterized protein
TAKKNGYTDNHSGISARQRDSNVSITDLVSAEDDTAKKNVYTDDHSGISAHQRDSNVSMTDLVSAEDDTAKKNVYTDNHSRISARQHDSNVTMTDLVSAEDDTAKKNVYTDDHSGISAHQCDSNVSMTDLVSVEDDSSNKNAYPDNHSGISDR

SEQ ID NO: 120820 - protein, 116 aa, Glycine max
  Coding DNA Sequence Number=SeqID_29135
MTEARQKGLKYITRGSETLRAAPFSLFIGKRGRRLPPSSPRRAGLLPPKAIQLQKYSERPNFKNSKFLFASPIFDKSITGVPDEGGGCHLARPGELGCFHLKQEIAQKPLFAPPFY

SEQ ID NO: 120821 - protein, 153 aa, Glycine max
  Coding DNA Sequence Number=SeqID_29136
MVIDYQRVKTLCFASTLETPVVLAKGETLPVYSLSYPNFVRGLLLDGMQPLIDRFEVLGTLCCTICEVQRRAGIQKEAWPTWAFQILPQKAIAFGGSNLARLGELGGKLLLYFAINRGRNEEGRGSAFLALRILLNLLRKIVSVKKIQAEALP

SEQ ID NO: 120822 - protein, 145 aa, Glycine max
  Coding DNA Sequence Number=SeqID_29137
  Homolog annotation: Hit_ID=A5BSR3; Match level="QueryCoverage=83%, HitCoverage=38%, E-value=4e-13, Identity=37%"; Hit description =Putative uncharacterized protein
KLLSEKTKKKLEEAAQSGSVDGVIDPLSPVRSHVKWMMARTKKIGEMTTEAAKEIAEKIDSFEEQATQGSFIPHGRQDVLATAIGRPEHPGRVRAVGVSVTIKKYFGSAPRMSHISSSLSPEELRQLTQQIRDKLEESITERVTR

SEQ ID NO: 120823 - protein, 100 aa, Glycine max
  Coding DNA Sequence Number=SeqID_29138
MGLKSILRLMRIQGPSLTSLTQSSWSLLSNECPWGVGLHHVKLELLVIRLDVHFHSIFPIRIVFSCEAWWPCERDPLNDELTVVVVIFHQDLFLLTLLGA

SEQ ID NO: 120824 - protein, 176 aa, Glycine max
  Coding DNA Sequence Number=SeqID_29139
MDNEEGVLEQMKADLSALKDQMASISEVMLKLQKTIEDKATATASSTVREVEPVLQPALNPGLDRNTVVFGRRYSPQAYPYGLPPDFTPCATPEDLSQAPTFEGQLPPYEDYPGQDDGEGDTHPGPLLHLKDPSPHELPQPNIVRHTPASPTLVKESVSLAEDRGKIEALEERLRA

SEQ ID NO: 120825 - protein, 313 aa, Glycine max
  Coding DNA Sequence Number=SeqID_29140
MAPRKLASKRSRKDKAAEGTSSAPEYDSHRFRSVVHQQRFEAIKGWSFLRERRVQLRDDEYTDFQEEIGRRRWAPLVTPMAKFDPEIVLEFYANAWPTEEGVRDMRSWVRGQWIPFDADAISQLLGISDGIGRGPGMQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAH

SEQ ID NO: 120826 - protein, 120 aa, Glycine max
  Coding DNA Sequence Number=SeqID_29141
  Homolog annotation: Hit_ID=A2FDT0; Match level="QueryCoverage=98%, HitCoverage=18%, E-value=5e-07, Identity=31%"; Hit description =Putative uncharacterized protein
CYKTYLATSNRLHPLNLSPLEGLHVLTFQGLHVLAIRGLHVPTFRGLHVLTLRGLHVLAFRGLDFLAFRGLHVFTFRGLHVLAFRGLHVLTFRGLHILTFRGLHVLIFRGLHALAFRGLY

SEQ ID NO: 120827 - protein, 57 aa, Glycine max
  Coding DNA Sequence Number=SeqID_29142
MEQNRLRPRLEVKTSQWQKSTKVLRDRGKWRIGSRPTVVLSAGLKNRERKKWQPSIL

SEQ ID NO: 120828 - protein, 107 aa, Glycine max
  Coding DNA Sequence Number=SeqID_29143
MSKSCGFGMTGPLDESISCFLIRVDPWVLVPITFRGLHVLALRGLHVLAIRGLHVLTIRGLHALTSRGLHVLALRGLHALTLGTSYPHRQRTTRPRLEKATRPHLGY

SEQ ID NO: 120829 - protein, 56 aa, Glycine max
  Coding DNA Sequence Number=SeqID_29144
DQRVPTNPKRIKVIPEWPTPPSVEGRSPEFQEPLDLRSNSFQGGGNDAILTPKDIG

SEQ ID NO: 120830 - protein, 152 aa, Glycine max
  Coding DNA Sequence Number=SeqID_29145
TLKAILHSHPFSEPHECHFLALFICPPLSSAKPLVTGKHKKKEGVETRVIITERAGRTKSVSYLCFPLISDERLARSVKFRNVAEIEKRPTWALQKIPPEGRCFWRKQPCSPGRAGKSKPRRFRNVSVSNYAKILDRSSRFIVRSSFPSVFN

SEQ ID NO: 120831 - protein, 164 aa, Glycine max
  Coding DNA Sequence Number=SeqID_29146
MVGYTPSSFADLVFAGEMIEVGLKRGKSDNHALINSKKKTRASEEGENEGETHAVTAIPIHPSFPPTQQCHYSANNKPSPYPPPSYPQRPSLNQPQSLSTALPMTNTTFSTNQNTNQEMSFAVEKKPVEFTLLGFLNLHFSEDTTRTQCVLFMEKPRGIPLSTV

SEQ ID NO: 120832 - protein, 206 aa, Glycine max
  Coding DNA Sequence Number=SeqID_29147
MVKEECKEVSVFFKRLAKKESHFVIKTNIKETYLLRQPPHLVLCKKTLVSTATPLRLEVIPHVNELLDEGLVRKSLNPCALLVPKIGIIRHQIPKIGDLMNVLSGATLFCKITHAPTIFMICVHRDSLGSDQEVPTYPKRITVIPLWPTPSSIRKIWGFHDLTNFYKRGGNDAILSPRALDIRLKEDWVRDAKEGHRVLMKLRVDF

SEQ ID NO: 120833 - protein, 160 aa, Glycine max
  Coding DNA Sequence Number=SeqID_29148
  Homolog annotation: Hit_ID=A5BG18; Match level="QueryCoverage=53%, HitCoverage=11%, E-value=4e-09, Identity=38%"; Hit description =Putative uncharacterized protein
MSNAWTDRKQRCIINFLLNSQAGTMFLKSIDGSDFVKTERLHKEKANIIKMFISDEWILNKLSKEPKGKEAAKVVLMPSFGIVWFTLLKSWLHLSQCFVLWVMKGNQPWAIFMKQWTRQKQQLSSLSTTTKASTKMCLQSLIKDEIVSFIGHCMQLRGIL

SEQ ID NO: 120834 - protein, 45 aa, Glycine max
  Coding DNA Sequence Number=SeqID_29149
MTHQGFQVYAIIPLVCLLKRPALLSVDFQDCSIRDYSSARLVGVP

SEQ ID NO: 120835 - protein, 60 aa, Glycine max
  Coding DNA Sequence Number=SeqID_29150
MTKSKGKDPLEGLGGPMTRARARKAKEALQQVLSILFEYKPKFQGEQSKVASAFWETNGG

SEQ ID NO: 120836 - protein, 84 aa, Glycine max
  Coding DNA Sequence Number=SeqID_29151
MCPAQDVKEALLGGNLVPFKSMLVIHSRTHLFAHDPKNLNKTSTSSEEHPLYPRTTGQTLTYIMTSRSTSLEPKSQLIINLDPG

SEQ ID NO: 120837 - protein, 223 aa, Glycine max
  Coding DNA Sequence Number=SeqID_29152
  Homolog annotation: Hit_ID=A5CBJ4; Match level="QueryCoverage=24%, HitCoverage=5%, E-value=3e-07, Identity=51%"; Hit description =Putative uncharacterized protein
  Pfam annotation: Domain name=Retrotrans_gag; Domain location=14-93; Score=12.9; E_value=0.003; Accession=PF03732.8; Description =Retrotransposon gag protein
MKPPDVQEDHIFLKAFPHSLEGVAKDWLYYLAPRSITSWDDLKRVFLEKIFPASRITTIRKHISATLEQLSSLKLYAANIYNRPPQPQQQNQPQQSNYDLSSNRYNPGWRNHPNLRWSNPQQQQQQPAPSFQNAAGPSRPYIPPPIQQQQQPQKQPTVEAPPQPSLEELVRQMTMQNMQFQQETRASIQSLTNQMGQLATQLNQQQSQNSGKLPSQAVQNPKN

SEQ ID NO: 120838 - protein, 172 aa, Glycine max
  Coding DNA Sequence Number=SeqID_29153
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=98%, HitCoverage=21%, E-value=3e-11, Identity=28%"; Hit description =Gag/pol polyprotein, 3'-partial, putative
  Pfam annotation: Domain name=G-patch; Domain location=97-141; Score =28.7; E_value=2.2e-05; Accession=PF01585.14; Description=G-patch domain
MVVRAFNGSRREVMGEIDIPIQIGPHTCNVVFQKLKFAVGGLLVIVSGEEDMLVSCPSSAPYVEAAVESLETAFQSFEVVSCASTETSPLLPSLSNAAIMVARVMLKHGYEPGMGLGKDGLGNADVVDIRGNPYKYGLGYEPGMLGRRNAPSRFRADRDGPTMLASVSPVPE

SEQ ID NO: 120839 - protein, 161 aa, Glycine max
  Coding DNA Sequence Number=SeqID_29154
MVGYTPSSFTDLVFASKKIEVDPKRGKFDHPTRTTEKTGANEEGEKEGETHAVTAIPIRPSFPPTQQCHYSANNKPPPYPPPSYPQRPSLNQPQSLSTALPMTNTTFSTNQKKHQQKGILQQKACRVHPKFRCHMLNLIPYLLDNSMVAITLAKVHQPPFL

SEQ ID NO: 120840 - protein, 259 aa, Glycine max
  Coding DNA Sequence Number=SeqID_29155
  Homolog annotation: Hit_ID=UPI000166267D; Match level="QueryCoverage =73%, HitCoverage=43%, E-value=3e-11, Identity=32%"; Hit description =UPI000166267D related cluster
VLHALAIRGPYVLTFRGLHALAIRGLHVLTFRGLHALAIRGLHVLTFVGLHALTFRGLHVLANRGLHALTFRGLHVLANRGLHALTLRGLHVLANRGLHALTLRGLHILANRGLHTLTSRGLHILALRGLHALTFRGLRVLIFRTSSFLLTVPGPPRDIGGGLRGLHVLANRGLHTLTSRGLHILTLRGLHALTFRGLCVLIFIFGPPPDIGGGPTVRAQPEREAITQLLCILGQDFTRAAAKRRVRIMRTNMTTLTQI

SEQ ID NO: 120841 - protein, 104 aa, Glycine max
  Coding DNA Sequence Number=SeqID_29156
AFVYRVQEFLNPVVCGVKSANQDGVDNTVCEKYDISKEKWAQFCQTCRDPSWEDVRKKAKHKLLAEKTRKKLEEAAQSGSVDGVNDPPSPVRRHVKWKMARTKK

SEQ ID NO: 120842 - protein, 248 aa, Glycine max
  Coding DNA Sequence Number=SeqID_29157
  Pfam annotation: Domain name=Transposase_23; Domain location=127-197; Score=9.8; E_value=0.0001; Accession=PF03017.5; Description=TNP1ENSPM transposase
  Subcellular localization annotation: CTP_CleavageSite=61; ConfidenceScore=5.12e-01
DSFEEQATQGSFVPHGQHPGRVRAAGAGVTIKQYFGSAPRMSRSSSSLPPKELQQLTQQIRDQLEESITKRVMRQVMASFSQMQSQLQSQMQSQGLVVPPDPLVGPSGPRVSTKGSCVDPSGNNLETGDSDRCGLYIEADPALLVAIGRVYEGSTIVHNTPLLPGQVKVSVEEVTDADAPVPVPTDEVSLVGQALHTFLAWPTHLVKSFSQQVVVSLAKPPPKPDLEVDDPLYLMTSTIPELFLRPYQ

SEQ ID NO: 120843 - protein, 82 aa, Glycine max
  Coding DNA Sequence Number=SeqID_29158
MTNAGMICPLRCHEEMHDAINEYARRQCITKRGKLYMRFHCHQASQRLSMTTDRPPLLMAHIDLGVGPNISMCVRGVGVMCA

SEQ ID NO: 120844 - protein, 269 aa, Glycine max
  Coding DNA Sequence Number=SeqID_29159
  Gene Ontology: Mol. function=transporter activity; Cellular component= integral to membrane; Biological process=transport
  Homolog annotation: Hit_ID=A4WCX1; Match level="QueryCoverage=99%, HitCoverage=86%, E-value=1e-130, Identity=85%"; Hit description =Putative transport
  Pfam annotation: Domain name=Form_Nir_trans; Domain location=1-247; Score=-120.4; E_value=0.0084; Accession=PF01226.8; Description =Formatenitrite transporter
MAIHEHIRQDGEKEMERDAMALFWSAIAAGLSMGASLLAKGIFHVQLEGVPGGFLLENLGYTFGFIIVIMARQQLFTENTVTAVLPVMQNPTLGNFGLLMRLWSVVLLGNIIGTGIAAWAFEYMPIFDEPTRDAFVKIGMDVMKNTPVEMFSNAIISGWIIATMVWMFPSAGSAKIVVIILMTWLIALADTTHIVVGTVEILYLVFNGTLHWSDFFWPFALPTLAGNICGGTFIFALLSHAQIRNDMSNKRKAERKARENDDKSTKKST

SEQ ID NO: 120845 - protein, 204 aa, Glycine max
  Coding DNA Sequence Number=SeqID_29160
VRKECVGLREENAATAKALEQETKRACKEEHGCEKFRRALWGNNSELKLRREERDRSRAHSMVLKEELAACSRSKRNLNQCLCETETNMLAIITKYQEELSLATTHKHRVADEYAQVYAKKEARGRVIDSLHQEATMWMDRFALTLNGSQELSRLLAKAKAMADTYSAPEEIHQTSRLLSAYDRFNGPYNYEPLGNLYCHSDLD

SEQ ID NO: 120846 - protein, 93 aa, Glycine max
  Coding DNA Sequence Number=SeqID_29161
SGYGLCSPTGCLFPPARSRHHDIALITGLCQFYGMPVTSSKVIKPPTNRVFIKKYCVPRQAQGETPQQPGDGRQRATDAPPSPLEFTSAHPQK

SEQ ID NO: 120847 - protein, 167 aa, Glycine max
  Coding DNA Sequence Number=SeqID_29162
  Homolog annotation: Hit_ID=B0HC01; Match level="QueryCoverage=19%, HitCoverage=70%, E-value=4e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTQARPRDFPDFSLSDEFILYKGAIWINPRNPLIPALLHEYHSTPLGGHFGIKKTLHRLR

SEQ ID NO: 120848 - protein, 80 aa, Glycine max
  Coding DNA Sequence Number=SeqID_29163
MHSLDFRIVIIKKGEIVEAMSSKVILMMPKNQESSKIQRFKNQVSRFKIQESSVKNQDSRIIKIKIQDSRFKKQGKTQSR

SEQ ID NO: 120849 - protein, 82 aa, Glycine max
  Coding DNA Sequence Number=SeqID_29164
MAEEARRVTLEDYSSSMVEKFLKKYFPEFKTAEGKTTISSFHQFLDESLSEALERFCDASAGGKIKLKTPEEAMDLIENMAA

SEQ ID NO: 120850 - protein, 141 aa, Glycine max
  Coding DNA Sequence Number=SeqID_29165
  Gene Ontology: Mol. function=chitin binding; Cellular component =extracellular region; Biological process=chitin metabolic process
  Homolog annotation: Hit_ID=UPI00006A17C9; Match level="QueryCoverage =74%, HitCoverage=100%, E-value=1e-15, Identity=35%"; Hit description= UPI00006A17C9 related cluster
  Subcellular localization annotation: CTP_CleavageSite=33; ConfidenceScore=5.51e-01
MARACSPLKLRMRSPLKARACSPLKARTCSPTKARACSPLKERTCSPLKERTCSPLKVRTCSPLKARTCSPLKVRACSPLKARVCSPLKARACSPLMARACSPSKIDCPFERGDNSCNLIVSFANLSGNSLRVYVLFDLNT

SEQ ID NO: 120851 - protein, 61 aa, Glycine max
  Coding DNA Sequence Number=SeqID_29166
MAPVVCAVAIAAVVDRDHTSSSNDLSNHDYRCWSKDYIAVVEKHQQHFMFPGVWNMHLLDD

SEQ ID NO: 120852 - protein, 165 aa, Glycine max
  Coding DNA Sequence Number=SeqID_29167
  Pfam annotation: Domain name=G-patch; Domain location=1-42; Score =25.1; E_value=0.00018; Accession=PF01585.14; Description=G-patch domain
MVARVMLKHGYEPGMGLGKDGLRNADVVDIRGNPYKYGLGYEPGMPGRRNVPSRFWADRAWPGHVSLCFTSAGIMFEEEVAAIGEECPQDPPSFVRPCHPDSQVGNWRMISQSEVYTADSIYEGRFFEDPNDEGLTIDFDRYVSQTMNEEVEEDVLSPELERLIA

SEQ ID NO: 120853 - protein, 229 aa, Glycine max
  Coding DNA Sequence Number=SeqID_29168
MSHGPRRMRRKAIKKEDPRRRILLGMTMTHPMVWRRRSSFYPRTMKVMRTSLKKFKLKLPKTPPNGRTIEEAKGGCNFIRSHWNSKPRNIQSADISNSSLSYVVFLGRTMYSFISMKLTFYPELVKAFYSNLEIQEDSFISEVYGIKMVIDQSLFFELTQLSSDDIPFEGTLDDEWKFDFSVSNARRMVCTNQADMDGRLLASSLAFECRIMHYLIVHILLPRSSNLAQ

SEQ ID NO: 120854 - protein, 98 aa, Glycine max
  Coding DNA Sequence Number=SeqID_29169
MASRKLSAKRSRRDATAEGTSAAPEFDNHHFRSAEHLQRFEAIKGWSFHRERRVPLRIGVRDMRSWVRGQWIPFDADALSQFLGDPLVLEEGQECEFS

SEQ ID NO: 120855 - protein, 203 aa, Glycine max
  Coding DNA Sequence Number=SeqID_29170
  Homolog annotation: Hit_ID=A5BSR3; Match level="QueryCoverage=64%, HitCoverage=43%, E-value=6e-12, Identity=35%"; Hit description =Putative uncharacterized protein
MDEKRKKKLEEATQSGSTDIVIDPSSPIKRHVKWKLARTKKTSDMTSEAAKEIADKIDALEEQASQGSFVTHGRHDILTAAIGRPEHPGRVRAVGAGITIKQYFGSASRTSFIALEYLQQLTQQIKDQLEDSITEKVTRRLMLSLSQMQSQGLELPLEPDVGPSAARVSTKESCVDPSGTIQTRVTHTNAGCILKNILLAWLP

SEQ ID NO: 120856 - protein, 79 aa, Glycine max
  Coding DNA Sequence Number=SeqID_29171
MQYLGSDPRSSPNEQWNNQHENKEKGMFYSTTFLNFLNSDQRLPMDPKRIKVLRKESLSFKNPFQGGGNDAILLPKGIG

SEQ ID NO: 120857 - protein, 169 aa, Glycine max
  Coding DNA Sequence Number=SeqID_29172
MHRSPTGNLVPLDLEIEATLRRNRAGRRRKLLQDRTVASILEEEAQSFDSTSSDSLSSRESAIYLLEASVMADEHQQRVTLEDYSSSSVSQFFTREAKKWLHSFKGNSLETWEQVVEKEREKRKEKASDKGMEVPYPVVQSKKDKDRHLARFLDIFRKLEITMPFGEAL

SEQ ID NO: 120858 - protein, 69 aa, Glycine max
  Coding DNA Sequence Number=SeqID_29173
  Homolog annotation: Hit_ID=UPI0000ECBAF8; Match level="QueryCoverage =59%, HitCoverage=48%, E-value=1e-16, Identity=100%"; Hit description= UPI0000ECBAF8 related cluster
DDSRRHSPGNSSRNSRGMQAWHWPSFYNVVTGKTLALPNLIALQHIPLSPAGVIAKRPAPIALPNSCAA

SEQ ID NO: 120859 - protein, 104 aa, Glycine max
  Coding DNA Sequence Number=SeqID_29174
  Gene Ontology: Mol. function=tetraacyldisaccharide 4'-kinase activity; Biological process=lipid A biosynthetic process
  Homolog annotation: Hit_ID=A8HSY3; Match level="QueryCoverage=83%, HitCoverage=82%, E-value=1e-17, Identity=53%"; Hit description =Putative uncharacterized conserved protein
  Pfam annotation: Domain name=Trm112p; Domain location=51-90; Score =68.5; E_value=2.2e-17; Accession=PF03966.7; Description=Trm112p-like protein
MRRPWTVKTCCGCSARFWMPTSWKRIGRVWKGPATVFCRIAAMDDRMNNVDPKLLELLVCPLTKGRLSYDRARNELISENARLAYPIRDGVPIMLISEARKIED

SEQ ID NO: 120860 - protein, 68 aa, Glycine max
  Coding DNA Sequence Number=SeqID_29175
MDVKSDFWNAMNEEVYVEQPKGICSPTHPILYREGSHGLKQAPRSRTNSVPYLQQKPSILTGSSCSQT

SEQ ID NO: 120861 - protein, 62 aa, Glycine max
  Coding DNA Sequence Number=SeqID_29176
MPISPCESIGWSVPSRHRGRAHKTPSGPGGAQQGPGVSSSGYGPLSVLQGVRPPQQGHAIVT

SEQ ID NO: 120862 - protein, 107 aa, Glycine max
  Coding DNA Sequence Number=SeqID_29177
  Gene Ontology: Mol. function=iron ion transmembrane transporter activity; Biological process=high-affinity iron ion transport
  Homolog annotation: Hit_ID=Q0AXQ8; Match level="QueryCoverage=70%, HitCoverage=20%, E-value=6e-10, Identity=39%"; Hit description =Iron(III) ABC transporter, solute-binding protein
MDNVAGDLPVKGDAGSAKALLHGGIPGQAWETLRAVKNGKVFSTPMGIHNWGGLSAETSLLPLFMINRYAPEDISDKTLREETRRYYQTMFSYAIPDRLLDEVLAQR

SEQ ID NO: 120863 - protein, 148 aa, Glycine max
  Coding DNA Sequence Number=SeqID_29178
  Homolog annotation: Hit_ID=A0ST23; Match level="QueryCoverage=21%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFIALQKRFLHYIKVAKGQVPDSNNKKVGKPVVPAALMNRPTRGERRFAYWALFRFLAH

SEQ ID NO: 120864 - protein, 159 aa, Glycine max
  Coding DNA Sequence Number=SeqID_29179
MRGAPTEESLSPFLVRDFGAQSLKVVQRVHKAWKSPLRKDKELRGIRNGIIGDWPSKLKIINEENFEAPEEDEEVQALKLELGKVRLAKEKFKLAATNIRKKCAELREENAATARALEQETKRPTRKSMAEINSKELCGVATMSSSSGERKETSHGYMA

SEQ ID NO: 120865 - protein, 301 aa, Glycine max
  Coding DNA Sequence Number=SeqID_29180
MVRTRELCLALGRVIGRALGTQVSGDADEAPQRRRPTTSARRQWAAAPVVEDVEHVDHAANEVHEQPQEAVIDDVCADAQGFPIGPHNTSVLADYVHHVTTIVWAGEERPKLKLSFHGRKRTARQLAGYITLLQCWIYRHFPTAALCVADEDYHERKPCACRWKFGKALSFGYVQTIPPHPAAPSLSIEEIDDRWMQFSEYLAPPRDPPRHPPVMHDDTFIEPNPPQQSVAAAAILEPPTPALADVDMPRHVMEACQQITEMLEHLINTRIVTTGTEAHIVTEQCLIITKGTGHMKILGID

SEQ ID NO: 120866 - protein, 69 aa, Glycine max
  Coding DNA Sequence Number=SeqID_29181
  Subcellular localization annotation: CTP_CleavageSite=61; ConfidenceScore=5.10e-01
STLEDPDRAAGHPVDQRSPTGSWGSSSDYGPLSVLRSVRRPNKVIRPRINRAFIKKYCAPRRAQGKTPQ

SEQ ID NO: 120867 - protein, 104 aa, Glycine max
  Coding DNA Sequence Number=SeqID_29182
MELIENMSASDHAILLDRAHIPTKRSLLELSSQDALLAQNKLLSKQIEALTETLSKLPTQLHVGQPSPSSVLQVAGCVICGGAHNFGCCIPTEDTTHEVNYIGN

SEQ ID NO: 120868 - protein, 143 aa, Glycine max
  Coding DNA Sequence Number=SeqID_29183
  Homolog annotation: Hit_ID=B0HC01; Match level="QueryCoverage=23%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTQGFVDGVVDDFLGQVVRAGGVGVHARAAFDRGIL

SEQ ID NO: 120869 - protein, 182 aa, Glycine max
  Coding DNA Sequence Number=SeqID_29184
MAPTRHPLDPDKSNRALGFPALITGLWQSFGVPVAPSKVIWPPITRAFIEKYCMQRQVQGDAPQAADAPPPHQTGPARSFDTEQYLRHFVRQQAANHRAHVQTHDCLYQMSLSLQDQGFTSFPCPTPDQFRAEVAWPRDWPEAQAGEAPAEALAKALDEADEAREDEEMTDLLDFLGGSGAT

SEQ ID NO: 120870 - protein, 62 aa, Glycine max
  Coding DNA Sequence Number=SeqID_29185
MTFCFLSCMLLGVKTPVVLSGNRDERAKRACVLSLFITTVKILDFQMNALSRPCRVKRVHPC

SEQ ID NO: 120871 - protein, 51 aa, Glycine max
  Coding DNA Sequence Number=SeqID_29186
MTTLASACQSNLGSSNDKVRITGSPPQGGVVDKSEAFAPTYPPFVMRNSDL

SEQ ID NO: 120872 - protein, 132 aa, Glycine max
  Coding DNA Sequence Number=SeqID_29187
MAFLGETSSQTIVNSRLAFIFPNGSIIHNDTGVYFQTSTPVPIRLLCTVGRTPDGIINLLQRIMPHTHDVILYYNGKWNMPPQNKFVGCAFTGKNPKKFQIPSTCTIDELKDLIKQVAPKMILPLGIHESQT

SEQ ID NO: 120873 - protein, 116 aa, Glycine max
  Coding DNA Sequence Number=SeqID_29188
MRKDVDRSPQIDNYIEGLYKSIYSFLCRSPRKITNELGEVRQRRAEARLLDTSGKPGQNHTCKFPCMWLVRDNLFGFARTSGPITKWGCSLQHERTFSKLVRNGRHYPSPDPARFY

SEQ ID NO: 120874 - protein, 123 aa, Glycine max
  Coding DNA Sequence Number=SeqID_29189
  Gene Ontology: Mol. function=chitin binding; Cellular component =extracellular region; Biological process=chitin metabolic process
  Homolog annotation: Hit_ID=UPI00006A17C9; Match level="QueryCoverage =68%, HitCoverage=19%, E-value=3e-07, Identity=34%"; Hit description =UPI00006A17C9 related cluster
  Subcellular localization annotation: CTP_CleavageSite=42; ConfidenceScore=5.15e-01
MTTRSPQGEGVQPSQWRGRVVLWKVRACSPTMARTCSPLMARACKPSEGEDMQSLMARACSPLKVRTRSPLMARACSPLKVRTCSPLKVRTHSPLKVRACSPLLARTCSPLKTRVLVPEGPSL

SEQ ID NO: 120875 - protein, 373 aa, Glycine max
  Coding DNA Sequence Number=SeqID_29190
  Gene Ontology: Mol. function=inositol 2-dehydrogenase activity; Biological process=electron transport
  Homolog annotation: Hit_ID=A8GKW1; Match level="QueryCoverage=44%, HitCoverage=49%, E-value=6e-63, Identity=71%"; Hit description =Inositol 2-dehydrogenase
MAITDTLIHELDVLRWLLNDDYVSAQVIYPRKTRHASSHLKDPQIVLLETAKGIRIDVEIFVNCAYGYDIQCEVVGESGIARLPEPMSVQTRHAAQLSTGILTDWKKRFIAAYDVELQDFINNVLSGNMTGPSAWDGYAAAVAADACVAAQNNGDIVPITMPPPVFPSVTARASHLLAIPCIIAAFMLCKEKCDDGERNGAPPALGMVGRHDHLWDGSGRRYVYVADRDGRGVVWLGAAAAGHQLGRNAALRAAVYACQPALSARRGLRYADARFAWARLGQHQWPQHPVCAGHSHLRLYLSQRSGLSALAESAWRAALNGRGQNRTDVVCRRRGMARHHRRQSFDDVLRAGKNPAIDFAVRRTVNPGRCALA

SEQ ID NO: 120876 - protein, 274 aa, Glycine max
  Coding DNA Sequence Number=SeqID_29191
MVPRKLASKRSRKDKAAEGTSSTPEYDSHRFRSAVHQQRFEAIKGWAPGGGHHWVTPMAKFDPEIVLEFYANAWPTEEGVRDMRSWVRGQWIPFDADAIGQLLGYPLVLEEGHECEYGQRRNRSDGFDEEAIAQLLCIPGQDFARTAAGRRVRIMRTNMTTLTQIWMTLLLSNILPSDHNSDLPLPKCQLVYAILTRMSIHVAQLIADAIYIFAGMAPTRHPLDPDKSNRALGFPSLITGLCQSFGVPVAPTKVIRPPITRAFIEKYCTQIQAQ

SEQ ID NO: 120877 - protein, 174 aa, Glycine max
  Coding DNA Sequence Number=SeqID_29192
MVKEECKEVSASSKRLVKKESHFEIKKNIKETSPLRQPLHLLLCKKTLVSTATPLGLEVIPQVKELLDEGLVRKSLNPCALLVPKIGIIRHQIPTISDMMNLLSVATLFCKISHAPNVFMIHVHRDSLGRNNQHKNTEKGVKGKSPEYQEPQDLRSNPFQGGGDDAILPPKGIG

SEQ ID NO: 120878 - protein, 208 aa, Glycine max
  Coding DNA Sequence Number=SeqID_29193
  Gene Ontology: Mol. function=oxidoreductase activity; Cellular component=cytoplasm; Biological process=metabolic process
  Homolog annotation: Hit_ID=Q3BBM8; Match level="QueryCoverage=100%, HitCoverage=77%, E-value=5e-74, Identity=69%"; Hit description =Xylitol dehydrogenase
  Pfam annotation: Domain name=adh_short; Domain location=2-133; Score =36.8; E_value=4.7e-08; Accession=PF00106.16; Description=short chain dehydrogenase
DKAAAALRELGEEQVFCQVCDVTDSDSVAAAFNAAQRRFGPLDILVNCAGYVNLQPATEVTLEEWQRHLAVNLTGPFLCSQELARRAIAAGHGGKIINIASQAASIAIDDHCAYTSAKAGLLGMTKVMAKEWAPHGITVNTLSPTVVLTPMGEKAWRGEKGEAMKKLIPLGRFAYTDEIAAAILFFASNGSDMITGADLMIDGGFTIW

SEQ ID NO: 120879 - protein, 81 aa, Glycine max
  Coding DNA Sequence Number=SeqID_29194
  Homolog annotation: Hit_ID=A7Q5A7; Match level="QueryCoverage=61%, HitCoverage=69%, E-value=5e-14, Identity=76%"; Hit description =Chromosome undetermined scaffold_52, whole genome shotgun sequence
MRSSSLICLLVPRTVEQRSIPTYTEISESIKSPQVGFEPTPSQLTADRSTTELLRNNGKFELIEFNSRSQPMTNMSSKYPS

SEQ ID NO: 120880 - protein, 83 aa, Glycine max
  Coding DNA Sequence Number=SeqID_29195
MPMPSRRLDGSSPEFHSLHPATVILHSQTRFVIITGIFSRKLLKEVSLVIRGMCVAKLYLLKEVFSKKLLKEVFSRKLLKEAT

SEQ ID NO: 120881 - protein, 70 aa, Glycine max
  Coding DNA Sequence Number=SeqID_29196
LIKVILVASTLTYLPSLEVGSTLTYLPSLGSGVYLDLSSFAGSCVYPDLFSLFGSGVIQISVACIKRSAP

SEQ ID NO: 120882 - protein, 29 aa, Glycine max
  Coding DNA Sequence Number=SeqID_29197
MEEIHGEDDEEQIEEAKRHHLDEDAHDTT

SEQ ID NO: 120883 - protein, 87 aa, Glycine max
  Coding DNA Sequence Number=SeqID_29198
MENWRIAPDNQFAGLQTRRWRTHELALGNEFMGLLIKVENGELANSARQSIRGAPDSKNGELANSARQSIRGAPDSKVGGHMNSARQ

SEQ ID NO: 120884 - protein, 112 aa, Glycine max
  Coding DNA Sequence Number=SeqID_29199
MSNNRVLKEHNKTFLNWFKDTIFGDDNASETLRKLADGPKRNVITCNIGVWTNDVQFMLVDLKKLAYQNDPFIIEEQTKEKMATPPSSHPPPPSTDSTSHSPSTMKRTRKVT

SEQ ID NO: 120885 - protein, 285 aa, Glycine max
  Coding DNA Sequence Number=SeqID_29200
  Homolog annotation: Hit_ID=A6YTC8; Match level="QueryCoverage=43%, HitCoverage=13%, E-value=8e-08, Identity=31%"; Hit description =Nucleolar GTPase
MYLEAYLNGTHWQMVIILPKENVVIWLCSLHNRPDNYLKGIINRQKGSTECEYYVMHWISTIILGSFKNNWEIYFNDTRPLEPERLKALRIPWASYYLKAHLTSLHFSEYLSQPQRVSTSNYTNPLDDDDWGEFMNHSNQINSKPFNSFGVPTDPTNKHVNDEKGVVVQPEAVKNPKGAILLSIFGEEEGKEEEKLVSANVFSNGDAGAMKRGSSSNRSVRISDLISSLYNQQRPQVDSHNNESVSVSNVAAPNLMYSNGSKLNSDEDEDGWEFKSAEWETGTKS

SEQ ID NO: 120886 - protein, 88 aa, Glycine max
  Coding DNA Sequence Number=SeqID_29201
MEAKMAELSNLVRENSTKKDHTQTNNQVPPGEYRLSAIAATLENGVGLRGESKLESFIDIVEHDMIILYGIRATPKSVLELMDVKDAL

SEQ ID NO: 120887 - protein, 85 aa, Glycine max
  Coding DNA Sequence Number=SeqID_29202
MCPRAHRGSLQDISLYYKWGPLTVIHRPKRVVQQFGYIQTILPHLATSSLSIEEIDDGWMQFGEYIAPVGQLCVVPGHYSPDYMD

SEQ ID NO: 120888 - protein, 66 aa, Glycine max
  Coding DNA Sequence Number=SeqID_29203
LYQFYGVPATSSKGIRPPTNRAFIKKYCVSRQAQGEIPQQPWDGRLRATDAPPSPLGFTSAHPQKG

SEQ ID NO: 120889 - protein, 35 aa, Glycine max
  Coding DNA Sequence Number=SeqID_29204
MEGTTGLSKKGPYTRVHGNLRSGGESMVMLGLRLA

SEQ ID NO: 120890 - protein, 113 aa, Glycine max
  Coding DNA Sequence Number=SeqID_29205
  Homolog annotation: Hit_ID=A4WBP0; Match level="QueryCoverage=100%, HitCoverage=29%, E-value=1e-47, Identity=76%"; Hit description =Fimbrial protein precursor
GYALKSVDINYHCDDNAVGNNDRIKLTLTADQGIVDSSTPYIAKLLERDDLGVRVYDENSQNVALDGTYAFPVNLDEQGNGSVKIQAVPVSTTDATPAPGSFEGNVTVKMDLR

SEQ ID NO: 120891 - protein, 360 aa, Glycine max
  Coding DNA Sequence Number=SeqID_29206
  Gene Ontology: Mol. function=signal transducer activity; Cellular component=membrane; Biological process=signal transduction
  Homolog annotation: Hit_ID=Q0G2R6; Match level="QueryCoverage=73%, HitCoverage=37%, E-value=2e-53, Identity=44%"; Hit description =Putative signal transduction histidine kinase with GAF domain
  Pfam annotation: Domain name=GAF; Domain location=151-291; Score =36.0; E_value=1.3e-07; Accession=PF01590.17; Description=GAF domain
  Pfam annotation: Domain name=HWE_HK; Domain location=306-360; Score =26.2; E_value=7.9e-07; Accession=PF07536.5; Description=HWE histidine kinase
  Pfam annotation: Domain name=PAS; Domain location=12-123; Score=18.8; E_value=0.0075; Accession=PF00989.15; Description=PAS domain
  Pfam annotation: Domain name=PAS_3; Domain location=35-129; Score =5.4; E_value=0.031; Accession=PF08447.2; Description=PAS fold
  Pfam annotation: Domain name=PAS_4; Domain location=18-131; Score =6.1; E_value=0.053; Accession=PF08448.1; Description=PAS fold
  Pfam module annotation: Pfam domain module=GAF::HWE_HK::PAS::PAS _3::PAS_4; Domain location=151-291::306-360::12-123::35-129::18-131
MRAVEALRNSETKLRLIVEGAKDYIILTLDENQRITSWFGGAEETFGWSEAQMLGRPFEEIFTQEDRAANIPQFEIETAGRDGVAPDRRWHLAADGTRVFLDGTIRPMPNHSSSHLSGFIKVARNATAQKLSEDRQLAFLELGEKIRELDSVAEVAFAAAEIMARNLQGATRAGYGIVDPIAETVEMLPDWRAPGMFTVAGQHQFRDYGSYIEDLKRGELVIIADVAADPRTSASAELLNSLGISVLGNVPILERGAFVGVMFVHYEKPHEFSSEERDFVRTIADRTREAISRIRAEQEQQVLNHEISHRLKNTMAMVQAIATQTLRPVTERAPVEAFVSRLHALSKAHEVLLTHDWSSA

SEQ ID NO: 120892 - protein, 102 aa, Glycine max
  Coding DNA Sequence Number=SeqID_29207
  Gene Ontology: Mol. function=nucleic acid binding; Biological process= DNA integration
  Homolog annotation: Hit_ID=A5C3F7; Match level="QueryCoverage=62%, HitCoverage=6%, E-value=5e-14, Identity=56%"; Hit description =Putative uncharacterized protein
MEKSEKKNHSEKKLKKAYITWDENDMESSEDSENEEINLCLMAKIYESDEEVSLRKKWYIDSGCSKHMTGDASNFTHISPKKSGHVTYGDNNKGRILGVGKI

SEQ ID NO: 120893 - protein, 139 aa, Glycine max
  Coding DNA Sequence Number=SeqID_29208
THPGNQFNKDQGGPSNRPQQQEPSLCDRMTKLEETLAQFLQVSMSNQKSTESTIKNLKVHVGQLAKQLADRPSSSFGANTEKNPKEECKAVMTRSKMVSLNEGEKRIGDEKQQLVTKLEIDPVVEPLSEAEEEVEAEDD

SEQ ID NO: 120894 - protein, 22 aa, Glycine max
  Coding DNA Sequence Number=SeqID_29209
STLEHPRLDTEFGMLLSPIALK

SEQ ID NO: 120895 - protein, 143 aa, Glycine max
  Coding DNA Sequence Number=SeqID_29210
IPDYPAGGVAALLQRGGGRDRQRLYRVGRHHLRRRPPAVGRPGADPRHRPLHVGSPRADQPGGQRGGDRGRGEGTRIHLIVGGLLLAAARGAGQRVFMANSRYAAAAKRPRGTAADRQYRLSGGVFTTDRLRPAAAAAGVDAQ

SEQ ID NO: 120896 - protein, 72 aa, Glycine max
  Coding DNA Sequence Number=SeqID_29211
AVASGGSNLARLGELGGKHLPYFAINSGGSEEEKAEALPKRFRNVFREEFRKSFSRSSTFFIRSSSFFDLQR

SEQ ID NO: 120897 - protein, 38 aa, Glycine max
  Coding DNA Sequence Number=SeqID_29212
MVYKNSHNIRYSLSLDEILLSFSSGAPMRILFTGQGSK

SEQ ID NO: 120898 - protein, 206 aa, Glycine max
  Coding DNA Sequence Number=SeqID_29213
ENFSPISPSGFNLLKRSAGIIEKRKALYVLVLGAPVKGLTSDVWKYVVEVNSSEMQPEGNLSFDPHMAMVQIQTKDFLSCFDLSGSRLFKIFRIVTAPFIAIRETALFPQDGPSCFCLMETRVQVQTFRNQTWRGQDSNLQSQGAATKEVARLTAIADRFTPRGAYTSRLSKFCSKTSSENLYREGFPAAQQFFHTNLAARRWGIL

SEQ ID NO: 120899 - protein, 30 aa, Glycine max
  Coding DNA Sequence Number=SeqID_29214
MFLHGKMPRKWVFRPYLTSTSQNPLIWLHM

SEQ ID NO: 120900 - protein, 115 aa, Glycine max
  Coding DNA Sequence Number=SeqID_29215
MQYNEKWKIPRQGGFLDYSFTGTNPIRFDILSGCSIDKLKDIIKQVASLGVPPYGIHELQVVRRLFFRQPGHAKYSEKLIEYEITELKNGEDMLKVLVESNYWKRFCPIEILLNK

SEQ ID NO: 120901 - protein, 152 aa, Glycine max
  Coding DNA Sequence Number=SeqID_29216
  Homolog annotation: Hit_ID=UPI0000ECBAF8; Match level="QueryCoverage =26%, HitCoverage=48%, E-value=1e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGMQAWHWPSFYNVVTGKTLALPNLIALQHIPLSPAGVIAKRPAPIALPNSCAA

SEQ ID NO: 120902 - protein, 132 aa, Glycine max
  Coding DNA Sequence Number=SeqID_29217
  Homolog annotation: Hit_ID=UPI0000ECBAF8; Match level="QueryCoverage =31%, HitCoverage=48%, E-value=1e-16, Identity=100%"; Hit description= UPI0000ECBAF8 related cluster
MEKRQQRGLFTVPGLLLAFCSHVLWVGDPLILWITVLPPLSELIPLAAAERPSAASHWHDRFPDWKAGSERNAINSRPAGMQAWHWPSFYNVVTGKTLALPNLIALQHIPLSPAGVIAKRPAPIALPNSCAA

SEQ ID NO: 120903 - protein, 50 aa, Glycine max
  Coding DNA Sequence Number=SeqID_29218
MWDRHMLKGVLKPGVFTPKAYTPKSLSGPLPPDSDTAHELYNTHDLTLVF

SEQ ID NO: 120904 - protein, 166 aa, Glycine max
  Coding DNA Sequence Number=SeqID_29219
  Homolog annotation: Hit_ID=B0JCV8; Match level="QueryCoverage=81%, HitCoverage=19%, E-value=5e-07, Identity=29%"; Hit description =Misfit TNP1-like protein
KWAVAVDKDGADDIVCEKYGISKEKWTQFCQTRRDPSWEASQKQNTAPHVLSRGGYEYLEEKLMAEKTKKRLEEAAQSGSTEGIIDPPSPIRRHVKWKMARTKKTGQMTSETAKEITDRIGSFVPHGRQDILTAAIGRPEHPGRVCAVGSRCHHKAILWISFTNIP

SEQ ID NO: 120905 - protein, 129 aa, Glycine max
  Coding DNA Sequence Number=SeqID_29220
MSSWGKKTVSFLRAPSSPKRGWMRKKHTGAHQQPHLGYNWVAYPYGVPPNYMPPVMRDEAGHVPSPILEGEPPRQSDEVHEDRREYAQGDIDFYPLVPVEGPAPNTLPQPNLLAQPIFLSTEGSPPAAE

SEQ ID NO: 120906 - protein, 124 aa, Glycine max
  Coding DNA Sequence Number=SeqID_29221
  Gene Ontology: Mol. function=thymidylate kinase activity; Cellular component=integral to membrane; Biological process=nucleotide biosynthetic process
  Homolog annotation: Hit_ID=Q1C6N6; Match level="QueryCoverage=99%, HitCoverage=58%, E-value=2e-51, Identity=82%"; Hit description =Thymidylate kinase
  Pfam annotation: Domain name=Thymidylate_kin; Domain location=8-124; Score=54.3; E_value=4.3e-13; Accession=PF02223.8; Description =Thymidylate kinase
MKSKFIVIEGLEGAGKTTAREAVVAVLHEQGIEDVVFTREPCGTPLAEQLRVLVKQGIDGEQVSDKAELLMLYAARVQLVENVIKPALARGAWVVGDRHDLSSQAYPGGGRGLDTQLMTTLRDA

SEQ ID NO: 120907 - protein, 84 aa, Glycine max
  Coding DNA Sequence Number=SeqID_29222
MDLFRSWRGSIIMPIGWTSQESGTNIEEEEPTNLRSNPLQGGGDDAILPRKGPVTKAMSKRLQEDWARGDKEGLRVLMNLRVDF

SEQ ID NO: 120908 - protein, 202 aa, Glycine max
  Coding DNA Sequence Number=SeqID_29223
MSEIEEVQERMKADMEAMKEQMATMMKAMMSMEKRMEVNVAAVAATSIASEVDPTPPSGLNPINHPTSNMVGKELGSMGIPHFVQVQNKHSFPPYGLPPDYAPPNVVHTPDENVNNSTPILIESQQTQFDHAHVTQPMGETHEIPHHNLANFEPCLGYAPEGSSWWCTFAKHFGGPSVSPTTTTLSFCSEESPSCYGGKGKV

SEQ ID NO: 120909 - protein, 125 aa, Glycine max
  Coding DNA Sequence Number=SeqID_29224
  Homolog annotation: Hit_ID=Q2AA09; Match level="QueryCoverage=47%, HitCoverage=21%, E-value=7e-08, Identity=47%"; Hit description =Retrotransposon gag protein
  Pfam annotation: Domain name=Retrotrans_gag; Domain location=7-99; Score=37.1; E_value=6.3e-08; Accession=PF03732.8; Description =Retrotransposon gag protein
MVEDPRRVTLEYYSGEAKRWLHSFKGNSLKTWDEVVEKFLKKYFPESKTAEGKAAISSFHQFPDESLSEALERFYGGKIKLKTPEEDMDLIENMVASNIVILRDRAHIPTKKSLLELTSQDALLA

SEQ ID NO: 120910 - protein, 113 aa, Glycine max
  Coding DNA Sequence Number=SeqID_29225
MKLCFYRNHPGNQFNRDQGGPSTRSQQQGPSLYDRTTKLEETLAQFMQVSMSNQKSTESSIKNLEVQVGHLAKQLADRSSSSFTANTDLALSNWWIDLTLSAISSRVKRKDPD

SEQ ID NO: 120911 - protein, 108 aa, Glycine max
  Coding DNA Sequence Number=SeqID_29226
  Subcellular localization annotation: CTP_CleavageSite=78; ConfidenceScore=5.33e-01
MSAHGGGGGGGVTVSGLRLRANRAQTMQFYVVGRIYNLQISRSKHVLLSRNPFSVLSVNFCAENNSSRVGIALSTTFRAEHNSSWVGIALSVIPLWQIPTVKMSITNL

SEQ ID NO: 120912 - protein, 66 aa, Glycine max
  Coding DNA Sequence Number=SeqID_29227
MSYADLLPYPLDNAMVAITPARFPQPPFFRGYNSNATCACHGEAPGHSIEHCMTSKRKVQGPIDAG

SEQ ID NO: 120913 - protein, 178 aa, Glycine max
  Coding DNA Sequence Number=SeqID_29228
MDFQIRCVYLVVALDVIGVVDEVVFRYVSSKNTRVVLKLKDLSGQVLSCTLWENYCLQFLSYLNDIEDERLVVILLTYARIKEAQGSYLLSVSNSFKAFKLMINNLVLEIQEFRESLLDLGIEVRSVLTPIGQGSSQVSRSSQLSSKDVFLSKAEEKNISQINATSEVMFLFICSFSL

SEQ ID NO: 120914 - protein, 73 aa, Glycine max
  Coding DNA Sequence Number=SeqID_29229
MTGDASKFTHISPKKSGHVTYEDNNKVDDYSRFTWTLFLTHKSDVFHAFKNLLNSIKQENLNIVSLGVIMEEI

SEQ ID NO: 120915 - protein, 70 aa, Glycine max
  Coding DNA Sequence Number=SeqID_29230
MSLRHPDEDMTKSKGKDPLEGLGGPMTRARARKAKEDLQQVLSILFEYKPKFQGEKSKVVNCIMAQMEED

SEQ ID NO: 120916 - protein, 117 aa, Glycine max
  Coding DNA Sequence Number=SeqID_29231
  Subcellular localization annotation: CTP_CleavageSite=28; ConfidenceScore=5.28e-01
SPPPLGPHNHSQTHLKLSGRLPLQALVSADHHTTKSLKLFGTWTFLSLEFSRRAEASRKAWLFSLSKWTKAVHLAGWPFAQRTCAAHPSSRFFVALSRGMLHSADGSISQKIGLARG

SEQ ID NO: 120917 - protein, 85 aa, Glycine max
  Coding DNA Sequence Number=SeqID_29232
  Homolog annotation: Hit_ID=UPI0000ECBAF8; Match level="QueryCoverage =48%, HitCoverage=48%, E-value=1e-16, Identity=100%"; Hit description= UPI0000ECBAF8 related cluster
MEVVKSGAQSVCKLLASSTPPSEVEGPLSRPAGMQAWHWPSFYNVVTGKTLALPNLIALQHIPLSPAGVIAKRPAPIALPNSCAA

SEQ ID NO: 120918 - protein, 206 aa, Glycine max
  Coding DNA Sequence Number=SeqID_29233
  Homolog annotation: Hit_ID=Q2HW90; Match level="QueryCoverage=90%, HitCoverage=43%, E-value=2e-18, Identity=30%"; Hit description =Putative uncharacterized protein
MGSSQKPSLKKRFYQVKIKSLEVTSLRELGQLMGQLQQQAFRKAYGKIWDLARVEVSMEPIASLSQYYDQPLRCFTFEDFQLVPTVKEFKEILGCPLGGRKPYLFSGFYPSTTRVAKVVKISAQELNQANGLSFIDILALLIFGVVLFPNMEGLVDLAAIDAFLAFHHGKESSVVAILAMYDTFDRGCEKSSARIVCCALALYVCL

SEQ ID NO: 120919 - protein, 89 aa, Glycine max
  Coding DNA Sequence Number=SeqID_29234
MLFSIACKGDEVLENVDAYLCLLHKWAMHDGPYYNPLKPSHMWKVVNDTKKPSSPRNVSFRNPSNTKTLRPTTLSSLQSTDLDKHTMSS

SEQ ID NO: 120920 - protein, 83 aa, Glycine max
  Coding DNA Sequence Number=SeqID_29235
MFEDEEAYDPMSQRGGQKCINFYQYIDVVYTNDHILRAYSPPSDASWTLVPDPSFNRMKGRPRSTRLRNEMDWREPSQTRKKC

SEQ ID NO: 120921 - protein, 171 aa, Glycine max
  Coding DNA Sequence Number=SeqID_29236
  Homolog annotation: Hit_ID=Q8LI60; Match level="QueryCoverage=61%, HitCoverage=17%, E-value=5e-08, Identity=31%"; Hit description =Putative uncharacterized protein OJ1634_H04.130
  Subcellular localization annotation: CTP_CleavageSite=51; ConfidenceScore=5.70e-01
MATPPASPPPPLPPPPANAVASPSTLKRTRKATRLRSLATRPPGAERPVVNVDPATGKADGPHKRKLRTYLGIVARDKVNVTYDTWKKVPTAQKDLIWEDIQVEFEIPEAFDTDKDGVDDIVCEKYDISKEKWTQFCQTHRDPSWEDVRKKAQVIQKQNTAPHVLSRGGYE

SEQ ID NO: 120922 - protein, 203 aa, Glycine max
  Coding DNA Sequence Number=SeqID_29237
  Homolog annotation: Hit_ID=A5AY05; Match level="QueryCoverage=63%, HitCoverage=33%, E-value=3e-09, Identity=30%"; Hit description =Putative uncharacterized protein
  Pfam annotation: Domain name=zf-CCHC; Domain location=115-132; Score =17.6; E_value=0.0033; Accession=PF00098.14; Description=Zinc knuckle
LSEELRDYYEGRHRSDLRTHSHGREKERKPQEANINLSYFHGKDNVEANLDWEIRVEQQLKRKSTSKFYGSHSYPKKDQGQGILGVTPSKPKDDKGKTIEKQPLKASMQEKTSSMKCFKCLGIEHITSQCPTKKTMIMRGQDIYSSQDEATTSPSYSEEECKETLVSIDTPLRLEFIPQVKELLDEGLVRKSLNPCALLVPKI

SEQ ID NO: 120923 - protein, 369 aa, Glycine max
  Coding DNA Sequence Number=SeqID_29238
  Homolog annotation: Hit_ID=Q84VH5; Match level="QueryCoverage=100%, HitCoverage=60%, E-value=1e-152, Identity=72%"; Hit description =Envelope-like protein
VPTSSTPNAEVLVSSSEEKSTEEEDQATEETPAPRAPEPAPGDFIDLEEVESDEEPIAKKLAPGIAERLQSRKGKTPITRSGRIKTTAQKKSTPITPTTSRRSKVAIPSKKRKEISSSDSDDDVELDVPDIKRAKKSRKKVPGNVPDAPLDNISFHSIGNVERWKFVYQRRLALERELGRDALDCKEIMDLIKAAGLLKTVTKLGDCYESLVREFIVNIPSDISNRKSDEYQKVFVRGKYPTEGVVDIAVSEHQIAKEITAKQVQHWPKKGKPSAGKLSVKYAILHRIGTANWVPTNHTSTVATESFAVKLPIAFPTVLCGIMLSQHPNILNNIDSVKKRESALSLHYKLFEGTHVPDIVSTSGKAVAS

SEQ ID NO: 120924 - protein, 213 aa, Glycine max
  Coding DNA Sequence Number=SeqID_29239
  Gene Ontology: Mol. function=helicase activity; Biological process =viral genome replication
  Homolog annotation: Hit_ID=Q2A9E0; Match level="QueryCoverage=99%, HitCoverage=14%, E-value=9e-38, Identity=42%"; Hit description =Putative uncharacterized protein
MARDRLAGDQANNIKLQLIAAWGKDGRVYNMPNVSEIAALIVGDFQPGSKRDIIVETQNGELQRIHELHPSYLPLHYPLLFPYGEDGYKADILHRSTSSSKKRRRNRLTMREWFAYRLQSRSNEAHTLLHSQKLFQKFIVEGYTMVESERLSYIRNNQKKLRVDKYSSLQTSLDTGTAKGLTKGKRVILPSTFVGSPCYMDQLYFDGMAICSH

SEQ ID NO: 120925 - protein, 362 aa, Glycine max
  Coding DNA Sequence Number=SeqID_29240
MGTTGYPMAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNGALGFPALITGLCQSFGVPVAPTKVIRPPITRAFIEKYCTQRQAQGDAPQAAGAPPPPHQAGQAGAFDMNIGGLHVLANRGLHALTLRGLCVLTFRGLHVLTFRGLHALAIRGLRVLTFRGLHALAIRGLHVLTFRGLHALAIRGLHVLTFVGLHALTFRGLHVLTNRGLHALTLRGLHVLAT

SEQ ID NO: 120926 - protein, 150 aa, Glycine max
  Coding DNA Sequence Number=SeqID_29241
MAAQLIHDRVEMECLEGAWETLEGNTRCRFWGTIRFTATSLVHPDEPVRTLQHIVEWILPTPTPYLLAKPVQVIEVTSSEEDPKEDPEELPPQPAVDALDFLEGDEDPLLEVDSPEEVMSASEADSTEDSARERWRPVEALHHSGQFHGL

SEQ ID NO: 120927 - protein, 165 aa, Glycine max
  Coding DNA Sequence Number=SeqID_29242
  Homolog annotation: Hit_ID=Q6CQE6; Match level="QueryCoverage=29%, HitCoverage=33%, E-value=2e-13, Identity=72%"; Hit description =Kluyveromyces lactis strain NRRL Y-1140 chromosome D of strain NRRL Y- 1140 of Kluyveromyces lactis
YEYDGVEALGPRISRAAGAHGHHATCGALPAAGPYLRLSRFQGAAVWARTQHSGSTPGIASLLYKKSDPTWSSRTSSELTGARGQQSAPKGPFPIRPPTGTRRPALAAEAARAVHRQPTGSGLGPPCPALRANPFPEVTDPFCRLPLPTLFHRPEAVHLGDLMRL

SEQ ID NO: 120928 - protein, 89 aa, Glycine max
  Coding DNA Sequence Number=SeqID_29243
MSTGTRKCDCPFRLRGRPLKNGEEWKVRVLYRLPLLEIVGVTCTGMKFYVAFAYLEVEYENNFVWALERFRGIFHIFDGLPKWLSLTEI

SEQ ID NO: 120929 - protein, 274 aa, Glycine max
  Coding DNA Sequence Number=SeqID_29244
  Pfam annotation: Domain name=Transposase_23; Domain location=19-90; Score=-15.1; E_value=0.053; Accession=PF03017.5; Description =TNP1ENSPM transposase
TKGSCAGPEGSGLLKELLNGDDDLMGLFVVVGQNIVLAGLGKVFENSSTIHNVRYENDVVKVQVVRTYMPHAEVPIPTSEVHYLEQAVGTFVAWPTHLVREVTNEVVVGPDKPPSKSVGEPNRLTSVATDDPLGELVKKSYVVYTKPMELAWDGAKFGLSNASNGFFITHADVTEIILGDKCLNIFVLQLWMMFMNDWSTSIGFSPVYGFLEPQSIRCTKDTREECQKYIEMWVKESHREIYLGPYFNYLMGNFMLLTSGHIGNFLCCVHKRTL

SEQ ID NO: 120930 - protein, 140 aa, Glycine max
  Coding DNA Sequence Number=SeqID_29245
MSAFTRDSPQISASPHQLDLAPYASEPYNAQWNAPGLLNDKHTLRSSRILGEMEVGFVVDLGMAFVDKWAVGKEKGWVMTLLGWWETWPYRNGSHCMGFSLILTLFICPSFLIRPSRMIKFASFQTHFDLFAGEDQIYKT

SEQ ID NO: 120931 - protein, 128 aa, Glycine max
  Coding DNA Sequence Number=SeqID_29246
MWTTTGEKLAAQLAQASKVASSRSNSLLEESSGGPKWAWCYLHPFLLNLSKKLWKLTDCAKTPLFDFRHITEFHGSCKPASFRFLRRLGTSFIVQQRTPSISKRLTKDCMSSSNNPRTKLGYDKWAEP

SEQ ID NO: 120932 - protein, 213 aa, Glycine max
  Coding DNA Sequence Number=SeqID_29247
MGEVEEIQEKMKADMEAIKEKMATMREAMMSVKKIMETNAVAIAATSVVAKVNLMSPSGINQMNHPTSDMVGKDLGSTDDPMMCKFKTSTPSHHMACLPTIHHPMWRTLPIRMSITPLLYPLKASNPKLIMHMSLKLWKRPMKFPITIYPTSSLGSDIPLKGKQLVVYPYKNPLEGPQYHPQLHLLHSTAVKNPHDYGRNGKVGSSRGKAQGH

SEQ ID NO: 120933 - protein, 136 aa, Glycine max
  Coding DNA Sequence Number=SeqID_29248
  Homolog annotation: Hit_ID=Q949K7; Match level="QueryCoverage=25%, HitCoverage=38%, E-value=3e-07, Identity=67%"; Hit description =Putative gag polyprotein
MSLNVGETHEIPHHNLATSSWLGYATEGQAVGGIPLENTSEGPQYHPQLHLLHSTTSKNPHAMAEMGKLDHLDERLRAIEGGEDYSFANLEELLPIPNIITPLKFKVLDFDKYKGITCPKNHLKMYFRKNGGIRKR

SEQ ID NO: 120934 - protein, 58 aa, Glycine max
  Coding DNA Sequence Number=SeqID_29249
MSYPNFVREPLLDDVRPFFGPREVPPEGGCFWRKQPGSPGRAELAWASWAASISPILL

SEQ ID NO: 120935 - protein, 210 aa, Glycine max
  Coding DNA Sequence Number=SeqID_29250
  Subcellular localization annotation: CTP_CleavageSite=39; ConfidenceScore=5.27e-01
MPGKASRCDPAPTGDALLGSRSPSPSTCRQFLLLAADARCTATFSPAQGLEQELWLVSGPLASKAAPAPGPGVLQHARALVQGSATAPRGRQQAGCRRAALRQRAGAGPATGAGRGGRLHQPSTRGCSQPGRDNWEKLSRGHVRARDRILRRDIRTSKGAGPRRARSDPGRQGPVLRRSTRKGIRNGGGGAAKAPVQTMFTLLGSIYTYY

SEQ ID NO: 120936 - protein, 157 aa, Glycine max
  Coding DNA Sequence Number=SeqID_29251
  Homolog annotation: Hit_ID=A5B6Y9; Match level="QueryCoverage=28%, HitCoverage=8%, E-value=9e-15, Identity=84%"; Hit description =Photosystem I P700 chlorophyll A apoprotein
STLEDPPGEGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDESRP

SEQ ID NO: 120937 - protein, 18 aa, Glycine max
  Coding DNA Sequence Number=SeqID_29252
MGAKHLTRTKKGRMSSSK

SEQ ID NO: 120938 - protein, 102 aa, Glycine max
  Coding DNA Sequence Number=SeqID_29253
MTHQDFKCKHGQFAQATCAPEFGLPRPFNHRLLGLHVGGGAVKQRDVGQMASVTLRKRGVELGYEVYSPIKLSLSLFELTMHTGTTLPLCSRISYNKRPTVS

SEQ ID NO: 120939 - protein, 322 aa, Glycine max
  Coding DNA Sequence Number=SeqID_29254
MAPRKLASKRSRKDKAAEGTSSAPEYDSHCFRSAEHQQRFEAIKGWSFLWERRVQLRDDEYTDFQEEIVHQRWASQVTPMAKFDPDIVLEFYANAWPTEEGVRDMRSWVRGQWIPFDADAIGQLLGYPLVLEEGQECKYGQRRNRSDGFDEEAIAYNIQPSDHNSGPPPVEVSAGVRHPDADKHSRPGISRLITGLCQSFGVPVAPSKVIRPPITRAFIEKYCTLVQPDHFDTEQYLRHLVRQQVANHRAHVQIHDCLYQMSLSLQSQGFTSFLCPTSDQFRAEVAWPGDWPEARAGEAPAKAPAEAPDEADEAREDEEMTD

SEQ ID NO: 120940 - protein, 200 aa, Glycine max
  Coding DNA Sequence Number=SeqID_29255
  Pfam annotation: Domain name=Transposase_23; Domain location=115-185; Score=1.7; E_value=0.00078; Accession=PF03017.5; Description =TNP1ENSPM transposase
MVCTKKTRQMTSEATKEIAEKIDSLEEQASQGSFLPHGRQDVLTVAIGQPEHPSRVRVAGAADPTNHGPVGGVDHRKSDSIADGILQPDAVPVSVSDAITRTCAASGAGGNDPEMSDSDKCGLYIEDNPSHLVALGRIYEGSTVVHNIPLLHGQVKVGVEEVKDAEALVPVPTGEVTSVGQALNTFLAWPTHLVKRLSEQ

SEQ ID NO: 120941 - protein, 56 aa, Glycine max
  Coding DNA Sequence Number=SeqID_29256
MDTSEPYTGEMRGTMHEPQVNLGADQKFSPSSKSKIETLSGTTAKPTGRAMQRTHA

SEQ ID NO: 120942 - protein, 103 aa, Glycine max
  Coding DNA Sequence Number=SeqID_29257
  Subcellular localization annotation: CTP_CleavageSite=35; ConfidenceScore=5.63e-01
MSPQPLEPHNHSQTHLKFSRQLPLQARFSAGGFVRACALSVILNRFVLISGFRLNACFSRSVDGLKRCASLDDPSLSANAQLILLPDSSSRSAEECCAQRMAR

SEQ ID NO: 120943 - protein, 86 aa, Glycine max
  Coding DNA Sequence Number=SeqID_29258
MLPLEATTFWRKNLEGPTFEEVTKTHGLRKTPPFDFRHITEFSRIANSNLGPSGTFWKLGCLRRKQLGGKLLHIVEKWFPGLPWLP

SEQ ID NO: 120944 - protein, 155 aa, Glycine max
  Coding DNA Sequence Number=SeqID_29259
  Gene Ontology: Mol. function=helicase activity; Biological process =viral genome replication
  Homolog annotation: Hit_ID=Q9AYF0; Match level="QueryCoverage=99%, HitCoverage=14%, E-value=3e-16, Identity=29%"; Hit description =Helicase-like protein
MHTIEFQKKGLPHVHLLLFLHPDNKYSSLDDIDHIISAEIPSHENDPELYTLVQNHMVHGPCGILQPKSPCYDIITAVVIHDDNGTLENAISQNDEIKEYVDCRYISPCEATWRIFGFPIHARKPAVERLHFHLPGQHIVFYEDDDDIDDILSKP

SEQ ID NO: 120945 - protein, 86 aa, Glycine max
  Coding DNA Sequence Number=SeqID_29260
  Subcellular localization annotation: CTP_CleavageSite=38; ConfidenceScore=5.22e-01
MHMTQMQFMNMGARETVSFLDTTSRGSKVLQRGRRETRGMRVPRKEYARSRHQRLFEENIGKTGKDAIYELLSERFGSCIYARGRY

SEQ ID NO: 120946 - protein, 96 aa, Glycine max
  Coding DNA Sequence Number=SeqID_29261
MKDKRDEEEKLEKQKKKKDSKALSSKAKGKEMEEKDSSKKIVKKENHFATKRETSLSTTIPLELEVIPQVKELLDEGLVRKSLNPCALLVPKIGTH

SEQ ID NO: 120947 - protein, 153 aa, Glycine max
  Coding DNA Sequence Number=SeqID_29262
  Homolog annotation: Hit_ID=A0ST23; Match level="QueryCoverage=29%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTLSTLEDPHGYRMQTVLKLVMHLAKGHSTLQVVFGLGTELEFVIMVIAVSFGKPVVPAALMNRPTRGERRFAYWALFRFLAH

SEQ ID NO: 120948 - protein, 162 aa, Glycine max
  Coding DNA Sequence Number=SeqID_29263
  Subcellular localization annotation: CTP_CleavageSite=14; ConfidenceScore=5.27e-01
MAESSKKRKGLSTSAAATRTSRPEATGAPPAPIPPSLSSSTLFSSDEQCICTLLSEVYGISMVIDEYVFFSLTHLPNQGAPFEGTIVDDWKFDYSSLDACRMVCNDQANMTGRLFAGSLTFDCHIMHYIIVRILLPRSSNLAQASEEDLILMWAFLTVHPID

SEQ ID NO: 120949 - protein, 55 aa, Glycine max
  Coding DNA Sequence Number=SeqID_29264
MWVQAIGLFAQASCAPEFGLPRPFNQRLLILHVVGGAVKQRLLVIDYQRANLNLK

SEQ ID NO: 120950 - protein, 119 aa, Glycine max
  Coding DNA Sequence Number=SeqID_29265
MILLAGVATYPSAGGRRETHGCVFQERKMHGIATNVYSRKTSKNRKRCGLCTLSVKGSGVVFTHGEGISTPRVRPKGRQPLIKRETLRRWTINDLLVWSTKAGLLLLRILNCDEEIRPT

SEQ ID NO: 120951 - protein, 65 aa, Glycine max
  Coding DNA Sequence Number=SeqID_29266
EGGAVSKCSAPLALLSLSNLLGKIVSVKKIYAEALPKRFRKRFCGYSSSFFTVLHPFFVRSSFFN

SEQ ID NO: 120952 - protein, 149 aa, Glycine max
  Coding DNA Sequence Number=SeqID_29267
  Gene Ontology: Mol. function=helicase activity; Biological process =protein amino acid phosphorylation
  Homolog annotation: Hit_ID=Q2A9E0; Match level="QueryCoverage=100%, HitCoverage=9%, E-value=2e-36, Identity=51%"; Hit description =Putative uncharacterized protein
  Pfam annotation: Domain name=DUF889; Domain location=34-146; Score =1.4; E_value=1.4e-11; Accession=PF05970.5; Description=Eukaryotic protein of unknown function (DUF889)
MAHKFCFEALDQSLRDIITNKSNSNQIFGGKVIVFGGDFCQILPVIPRGSRSDIINATINSSYLWNSCEILTLTKNMRLHSNLASVDEQENATFAKWILDIGDGIIGHENDGYATIEIPAHLLITEYDDPISAIVKSTFPDLDQHHNNP

SEQ ID NO: 120953 - protein, 117 aa, Glycine max
  Coding DNA Sequence Number=SeqID_29268
MTRGNPSDLQPFDPEIDRTFHRLVRHHFIPFDHSEHSITGEYVHSVIGDFEHPDLEHYNFEHSENMAQPPPRERTLREMAAPDFTYESLCIQYPDEDVPYVLKTGLIHLLPKFHGLA

SEQ ID NO: 120954 - protein, 85 aa, Glycine max
  Coding DNA Sequence Number=SeqID_29269
MPPNYTWGQSCTVMLMLLPHPEGKSLLDSPTRSTKIRSERGVMPQGDVQIVLPPILVERPSTQHCCPQPNLTDNQYSCPQKDHPT

SEQ ID NO: 120955 - protein, 69 aa, Glycine max
  Coding DNA Sequence Number=SeqID_29270
MAQAPQPAARIEPPVQQVEPNPGAIPDTVGRLRVRPLRRSYESDGGNFSYDQHDVGKFDHVSVCFCPME

SEQ ID NO: 120956 - protein, 95 aa, Glycine max
  Coding DNA Sequence Number=SeqID_29271
MGILSGSNWEWKIQWRRHFFDHEIDTLAAFTADIEGIQIQPLTRDFLSWGADPAGYYSTKSAYNLLKAEASSNSEDSNYKTIWKLQIPPRASAFS

SEQ ID NO: 120957 - protein, 74 aa, Glycine max
  Coding DNA Sequence Number=SeqID_29272
MNVYIHDFDDAKEESNKAASKDKHCFKINTRLLQQTKPCFKISLRSSLASKQSVSKTCKALVIDYQMFVIDYQQ

SEQ ID NO: 120958 - protein, 209 aa, Glycine max
  Coding DNA Sequence Number=SeqID_29273
  Homolog annotation: Hit_ID=Q5CDC4; Match level="QueryCoverage=13%, HitCoverage=21%, E-value=2e-07, Identity=100%"; Hit description =LacOPZ-alpha peptide from pUC9
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLPFTYKEFNVTLSENDDVTCGTREREFKVVIKGTELEFVIMVIAVSCVKLLSAHNSTQHTSRKHKV

SEQ ID NO: 120959 - protein, 165 aa, Glycine max
  Coding DNA Sequence Number=SeqID_29274
MLLCFLLCFLLIILIFIGGLTRRISTNPCLFLLYQLNIFPFTFAFVNYTVIYKTKVERKDIDLVDEEEAQIGADRSSATSNKAKIYNQEASEALEHTKKRDTGHQGVSLENKTGDSTMLKMGDSVKVVIKQDMKKITLDDVNQFSFIMIISISMNVISFFFSDTL

SEQ ID NO: 120960 - protein, 134 aa, Glycine max
  Coding DNA Sequence Number=SeqID_29275
  Homolog annotation: Hit_ID=A1IW39; Match level="QueryCoverage=42%, HitCoverage=93%, E-value=4e-12, Identity=66%"; Hit description =Putative uncharacterized protein ophh-69
MGDKLHRREGNSPDHQLRPLNDRSVIKEMNGAKRSAEAVGCKKESVGERSALEGRTRASSAGRSGSENVGLSNANVGENPMPRKPKGPKISRKGVVDGQQVNIPVLPFVGPEGRRARLAERWLSVQDASAPAFS

SEQ ID NO: 120961 - protein, 74 aa, Glycine max
  Coding DNA Sequence Number=SeqID_29276
MKMLSWTSSLNPCVGVFWSNPWKQSRASLSDSRGYWWKDEIYTFPSTVLDSGKYFFRNFSTTSSHVHMLFLLNE

SEQ ID NO: 120962 - protein, 70 aa, Glycine max
  Coding DNA Sequence Number=SeqID_29277
  Homolog annotation: Hit_ID=UPI0000ECBAF8; Match level="QueryCoverage =58%, HitCoverage=48%, E-value=1e-16, Identity=100%"; Hit description= UPI0000ECBAF8 related cluster
MGRKWNDIPFESESRPAGMQAWHWPSFYNVVTGKTLALPNLIALQHIPLSPAGVIAKRPAPIALPNSCAA

SEQ ID NO: 120963 - protein, 155 aa, Glycine max
  Coding DNA Sequence Number=SeqID_29278
  Homolog annotation: Hit_ID=Q2HW90; Match level="QueryCoverage=47%, HitCoverage=14%, E-value=1e-07, Identity=44%"; Hit description =Putative uncharacterized protein
MGQLQRQAFHKAYGKIWDLARDFQLVPTVKEFEEILDAHWEEGSHIFSLGSIPPRQELPRKGQRPWQNQGKWTSFIDILALLIFGGVLFPNMEGLVDLAVIDAFLAFHHGKESPVVAILAMHDTFDQRCEKSGARIVCCTPALYVWLVSHLFLQE

SEQ ID NO: 120964 - protein, 106 aa, Glycine max
  Coding DNA Sequence Number=SeqID_29279
MIESFQQQQQMSVLELYVEKDVAGGSMYHSANSVTSCGHNLSHHESELPRNINNLHDDEDDDDDYLASNSYVEDSLDEDDSVDGISNTDDEVTNIIEPISIVHPTE

SEQ ID NO: 120965 - protein, 215 aa, Glycine max
  Coding DNA Sequence Number=SeqID_29280
  Gene Ontology: Mol. function=transferase activity, transferring pentosyl groups; Cellular component=peptidoglycan-based cell wall; Biological process=peptidoglycan-based cell wall biogenesis
  Homolog annotation: Hit_ID=A8GKR4; Match level="QueryCoverage=64%, HitCoverage=16%, E-value=2e-66, Identity=87%"; Hit description =Penicillin-binding protein, 1A family precursor
MGTAWRAGRDLKRREIGGKTGTTNSSKDAWFSGYGPDTVTSVWIGFDDHRRDLGRSTVSGAIPDQISGGEGGAKSAQPAWDDFMKTALEGIPEQKVTPPPGIISVTIDKSSGKLSGGGGGSRSEYFIEGTQPTDYPSRDTGTTLTDPGGPEKSGPFFVRREAYQRDARKNASERNSALTLRASRKSGSASSAIMLAIGQSTCGRGSGSSPSRLCG

SEQ ID NO: 120966 - protein, 128 aa, Glycine max
  Coding DNA Sequence Number=SeqID_29281
MEGLVDLAAIDAFLAFHHGKESPVVAILAMYDTFDRGWKRALQELFFTNSASMEGRLLSMCLSHSISVGFSFIPSLSGTTTEGSGVRLLKKGIRWGCWPLKKETISESSLFGELHVMGFLHRLGSFHP

SEQ ID NO: 120967 - protein, 160 aa, Glycine max
  Coding DNA Sequence Number=SeqID_29282
  Homolog annotation: Hit_ID=A7Q0K5; Match level="QueryCoverage=34%, HitCoverage=43%, E-value=1e-12, Identity=72%"; Hit description =Chromosome chr7 scaffold_42, whole genome shotgun sequence
ARVYRLAVGTPHLHGEFNFTGYCRRLPGLPFKAYNTSPSDLPAPGRRAPLLPKLRGHFAEFLRHGSLKRPSILYLFTCVGLGYGQFTGRIALPIRSFFLEVSTLLTMTTVATINRLATMAGRPSQKGFDDSSKVHLRERRVRGRGGSPRPDHPIHSNRQA

SEQ ID NO: 120968 - protein, 58 aa, Glycine max
  Coding DNA Sequence Number=SeqID_29283
LIKVILVASTLTYLPSPEVASNLTYLPSLEVASILTYLPSPEVASSKSSTACIKRSAP

SEQ ID NO: 120969 - protein, 94 aa, Glycine max
  Coding DNA Sequence Number=SeqID_29284
TLANIATPLGLEFIPQVKKLLDEGVPMNPKRIKVIPEWPTPPTPLIVLVRNHVPSWEDAQEIGVEGRSPEYEEPRDLRSNPFQGGGNDAILPSK

SEQ ID NO: 120970 - protein, 90 aa, Glycine max
  Coding DNA Sequence Number=SeqID_29285
SRGVDTTYTYSISTSGAVQVIEVSSFEADIEEDQKKLPLEPVVDALDFPEDDEDPLLDVDFPEDVMSTSEADSTEKSGPGGTANSDDSSS

SEQ ID NO: 120971 - protein, 398 aa, Glycine max
  Coding DNA Sequence Number=SeqID_29286
  Homolog annotation: Hit_ID=Q2HW90; Match level="QueryCoverage=74%, HitCoverage=66%, E-value=6e-34, Identity=32%"; Hit description =Putative uncharacterized protein
MQAFRKTYGKILELTLAEVSIEAIASLTQYYDQPLRCFTFGDFQLVPTIEEFEEILGCPLGGRKPYLSSGCLPSLSRIATVVKDSARGLDHIKQTRNGIAGLPQGYLEDKARGMANQGDWVPFMDVLALLIFGVVLFPNVDGLVDLAAIDAFLAYHHSKESPVTQDIHVRSLSHRSCTEKGRIDWDQLLAGIGGRTISWFPRWKEGKEGVLFSCGRYPNIPLVGTRGCINYNPALAIRQLGYPMRGAPTEESMSPFLVRDLGAQNSKTIQRIHKAWETPLRKDQELRGIRNGIIGGYHEWLKVHIRGLDWLAKLKVVSEENFEAPEEDEEVQALKSELGKAKLAKEKFKLAATHIRKECAGLREENAITARALEQETKRARKEEYGRNKFRGALWGSN

SEQ ID NO: 120972 - protein, 77 aa, Glycine max
  Coding DNA Sequence Number=SeqID_29287
MPISPCRCIGWNRTHKDTQWTRRSPTGPWGFQLWLRASVVLQGARSPPARSRHHRDRACKTSSGPEEVQQGLGIVKL

SEQ ID NO: 120973 - protein, 117 aa, Glycine max
  Coding DNA Sequence Number=SeqID_29288
MERSMIDAAGGGALGDMTPTEARNLIEKMASNSQHEVATNSSASSETKKLEGKLDALVNLVTQLALNQKFVAVTRVYGLCSSADHHTDLCPSMQQPGAIEQPEAYAANIYNRPPQPQ

SEQ ID NO: 120974 - protein, 45 aa, Glycine max
  Coding DNA Sequence Number=SeqID_29289
MRGYLIVTHTVRQPWEHEPIDAQRLTSSSAPFVVLTREVRGTRAR

SEQ ID NO: 120975 - protein, 52 aa, Glycine max
  Coding DNA Sequence Number=SeqID_29290
MEKDLKKTLKFLDATNATNLAYIAWDDNDLSDGSEKKINLLTKDCESDENIS

SEQ ID NO: 120976 - protein, 101 aa, Glycine max
  Coding DNA Sequence Number=SeqID_29291
  Gene Ontology: Mol. function=magnesium ion binding; Biological process=metabolic process
  Homolog annotation: Hit_ID=A4W8I6; Match level="QueryCoverage=99%, HitCoverage=37%, E-value=9e-44, Identity=86%"; Hit description=Cof -like hydrolase
MDGTFLSDAKTYNRERFLAQYARMKEQGIRFVVASGNQYYQLISFFPEIAHEIAFVAENGGWVVSAGEDVFNGELSKTHFDTVAAVLNDVPGIEIIACGKG

SEQ ID NO: 120977 - protein, 124 aa, Glycine max
  Coding DNA Sequence Number=SeqID_29292
  Gene Ontology: Mol. function=nucleic acid binding
  Homolog annotation: Hit_ID=Q2AA09; Match level="QueryCoverage=49%, HitCoverage=22%, E-value=5e-09, Identity=45%"; Hit description =Retrotransposon gag protein
MAEDHPQRMTLEDYSSFATPQYFTSIARLDVQAANLSYPHSLIQLIQGNIFHGVPEDAIHLNLFSFSMASEVKRWLHSFKGNSLWTWEEMVEKFLKKYFPKSKTAEGKVEISFNHVEENTTGIL

SEQ ID NO: 120978 - protein, 151 aa, Glycine max
  Coding DNA Sequence Number=SeqID_29293
  Homolog annotation: Hit_ID=A4EB57; Match level="QueryCoverage=58%, HitCoverage=56%, E-value=8e-23, Identity=60%"; Hit description =Putative uncharacterized protein
GANGIRYPSSPSRKRWILGAVRIDPCNAVANALSIPPGEYRRTLPGLDMPRILLKERGAFGNADTGGAWLSSARAVRCGLSPATSATLVLVANISWNPEQTAGDKPEEGEDDVKSSCPLCPGRHTCYNGRDKGSRSREGELTPKTRPQFGL

SEQ ID NO: 120979 - protein, 88 aa, Glycine max
  Coding DNA Sequence Number=SeqID_29294
MDIFRNSGQPSEQCWNPHASFPQFNKYIYQGFYKHICTFYNGLISSQSSSVCNNLMYNYHAYLSHTGATSFNASLLRVRGLGLTASSS

SEQ ID NO: 120980 - protein, 832 aa, Glycine max
  Coding DNA Sequence Number=SeqID_29295
  Gene Ontology: Mol. function=transporter activity; Cellular component= intracellular; Biological process=transport
  Homolog annotation: Hit_ID=A5AZ38; Match level="QueryCoverage=96%, HitCoverage=92%, E-value=0.0, Identity=61%"; Hit description =Putative uncharacterized protein
  Pfam annotation: Domain name=CRAL_TRIO; Domain location=386-572; Score=133.8; E_value=5e-37; Accession=PF00650.11; Description =CRALTRIO domain
  Pfam annotation: Domain name=CRAL_TRIO_N; Domain location=291-369; Score=54.3; E_value=4.3e-13; Accession=PF03765.6; Description =CRALTRIO, N-terminus
  Pfam module annotation: Pfam domain module=CRAL_TRIO::CRAL_TRIO_N; Domain location=386-572::291-369
  Subcellular localization annotation: CTP_CleavageSite=36; ConfidenceScore=5.05e-01
YEFNGYINRSEITLNLTFKVWRMSSVQGPVVCPSVRAKQVGFCSIPMIGAVKMNVRRIRSEFWGLNGAKAKPGFLSCHINTRKCKTVHCTFNSPSNDSGSTADNFNEKDEDYVISSVIEAVEVKSGADGFIIKMRDGRHLRCVHNNPQGGHLPDYAPHPAIVLKMEDGTGPIQVNKYLAYSDGMRVIESGKLSTQFPGMDGRLFTEMDRPSGQPCAETTEFNLLHNMLKAVVEERYKDAGFSGHDERRERKSDFENSEDDRRTRIGSLKKRAINASSKFRHSLRKKSSRRKTASRSNSVSIEDVRDVKELQAVDEFRQALILDNLLPPRHDDYHTLLRFLKARKFDIEKAKHMWANMIHWRKEYGTDTIMEDFEFGELNEVLQYYPHGYHGVDKEGRPVYIERLGKVDPNKLMQVTTMERYLRYHVQGFEKTFAVKFPACSIAAKRHIDSSTTILDVHGVGFKNLTKSARELIMRLQKIDGDYYPETLCRMFIINAGPGFKLLWNTVKSFLDPKTTSKINVLGNKFHNRLLEIIDASELPEFLGGNCTCMDRGGCMRSDKGPWQDPNILKMVLSGEVQCSRQIVTVSNDEGTVIECDKACYPMPIRSSDTSTAESGSEVEDITSPKASGNYTNPRLTPVHEEARLIGRASGFSEYDEYVPMVDKAVDLGWKEKQVTTQNSYGSTENFLLRAGKSGGNCAYILAVIVGFFVAIFTFVRSLALRVTKRIQDTKSDSAKNMPKTTVDSITKEESRPPSPVPRLTKTEFISSAMKRLGELEEKVDMLQSKPNVMPYEKEELLNAAVYRVDALEAELIATKKAKQTAIPAVLPSLKF

SEQ ID NO: 120981 - protein, 42 aa, Glycine max
  Coding DNA Sequence Number=SeqID_29296
MMQTILDAGCASSGGYLRECREATRQEATQPEQHDKNMLGAR

SEQ ID NO: 120982 - protein, 641 aa, Glycine max
  Coding DNA Sequence Number=SeqID_29297
  Gene Ontology: Mol. function=metal ion binding; Cellular component =nucleus; Biological process=regulation of transcription, DNA -dependent
  Homolog annotation: Hit_ID=A7NT69; Match level="QueryCoverage=63%, HitCoverage=99%, E-value=1e-138, Identity=60%"; Hit description =Chromosome chr18 scaffold_1, whole genome shotgun sequence
  Pfam annotation: Domain name=bZIP_1; Domain location=27-90; Score =31.8; E_value=2.4e-06; Accession=PF00170.12; Description=bZIP transcription factor
  Pfam annotation: Domain name=bZIP_2; Domain location=27-81; Score =20.9; E_value=0.0029; Accession=PF07716.6; Description=Basic region leucine zipper
  Pfam annotation: Domain name=zf-C3HC4; Domain location=477-535; Score= 16.3; E_value=0.0013; Accession=PF00097.16; Description=Zinc finger, C3HC4 type (RING finger)
  Pfam module annotation: Pfam domain module=bZIP_1::bZIP_2::zf-C3HC4; Domain location=27-90::27-81::477-535
MASSSGTSSMSNILLQSSSSEEDLQLLMEQRKKKRKQSNRESARRSRMRKQKHLDDLIAQVDHLKKQKSLTLMKVDITTKHYLEVKAENSILWAQKTELTQSLQSLNDIIDLINTTNGVYHTDCYDINNHNNHNNYYNNNNNFMNPMHMAYLNQPIVATADNICVTVESFMSDGKDRSGHQSGMVLATVQCFGKMDVGVSVTVQEEVSYCFLLEIEVAFEFSIVIFGLTVMFGAAIMGSACCVAAKDPNLPNRTGGESLHRDVVCSPSGSFQWDSRGRFAGEIENPSYHTSHVDSRNVSMELKGSLSSERGNLSDGGSIVENSVTPIFLKSPVDEALVANLMTPTSVFSTPTADPLPNHNYHHLPSSTPTRWAHRSPAHPLLRQISDSRIMDLKLPDNSISEGRPSFVLSTCSNEMTAGSICGSSDGWSMRTFSELVASSQRERWSFDSECFGSGRHKISGSSSRFSYSPSMELQSCGACSKLLTERSTWSNQKFISNSDLSVVAVLVCGHSYHAECLEAMTSEADRYDPACPICMVGDKHLSKLLSRKGLRAESDIKAKNHKISRNRVVDSYLDGGFDVFDRQKGIDLRGKVSKMEPSSSARSSFGKPFLRRHFSLGSKWSRSLSENDSARKKGFWARYR

SEQ ID NO: 120983 - protein, 225 aa, Glycine max
  Coding DNA Sequence Number=SeqID_29298
MTVIKYLSGQYLRYRDLNYAYFNSHKVLHCLEVVYKHCLLSLLQGQNHNGHRTPKWTISRIWATSMIIMMKEIRSRQDNRKHIAQHPKGTHGRPGIQMQLGTRQQTYKIEIGVGPYSSDCATQRDDDINIRRDRDTLNDDITDVNVRNMVVSSVRTTMKVGGIVVETLPYRTKGHCRGLTTTYLGEEIDERDVREKKVDRNKAIRGREDGQKENNENVEKFFILL

SEQ ID NO: 120984 - protein, 250 aa, Glycine max
  Coding DNA Sequence Number=SeqID_29299
  Gene Ontology: Mol. function=protein binding; Cellular component =nucleus
  Homolog annotation: Hit_ID=A7NT43; Match level="QueryCoverage=81%, HitCoverage=94%, E-value=6e-69, Identity=65%"; Hit description =Chromosome chr18 scaffold_1, whole genome shotgun sequence
MTTLIRIDIHQMEKMCDESCCIRVEVQRRLSLYLFFNNFGYSFCSNAINENDVNNIILSYLIHNCYKESSESFISCTGMKQPADHLENMEKRKRIFHHALEGNVLKAIELTGQLAQDILENNNDLLFDLLSLHFVDLVCSKKWTEALEFAQTKLSPYSVKEQKYMDKIEGFMSLLAYENPVECPMFHLIGLDYRQQVVDSLNQTILAHFNLPIHTAMERLIQQTSVVRQCLSQEDGGPPPFSLKDFLKSR

SEQ ID NO: 120985 - protein, 224 aa, Glycine max
  Coding DNA Sequence Number=SeqID_29300
  Gene Ontology: Mol. function=transporter activity; Cellular component= integral to membrane; Biological process=transport
  Homolog annotation: Hit_ID=P49173; Match level="QueryCoverage=100%, HitCoverage=75%, E-value=3e-73, Identity=64%"; Hit description =Probable aquaporin NIP-type
  Pfam annotation: Domain name=MIP; Domain location=54-224; Score=71.7; E_value=2.4e-18; Accession=PF00230.11; Description=Major intrinsic protein
MAAKSEGIQEEMPSMEEGVSSPSPSRTCNVSHNCCSNHVVALAQKVSDHDHLHVLITCMFGFQVFAEVIGTYFVVFAGCGSVAVNKIYGSVTFPGVCVTWGLIVMVMIYSLRHISGAHFNPAVTITLAIFRRFSYKQVPLYIFAQLLGSILASGTLALMLDVTPKAYFGTVPVGSNGQSLVAEVIITFLLMFVISAVSTDDKAVGDFAGVAVGMTIMLNVFIAG

SEQ ID NO: 120986 - protein, 208 aa, Glycine max
  Coding DNA Sequence Number=SeqID_29301
  Homolog annotation: Hit_ID=A7PR83; Match level="QueryCoverage=78%, HitCoverage=97%, E-value=1e-46, Identity=59%"; Hit description =Chromosome chr14 scaffold_26, whole genome shotgun sequence
MGNTMGRSKKTKVMKVDGETFKLKTPARANDVVKDYPGHVLLDSEAVKHFGLRAKPLEPYQELKPKKIYFLVELPKIQPEEEKTALPRRVRSSGIRGMNASDRLELLMLSKRSVSDLPLARQGPKMGSDGPMRVKMRLPKAHLDKLMEESTDGSEVAEKIMSLYVGTNAGEGGGVAAVAEEGGAKTVYNHKPRGDSTSDTEDLVNSLS

SEQ ID NO: 120987 - protein, 128 aa, Glycine max
  Coding DNA Sequence Number=SeqID_29302
  Gene Ontology: Mol. function=DNA binding; Cellular component=nucleus; Biological process=regulation of transcription
  Homolog annotation: Hit_ID=A7PR80; Match level="QueryCoverage=84%, HitCoverage=48%, E-value=2e-22, Identity=53%"; Hit description =Chromosome chr14 scaffold_26, whole genome shotgun sequence
MYILTILLYYQSIFWWSLIAGRLPGRTDNEVKNYWNSHIRRKLIKMGIDPNNHKPHQSFPRSHASTEGASTSESMNKVPFFKSSGVAASDHRISFTKEETAIISSSSPPLNLDLTIALPSPMLRAAEE

SEQ ID NO: 120988 - protein, 1138 aa, Glycine max
  Coding DNA Sequence Number=SeqID_29303
  Gene Ontology: Mol. function=protein binding; Cellular component =membrane coat; Biological process=intracellular protein transport
  Homolog annotation: Hit_ID=A7PIU1; Match level="QueryCoverage=97%, HitCoverage=96%, E-value=0.0, Identity=63%"; Hit description =Chromosome chr13 scaffold_17, whole genome shotgun sequence
  Pfam annotation: Domain name=Adaptin_N; Domain location=31-664; Score= 262.9; E_value=6.7e-76; Accession=PF01602.11; Description=Adaptin N terminal region
  Pfam annotation: Domain name=HEAT; Domain location=136-172; Score =15.8; E_value=0.12; Accession=PF02985.13; Description=HEAT repeat
  Pfam annotation: Domain name=HEAT; Domain location=174-210; Score =12.7; E_value=0.34; Accession=PF02985.13; Description=HEAT repeat
  Pfam annotation: Domain name=HEAT; Domain location=460-493; Score =1.3; E_value=18; Accession=PF02985.13; Description=HEAT repeat
  Pfam module annotation: Pfam domain module=Adaptin_N::HEAT::HEAT::HEAT ; Domain location=31-664::136-172::174-210::460-493
MMFPQFGATAESLSKASTAVFRIGTDAHLYDDPEDVNIAPLLDSKFDSEKCEALKRLLALIAQGFDVSNFFPQVVKNVASQSLEVKKLVYLYLLHYAEKRPNEALLSINYFQKDLGDTNPLVRAWALRAMAGIRLHVIAPLVIVAVQKCARDPSVYVRKCAANALPKLHDLRMEEHASAIEEIVGLLLNDHSPGVVGAAASAFTSVCPNNFSLIGRNYRRLCEILPDVEEWGQIILIGILLRYVIARHGLVKESIMFSLYNKDIDNLEEDESYITSKEDAGYSIDKTVSELATMVFQCYIEGPDEYLSRSSSTNRVAPKLDVSQYTSCSNDVVKILLHCTSPLLWSNNSAVVLAAAGVHWIMASKEHIKRIVKPLLFVLRSSSASRYVKFGIDGFTFTRKFYSVVKKIIRRDEVLCNIQVFAKAIPSLFAPHYQDFFICSSDSYQIKALKLDVLSSIATDSSISFIYKEFQDYIRDPNRRFAADTVAALGLCAQRLPKMATSCVEGLLTLVRQEFFCGEIRSLDGEEGVLTQAIISIKSIIKLEPSSYEKVIIQLVCSLDKIKVPAARAMIIWILGEYCSLGDIIPRMLSTVLKYLARCFTSEALEAKLQFLNTTAKVLLCIKGEDILTVRKVWSYVIELAERDLNYDIRDRSRFLKKLLSSNLESQHGEEENSESQKRDQSYILAECIFGGQTKAMTVPSEPIDYRFYLPGSLSQLVFHAAPGYEPLPKPCSLPYTDLDQYDGAAKSDSDEEDDTGTSGSLDEGSASDYSSEQSITASGEASGSDESVSGNEGEDNADPLIQISDTGNVCEYQNSGAPSGTAGFRDLMSTKSLESWLDEPARSSKGSEIEQSQVRRSSARITIGNIGNRVKPKCYTLLDPVNGNGLKVNYSFSSETSSISSHLVCLEVLFENCSLEPMFDIVLIEEDYSKSSDSTDRTSSPTENTLKFHVNKPALVSMEEIPSLEPGETANRTLLVRFHHHLLPLHLALFCNDKKFPVKLKPDIGYFIKPLPLSIEDFRDKESRLPGMFEYVRSCTFTDHILELNKRSNSLTEDKFLVICETLALQMLSNANLSLVSVDMPVAANLDDASGLCLRFSSEILSNSMPCLITVTVEGISVVKEWFYLLCSMDFSTLIGG

SEQ ID NO: 120989 - protein, 1032 aa, Glycine max
  Coding DNA Sequence Number=SeqID_29304
  Homolog annotation: Hit_ID=A7PIT9; Match level="QueryCoverage=98%, HitCoverage=91%, E-value=0.0, Identity=52%"; Hit description =Chromosome chr13 scaffold_17, whole genome shotgun sequence
  Pfam annotation: Domain name=XH; Domain location=938-1031; Score =87.9; E_value=3.3e-23; Accession=PF03469.5; Description=XH domain
  Pfam annotation: Domain name=XS; Domain location=551-668; Score =187.1; E_value=4.5e-53; Accession=PF03468.5; Description=XS domain
  Pfam annotation: Domain name=zf-XS; Domain location=160-202; Score =68.6; E_value=2e-17; Accession=PF03470.5; Description=XS zinc finger domain
  Pfam annotation: Domain name=zf-XS; Domain location=236-280; Score =32.8; E_value=1.3e-06; Accession=PF03470.5; Description=XS zinc finger domain
  Pfam annotation: Domain name=zf-XS; Domain location=361-405; Score =33.5; E_value=7.6e-07; Accession=PF03470.5; Description=XS zinc finger domain
  Pfam annotation: Domain name=zf-XS; Domain location=44-86; Score =88.5; E_value=2.1e-23; Accession=PF03470.5; Description=XS zinc finger domain
  Pfam annotation: Domain name=zf-XS; Domain location=481-525; Score =87.3; E_value=4.9e-23; Accession=PF03470.5; Description=XS zinc finger domain
  Pfam module annotation: Pfam domain module=XH::XS::zf-XS::zf-XS::zf -XS::zf-XS::zf-XS; Domain location=938-1031::551-668::160-202::236 -280::361-405::44-86::481-525
MAHCSNKDNDPSASQLSWWYVDISYQELKKGSYKVMRSDETFICPYCPERKQDYKYRELLNHASGVGRSSSEKRSAKEKANHLALVKYLEKDLAYMDGPSKPVDKGAKLLSPGETVMPHCSNKDTDISASQISWWYVDTSYEELKKGSHSVKTSDVTFICPYCPRRKQDYLYRELLEHAYMVGRSSSEKRSARERANHLALVKYLENDLIIIMDGPSEPVDKGTKLSLGQTVVAQCSNKETGMSASPINWWELLEHASGVGQSSSEKRHVREKATHLALMKYLKNDLKYLNDPSKSVNEGNPPVNRVHQISSQERSVREDATHLPSAKYFKKDLTNVSDPSSKPVNEGTITGSPGETVIGCCSNKDSNISSSQIGREILEHASGVGQSKSQKRSFIEKANHLALVKYLKKDLMNVGAPCPSKPMDQGTKTISPGETVMGHYSHNDNNIRASQISGWYVHKSYEALKKGSHNVKTSEMTFSCPYCPNKKRKRDYVYREILEHASGVGQSSSEKRSAIEKANHLALMKYLEKDLMIVDGPPKTADEGSPPFNFEKQFVWPWTGIVVNIPTRLTEEGCCVGESGSKLRDEYRSRGFNPQRVRILSNFCGHSGTAVVEFNKNWTGLDNALAFERAYELDHHGKKDWFANTEHKSGIYAWIARADDYKVNNIIGEQLQKMGDIKTISELMEEEARMQDKLLSSLNNTLQVKKKRLKEMEVKYYETSHRMDIVMGEIDKLTQGHNQEMKKIQSSATQHFQNIFNGHERLKLQLESQKRELELRRIELEKREARNESERKKLEEEIMENALKNSSLDMAVLEQQKAGENVLKLAADQKRQKEQFHAKIILLERQLEVKQKLELEIQQLKGKLNVMAYIEDDGDTEVLNKVDALHKDLREKEQSLRDLDSLNQTLIIKERQSNDELQEARKELINGIKEISCRANVGVKRMGELDIRPFLEAMKKKYNDEDAEDRASELCSLWEEYIKDPDWHPFKITMIEGKHQEIIDDDDEKLKGLKNEMGEGVYKAVRERELPCKRE

SEQ ID NO: 120990 - protein, 127 aa, Glycine max
  Coding DNA Sequence Number=SeqID_29305
MFKIQQFGYSCPLKANIESSILHTTLLHDPVTKVSRPHNSSLVCCLSQQRREEGGEGCDSGRVRVAWLRHGGAERKKEKGAILGGEGGAVAMWQRRKEGGKWCNTGRVRVARKCIDVELKRTTLSFR

SEQ ID NO: 120991 - protein, 726 aa, Glycine max
  Coding DNA Sequence Number=SeqID_29306
  Gene Ontology: Mol. function=metal ion binding; Cellular component =Golgi apparatus
  Homolog annotation: Hit_ID=A7NTC7; Match level="QueryCoverage=100%, HitCoverage=100%, E-value=0.0, Identity=62%"; Hit description =Chromosome chr18 scaffold_1, whole genome shotgun sequence
  Pfam annotation: Domain name=DUF248; Domain location=218-721; Score =851.0; E_value=6e-253; Accession=PF03141.7; Description=Putative methyltransferase
  Pfam annotation: Domain name=Methyltransf_11; Domain location=350 -445; Score=34.2; E_value=4.6e-07; Accession=PF08241.3; Description =Methyltransferase domain
  Pfam annotation: Domain name=Methyltransf_12; Domain location=350 -443; Score=19.3; E_value=0.0083; Accession=PF08242.3; Description =Methyltransferase domain
  Pfam module annotation: Pfam domain module=DUF248::Methyltransf _11::Methyltransf_12; Domain location=218-721::350-445::350-443
  Subcellular localization annotation: CTP_CleavageSite=61; ConfidenceScore=5.02e-01
MAIARLVRQAKRPHGLWVKMTAVTILGLCFIFVWGVFSSSSTSVTTQRESFEDIAEPVSSSSSHKPQKLKKDESKKGGGGGKSEKKSNGNGSSHPEQHKGKDNQKKEKKRVHKEDNKEKGNHRGDEDPQPQHDQEEKEKREEEVEVEGEEERVDRESEGDVDADGGGDLAESVDQGDSEAVEDVEEVRKASKGKVKGPLFNPNATYSWKLCSTRSKHNYIPCIDIEVGGGKVPSYRHTERSCPRTPFMCMVPLPHEGYGFPLPWPESKLKVIMEKLDKVAYGKVKILYKNVAHPKLAAYIKRHNWLMESGEYLTFPQNQSELKGGIHHYLESIEEMVPDIEWGKNIRVVLDIGCTDSSFAAALLDKEVLTLSLGLKNDLVDLAQVALERGIPAVISPFSRRRLPFPSQSFDAIHCGGCGIPWHSNGGKLLLEMNRILRPGGYFIMSTKHDSIEEEEAMTTLTASICWNVLAHKSDDVGEVGVKIYQKPEGNDIYELRRKKVPPLCKENENPDAAWYVSMKTCLHTIPIGIEQHGAEWPEEWPKRLESYPDWVNNKEKVVADTNHWNAVANKSYLNGLGINWTSIRNVMDMKSVYGGLAVALSQQKVWVMNVVPVHAPDTLPIIFERGLIGIYHDWCESFGTYPRTYDLLHADHLFSRLKNRCKQPVTIVVEVDRILRPGGWIIIRDKVEILNPLEEILKSMQWEIRMTFAQDKEGILCAQKTMWRP

SEQ ID NO: 120992 - protein, 346 aa, Glycine max
  Coding DNA Sequence Number=SeqID_29307
  Gene Ontology: Mol. function=aspartic-type endopeptidase activity; Cellular component=endoplasmic reticulum; Biological process =proteolysis
  Homolog annotation: Hit_ID=A7PIR8; Match level="QueryCoverage=100%, HitCoverage=83%, E-value=1e-137, Identity=69%"; Hit description =Chromosome chr13 scaffold_17, whole genome shotgun sequence
  Pfam annotation: Domain name=Asp; Domain location=2-341; Score= -143.1; E_value=3.9e-05; Accession=PF00026.14; Description=Eukaryotic aspartyl protease
  Subcellular localization annotation: CTP_CleavageSite=41; ConfidenceScore=5.40e-01
MVLDTGSELSWLHCKKLPNLNSTFNPLLSSSYTPTPCNSSVCMTRTRDLTIPASCDPNNKLCHVIVSYADASSAEGTLAAETFSLAGAAQPGTLFGCMDSAGYTSDINEDAKTTGLMGMNRGSLSLVTQMVLPKFSYCISGEDAFGVLLLGDGPSAPSPLQYTPLVTATTSSPYFDRVAYTVQLEGIKVSEKLLQLPKSVFVPDHTGAGQTMVDSGTQFTFLLGPVYNSLKDEFLEQTKGVLTRIEDPNFVFEGAMDLCYHAPASLAAVPAVTLVFSGAEMRVSGERLLYRVSKGRDWVYCFTFGNSDLLGIEAYVIGHHHQQNVWMEFDLVKSRVGFTETTCDLA

SEQ ID NO: 120993 - protein, 616 aa, Glycine max
  Coding DNA Sequence Number=SeqID_29308
  Homolog annotation: Hit_ID=Q9LKB4; Match level="QueryCoverage=90%, HitCoverage=91%, E-value=1e-161, Identity=53%"; Hit description =Genomic DNA, chromosome 3, TAC clone:K15M2
  Subcellular localization annotation: CTP_CleavageSite=48; ConfidenceScore=5.45e-01
MDLRHFRSEFLPTTLNPSSTYLQFSPLRPLHKTLNLKFQSQKRFAVVSFSQRPKTISEFSILGQNSWCTRDLRSYAGRSKKSGGAGSSGGRIEGNAEFRRRLKRNARARSKKYAESLFYRLKNPKGGGNYPDNFTEDELQQIGLGYDRMVRFMEKDDPNLRHPYDWYKYGQYGPYSWRGVVVGEPVRGRFSDECVTIISEVKDHEEWEQIEQGEMAEEYGEKLKQLDQSKLKYFWVFVRHPRWRISELPWQQWTLVSEVVLEAGKQRLDKWNLMGRLGNKARSSIGQCAAWMRPDIVYVKKPVFQCRFEPQDDFFKPIIPFLNPKTEQDFLFELENDDGSVELCTYFGGLCKIVKVNQKAFVDDVVNAYQKLSDEKKSKCLEFLLKNHPVELLHPYTKEWKAKLEEMELGCDAPDEEDDAIVDDPDETEVLDWIEDEGSDDDTNITDDDEDEEELIDDDDDDGDEDQDLVMDMEESEDGKFHAMEEDTLDEDEKDFNWNEEFQKALSSGEAMENLAKKALEFNKKLNKNQFMMNKVEEETALSVDGDETALRGKRAKVSQEEWKYIGVGPWRKKIKKSKIPPELFLRAVVRPFTYRNLVKEIVLTRHAILDGEIGA

SEQ ID NO: 120994 - protein, 517 aa, Glycine max
  Coding DNA Sequence Number=SeqID_29309
  Gene Ontology: Mol. function=ubiquitin-protein ligase activity; Cellular component=intracellular; Biological process=protein modification process
  Homolog annotation: Hit_ID=A7PIN9; Match level="QueryCoverage=77%, HitCoverage=89%, E-value=1e-171, Identity=69%"; Hit description =Chromosome chr13 scaffold_17, whole genome shotgun sequence
  Pfam annotation: Domain name=RCC1; Domain location=351-400; Score =11.8; E_value=0.039; Accession=PF00415.9; Description=Regulator of chromosome condensation (RCC1)
MAEESSGQHDATWKSNHVGIRRGTLLPLKMILGMAINNGGGSEEGALQTVLYMWGYLPGALPQRTPLLTPVAVRVPPCDYSWNDVCGGGCGFAIAISESGKLITWGSTDDLGQSYVTSGKHGETPEPFPLPTEASIVKAAAGWAHCVAVTEHGAVYTWGWKECIPSGRVFGEPSTGVSLEKDVPGRHSQVSTEQVSPRSQGSRSTGGTASSNSGEESTKRRRVSSAKQTAESSSSSDDSLTAFPCLVTLNPGIRIASVAAGGRHTLALSDTGLVWAWGYGGEGQLGLGSRIRMVSTPHLVPCIDSSYYSKDRSATLARGNMDSEGQTFRVPGSYIKRIACGGRHSAVITDAGALLTFGWGLYGQCGQGITDDELSPTCVSSILGIHIERVAAGLWHTVCTSADGDVYAFGENQFGQLGTGADQAEGGKVFCWGWNKYGQLGVVLGISNIVVESSLLSCDFWALQLGLGDVVYPKMLLVVGGILFFWPSPPLDVMVYQRLLTQLLDSGSAMYMNIRAV

SEQ ID NO: 120995 - protein, 445 aa, Glycine max
  Coding DNA Sequence Number=SeqID_29310
  Gene Ontology: Mol. function=nucleic acid binding; Cellular component= ribonucleoprotein complex; Biological process=ribosome biogenesis and assembly
  Homolog annotation: Hit_ID=A7PJ88; Match level="QueryCoverage=100%, HitCoverage=100%, E-value=1e-178, Identity=67%"; Hit description =Chromosome chr12 scaffold_18, whole genome shotgun sequence
  Pfam annotation: Domain name=Sof1; Domain location=354-441; Score =142.8; E_value=9.4e-40; Accession=PF04158.5; Description=Sof1-like domain
  Pfam annotation: Domain name=WD40; Domain location=106-144; Score =37.8; E_value=3.8e-08; Accession=PF00400.23; Description=WD domain, G-beta repeat
  Pfam annotation: Domain name=WD40; Domain location=188-226; Score =4.3; E_value=9.4; Accession=PF00400.23; Description=WD domain, G -beta repeat
  Pfam annotation: Domain name=WD40; Domain location=272-310; Score =33.6; E_value=7.2e-07; Accession=PF00400.23; Description=WD domain, G-beta repeat
  Pfam annotation: Domain name=WD40; Domain location=314-353; Score =27.7; E_value=4.4e-05; Accession=PF00400.23; Description=WD domain, G-beta repeat
  Pfam annotation: Domain name=WD40; Domain location=56-95; Score=11.4; E_value=1.2; Accession=PF00400.23; Description=WD domain, G-beta repeat
  Pfam module annotation: Pfam domain module=Sof1::WD40::WD40::WD40::WD4 0::WD40; Domain location=354-441::106-144::188-226::272-310::314 -353::56-95
MKVKVISRSVDEFTRERSQDLQRVFRNYDPSLRPQEKAVEYVRAVNAVKLDKIFARPFIGALDGHIDAVSCMTRNPSQLKGIFSSSMDGDGEGWKRRGGNLFCYVVDFQNMFPGHRGAVRGLTASTDGHILVSCGTDCTIRLWSVPLLLLWSQMTQLRALLRGADHQWDGEHFATAGAQVDIWNHNRSQPINSFEWGTDTVISVRFNPGEPNLLATSARYVRLPWPLAATMTSAVGWIEGAAVAFVIALVWYGAIAANEDGNCYSYDARKLDEAKCVHKDHVSAVMDVDYSPTGREFVTGSYDRTVRIFQYNGGHSKEIYHTKRMQRVFCVKFSGDGSYVISGSDDTNLRLWKAKASEQLGVILPRERKKHEYHEAIKKRYKHLPEVNRIARHRHLPRPIFKASALMCVMADAKRRKEEKRKAHSAPGSITTQPLRRRRIIKEVE

SEQ ID NO: 120996 - protein, 794 aa, Glycine max
  Coding DNA Sequence Number=SeqID_29311
  Gene Ontology: Mol. function=caspase activity; Cellular component =membrane; Biological process=proteolysis
  Homolog annotation: Hit_ID=A7PIM9; Match level="QueryCoverage=99%, HitCoverage=98%, E-value=0.0, Identity=64%"; Hit description =Chromosome chr13 scaffold_17, whole genome shotgun sequence
  Pfam annotation: Domain name=WD40; Domain location=123-161; Score =16.3; E_value=0.11; Accession=PF00400.23; Description=WD domain, G -beta repeat
  Pfam annotation: Domain name=WD40; Domain location=165-205; Score =15.0; E_value=0.29; Accession=PF00400.23; Description=WD domain, G -beta repeat
  Pfam annotation: Domain name=WD40; Domain location=210-249; Score =18.7; E_value=0.021; Accession=PF00400.23; Description=WD domain, G -beta repeat
  Pfam annotation: Domain name=WD40; Domain location=252-290; Score =7.0; E_value=4.4; Accession=PF00400.23; Description=WD domain, G -beta repeat
  Pfam annotation: Domain name=WD40; Domain location=31-69; Score=24.4; E_value=0.00042; Accession=PF00400.23; Description=WD domain, G-beta repeat
  Pfam annotation: Domain name=WD40; Domain location=80-119; Score =10.9; E_value=1.4; Accession=PF00400.23; Description=WD domain, G -beta repeat
  Pfam module annotation: Pfam domain module=WD40::WD40::WD40::WD40::WD4 0::WD40; Domain location=123-161::165-205::210-249::252-290::31 -69::80-119
  Subcellular localization annotation: CTP_CleavageSite=56; ConfidenceScore=5.19e-01
MALLAASGGDTVKLFDASAVKPGVYTPAGDPCALSFTPSPGSQVNSVKWNHTNLVVASAGDDKKISLWRKNGNSMGTIPVAGTDSGDNIEESILAISFSNKASRYVCSGGTGQVVRIWDLQRKRCIKWLKGHTNTVTGVMYNCKDEHLASISLSGDLMLHNLASGQKAAELKDPNQQMLRVLDYSRVSRHLLVTAGDDGTVHLWDTTGRSPKVSWIKPHSAPTAGISFSPSNDKIIASVGLDKKMYIYDSGSRRPSSYISYEAPFSSLAFRDDGWMLAAGTSNGRVAFYDVRGKPQPVAVLHAYGSSEAVTSLCWQRSKPVVVDERNCSAETALVGDTVEDSILMPDPLPSATSSNNSLSTSVASTRNSGWLGASFDGSSLMASGSGFTSSILNASTAEETPQRNHLWPGGTLSRLHAPRASYNFKDDMEVFSPLVDVQPLTPSLWDENGIKKDNLFSDRKPLLFPSSSRRFSNSEDGTSDHPISDWKSGSTTKQDITQSSFPLVGSTPPPPSSKNEDSSITPPEAWGGERLSDKYAYTRQPVNAPSRFGVLASAGQTAGSMLSGLQDTSSSVGVSSYTSSSLSFANLRAKDASSSQETSLGFTDHMFSAPMSINTKTSLGQAIDSPKILDSPRMSSFNRRFSTYAERISTTSTLSDGVSLSVGSPKIKKSGAETREELLNSLLLKSDISAPIESGSLPLTSGIISQPKASQPDAQGSSFTLQLFQRTLEETLDSFQKSIHEDMRNLHIEILRQFHMQETEMSAVMNSILENQAELMKEVKSLRQENQQLRQML

SEQ ID NO: 120997 - protein, 96 aa, Glycine max
  Coding DNA Sequence Number=SeqID_29312
MNRTSTPRQEKKEDLSKDEDIVSQVPLCDCSWLIGVNLPGVYSPRIPQQLVSESMVRLGDRLRRVRWRQWILALEIPCIECLSSGGSRQRVEETHT

SEQ ID NO: 120998 - protein, 679 aa, Glycine max
  Coding DNA Sequence Number=SeqID_29313
  Gene Ontology: Mol. function=identical protein binding; Cellular component=extracellular region; Biological process=negative regulation of catalytic activity
  Homolog annotation: Hit_ID=A7PIM2; Match level="QueryCoverage=94%, HitCoverage=90%, E-value=0.0, Identity=60%"; Hit description =Chromosome chr13 scaffold_17, whole genome shotgun sequence
  Pfam annotation: Domain name=PA; Domain location=260-356; Score=65.9; E_value=1.4e-16; Accession=PF02225.13; Description=PA domain
  Pfam annotation: Domain name=Peptidase_S8; Domain location=21-488; Score=-4.3; E_value=1.6e-06; Accession=PF00082.13; Description =Subtilase family
  Pfam module annotation: Pfam domain module=PA::Peptidase_S8; Domain location=260-356::21-488
MDSVVSVIPDRIHKPQTTRSWDFLGFPENVQRNIIAESNTIVGVIDSGIWPESDSFNDAGFGPPPKKWKGICQNFTCNNKIIGAQYFRTKGFFEKDDIKSPIDTTGHGSHCASTAAGNPVRSASLLGFGSGTARGGVPSARIAVYKVCWATGCDTTDILKAYDAAIADGVDILSVSVGATQLTHNKYFKDVHAIGAFHAMKKGILTSTSADNLGQLGPYSTSKFAPWLLSVAASTIDKKFFTKIQLGNGKIYEGVSVNAFDLHNIQHPLIYAGDASIIKGNSSNARYCQENALDKALVKGKILLCDNIPYPSFVGFAQGAVGVIIRSNVSLAVSDVFPLPAAHITHNDGAQIYSYLKSTSNPTATIFKSYEGKDPLAPYIDSFSGRGPNKITPNILKPDLAAPGVNILAAWSPIAPISGVKGDKRISKYNILYGTSMACPHVTAAAVYIKSFHPNWSPAVIKSALMTTATPMRDILNHGNAEFGYGAGQINPMKAVKPGLVYDATEIDYVKFLCGDGYSGFMDKITGDNKTTCTPANTGSVLDLNLPSFALSTTRSKYISATFSRTVTNVGSAKSIYKATVTTPPSSSSLNIKVVPDVLVFSSLEEKMSFTLKIEGSINNANIVSSSLVWDDGTFQVRSPVVVYVPPCTYCYYLLHAAKQMNPVNNRDAEFAYACCRPN

SEQ ID NO: 120999 - protein, 382 aa, Glycine max
  Coding DNA Sequence Number=SeqID_29314
  Gene Ontology: Mol. function=transporter activity; Cellular component= mitochondrial inner membrane; Biological process=transport
  Homolog annotation: Hit_ID=A7PIM6; Match level="QueryCoverage=97%, HitCoverage=96%, E-value=1e-119, Identity=61%"; Hit description =Chromosome chr13 scaffold_17, whole genome shotgun sequence
  Pfam annotation: Domain name=Mito_carr; Domain location=131-253; Score=101.3; E_value=3e-27; Accession=PF00153.18; Description =Mitochondrial carrier protein
  Pfam annotation: Domain name=Mito_carr; Domain location=26-119; Score= 86.5; E_value=8.4e-23; Accession=PF00153.18; Description =Mitochondrial carrier protein
  Pfam annotation: Domain name=Mito_carr; Domain location=298-380; Score=64.5; E_value=3.6e-16; Accession=PF00153.18; Description =Mitochondrial carrier protein
  Pfam module annotation: Pfam domain module=Mito_carr::Mito_carr::Mito_ carr; Domain location=131-253::26-119::298-380
  Subcellular localization annotation: CTP_CleavageSite=63; ConfidenceScore=5.10e-01
MEARVGMAVDGGGVRKLVQPPPKQIGTVSQLLAGGVAGAFSKTCTAPLARLTILFQGMHSNVAALRKVSIWNEASRIIHEEGFRAFWKGNLVTIAHRLPYSSVNFYSYEHYKKLLKMVPRLQSHRDNVSADLCVHFVGGGMAGITAATSTYPLDLVRTRLAAQPFPLWPYAFYLHLCPSFDEYYQSMICAQVVIQTNFTYYRGIWHALHTISKEEGIFGLYKGLGTTLLTVGPSIAISFSVYETLRSYWQSNRSDDSPVVISLACGSLSGIASSTDYWSDVKIEFLLSRMGVVQFNSSVILYAATFPLDLVRRRKQLEGAGGRARVYTTGLYGVFRHIIRTEGFRGLYRGILPEYYKVVPGVGICFMTYETLKMLLADIATG

SEQ ID NO: 121000 - protein, 567 aa, Glycine max
  Coding DNA Sequence Number=SeqID_29315
  Gene Ontology: Mol. function=transferase activity, transferring glycosyl groups; Cellular component=Golgi stack; Biological process =metabolic process
  Homolog annotation: Hit_ID=A7NTB3; Match level="QueryCoverage=96%, HitCoverage=89%, E-value=0.0, Identity=61%"; Hit description =Chromosome chr18 scaffold_1, whole genome shotgun sequence
  Pfam annotation: Domain name=PPR; Domain location=233-267; Score =23.6; E_value=0.00074; Accession=PF01535.11; Description=PPR repeat
  Pfam annotation: Domain name=PPR; Domain location=268-302; Score =16.6; E_value=0.084; Accession=PF01535.11; Description=PPR repeat
  Pfam annotation: Domain name=PPR; Domain location=303-337; Score =24.7; E_value=0.00034; Accession=PF01535.11; Description=PPR repeat
  Pfam annotation: Domain name=PPR; Domain location=338-372; Score=6.0; E_value=1.5; Accession=PF01535.11; Description=PPR repeat
  Pfam annotation: Domain name=PPR; Domain location=412-446; Score =22.2; E_value=0.002; Accession=PF01535.11; Description=PPR repeat
  Pfam annotation: Domain name=PPR; Domain location=447-481; Score =14.5; E_value=0.15; Accession=PF01535.11; Description=PPR repeat
  Pfam module annotation: Pfam domain module=PPR::PPR::PPR::PPR::PPR::PP R; Domain location=233-267::268-302::303-337::338-372::412-446::447 -481
MSSFRSADFSEDLWRTVWEVSNLVLEDMDKEIKKEKMKGFLQCEEVKEMCRFAGEVGIRGDLLRELRFKWAREKLEEHEFYEGLERLRKETQSEGNAIDVPKEEKEKVVVGLPKRRGKIRYKIYGLDLSDPKWAQVADRIHEAEQVFWPQEPKPITGKAKIVTTKILLSKEEEEEEEEEDGLQSLLAEWVELVQPSRVEWMDLLDKLKEHNPGLYFKVAEMVLTEDSFQTHVSDYSRLIDIYAKENRFDDVERMLKKLNENGLQVDASIASTLVLMYCKRGDLAHAKEAFEVLTSLGFQPDAHVYNSMITALVNNGQPKLGEKLMRDMDDRHIPITKDIYMALLRSFSQLGDAVGAERISNTMQFAGIQQGMDMETSTLLIEASALAVPCNPDQARSHFDYMIKLGHKPDDRCTASMISAYEKKNYLDNALNLLLELEKDGFEPGVATYSVLVDWLGKLQLVDEAEQLLGKIALLGEAPPFKLQVSLCDMYARAGNEKKALQSLGVLEARKDELGQAEFERILSGLIDGGFQKDAQRISQIMEAQGFDASRVKFKLSKPVSRAPSFR

SEQ ID NO: 121001 - protein, 114 aa, Glycine max
  Coding DNA Sequence Number=SeqID_29316
  Gene Ontology: Mol. function=catalytic activity; Biological process =cellular metabolic process
  Homolog annotation: Hit_ID=Q9SPJ5; Match level="QueryCoverage=48%, HitCoverage=15%, E-value=3e-22, Identity=90%"; Hit description =Dihydroflavonol-4-reductase DFR1
MKKVKHLVELPGAKSKLSLWKADLAQERSFDEAIEGCTGVFHVATPMDFECNDPEKLNLIGNAEQSDKSYNKRIARHHESMREGQNLKACIHIISWNCGRYGAPKPCHGRELLE

SEQ ID NO: 121002 - protein, 429 aa, Glycine max
  Coding DNA Sequence Number=SeqID_29317
  Gene Ontology: Mol. function=hydrolase activity, hydrolyzing O -glycosyl compounds; Cellular component=extracellular region; Biological process=carbohydrate metabolic process
  Homolog annotation: Hit_ID=A7NT93; Match level="QueryCoverage=97%, HitCoverage=96%, E-value=1e-158, Identity=64%"; Hit description =Chromosome chr18 scaffold_1, whole genome shotgun sequence
  Pfam annotation: Domain name=Cellulase; Domain location=40-371; Score= -61.9; E_value=0.0044; Accession=PF00150.9; Description=Cellulase (glycosyl hydrolase family 5)
MKLGFFMVFLVLYMILERGILLLPQVEAAAADGFVKVRGVQLMLNGRPYYANGYNAYWLMYMASDPSQRNKVSSVFQKGTNHGLNIARTWAFSDGGYKPLQYSPGSYNEDMFRGLDFVISEARRYGTKLVLSLVNNYDNFGGKKQYVDWARSEGQAIDSEDDFFTNPLVKEYYKNHVKSVLTRRNNFTGVVYKDDPTIMAWELMNEIRCPSDQSGNTVQGWITEMASYLKSIDGNHLLEAGLEGFYGLSKQESNPSFHVGTDFITNNQIPGIDFATVHSYPDQWLPGSSNEDQILFLVRWLNDHIQDSQNIQKPVLFAEFGVATKNISTDSTLRDQFFNLVYSAIYSSASDSGAAVGGLFWQLLAEGMDSFRDGYEVPLDESCSTATLIAQESEKLNRIRMKIFPRVKNSKKWNKAREVRIPRWQGGAN

SEQ ID NO: 121003 - protein, 321 aa, Glycine max
  Coding DNA Sequence Number=SeqID_29318
  Gene Ontology: Mol. function=jasmonate O-methyltransferase activity; Cellular component=cytoplasm; Biological process=fatty acid biosynthetic process
  Homolog annotation: Hit_ID=A7NT84; Match level="QueryCoverage=99%, HitCoverage=86%, E-value=1e-109, Identity=63%"; Hit description =Chromosome chr18 scaffold_1, whole genome shotgun sequence
  Pfam annotation: Domain name=Methyltransf_7; Domain location=1-320; Score=504.3; E_value=1.5e-148; Accession=PF03492.6; Description=SAM dependent carboxyl methyltransferase
MGIADLGCSSGPNVLRVISEILDTVYSTTCLLDRPAPELVVYLNDLFTNDFNNIFGSLPSFYRKQKQEKGSGFGPCFVSAVPGTFYGRLFPSKSLHFVHSSSSLHWLSQVPGGLEDGSGRALNKQKIYLSKSSPKCVLDAYSRQFKNDFSVFLASRSQEIVAGGRMVLSLMGRETMDPTTDHSCYQWELLARSLMTMVSEGLLEEEKVDSFDAPYYAPCLEEMKMEIQKEGSFIVDEHEAYEIDWDAGMKLQSDSPTVTPLTSGERVARTIRAVVESMLEPHFGCHIMDELFRRYAEVVEDHLSKTRTTYINLVISLVKQG

SEQ ID NO: 121004 - protein, 194 aa, Glycine max
  Coding DNA Sequence Number=SeqID_29319
MSLSTYDISFKITDVNITLNRAVNIGYFKTDVAQTYNSIIGFPDPNYGIKTIINQKLSSPIYILPLAPRNVVLRSLRFMSVTLSVELLSYPNFVWGLLFDGMQPLVDRFEGKKKERRESSWTNHGEGEDRRSQCFIFTFLLSMIKGMQIATRPTWAFQDVPPEGGCIWRKQPGSPGRAELAWANWVASSSPILL

SEQ ID NO: 121005 - protein, 115 aa, Glycine max
  Coding DNA Sequence Number=SeqID_29320
  Homolog annotation: Hit_ID=A5BP71; Match level="QueryCoverage=65%, HitCoverage=19%, E-value=1e-11, Identity=46%"; Hit description =Putative uncharacterized protein
  Pfam annotation: Domain name=zf-CCHC; Domain location=88-105; Score =17.9; E_value=0.003; Accession=PF00098.14; Description=Zinc knuckle
MIVIVNAEACGYVSMNYYQYIDVVYTNEHILKAYSAQWWPLGNEAAIPPSDDAWTLIPDPTTIRAKGRPKSTRIRNEMDWVEPSEHRTKCSRCGAEGHNRRRCPMQSERGSCSNR

SEQ ID NO: 121006 - protein, 83 aa, Glycine max
  Coding DNA Sequence Number=SeqID_29321
  Gene Ontology: Mol. function=polysaccharide transmembrane transporter activity; Cellular component=membrane; Biological process =polysaccharide transport
  Homolog annotation: Hit_ID=A8GC47; Match level="QueryCoverage=65%, HitCoverage=14%, E-value=1e-12, Identity=61%"; Hit description =Polysaccharide export protein
MAKRQLKVISLLISISVISGCTVFPGTHLSTSGKEVVKQEDADFDIDKMVNIYPDDTEVVGLDASDKGGCSAECAVGRIATHV

SEQ ID NO: 121007 - protein, 180 aa, Glycine max
  Coding DNA Sequence Number=SeqID_29322
MTLLLSNILPSDRNANLPLQKYQLVCVVPTWGSHPQRHLVDLKKSNRALGFPALVTGLYRPYRALVPPASSCHHDIGKDCARKTPSGPEEGQQCLGVASSKYGSLSVQGSACCPQQGHQAPYQSSFHLEVLRLQAGAGRNTTAAWGWPAAGNRRTAITSRVHLSSSTKRLERCLRPMADQ

SEQ ID NO: 121008 - protein, 89 aa, Glycine max
  Coding DNA Sequence Number=SeqID_29323
  Subcellular localization annotation: CTP_CleavageSite=12; ConfidenceScore=5.11e-01
MEANAVIVAATSAVAKVNPMLPSGLKQMNHPTSNMDVNNSTPILIKSQQPQSDHAHVSRPMEETHGMPHHNLADFEPCLGYATERQAVG

SEQ ID NO: 121009 - protein, 92 aa, Glycine max
  Coding DNA Sequence Number=SeqID_29324
MEENREKLVVLSTRILSQHALLRACEARLTGALSKGVKMRGVATNVYLWKNRRKPVKTKILSSGVVFTFEEGRQKRGFWSYVPSIEEEIRPT

SEQ ID NO: 121010 - protein, 64 aa, Glycine max
  Coding DNA Sequence Number=SeqID_29325
MRGYHMATRTFRQLGENEPVDVQRLTSSSPPLAIQGQRVRFYTRCPETFKPDDARDSSLLGGGN

SEQ ID NO: 121011 - protein, 78 aa, Glycine max
  Coding DNA Sequence Number=SeqID_29326
MGTRGCISYYPVLAIRQLGYPMSTARGRARASHVRGLDWLPSLRTAKREEVEASEEDKEVQALRTELEQPKKGSNQQL

SEQ ID NO: 121012 - protein, 23 aa, Glycine max
  Coding DNA Sequence Number=SeqID_29327
MTVQKRLSHEVLKVKVELSSSVG

SEQ ID NO: 121013 - protein, 186 aa, Glycine max
  Coding DNA Sequence Number=SeqID_29328
GSPSAALKIRKENAELRDINIATTKALEQETKRARREEHGRNKFRGALWGSNSELKLRREERDRSRVDSLILKDELKVCSRSKRNLSQRLCEIETNMLAIVSKYQEELNLATAHEHKVANEYTQVYAEKEARGRVIDALHQEATMWMDRFALTLNGSQELPRLLAKAKAMADTYSVPGEIHGLLNY

SEQ ID NO: 121014 - protein, 91 aa, Glycine max
  Coding DNA Sequence Number=SeqID_29329
  Subcellular localization annotation: CTP_CleavageSite=38; ConfidenceScore=5.46e-01
MNYFSDWGGRFPKPSLSFSSYSIALAWARKGSKKSGSRGSMEVSSCKPGREDESAPSSSYSRPIRENDSFKYRIRPLFGTLDYVGFQEITD

SEQ ID NO: 121015 - protein, 65 aa, Glycine max
  Coding DNA Sequence Number=SeqID_29330
MTNLVSACHRTRLCLNGKGVRITVRMTKLGLCVPTDTTVSEWQRGADNRKNDQTWSLRAIGHDCV

SEQ ID NO: 121016 - protein, 92 aa, Glycine max
  Coding DNA Sequence Number=SeqID_29331
  Pfam annotation: Domain name=zf-CCHC; Domain location=20-37; Score =34.2; E_value=4.8e-07; Accession=PF00098.14; Description=Zinc knuckle
MERSHNFNNGKRSQEVSPTLKCYKCNQPGHIKANCPSNESWPEKNEKKSYKERRSKKAYIAWDDNDSSDGSEKEINLLSKDYESDENISQEV

SEQ ID NO: 121017 - protein, 84 aa, Glycine max
  Coding DNA Sequence Number=SeqID_29332
MGEKEGITASLDKMANSFNRMVERMDGKVDDEDIQEVLREAALIPDLSRQQWAKAIKWFDLLHLMMNEDYGMKNVVFFFKIWTL

SEQ ID NO: 121018 - protein, 289 aa, Glycine max
  Coding DNA Sequence Number=SeqID_29333
  Homolog annotation: Hit_ID=Q84VH5; Match level="QueryCoverage=85%, HitCoverage=40%, E-value=1e-113, Identity=77%"; Hit description =Envelope-like protein
MDCKEIVDLIKAAGLLKTVSKLGECYEGLVREFIVNIPSDISNRKSDDYQRVFVRGKCIRFSPAVINKYLGRPTDGVIDIDVSEHQIAKEITAKRVQHWPKKGKLSAGKLSVKYAILHRIGAANWVPTNHTSTVATAFRIFCCQITIAFPTVLCGIMLSQHPNILNYTDSVMKRESPLSLHYKLFEGTHVPDIVSTSGKAAASGAVSKDALIAELKDTCKVLEATIKATTEKKMELERLIKRLSDSGIDDGEAAEEDGEAAEEEEEAAEEEEDAAEDTESDDDDSEATP

SEQ ID NO: 121019 - protein, 124 aa, Glycine max
  Coding DNA Sequence Number=SeqID_29334
MDICEDTDIPIILGRPFMLTTSCIVDMGRKKHDFEDPKIDFDLFVEDKPAPEQNVCLQVMKVGQEVLKHKPRAKHIFGHVLSRKSQALSAQPLHLRLIWSTKLAKAELSQFQFDLNSAKRRPDR

SEQ ID NO: 121020 - protein, 166 aa, Glycine max
  Coding DNA Sequence Number=SeqID_29335
  Pfam annotation: Domain name=zf-CCHC; Domain location=80-97; Score =26.8; E_value=8.2e-05; Accession=PF00098.14; Description=Zinc knuckle
EHEMELQRLNQNEETDKKKRSIALKASSSMQEENEEDESKDEEDFSLFVKKFQKFIKKRRIERRKNFNNGRRSQEDSQVLRCNKCNQLGHIKANCPSNEEWPKKSDKKRYHERRTKKAYIAWCRNLPFCRQARRGSRVRLPKEENARSHHQRLFVENVRKTKGNWS

SEQ ID NO: 121021 - protein, 125 aa, Glycine max
  Coding DNA Sequence Number=SeqID_29336
MEADVEAMKEQMSAMMEAMMSMKKIMEANAVAIAATSVVAKVNLMSPSDINQMNHPTSDMVGKDLGSTGGPHDVQIQNEHAFPPYGLPLNYTPPNVAYTPNKNVNNSSPIPIKSQQPQTDHAPVS

SEQ ID NO: 121022 - protein, 111 aa, Glycine max
  Coding DNA Sequence Number=SeqID_29337
MQLRILGSISIQILDFQLSMDFHFEKSRILGYFLKIHGLNFIFGGIFQVSILVGGSPRIESFMEQHVLRDPEFGVCSDNVTGLVNKASVIFHARSECSHQIFNMIPRDLSY

SEQ ID NO: 121023 - protein, 254 aa, Glycine max
  Coding DNA Sequence Number=SeqID_29338
YARVSTKESCVDPLGNDPDKGDSEKYGLYVEENPPRLVALGRLYEGSTTVHNIPLLHDHVKVGVEEVKDADTLIHVPTEELTVLDKQGVVGPAKPADRLDHDPLYLMTLTIPQLFLKSLQVMWDATVFGVFNDNFPLYIKHEDLSKIAHGGQCLNISVIQLWILHMTETSMRAGNADVYGFLEPQSIQRFGQSQFESESYIKNWMQKSKRDVYLAAYLNGAHWQMVIILAKENVVIWFFSLHNKPDNYLKGIIN

SEQ ID NO: 121024 - protein, 80 aa, Glycine max
  Coding DNA Sequence Number=SeqID_29339
VIRPPTNRAFIKKVLRPRQAQGETPQQPRDGRQRPTDAPPPPLEPLSSSTKVGALSTTRDRQVITRPAQDVKEALLGGNL

SEQ ID NO: 121025 - protein, 301 aa, Glycine max
  Coding DNA Sequence Number=SeqID_29340
  Pfam annotation: Domain name=Transposase_23; Domain location=81-151; Score=8.3; E_value=0.00015; Accession=PF03017.5; Description =TNP1ENSPM transposase
STLEDPHELQQLTQQIRDQLEESITEKVTRQVMASFSHLQSQMQSQGVAVPPEPVVGLGPSGPRVSRKGSCVDPSGNDPETGDSDRCGLYIEADPARLVAIGRVYEGSTVVHNTPLLPGQVKVSVEEVRDADAPVPVPTDEVFLVGQALYTFLAWPTHLVAVSPPKPPLKPDPEVDDPLYLMTLTIPELFLSLINFPLYIKHEDLSEIAHGGQCLSISVLQLWILHLTETCMRAGNSDIYGFLEPQSIQRSGQSQFESESYIKSLMQSSQRDVYLGAYLNGPDNYLKEIINSAIKGLDDAP

SEQ ID NO: 121026 - protein, 68 aa, Glycine max
  Coding DNA Sequence Number=SeqID_29341
MWWIAVTNTIWKFRNELIFHNQPFDISKLADSTLFLMWTWLWGWERDFKVPFQWWSSAMRLDPLLFML

SEQ ID NO: 121027 - protein, 269 aa, Glycine max
  Coding DNA Sequence Number=SeqID_29342
AGAADESWIGYSGSVTSVAGWVSLGIGAGDESGVSTSSPSAVAAVGSLATGFWAAKAPPPPEGENWAPGQATYRTDVDADGADGIGAGAEEGGASDFFPLALRGPLKRLTRIPFQGCIIELPVPVVLASNDRTWSILESSPPPQVRIKLLVPVSMLKFFSKFIELNVMENDIPSRQNLPRYHSSVYLSQASWDVNLDLSNMALGTSTCVVVTENKRGYISCGSVLVEGTSTRLFKENKGGYIPCGSFLVNEFYKVEKKSQGPQVAWGLD

SEQ ID NO: 121028 - protein, 59 aa, Glycine max
  Coding DNA Sequence Number=SeqID_29343
MALLHLRSMCAWLRRHLLKLFMIELMLKERLKVSSNDFGDEFFCEIKEKEVAKQKGEKK

SEQ ID NO: 121029 - protein, 156 aa, Glycine max
  Coding DNA Sequence Number=SeqID_29344
  Homolog annotation: Hit_ID=A5B3J2; Match level="QueryCoverage=86%, HitCoverage=24%, E-value=9e-09, Identity=31%"; Hit description =Putative uncharacterized protein
MWSQQKRPSVGDLIPIDLEINATCRRRNQERIRKNLQDLEVVAIPEEEPQSSEASSSFPIVEHSHLDPSEDYIMAEEPRRVTLEDYSSSNVPQFFTSIAQPEVQAQTITYPPSLIQLIQNNLFHGLPNEDPYAHLATYIEICNTIKWLECLKMQSD

SEQ ID NO: 121030 - protein, 69 aa, Glycine max
  Coding DNA Sequence Number=SeqID_29345
  Subcellular localization annotation: CTP_CleavageSite=52; ConfidenceScore=5.38e-01
MVRVTSTHGEGRVALSRARTCSPLKVRTCSPLKARTCSPLEVRACNPLMVRVCSPLKARTCSPLNGEGN

SEQ ID NO: 121031 - protein, 96 aa, Glycine max
  Coding DNA Sequence Number=SeqID_29346
MAKFDPEIVLEFYANAWPTEEGVRDMRSWIRGQWIPFDTDAFSQFLGDPLVLEEGKQCMAPTRHPLEPDKSNRALGFLALITGLCQSYGVPVTPVG

SEQ ID NO: 121032 - protein, 111 aa, Glycine max
  Coding DNA Sequence Number=SeqID_29347
MRNRDHMLAIVSTYQEELNLATTHEHRVADEYAQVYAKKEARGRVIDSLHQEATIWMDRFALTLNGSQELPRLLAKAKVMADTYSAPEEIHGLLSYCQHMIDLIVHIIRNR

SEQ ID NO: 121033 - protein, 130 aa, Glycine max
  Coding DNA Sequence Number=SeqID_29348
MACLPNYTPPNVAYIPNEDVKNSTPILIKSQQPQSDHAHVSRPMEETHEIPHHDLADFEPCLGYATEGQAVGGMGKLDHLEERLRAIEGGEDYAFANLEELFLVPNIITPPKFKVLDFDKYKGLLVPRTI

SEQ ID NO: 121034 - protein, 57 aa, Glycine max
  Coding DNA Sequence Number=SeqID_29349
MDGEELPSPVNSEGQDHLELPSGVETKHEQQKPIKVHRDGCKWGWGHDRPIVAPSLR

SEQ ID NO: 121035 - protein, 217 aa, Glycine max
  Coding DNA Sequence Number=SeqID_29350
  Homolog annotation: Hit_ID=A5AP21; Match level="QueryCoverage=79%, HitCoverage=11%, E-value=1e-07, Identity=30%"; Hit description =Putative uncharacterized protein
RWRQFKSDLTRKWALAVDKDGADDIVCEKYGISKEKWTQFCQTRRDPSWEDVRKKAQASQKQNTAPHVLSRGGYEYLEEKLMAEKAKKRLEEAAQSGSTEGIIDPPSPFRRHVKWKMARTKKTGQMTSEAAKEIADRIVIIFVYFVNSLDKYVFGTGFFGRAGVTGIVCPPWTSDILTAAIGRPEHPGRVRAVGAGVTIKQYFGSASRTSRSSSSML

SEQ ID NO: 121036 - protein, 182 aa, Glycine max
  Coding DNA Sequence Number=SeqID_29351
  Homolog annotation: Hit_ID=Q6WAY6; Match level="QueryCoverage=97%, HitCoverage=28%, E-value=1e-23, Identity=38%"; Hit description =Putative uncharacterized protein
RGEWAPFIDILALSIFGGVLFPNVDGLVDLAAIDAFLDFHDRKESPVVVILADLYDTFNRRCEKSSTRIVCCTPTLYVWLVSHLFRQEVRHACPLESHRSCTEKREGSWDRLLASKEGASVNWFPRWKEGRTGVLISCGGFPNVPVMGTRGCISYNPVLAIRQLGYPMRGAPLEEELAPIIA

SEQ ID NO: 121037 - protein, 75 aa, Glycine max
  Coding DNA Sequence Number=SeqID_29352
MAVEWRRKRERRRHFKEKMSLEEAHHHRRPWIRAWRKEMNEGRGREEHEILCSKRALKSEPTNPRSSPRFSTKCA

SEQ ID NO: 121038 - protein, 103 aa, Glycine max
  Coding DNA Sequence Number=SeqID_29353
  Homolog annotation: Hit_ID=A7QUI1; Match level="QueryCoverage=94%, HitCoverage=22%, E-value=5e-26, Identity=60%"; Hit description =Chromosome chr10 scaffold_179, whole genome shotgun sequence
DGLVPALAGALATVVNAFEHGGQVGMVFEMYRTCGGFFRVLEETIEAAIEEKDLDKRENEELIEMNMALQFGRSVSQLRELATKSASCRIEGREIHEFASKLF

SEQ ID NO: 121039 - protein, 138 aa, Glycine max
  Coding DNA Sequence Number=SeqID_29354
QARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSQVLMIGPLLPHKMLLGDEASASQV

SEQ ID NO: 121040 - protein, 124 aa, Glycine max
  Coding DNA Sequence Number=SeqID_29355
MRVHCNQASQRPSMTTDSPPLLMFPWTRHTKGTTRVYIYKNIKKKGKEKEQKGSHSKENTLIDWPNSLTIVPNGVANCRNLPFGGRATRDSRVHLPRKENARSSHQRLFEENVGKIGKGVVYEL

SEQ ID NO: 121041 - protein, 120 aa, Glycine max
  Coding DNA Sequence Number=SeqID_29356
MEASGNRLPACVIDYTEEWVTDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 121042 - protein, 71 aa, Glycine max
  Coding DNA Sequence Number=SeqID_29357
MELAFEEVGVGLMNEILQRGIVVQLYNVLDLSIETMQKPCHGGLLRLLNLIPNQGNFHLFVILIHTPISLK

SEQ ID NO: 121043 - protein, 120 aa, Glycine max
  Coding DNA Sequence Number=SeqID_29358
  Pfam annotation: Domain name=G-patch; Domain location=1-42; Score =21.1; E_value=0.00054; Accession=PF01585.14; Description=G-patch domain
MVARVMLRNGFEPGMGLGKDCLGNADVVDIKGNPYKYGLGYEPGMPGRRNVPSRFRADRVWPDRISQCFTNAGMVSEEEVAAIEEEFPQDPPSFVQPCHPDSQVGNWRVISQSEVYTADS

SEQ ID NO: 121044 - protein, 156 aa, Glycine max
  Coding DNA Sequence Number=SeqID_29359
WTPYDLLVTDLVLRLPLALDLVAYWSAMWWRCVYCPLPAIPMLLWCFALRLPGDAVLLDESSISRGPDALAGGYRYSVELTETRLIEARNQSWKPQGPVGLFGSIGCLVGAIPATIDGIRNQLNYMHTYPCRDDTDQPILLQGEIGIAVAGQNVAK

SEQ ID NO: 121045 - protein, 49 aa, Glycine max
  Coding DNA Sequence Number=SeqID_29360
MCTCAIFGSQDALSMHVCKFSQGSACDVGNGPEEACLKEVQEGYGGRRN

SEQ ID NO: 121046 - protein, 39 aa, Glycine max
  Coding DNA Sequence Number=SeqID_29361
MTSEAAKEIAEKIDLLEEQASQGLFVPHGGQDVLTAAIG

SEQ ID NO: 121047 - protein, 180 aa, Glycine max
  Coding DNA Sequence Number=SeqID_29362
RQVAQAAALVAADLVQGVFADADQVGDGTGQLLLERIGDAGDLLGHVLHLVGHHREPAPRLARARGLDARVQRQIFGLLVDIDDALDLLVRNALDAARQFDDSFRLMGHVQHSFCWTLLREETVTWGHKQEACQVVHGLMTSPFHGRGGGDDGASRLEAGLAARTNTVQATDTSGAFRAR

SEQ ID NO: 121048 - protein, 92 aa, Glycine max
  Coding DNA Sequence Number=SeqID_29363
  Homolog annotation: Hit_ID=A6FJQ2; Match level="QueryCoverage=41%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARHHTPRTIMPCNHLLDATLWSSVVLRTDSSVTHPDVPSFSSIF

SEQ ID NO: 121049 - protein, 83 aa, Glycine max
  Coding DNA Sequence Number=SeqID_29364
MAKEPRRVTLEDYSSSNVPQFFTSIAQPEVQAQTITYPPSLIQLIQNNLFHGLPNEDPYAHLATCIEICNTIELVFILTIWRS

SEQ ID NO: 121050 - protein, 287 aa, Glycine max
  Coding DNA Sequence Number=SeqID_29365
  Gene Ontology: Mol. function=helicase activity; Biological process =viral genome replication
  Homolog annotation: Hit_ID=Q9C8B0; Match level="QueryCoverage=98%, HitCoverage=19%, E-value=7e-63, Identity=37%"; Hit description =Putative uncharacterized protein F10O5.11
MDQLYFDGMVICSHVGFPNLFITLTCNPNWPKIHRLLNPLNLKAADRLDIISRVFKLKYEQMLMDLTKNHMLGKVIVYMYIIEFQKRGLPHVHLLLFLHPDNKYPSLDEIDQIISAEIPSQQDDPELYSLVKNHMVHGPCGSLNPGSPCMKEGKCSHFYPKMFHLHIVLDADGFPVYRRRNNGNAIEKNGVIIDNRVTAVLIDEDNGQTENGGTHNDEIKEYLDCRYICPCESTWRIFGFPIHGRKPVVERLHFHLPGQHSVLYEDHDDIDDVLSKPSISDSSLFHG

SEQ ID NO: 121051 - protein, 76 aa, Glycine max
  Coding DNA Sequence Number=SeqID_29366
MMQSYPAKALDKRIQVDWARDPREGPRVLMSLKGVEVSLAIRELLKEVFSKKLLKEVFSKKLLKEVFSRKLLKEAT

SEQ ID NO: 121052 - protein, 95 aa, Glycine max
  Coding DNA Sequence Number=SeqID_29367
STLEDPPRTDDIPSSSIPAPQSASIGPDVQHSQTLVPMLQSLFRGQLIIMHSLRELAHNRLIIPMEHFLEQVAWPEAQLPLVRPNEAATLEPAPA

SEQ ID NO: 121053 - protein, 241 aa, Glycine max
  Coding DNA Sequence Number=SeqID_29368
  Homolog annotation: Hit_ID=Q84VH5; Match level="QueryCoverage=78%, HitCoverage=31%, E-value=7e-86, Identity=77%"; Hit description =Envelope-like protein
IPVINKYLGRPTEGVVDIAVSEHRIAKEITAKQVQHWPKKGKLSAGKLSVKYAILHRIGAANWVPTNHTSTVATESFAVKLPIAFPTVLCGIMSSQHPNILNYTDSVMKRESPLSLHYKLFEGTHVPDIVSTSGKAAASGAVSKDALIAELKDTCKVLEATIKATTEKKMELERLIKRLSDSGIDDGEAAEKKKQLRKKKKLRKKKKQLRKRKMQQKIQNQMMMILKPPHDHQTFIFALTS

SEQ ID NO: 121054 - protein, 69 aa, Glycine max
  Coding DNA Sequence Number=SeqID_29369
DSFEEHATQGSFVPHGRQDVLAAAIGRPEHPGRVRAAGAGVTIKQYFGSAPRMSRNISSLPPDELQQLT

SEQ ID NO: 121055 - protein, 51 aa, Glycine max
  Coding DNA Sequence Number=SeqID_29370
MKKKKVEAAGVLISEAYALSEDVTESKNRAREKSLDEKPQPLRDSEFRSDY

SEQ ID NO: 121056 - protein, 68 aa, Glycine max
  Coding DNA Sequence Number=SeqID_29371
MKETIRSFQEWTREGSKLVYQVFCLLWNARVVVGGGMEGPPKCFAGVYHHCLPFRCISEARLEVARLW

SEQ ID NO: 121057 - protein, 163 aa, Glycine max
  Coding DNA Sequence Number=SeqID_29372
  Homolog annotation: Hit_ID=A0ST23; Match level="QueryCoverage=19%, HitCoverage=65%, E-value=2e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARDIRKKAQAIQKQNKAPHILSRGGYDYLEEKLMEDKKKKGYRARIRNHVGKPVVPAALMNRPTRGERRFAYWALFRFLAH

SEQ ID NO: 121058 - protein, 127 aa, Glycine max
  Coding DNA Sequence Number=SeqID_29373
MEFLQPDAVPVSVSDLGNHNLNPKVALPQSWIQSSKTRPDNYLKGIINSALKGLDDTPQPKSKAAARQKGITECGYYVMHWMSTIILGSFRNNWETYFNEVRPLEAERFNALRIQWAQYYLKVRNQT

SEQ ID NO: 121059 - protein, 109 aa, Glycine max
  Coding DNA Sequence Number=SeqID_29374
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=98%, HitCoverage=36%, E-value=3e-17, Identity=95%"; Hit description=DNA -directed RNA polymerase subunit beta
  Pfam annotation: Domain name=RNA_pol_Rpb2_6; Domain location=1-109; Score=-161.9; E_value=0.00013; Accession=PF00562.19; Description=RNA polymerase Rpb2, domain 6
SPLNRDIQEEQTVPARYRQEFLTIAWEQGQILADGAATVDGELALGKNVLVAYMPWEGYNSEDAVLINERLDMPYLQDGRPVDMVFNPLGVPSRMNVGQIFECSLGLAG

SEQ ID NO: 121060 - protein, 86 aa, Glycine max
  Coding DNA Sequence Number=SeqID_29375
MPHNGQVRSLSLSEIKGRPVRVTLFCENAPTMWDRHRLTGALKPDDPQGLHSEDAPQVINSSGSHSGSHHNSSRINSSPLKGITVV

SEQ ID NO: 121061 - protein, 66 aa, Glycine max
  Coding DNA Sequence Number=SeqID_29376
  Homolog annotation: Hit_ID=Q42806; Match level="QueryCoverage=48%, HitCoverage=6%, E-value=1e-07, Identity=81%"; Hit description =Pyruvate kinase, cytosolic isozyme
MTEKLLRAEMKVARFNFSHGNYNFHQETLNNLHYIPIFLFTLKIKNLKDDIRIVIFDGIGGNGFSL

SEQ ID NO: 121062 - protein, 124 aa, Glycine max
  Coding DNA Sequence Number=SeqID_29377
  Gene Ontology: Cellular component=chloroplast
  Homolog annotation: Hit_ID=A7PF69; Match level="QueryCoverage=93%, HitCoverage=47%, E-value=7e-27, Identity=55%"; Hit description =Chromosome chr11 scaffold_13, whole genome shotgun sequence
MRMKEGRLKEIGYLQDLVYKLSAVGQALEKNDLSAAGSVLGGSTDADWVQRANIAFNKEMTNYVPITLLISQLINFGAYTDTSCFKHAVSKKDVESSKIAFVSSATAFEKWTSMTGLAAQLKGL

SEQ ID NO: 121063 - protein, 40 aa, Glycine max
  Coding DNA Sequence Number=SeqID_29378
MSQRFRPFFDVLHLFFIVLRSSTGETKAKINSPSQARPQK

SEQ ID NO: 121064 - protein, 218 aa, Glycine max
  Coding DNA Sequence Number=SeqID_29379
  Gene Ontology: Cellular component=integral to membrane
  Homolog annotation: Hit_ID=A7PSW2; Match level="QueryCoverage=66%, HitCoverage=28%, E-value=3e-45, Identity=66%"; Hit description =Chromosome chr8 scaffold_29, whole genome shotgun sequence
MRKEKIPHQAPFAIQAAQLLGRAIGAGLFAITPAGERGMCCKAIKLGNARVFPVTTLSTLEDPLANFLQHRGAQSAKSIKSPTTNTALELKRTVSDIKSGVHNQLEHTIKTQRRMQGIAKRINKMHTEGLNNAINSNTVVAVLIATVAFAAIFNVPGQYPEKQNELSPGMSPGEAYIAPDIGFKIFIIFDSTALFISLAVVIVQTSVVVIERVPSSNS

SEQ ID NO: 121065 - protein, 189 aa, Glycine max
  Coding DNA Sequence Number=SeqID_29380
MCCRCSFRASLFQQGHNGGIATAAGMLERRHAVIVGEIDVGTGLDEKLHDLDMALTAIAEHDGFKERRPAEIVDVIDLHASLDQRAHRFDMPPFGSGNEGRSAIAVGAFEVRSMRKRHLENFEVSARARIKIGAVLDGIPRVDVRPCINERTGDIDLVCVGCCKKRRLAISAACFEIRSGLDGRIDRGQ

SEQ ID NO: 121066 - protein, 88 aa, Glycine max
  Coding DNA Sequence Number=SeqID_29381
PLGPPEFPPEGCASGGSNLARLGELSSPGRAGRHHLPYFAINRGGSEEEKAEALPKRFRNVFREEFRKGFNRSSTFFIRSSSFFDLQR

SEQ ID NO: 121067 - protein, 96 aa, Glycine max
  Coding DNA Sequence Number=SeqID_29382
MSNQKSTESTIKNLEVQVGQLAKQLADLPSRSFGANTEKNPKEECKAVMTRSKMRASTAKHSFNALSVTKESGRAQESRPHAKRKISSLSETFVSC

SEQ ID NO: 121068 - protein, 137 aa, Glycine max
  Coding DNA Sequence Number=SeqID_29383
DQHLRYNSQFSSRIILDPKYLDTDLFNDETFDCYQVFQNSGLVDFMSLKLPYYPELVKVFYNNLKIQDGIISSEVHGAGAITSFGYRKDRDWQWLKKDTLPPQDERTPSPPPQQDDSSALMNEVLSELRGLHTYVGE

SEQ ID NO: 121069 - protein, 210 aa, Glycine max
  Coding DNA Sequence Number=SeqID_29384
  Gene Ontology: Mol. function=hydrolase activity, acting on ester bonds; Biological process=lipid metabolic process
  Homolog annotation: Hit_ID=A0GJ83; Match level="QueryCoverage=96%, HitCoverage=85%, E-value=2e-54, Identity=50%"; Hit description =Lipolytic enzyme, G-D-S-L precursor
  Pfam annotation: Domain name=Lipase_GDSL; Domain location=31-200; Score=92.2; E_value=1.7e-24; Accession=PF00657.13; Description=GDSL -like LipaseAcylhydrolase
MMFRFLKILSVCTTLFFAHAALAETTSKPVILVFGDSLSAAYGIPKEKGWVNLLAQRVKDNQLPYEVANASVSGETTAGGLSRLPAALQQFKPSIVVIELGANDGLRGLPTDAMKNNLEKMIAACKQMNARVVLLGMLIPPNYGPQYTNGFKQVYLDLSQTYKTPFVPFFLDGVSGHSDLVIEDGLHPNVIAQPKILENVWPTLKPLLKQ

SEQ ID NO: 121070 - protein, 23 aa, Glycine max
  Coding DNA Sequence Number=SeqID_29385
GIGKEDWCHALKNLSPEAWGQPP

SEQ ID NO: 121071 - protein, 55 aa, Glycine max
  Coding DNA Sequence Number=SeqID_29386
MARSRIVSGHGQKSRQVNGRNQPRQMEDRIVTDQSSPLPGAGPAENVAARQPSIL

SEQ ID NO: 121072 - protein, 58 aa, Glycine max
  Coding DNA Sequence Number=SeqID_29387
STLEDPSPWVLVTLTVERTTRPRLERTTRPHHQRVARPHLQRTTCPRLERATRPHLGY

SEQ ID NO: 121073 - protein, 65 aa, Glycine max
  Coding DNA Sequence Number=SeqID_29388
MKEVNEDSQVNGDRANNELPREWKASRDHPLDNIIGDISKGVEKPENYPVIGTKWVFRNKLENMA

SEQ ID NO: 121074 - protein, 52 aa, Glycine max
  Coding DNA Sequence Number=SeqID_29389
MLRLAPPSRLARILLCAKRAKAALSGGSLLSPAAELSPTATFCNSKLSLFLT

SEQ ID NO: 121075 - protein, 310 aa, Glycine max
  Coding DNA Sequence Number=SeqID_29390
MGFVTWWEKYYSTRSVGDTTIMISRLESGFTQPTVENIRSNLQARGKTIMTKKSAETSRADVRPKKPTGVKIQERKQEEKEEEERPLIRKRKFPSTSTKSTEQTEAGNSQAQIPKKKKKVKQDEPEPPVAVEAGEPIKKKKKKTKSSKEQGDNQLVDVQPPSTDVDGTEVEATPSIAEMGNPVEQPNSPQEQPAVEVQQNVSVEEIPSHARTSPAPETDALNVEEQGEGQGIGPSSPHGSSQKSSSEENFFDEEGIEEAEAGGSDIYPASSTSKLSASIGIAEDTFIQMQDKDPAAALRLLLNTSQANTS

SEQ ID NO: 121076 - protein, 130 aa, Glycine max
  Coding DNA Sequence Number=SeqID_29391
MAYRRLSWMAKNHTRGLDWLSKLKVIDEENFEAPEEDEEENAATARALEQETKKARKEEYGREKFRGALWGSNNELKLRREERDRSRVHGMILKEELVACARSKKSLAQNLEATEQSMLAIIGQYKEELN

SEQ ID NO: 121077 - protein, 208 aa, Glycine max
  Coding DNA Sequence Number=SeqID_29392
  Homolog annotation: Hit_ID=A7PHV0; Match level="QueryCoverage=50%, HitCoverage=33%, E-value=4e-10, Identity=31%"; Hit description =Chromosome chr13 scaffold_17, whole genome shotgun sequence
MCSATDYKVKSIGGMCILIQMWAWERCMTLAPKGTPPVIENKPLGHRWLRRGNQHIGNDDLRLFRHKLDLMKRHEFVWEPYTATVMAALPPICVVGSVAWFAVLSLGSTFILDRRPTGFNSDYMVWYRRKAKMFVDPNDANTTTLGEIVETLQYMVSPQGRNTWTVDDLVPYVEKLAIISKEQERITEPVSHGPALELEFPAQEFHIL

SEQ ID NO: 121078 - protein, 145 aa, Glycine max
  Coding DNA Sequence Number=SeqID_29393
  Gene Ontology: Mol. function=phosphoprotein phosphatase activity
  Homolog annotation: Hit_ID=A5AWR0; Match level="QueryCoverage=88%, HitCoverage=14%, E-value=8e-21, Identity=34%"; Hit description =Putative uncharacterized protein
  Pfam annotation: Domain name=DUF1723; Domain location=81-123; Score =21.3; E_value=0.0016; Accession=PF08330.1; Description=Protein of unknown function (DUF1723)
MASSSSSSSHINIKSGPIDADVLWMQPKHVSEHVWNGKEDRKLHIRRAVPTYQGEEQIPEQIFPFLQQSSFGWIIKMGYLKINASLSSALIERWRPKTHTFHMRCGECISVDGLPLIGPTNLDWADLCEELLGARPQEGEIKGSV

SEQ ID NO: 121079 - protein, 293 aa, Glycine max
  Coding DNA Sequence Number=SeqID_29394
  Gene Ontology: Mol. function=nucleoside-triphosphatase activity; Cellular component=chloroplast
  Homolog annotation: Hit_ID=Q2PMM5; Match level="QueryCoverage=100%, HitCoverage=17%, E-value=1e-80, Identity=84%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPKRRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQK

SEQ ID NO: 121080 - protein, 131 aa, Glycine max
  Coding DNA Sequence Number=SeqID_29395
MIDAASAGALGDMTPIEARNLIENMASNSQQFSARNDAIVLRGVHDMATDSSSSAENKKLEGKLDALVNLQSGVNDKRYSPGWRNHPNLRWANPPQQQQQQQQQPVPPFQNAVGPSRPYVPPPMQQQQQQQ

SEQ ID NO: 121081 - protein, 72 aa, Glycine max
  Coding DNA Sequence Number=SeqID_29396
MASDSMGRIESVGPQEVNTTQGIKTQIINPMFINVVIMVYKGLEDFGDPNESSENKHVLNPLAAPSTKHNIV

SEQ ID NO: 121082 - protein, 128 aa, Glycine max
  Coding DNA Sequence Number=SeqID_29397
GAEDDVSLCVLSGFSSYRQQKVYTDNHSGISARQRDSKAFRLTAQQKVYTDNHSGISARQRDLKVSMTDLVSAEDDQKVYTDNHSGISARQRDSKVSMTDLVSTEDDGNLCVSTGLSAAIDEWRRRRH

SEQ ID NO: 121083 - protein, 50 aa, Glycine max
  Coding DNA Sequence Number=SeqID_29398
MTNFCEKWARLVKCRIYELAKPDHALGESSAKHTILRLSAQKNLEEGLVV

SEQ ID NO: 121084 - protein, 52 aa, Glycine max
  Coding DNA Sequence Number=SeqID_29399
MVHYIFVKVKLEVTRTSTVLNVFGNRQSSDKWVYDPNMVGSWYLTHATKNVV

SEQ ID NO: 121085 - protein, 89 aa, Glycine max
  Coding DNA Sequence Number=SeqID_29400
APSTSAPPISALSTSPLPPVPETPILIELALGPAPDHAELAECGPPVAGVQHSPSDGSEASAPRSLSDVSSIGACRPRIFFINGFLCFL

SEQ ID NO: 121086 - protein, 144 aa, Glycine max
  Coding DNA Sequence Number=SeqID_29401
EKSCDLVGVLAEFSAFALFCLAVIACAVECCFAWMLWKLGRIDGDLVLRETRIWATWEYVSSDGGGQQGMSGTWRYVAGVRRPWGRQASSWQSTDKRKTRPQSKEACGGWPAEAKMVSGNWELMEASGNRLPACVIDYTEEWVT

SEQ ID NO: 121087 - protein, 67 aa, Glycine max
  Coding DNA Sequence Number=SeqID_29402
MGQLQRQAFRKAYGNIWDLARVEVSMEPIASLSQYYDQALRNPGMPTGRKEAISFLWVLSLHDKSCQ

SEQ ID NO: 121088 - protein, 337 aa, Glycine max
  Coding DNA Sequence Number=SeqID_29403
MAPRKLASKRSRKDKAAEGTSSAPEYDSHRFRSAKHQQRFEAIKGWSFLRERRVQLRDDEYIDFQEEIVCRRGGRARYAILGEGSVDPVRCGCSQPVPGYPLVLEEGQECEYGQRRNRSDGFDEETIAQLLCIPGNIHPSDHNSDLPLPKCQLVYAILTRMSIHVAQLIADVIYLFAGMAPTRHPLDLDKSNRALGFPALITGLCQSFGVPVAPSKVIWLPITRAFIEKYCTQRQAQGDAPQAADAPPPHQAGPAGSFDTEQYLRHLVRQQAANHRAHVQTHDCLYQLSLSLQSQGFTSSPCPTPDQFRAEVAWPGDWPEAQAGEAPVEAPDEADEA

SEQ ID NO: 121089 - protein, 128 aa, Glycine max
  Coding DNA Sequence Number=SeqID_29404
MSILTLGSKKKRRENFQSKRKQKKGKERKFPIKEWEKAKRKERKFPIKEWEKEKKKEKKERKLLIKDRKENRRNVQRGLWTGQYLNNTELSPNEQKRRKGNHDLKWSSPFDYQPKSRALATFFFLAPH

SEQ ID NO: 121090 - protein, 174 aa, Glycine max
  Coding DNA Sequence Number=SeqID_29405
MEFGDIVVHFNILDAMKHLFEDHSVFRTEIIDQIVDDYMFDFDYVLYGRKHPFLSDLHTCHSLCIESDSEFEFDLVSDFYAESEFEFESGIVPLDVDFLESECTNHVAGSTYTSDLLYEVQVEEPSSSSPTLVPPTFQPPPTPELKPLPTTLKYAYLEDKEKFPVIIFASLAAE

SEQ ID NO: 121091 - protein, 50 aa, Glycine max
  Coding DNA Sequence Number=SeqID_29406
MSHSLGFFKGSVKTPYYSTQHIRDIKRNSNQLGEATMASGGHRWPWVVEK

SEQ ID NO: 121092 - protein, 118 aa, Glycine max
  Coding DNA Sequence Number=SeqID_29407
MHHQKRKTLDEASLLSCESETQHDHRSTSTPYGSLIRVQCPGHRIPQHTIVPISGKELWRQQEEQLLQRYLGFNLNEAELKLSLTRGICGLSFGFKYVVTIMLFGLSLVQQEGSKDKA

SEQ ID NO: 121093 - protein, 153 aa, Glycine max
  Coding DNA Sequence Number=SeqID_29408
PQEDETNRRHVGRESTHCWTVEAIDSEETIKKIKVKVRGVNSLPRELRIIVNFDDQGQAIGEAQALLAGFLGTLVADCKLFPMDYDRWSGPSGVPKAYFDDCFETILKPRFYFKINEAGAKRYCKLSMGRKWAANRQSLWNEFNDPTKTRDES

SEQ ID NO: 121094 - protein, 105 aa, Glycine max
  Coding DNA Sequence Number=SeqID_29409
MTPIHDALLYYNGRWNMSRQNEFVGYSFIGKNPKKIDIPSGCTMDELKDLIKQVAPYGIPPYGIHEIQTVLIESNYWKKIGPIEILAVFNKPVMEMEDKLSLSQN

SEQ ID NO: 121095 - protein, 102 aa, Glycine max
  Coding DNA Sequence Number=SeqID_29410
MSLHVLYLYAFSRFLPPRDFRSVVSLVTIFQRNEHGFEAFSPHGQDHLGLPSGVKTKHERQKPIKILKDERERGWGHDRPIVTFLRAKQAGNVAGKAAPGIL

SEQ ID NO: 121096 - protein, 112 aa, Glycine max
  Coding DNA Sequence Number=SeqID_29411
MGAYAKDEELLIHSFQESLTGTHYQFYYGKWWAMHLQSFADLVFASERIDVGLKRGKFSHPAWTNEKTGANEEGEDEGEARAVTAIPIQPSFPPTQQCHYLANNKPSPYPPP

SEQ ID NO: 121097 - protein, 68 aa, Glycine max
  Coding DNA Sequence Number=SeqID_29412
MAHQNAKHMATPMSTACYLDKDETGQSIDIKKYRERAQVKLVISLDLLYPLLRQNIFLLAIVVLKYFG

SEQ ID NO: 121098 - protein, 85 aa, Glycine max
  Coding DNA Sequence Number=SeqID_29413
MAWSVFALCPYLGTYRTISRGGKCAESPPTFICGKRRKNRRKPVIKNIPSSGVVFTFEEGISTSHVDKSGALAPTYPSSKRKSDL

SEQ ID NO: 121099 - protein, 163 aa, Glycine max
  Coding DNA Sequence Number=SeqID_29414
MWRRWWCICCQLLLLVLPWLLCLPWHAVLLNEGPVNGRSDELCGHDRCNTYKLVDGIRDKLCYMNTDLGQGSVDQLAFRQREIRIMVTKKDVIEQKHDPNLGQSGHASAHDLHYLPVTLRAKSCPGEHSSWPMASSSKPDTWLLLLAYSQSYPSSKINRCPRN

SEQ ID NO: 121100 - protein, 189 aa, Glycine max
  Coding DNA Sequence Number=SeqID_29415
  Gene Ontology: Mol. function=ribonucleoside-diphosphate reductase activity; Cellular component=cytoplasm; Biological process =deoxyribonucleoside diphosphate metabolic process
  Homolog annotation: Hit_ID=P49730; Match level="QueryCoverage=37%, HitCoverage=21%, E-value=3e-27, Identity=85%"; Hit description =Ribonucleoside-diphosphate reductase small chain
  Pfam annotation: Domain name=Ribonuc_red_sm; Domain location=1-173; Score=-101.7; E_value=0.022; Accession=PF00268.12; Description =Ribonucleotide reductase, small chain
DAGSRQARQGASAGVGGCRGWLNYAASEQIVLRVHHMRAIGAGLFAITPAGERGMCCKAIKLGNARVFPVTTLSTLEDPLSNELISRDEGLHCDFACLLYSLLRKKLSEERVREIVRDAVEIEREFVCDALPCALVGMNGELMGTELEFVIMVIAVSFGKPVVPAALMNRPTRGERRFAYWALFRFLAH

SEQ ID NO: 121101 - protein, 80 aa, Glycine max
  Coding DNA Sequence Number=SeqID_29416
MPQPYGINIGLKELSNRVTPKAYTPKSPSRPLPPNSGPTQKIFLHTDSIYELYKTHDSSIVLKIVLTRCPLRVLALTRRP

SEQ ID NO: 121102 - protein, 99 aa, Glycine max
  Coding DNA Sequence Number=SeqID_29417
  Homolog annotation: Hit_ID=B0HC01; Match level="QueryCoverage=32%, HitCoverage=68%, E-value=4e-10, Identity=100%"; Hit description =Putative uncharacterized protein
MEKRQQRGLFTVLAFCWPFAHMFFLRYPLILWITVLPPLSELIPLAAAERPSAASHFTRNFCTPLFVSPSASTFGIALTTLLVAVAGGGAPPPPPMALP

SEQ ID NO: 121103 - protein, 77 aa, Glycine max
  Coding DNA Sequence Number=SeqID_29418
MSRFATIVAEEWLTGIILGRWMLSSMLDPWGVLVAVGGIAHIAVLILKVFAYRLQNCTCVLPFRVVVRHNQHFLSNT

SEQ ID NO: 121104 - protein, 133 aa, Glycine max
  Coding DNA Sequence Number=SeqID_29419
  Homolog annotation: Hit_ID=A0ST23; Match level="QueryCoverage=35%, HitCoverage=95%, E-value=9e-12, Identity=72%"; Hit description =Putative reverse transcriptase
DAGSRQARQGASAGVGGCRGWLNYAASEQIVLRVHHMRAIGAGLFAITPAGERGMCCKAIKLGNARVFPVDSRGSPLTMIGKGAFGEGTELEFVIMVIAVSFGKPVVPAALMNRPTRGERRFAYWALFRFLAH

SEQ ID NO: 121105 - protein, 77 aa, Glycine max
  Coding DNA Sequence Number=SeqID_29420
  Gene Ontology: Mol. function=protein dimerization activity
  Homolog annotation: Hit_ID=A5BWC2; Match level="QueryCoverage=84%, HitCoverage=12%, E-value=5e-20, Identity=63%"; Hit description =Putative uncharacterized protein
MDKAKETIIKSFNSNESKYKDVFAIIDKRWNCQLHRPLHAAAHFLNPEFFYDNTDLEFDFEVTNENSNRVASLQDWC

SEQ ID NO: 121106 - protein, 39 aa, Glycine max
  Coding DNA Sequence Number=SeqID_29421
MKKQQWKRSGRQRRRGEGRHHPLGNKPRKKELHHHDFPG

SEQ ID NO: 121107 - protein, 74 aa, Glycine max
  Coding DNA Sequence Number=SeqID_29422
MESPTVATYHSAGGRREGSQVRLPRKENARSRHQHLFEENVGKIGKECFPCSYVFLNCGKEIRPTQFFQKGRIK

SEQ ID NO: 121108 - protein, 46 aa, Glycine max
  Coding DNA Sequence Number=SeqID_29423
MTESRQKGVRKGKEGEAYHPARPGELGCFLQKAPPSGELPRRPKWA

SEQ ID NO: 121109 - protein, 71 aa, Glycine max
  Coding DNA Sequence Number=SeqID_29424
MASSDHAILRDRAHVPTKRSLLELSSQDALLAQNKLLAKQLESLTETLSKLTNQLQVTQPYTFNNSVGRRM

SEQ ID NO: 121110 - protein, 50 aa, Glycine max
  Coding DNA Sequence Number=SeqID_29425
MRTTKGKGRRGLPPSSPWRARLLPPEATAFWRNIQEGSTRPDYYLHPHFY

SEQ ID NO: 121111 - protein, 143 aa, Glycine max
  Coding DNA Sequence Number=SeqID_29426
DSTSDSPQISASPYQLDLAPYASEPYNAQWNAPGLLRDKHTLRSSRILGEMEVDEPWLGLWLPLNYQVVFVIGSAVDSFVVDLGMAFVDNWVVGKEEVCYWLSNDIVGFGGKLGRIGMAVTAWVSPSFSPSSFAPVFSVVLVG

SEQ ID NO: 121112 - protein, 173 aa, Glycine max
  Coding DNA Sequence Number=SeqID_29427
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPVQPDRCALSGYYRLESKP

SEQ ID NO: 121113 - protein, 44 aa, Glycine max
  Coding DNA Sequence Number=SeqID_29428
MAIQAEESRADQKVEGFKQQLANELALEPVDDLVELEEIVEEVE

SEQ ID NO: 121114 - protein, 77 aa, Glycine max
  Coding DNA Sequence Number=SeqID_29429
  Homolog annotation: Hit_ID=B0HC01; Match level="QueryCoverage=45%, HitCoverage=74%, E-value=3e-12, Identity=100%"; Hit description =Putative uncharacterized protein
MRKRHASRRRKPTRYPGVGAYGKTPATRPFYGSWPFAGLLLTCSFLRYPLILWITVLPPLSELIPLAAAERPSAASQ

SEQ ID NO: 121115 - protein, 100 aa, Glycine max
  Coding DNA Sequence Number=SeqID_29430
MASTFFLLKKQNSLEIMSSEKEMTPNRVVNWPFRTLYHYFGDATIPSSNVNTTPESGIFFMTSFLRFFRHFPQINVGGDSAHFPPLEDAPVSLASHARKG

SEQ ID NO: 121116 - protein, 132 aa, Glycine max
  Coding DNA Sequence Number=SeqID_29431
SRRRSQLVCNRYAGSRQARQGASAGVGGCRVWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPE

SEQ ID NO: 121117 - protein, 101 aa, Glycine max
  Coding DNA Sequence Number=SeqID_29432
MSGFTRNSPQISASPHQLDLAPYASEPYHAQWNAPGLLRDKHTLRSSRILGEMEIWDQVWHRTLELGEFYRLSRCKIHFLVVFLVCAKGGLSSVGSAEIGL

SEQ ID NO: 121118 - protein, 167 aa, Glycine max
  Coding DNA Sequence Number=SeqID_29433
  Homolog annotation: Hit_ID=A7QZ64; Match level="QueryCoverage=98%, HitCoverage=58%, E-value=1e-52, Identity=48%"; Hit description =Chromosome undetermined scaffold_265, whole genome shotgun sequence
  Pfam annotation: Domain name=DUF821; Domain location=1-167; Score= -26.2; E_value=6.2e-18; Accession=PF05686.3; Description=Arabidopsis thaliana protein of unknown function (DUF821)
QDLIKCNVSENQDWNARLFAQDWFRESQEGFNKSDLPSQCTYRGLIPVHHYWPIKDDDKCRSIKFAVDWGNNHKQRAQQIGKVASDFNSFKKRYKPSISANATELCVESMVCGAEGSVKKFMMESLVKVPANTDLCTMPVPFDPPTLYATLQRKESSIQQVESWEKS

SEQ ID NO: 121119 - protein, 99 aa, Glycine max
  Coding DNA Sequence Number=SeqID_29434
  Gene Ontology: Mol. function=lipid binding; Cellular component =anchored to membrane; Biological process=lipid transport
  Homolog annotation: Hit_ID=A7QR85; Match level="QueryCoverage=83%, HitCoverage=67%, E-value=5e-20, Identity=45%"; Hit description =Chromosome chr13 scaffold_149, whole genome shotgun sequence
MDSNVCLPHLLVLAITLVLVSHAMGDSAQDKQRCAESLTDCCSGLTQAMKTNKKCVCLILKDRDDPDLGLKTNMTIAVGLPSLCKTPDNLSQCSGTFNF

SEQ ID NO: 121120 - protein, 98 aa, Glycine max
  Coding DNA Sequence Number=SeqID_29435
MDPKRIKVIPEWPTPPSVEERINEFQEPLDLRSNPFQGGGNMMKRERRRHFKEKMSLEEAHHHRRPWIRAWRKKELNEGREREEHEILCSKSVLKSEV

SEQ ID NO: 121121 - protein, 56 aa, Glycine max
  Coding DNA Sequence Number=SeqID_29436
MEAMKDQMTTMVEAMMSMRKMMEVNAATVVATSIATEVDPTHPSSLDQVNPPVSNM

SEQ ID NO: 121122 - protein, 56 aa, Glycine max
  Coding DNA Sequence Number=SeqID_29437
MTRARARKAKEALQQVLSILFEYKPKFQGEKSKVVLGIKWNNEMGKRRLSGGWTEI

SEQ ID NO: 121123 - protein, 167 aa, Glycine max
  Coding DNA Sequence Number=SeqID_29438
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
KRKSAQYANRLSPRVGRFINAAGTTGFPTGKRAVSATQLIYDHDYEFELGTLLMKMIAPGGIKWTAIKRLNLKHKVDLVCIQETKKESVDKLICQSIWGDSSVSWDFVPSVQASGMQAWHWPSFYNVVTGKTLALPNLIALQHIPLSPAGVIAKRPAPIALPNSCAA

SEQ ID NO: 121124 - protein, 174 aa, Glycine max
  Coding DNA Sequence Number=SeqID_29439
  Homolog annotation: Hit_ID=UPI0000ECBAF8; Match level="QueryCoverage =20%, HitCoverage=42%, E-value=2e-12, Identity=100%"; Hit description= UPI0000ECBAF8 related cluster
SEQESARGSFQGETPGIFIVLSGFATSDLSVDFCDARQGAGAYGKTPATRPFYADTARRSRTTERSESVSEEAEERPIRKPPLPARNSYDHDYEFELGTHYVKIPFDLQFKKQGDPLESTCRHASLALAVVYNVVTGKTLALPNLIALQHIPLSPAGVIAKRPAPIALPNSCAA

SEQ ID NO: 121125 - protein, 126 aa, Glycine max
  Coding DNA Sequence Number=SeqID_29440
  Gene Ontology: Mol. function=tRNA dihydrouridine synthase activity; Biological process=metabolic process
  Homolog annotation: Hit_ID=O52536; Match level="QueryCoverage=100%, HitCoverage=39%, E-value=6e-63, Identity=96%"; Hit description=tRNA -dihydrouridine synthase B
  Pfam annotation: Domain name=Dus; Domain location=1-126; Score=-77.3; E_value=9.4e-05; Accession=PF01207.8; Description=Dihydrouridine synthase (Dus)
MAGITDRPFRTLCYEMGAGLTVSEMMSSNPQVWESDKSRLRMVHIDEPGIRTVQIAGSVPEEMADAARINVESGAQIIDINMGCPAKKVNRKLAGSALLQYPDQVKSILTAVVSAVDVPVTLKIRT

SEQ ID NO: 121126 - protein, 160 aa, Glycine max
  Coding DNA Sequence Number=SeqID_29441
  Gene Ontology: Mol. function=helicase activity; Biological process =viral genome replication
  Homolog annotation: Hit_ID=Q2R1R7; Match level="QueryCoverage=99%, HitCoverage=9%, E-value=5e-37, Identity=50%"; Hit description=AT hook motif-containing protein, putative
MWYDERISKRVSTTNPTFNLCCGGGKVELPLLQNPPKYLHQLLYDHDTSDSKNYQQNIRTYNIMFTFTSTSIKFDKSINHSRGPPTIRIQGQPCHRIGSMLPMPGKEPQFAQLYIFDTENEVQNRINAVSPHNQIQAHIVSQLSEKLDEYNVQAKSFRMA

SEQ ID NO: 121127 - protein, 48 aa, Glycine max
  Coding DNA Sequence Number=SeqID_29442
  Homolog annotation: Hit_ID=Q0ZCD2; Match level="QueryCoverage=95%, HitCoverage=6%, E-value=2e-07, Identity=58%"; Hit description =Integrase
MIVKKDFMVEQKVLLYNSRLGLMSDKLWSKWIGPFVVTNVFPYVSSDF

SEQ ID NO: 121128 - protein, 141 aa, Glycine max
  Coding DNA Sequence Number=SeqID_29443
  Homolog annotation: Hit_ID=A7QB55; Match level="QueryCoverage=51%, HitCoverage=33%, E-value=3e-11, Identity=50%"; Hit description =Chromosome chr4 scaffold_73, whole genome shotgun sequence
MEAGNTYVSHEMRRADLCEELLGVRLQEGEIKGSVVKLSWLAHHFAQINNHDDEEHVRRFARAWILRFIGGVLFVDKSSNKVSLRWLRRGNQHIGNDDVRVFRRKFDIMKCHKEPYTTTVISLLPPICVAGSVAVVHGGGH

SEQ ID NO: 121129 - protein, 155 aa, Glycine max
  Coding DNA Sequence Number=SeqID_29444
QARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPALPLLLSFLQHPLCIIIEVIYDEVRGGSSATIVGHVFFSL

SEQ ID NO: 121130 - protein, 109 aa, Glycine max
  Coding DNA Sequence Number=SeqID_29445
MDNEEGVQEQMKADLSALQDQMASISEVMYSLQAYPYGLPPDFTPRATLEDLSQAPTFEGQLPPYDDYPEQDDEEGDTHLGPLLHLKDPSPHELPQPNIVRHIPASPTP

SEQ ID NO: 121131 - protein, 173 aa, Glycine max
  Coding DNA Sequence Number=SeqID_29446
  Gene Ontology: Mol. function=helicase activity; Biological process =viral genome replication
  Homolog annotation: Hit_ID=A2Q378; Match level="QueryCoverage=91%, HitCoverage=10%, E-value=3e-39, Identity=48%"; Hit description =Putative uncharacterized protein
MTRLKNMWIAATWRIFGFPIHARKPAVERLHFHLPGQHSVLYEDDDDIDDILSKPRISYSKFLAWMNSNKCFSEGRNLTYSQFVSKFVYNQKARSWNLRKKGNTIGRLIWVPPTTSELFYLRMMLTACKGATSFEDIRTVENVLYPTYREACFAMSLLQDDREFVEAIKEAKD

SEQ ID NO: 121132 - protein, 73 aa, Glycine max
  Coding DNA Sequence Number=SeqID_29447
  Subcellular localization annotation: CTP_CleavageSite=53; ConfidenceScore=5.50e-01
MRGSGEFVPFLDTMSRGSKVPQRTFLRRRHGPSVVPSGVANCRNLPFGGRATRDSRDACSTKGIRAESPPTFI

SEQ ID NO: 121133 - protein, 219 aa, Glycine max
  Coding DNA Sequence Number=SeqID_29448
MIMKGQDIYSSQDEATTSPSSSESEKAKGEESSEEIYPQEEGQPLVVKEKCKEVSVSSKSLAKKETHFTIKTNIKETFPLRQPPHFLFCKKALASIATPLGLEFIPQVKKLLDEGLVRKSLNPCALLVPKIGIIRHQVPKIGGMMNVLSGATLFCKITHTPNIFMVCVHRDPLGRNNQYENTEKGVEEKNPEFQEPRDLRSNPFQGGGNDAILPRKGIG

SEQ ID NO: 121134 - protein, 230 aa, Glycine max
  Coding DNA Sequence Number=SeqID_29449
  Homolog annotation: Hit_ID=Q6Z8F0; Match level="QueryCoverage=27%, HitCoverage=58%, E-value=2e-21, Identity=79%"; Hit description =Putative uncharacterized protein P0459B01.18
GSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGSVDFSQRRGQRTAHVAAIRTLHRTIQSVGATGGVYKGQGRSQRELMTRAY

SEQ ID NO: 121135 - protein, 121 aa, Glycine max
  Coding DNA Sequence Number=SeqID_29450
  Pfam annotation: Domain name=G-patch; Domain location=1-42; Score =18.2; E_value=0.0012; Accession=PF01585.14; Description=G-patch domain
MVARVMLRNGFEPGMGLGKDCLRNADVVDIKGNPYKYGLGYEPGMPGRRNVSSRFRADRVWPGRISQCFTSAGMVSEEEVAAIEEEFPQDPPSFVQPCHPDSQVGNWRVISQSEVYTADSM

SEQ ID NO: 121136 - protein, 37 aa, Glycine max
  Coding DNA Sequence Number=SeqID_29451
MAKGSVVVVQLCHFQDTEGVPTEGGAFWWKQPSSPGL

SEQ ID NO: 121137 - protein, 101 aa, Glycine max
  Coding DNA Sequence Number=SeqID_29452
MQSSKHDVYLGAYLNGGHWQMVVIVPKEHLVVWFCSLHNRPDNYLKEIINSALKGLDDAPQPKSKAPARWIVVKMSTIILGTFRNNWEAYLTILDHWSQRD

SEQ ID NO: 121138 - protein, 155 aa, Glycine max
  Coding DNA Sequence Number=SeqID_29453
  Homolog annotation: Hit_ID=UPI00016621D1; Match level="QueryCoverage =94%, HitCoverage=40%, E-value=2e-13, Identity=37%"; Hit description =UPI00016621D1 related cluster
TLTFKGLHVLAFRGLHALTFRGLHVLTFGGLHVLTFRGLHVLTFRGLHALAFRGLRVLAFRGLHVLTLGTRTLTFRGLHVLTIRGLHVLTFRGLHVLTLRGLHALAFRGLHVLPFRGLHVLTFRGLHILTFRGLHVLTFRGLHALAFRGATRPCL

SEQ ID NO: 121139 - protein, 168 aa, Glycine max
  Coding DNA Sequence Number=SeqID_29454
MSSLMHCILCPHFVMGSRKPRGSRFARARAVNGIPRKHLEEKVKALADQGEWTSFIDVLALLVFGVFLFPNVDGLVDLAVINAFLAYHHSKESPILAILADSYDTFDRRYEKSGARIVYCKPTLYVWLVSHIFRHESRPVCPLQGHRMCRERESKLGSAFGWYSRGIR

SEQ ID NO: 121140 - protein, 99 aa, Glycine max
  Coding DNA Sequence Number=SeqID_29455
MVSNRRGQGAGGNRGGQAGRGCHHQCSYCASDHIADNSSLFSSLSPPKISHFITLADGSRVATTGIDHVRGTGRTIGLYYLKPNLSWVCSAATSSKLLH

SEQ ID NO: 121141 - protein, 144 aa, Glycine max
  Coding DNA Sequence Number=SeqID_29456
MSSVKFIILQRCIIHMYSCFFVFPLWLHCSLHYFLEVKIVIIVTKEKDRALWHPYQTRAKARIMSEIEEVQEQMKVDMEAMKEQMTTMMEAMMSMRKMMEDNTATVVVVSTATEMDLIHPVSFNQVNRPVLDVVGQVGKAAKNA

SEQ ID NO: 121142 - protein, 167 aa, Glycine max
  Coding DNA Sequence Number=SeqID_29457
MGDQEETQEQMKANVSALKEQMASMMEAMLGMRQFMEKNMATAAAASSATEADPTLLATAHHPPPNTVAYPYGLPPNYTPPVMQDDAGHVSSLILEGEPPRQPDEVYEDHQEYAQGDVEFYPPIPVEGPTPNTLLSPTSQHNQYSCPQKDHPRRPRKEGNSISSRRD

SEQ ID NO: 121143 - protein, 487 aa, Glycine max
  Coding DNA Sequence Number=SeqID_29458
  Homolog annotation: Hit_ID=Q2HW90; Match level="QueryCoverage=81%, HitCoverage=96%, E-value=2e-29, Identity=24%"; Hit description =Putative uncharacterized protein
PSLKKRFYPVKVKSLGITSLRELGQLMGQLQRQAFRKAYGKIWDLAMIEVSTEAISSLAQYYDQPLRCFTFGDFQLSPMVEEFEEILGCPLGGRKPYLFTGFYPSLARISKIVQISAQELDHRKQVENGVVGIPRKYLEIFGEVLFPNVDGLVDLAAIDAFLAYHNHKESPVVAMLADLYDTFDRRCEKSSTRIVCCTPALYVWLVSHLFRQEVRHACPLEEGRTGVLISCGGFLNVPMMGTRGFNKTNVEMLQKVRKAWGVVQKKDKELRDNGPIGGYHEWLKAHVQDEAPEEDEGVQALRTELKQAQTVKERFNLATLKIRKENAKLRDINIATTKALEQETKRARREEHGRNKFRGALWGSNNDLKLRREERDQSRVDSLILKDELKACLRSKRSLSQRLCETETNMLAIITKYQEEVSLATVHEHRVADKYAQVYAEKEARGRVIDSLHQEATMCVATYPSAGGRPVTRGMRVHERNTRGVAH

SEQ ID NO: 121144 - protein, 94 aa, Glycine max
  Coding DNA Sequence Number=SeqID_29459
  Homolog annotation: Hit_ID=Q51617; Match level="QueryCoverage=43%, HitCoverage=59%, E-value=1e-14, Identity=95%"; Hit description =Putative uncharacterized protein
  Subcellular localization annotation: CTP_CleavageSite=77; ConfidenceScore=5.29e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAASD

SEQ ID NO: 121145 - protein, 178 aa, Glycine max
  Coding DNA Sequence Number=SeqID_29460
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=3e-15, Identity=31%"; Hit description= UPI00006A17C9 related cluster
  Subcellular localization annotation: CTP_CleavageSite=74; ConfidenceScore=5.33e-01
MLVRMIRTCLFAAARVKSCPGMHSSCVIASLSGCARTVGPPPISGGGPGTVRMWSTLKMRTRSPLKVRACNPLKARMYSPLEVRACSPLKVRACSPLLARTCSPLKVKACSPLLARTCSPLKVRACSPTKVRTCSPLMARACSPLKVRTCGPLKVRACSPTKARASSPLKARTCSPLE

SEQ ID NO: 121146 - protein, 98 aa, Glycine max
  Coding DNA Sequence Number=SeqID_29461
MSNETIHGIVRRVKRRSSPFLTETQEPSTSWQARHQVSGLMRITKLTRRSWLLAQQGGALPHRRRTRGSVRGGASGFQCTASKIRTSLPADHCRPILE

SEQ ID NO: 121147 - protein, 133 aa, Glycine max
  Coding DNA Sequence Number=SeqID_29462
  Gene Ontology: Mol. function=protein binding; Cellular component =cytoplasm; Biological process=keratinization
  Homolog annotation: Hit_ID=Q86AI8; Match level="QueryCoverage=95%, HitCoverage=35%, E-value=5e-12, Identity=32%"; Hit description =Similar to Homo sapiens (Human). Mucin 2
MTGPLNESISCFLKRVDPWVLVPSPSEDYTSSPPEDYTPSPSEDYTPSPSEGCTSSPSEDYTSLPSESCTPSPSEDYTSSSSEDYTSSPSEGCTPLPSEGCTPSPSEDYTSSPSEGCTPSPLEDYTSSPSEDY

SEQ ID NO: 121148 - protein, 334 aa, Glycine max
  Coding DNA Sequence Number=SeqID_29463
VSYGPRRLAFVPVMYASTWSTSALSFGMPGKCHAVDLDARAVALAVGLVGRPLDALGGQVADLLGRGRAGRWRVQGDVGGGRTAAAGQGQQDGSQTRGGQKPGRARGRDRPTQTRGASGDDRGPFGRGELFGGLGLGLGQRGRAQLARRQPVQAGEGVHHALDDDLARQPGLGAQRVDPLLGAGGALVRQFLAPDAQDFHHFIGVDVVGHGDVVQHCPCAARLGRAADLADVRGDVVERLEGIAFLEAHAVHQRLRRAEGIGDAVARFDEHGAAAADAAHHLDAVAPGAFGIDFVLERLEAADHDRGRRPFPDAQGGRARAGADLIGDDGVQRH

SEQ ID NO: 121149 - protein, 125 aa, Glycine max
  Coding DNA Sequence Number=SeqID_29464
MLSKRKTLDEGSLLSSKSETQHDHRFTSTPYVPMDPASKSYIQERKGSKRKPKKEEVMILHEIRRHNSLKTVPSGVANCRNLPFDGRATRGSRVRLPRKENTWSRHQRLFEENVGKTRKGVVYEL

SEQ ID NO: 121150 - protein, 120 aa, Glycine max
  Coding DNA Sequence Number=SeqID_29465
MGQDDKGAEDDVSLCLSTGLLAPDCQRVQKTTLVSACYRTLTIVCADNSLGISACHPTSRVRMTQTVCTDNRLGISTCHPTSWVRMTKVLKTIVYTDNALGISACHRDITGQVDEGAEDD

SEQ ID NO: 121151 - protein, 104 aa, Glycine max
  Coding DNA Sequence Number=SeqID_29466
MAPLPSLQNGQVTKSNTTYTLREFPERFTKDRISPHLPNFTTKVVWILSQHALLRASEARLTGALSKGGKMCGVATNEGISTSHVDKSGAFAPTYPPSKRKSDL

SEQ ID NO: 121152 - protein, 35 aa, Glycine max
  Coding DNA Sequence Number=SeqID_29467
AFYEELAKHAYHGKRVHPLRMNTHPLVELLVAKQG

SEQ ID NO: 121153 - protein, 101 aa, Glycine max
  Coding DNA Sequence Number=SeqID_29468
  Subcellular localization annotation: CTP_CleavageSite=16; ConfidenceScore=5.33e-01
GRSLPPSSPRRAQLAQASKFASSRSNSLLEEESGRPNFRRSYRNSRIAQQHLLLVSATLRNFTDRITLLPFDFRRVSRLTYCATKGAKYLETANQRLHVVK

SEQ ID NO: 121154 - protein, 213 aa, Glycine max
  Coding DNA Sequence Number=SeqID_29469
  Homolog annotation: Hit_ID=A1ZC97; Match level="QueryCoverage=67%, HitCoverage=14%, E-value=3e-07, Identity=29%"; Hit description=Tmem2 protein
  Pfam annotation: Domain name=MAM; Domain location=41-191; Score= -40.4; E_value=0.064; Accession=PF00629.14; Description=MAM domain
  Pfam annotation: Domain name=VPEP; Domain location=182-213; Score =30.4; E_value=6.8e-06; Accession=PF07589.2; Description=Protein of unknown function (DUF1555)
  Pfam module annotation: Pfam domain module=MAM::VPEP; Domain location= 41-191::182-213
MAMRKLISVSSFLALAFAAMNAQAAAVSLINDGFEAPWDTTSFVGQDNDFFFNYSPTGSNLGWTFGVNTGVVTTKTSLVPAPEGDHYAFLQFASGLISQTFNVSQSGNADLSFLYGLRPLYESGQALNVYLDGNLVNTFSTQTGWNTGTLSLGFLSAGNHIIGFAGTGNSNAGDTTVFLDKVAINVSSVPEPSSALMLSLGLGGLLLARRRQA

SEQ ID NO: 121155 - protein, 82 aa, Glycine max
  Coding DNA Sequence Number=SeqID_29470
MPQLPAPTAVDANMPRHAVVAYQKIVESLEYMINMRMVTTETDAYTLTKHCLRLATSVTEQGNVYVHSRRRRDTQDKDGGGR

SEQ ID NO: 121156 - protein, 234 aa, Glycine max
  Coding DNA Sequence Number=SeqID_29471
  Homolog annotation: Hit_ID=Q6WAY6; Match level="QueryCoverage=57%, HitCoverage=22%, E-value=8e-12, Identity=32%"; Hit description =Putative uncharacterized protein
MVPTIEEFEEILGCPLRGRKPYLFSGFPPSLSKIAAVVGDSAKELDCTKQTRNGVVGLPRKYLEGKARDMASQEKWGPFADILALLIFGVVLFPNVDGLVDLAAIDAFLAYHHSKESPVVAILADLFDTFDRRYSPQAYPYGLPPDFTPRATLEDLSQAPTFEGQLLPYEDYPGQDDGEGDTHLGPLLHLKDPSPHELPQPNIVRHIPGSPTPVKESVPFVEDKGKIEAPLKRG

SEQ ID NO: 121157 - protein, 258 aa, Glycine max
  Coding DNA Sequence Number=SeqID_29472
  Gene Ontology: Mol. function=oxidoreductase activity
  Homolog annotation: Hit_ID=A6TCK1; Match level="QueryCoverage=94%, HitCoverage=100%, E-value=1e-120, Identity=86%"; Hit description =Putative uncharacterized protein r'rH
  Pfam annotation: Domain name=DUF152; Domain location=44-258; Score =359.2; E_value=6.9e-105; Accession=PF02578.6; Description =Uncharacterised ACR, YfiH family COG1496
MRADFEAHKDDIGLVMTKLIVPQWLMPKGVAACSSTRVVGVSLPPYDSLNLGAHCGDDLLHVEENRRRMFSAGGLPSYPVWLEQVHGTTVLKLDGGPYVSKRADASYCNTPGTVCAVMTADCLPVLFCNRAGTEVAAAHAGWRGLCEGVLEETVACFNDKPENILAWLGPAIGPEAFEVGAEVREAFIAKDAQAQSAFRPAGEKYFANIYQLARQRLANVGVEQIFGGDRCTLSEKDDFFSDRRDKTTGRMASFIWLI

SEQ ID NO: 121158 - protein, 172 aa, Glycine max
  Coding DNA Sequence Number=SeqID_29473
  Gene Ontology: Mol. function=chitin binding; Cellular component =extracellular region; Biological process=chitin metabolic process
  Homolog annotation: Hit_ID=UPI0000DBF0F4; Match level="QueryCoverage =99%, HitCoverage=79%, E-value=6e-16, Identity=44%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
  Subcellular localization annotation: CTP_CleavageSite=37; ConfidenceScore=5.70e-01
MARACSPLKVRTCSPLMARACSPLKVRTCGPLMARVRACSPMKVRARSPLKVRTCSPRKVRACSPTKARARSLLKVRACSPTKARARSPLKVRVCSPTKARARSPLKVRTWRVALKVRACSPTKVRARSPLKMRTCSPRKVRACSPTKARARSLLKVRACSPTKARARSPLK

SEQ ID NO: 121159 - protein, 121 aa, Glycine max
  Coding DNA Sequence Number=SeqID_29474
MQLAVNMSDLPNITRNVIIFTDIHYHKVCQEDKMFCSGGPCGSCPCLKIGLISGPCNCGPELLRGRPRERTGVLALLRWTPGMVSPVEAVAVHLRLAAASPPPVVVPGPPAVLAWAWNISL

SEQ ID NO: 121160 - protein, 142 aa, Glycine max
  Coding DNA Sequence Number=SeqID_29475
MGRGEAILHPNSSPNFQKPKCSWESRIQQPPSPYCAFIPTDKLCVNPCVVCLNWGAVDVEFDGHKFQSEEHQCRFETIKGWSFLKERRVQLRDGDYVEFHEEISKRQWTQLVSPMAKYDSEIVMEFYANAWPIEEGARDKHS

SEQ ID NO: 121161 - protein, 43 aa, Glycine max
  Coding DNA Sequence Number=SeqID_29476
VVVIIKKGENVNHEDFDDVKKIKPWIMSVIIKNGENVDHALFL

SEQ ID NO: 121162 - protein, 255 aa, Glycine max
  Coding DNA Sequence Number=SeqID_29477
MTLLLSNILPSDRIANLPLQKYQLVCVVPTWGSHPQRHPVDPKKSNRALGFPALVTGLYQSYRVPVPPRQGHVIIGMAPTRHPLDPDKSNRALGFPAVITGLCQSFGVPAAPTKVIWPPITRAFIEKYCTQRQAQGDAPQAAGAPPPPHQAGQAGAFDMEQYLRHLVRQQAANHRAHVHTHDCLYQISLSMQSQGFASFSCPTPDQFRAEVAWPGDWPEAQAGEAPPEAPGDGEEAHEDEEMADLLDFLGGSGDT

SEQ ID NO: 121163 - protein, 93 aa, Glycine max
  Coding DNA Sequence Number=SeqID_29478
GSRPARHPCGPWRSPNRVLGLPALITGLCQFYGVPIIPSKVIRPHTNRAFIKKYCAPRQAQGKTPQQAGDGLQRATDAPPPPLEFTSAHPQKG

SEQ ID NO: 121164 - protein, 134 aa, Glycine max
  Coding DNA Sequence Number=SeqID_29479
MEVSFVLFHLDIGKDRAHKTPSGSGGVQQGHGVSSFGYGPLLVLQGARPPQQGHAIGSRLQDTQWTRRSPNRVLGFPALITSLCQFYGVPVIPSGVANCRNLPFSGRATRELRRSDFLFDGGYVGAKAPLLSTS

SEQ ID NO: 121165 - protein, 106 aa, Glycine max
  Coding DNA Sequence Number=SeqID_29480
MILKDELKTCLRSKRSLSQQLSETEANMLAIIGKYKEELDLATAHEHKVADEYAQVYAEKEARGRSRSSPITSKGQGDGRRVLSPRGNPWAPQLLPTYDRLDGPYN

SEQ ID NO: 121166 - protein, 118 aa, Glycine max
  Coding DNA Sequence Number=SeqID_29481
AFVLQIAKKNVYTDNHSGISARQRDSKVSMTDLVSAEDDIAKKNVYTDNHSGISARQRDSNIAKKNVYTDNHSGISARQRDSNGAEDDVSLCVLSGFSSYRSAKKNVYTDNHPGISAR

SEQ ID NO: 121167 - protein, 163 aa, Glycine max
  Coding DNA Sequence Number=SeqID_29482
  Homolog annotation: Hit_ID=A7Q5D6; Match level="QueryCoverage=23%, HitCoverage=24%, E-value=3e-08, Identity=71%"; Hit description =Chromosome undetermined scaffold_53, whole genome shotgun sequence
MALCSVFLNLHLWLFVCLTIEALGVPKPSVASYLSQELLAEQEVDRVHGLLAQPPVKLNNMLVISLSMKLKEEICSIGFSRPPINRNKNPFSYGSMEKQRRHSLVWLLPFLSLWCLTDENLCHSLEGNVGALTNFEVLDFLRAKGASKDPTRVITKVAQSEYK

SEQ ID NO: 121168 - protein, 81 aa, Glycine max
  Coding DNA Sequence Number=SeqID_29483
  Homolog annotation: Hit_ID=Q51617; Match level="QueryCoverage=56%, HitCoverage=66%, E-value=1e-15, Identity=91%"; Hit description =Putative uncharacterized protein
  Subcellular localization annotation: CTP_CleavageSite=65; ConfidenceScore=5.70e-01
MCAKKRLALRSSDRVRSVSRGPFVSRVSVMTVKTSDTCSSRRRSQLVCKRMPGADKPVRARQRVLAGVGAGLTMRHQSRLY

SEQ ID NO: 121169 - protein, 120 aa, Glycine max
  Coding DNA Sequence Number=SeqID_29484
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=65%, E-value=2e-33, Identity=100%"; Hit description=LacZ protein
MARGFKEKLGGGGYGIVFKGKLHSGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 121170 - protein, 45 aa, Glycine max
  Coding DNA Sequence Number=SeqID_29485
MHTHTHAYCCGKAGAGSSRATFWGRNKVKAAKNQSRYLGMDANGG

SEQ ID NO: 121171 - protein, 108 aa, Glycine max
  Coding DNA Sequence Number=SeqID_29486
MPISPCRCISWDRAHKTPSGPEEVQQGPGVSSSGYGPLSVLQGAHPPNEGSHPQRHPVDPEKSNRALGFPALVTGLCRPTGCPFPPARSRHHDIGKDRAYKTPSGLEE

SEQ ID NO: 121172 - protein, 76 aa, Glycine max
  Coding DNA Sequence Number=SeqID_29487
MKSGDMRGYRMVIRTFRQPGANEPIEAQRLTSSFAPFVIQGQRVRWQVEIPYGHPHLSSTEANEFDGIRMMLVVRF

SEQ ID NO: 121173 - protein, 238 aa, Glycine max
  Coding DNA Sequence Number=SeqID_29488
  Homolog annotation: Hit_ID=Q2QWB8; Match level="QueryCoverage=64%, HitCoverage=16%, E-value=1e-09, Identity=27%"; Hit description =Transposon protein, putative, CACTA, En/Spm sub-class
SYEGEDEGYVNSSDEMSEGQQTQDVVTKYGLDPEAWKQFEETRLTPNWEGIRKRAQSIQKHNDCPHVLSRGGYDLLEKKLLDQKRKRIQEEALLSENPASLDEPPSPIKRHVKWKVARTRAVGNMTSDSAQEIADKIDSLEEQVTQGSFVPHGRQDILNTAIGRPDHGGRVRAAGSGVTITQYYGRASRTCSSSSTSISQQQLDEVVARLREDMTGQIREELRTQIKERIEDSVRRGK

SEQ ID NO: 121174 - protein, 42 aa, Glycine max
  Coding DNA Sequence Number=SeqID_29489
MVMEEQEENVGEEGEEAGNFWRKEREEISGRNSKMSHSEIWW

SEQ ID NO: 121175 - protein, 45 aa, Glycine max
  Coding DNA Sequence Number=SeqID_29490
MGVKHFKAVKRRSHADSLYTCSYSHLSLHTRHLLAEIAYQVTQVP

SEQ ID NO: 121176 - protein, 287 aa, Glycine max
  Coding DNA Sequence Number=SeqID_29491
  Gene Ontology: Mol. function=hydrolase activity, acting on glycosyl bonds; Cellular component=intracellular; Biological process =regulation of transcription, DNA-dependent
  Homolog annotation: Hit_ID=Q6MA41; Match level="QueryCoverage=87%, HitCoverage=52%, E-value=3e-69, Identity=52%"; Hit description =Putative DNA-3-methyladenine glycosidase II
  Pfam annotation: Domain name=Ada_Zn_binding; Domain location=34-99; Score=141.5; E_value=2.4e-39; Accession=PF02805.7; Description=Metal binding domain of Ada
  Pfam annotation: Domain name=AlkA_N; Domain location=228-287; Score= -8.8; E_value=0.0011; Accession=PF06029.2; Description=AlkA N -terminal domain
  Pfam annotation: Domain name=HTH_AraC; Domain location=124-163; Score= 27.2; E_value=6.1e-05; Accession=PF00165.14; Description=Bacterial regulatory helix-turn-helix proteins, araC family
  Pfam annotation: Domain name=HTH_AraC; Domain location=169-213; Score= 40.2; E_value=7.3e-09; Accession=PF00165.14; Description=Bacterial regulatory helix-turn-helix proteins, araC family
  Pfam annotation: Domain name=MerR; Domain location=131-168; Score =16.3; E_value=0.092; Accession=PF00376.14; Description=MerR family regulatory protein
  Pfam module annotation: Pfam domain module=Ada_Zn_binding::AlkA _N::HTH_AraC::HTH_AraC::MerR; Domain location=34-99::228-287::124 -163::169-213::131-168
MSINWLAVRKQPVFHLHLRDDGVYLPETMMFDPEIAYQALTARDSRFDGVFFVGVTSTGIYCRPICPVKAPMQKNCLFFTSAEAAEKAHFRPCLRCRPELAPGSAPVDSHHRIADRLIRRIEEGLLEEQETLAEIASEFDLSERQLRRVIQQELGVSPLELRQTRRMLLAKQLLTETALPVTEIAYASGFRSLRRFNDVFQARYRMTPSRLRKQIQTEALNGEQESAELRLSYRPPYDWDAILDFLQQRVMKQVEWVSEGVYHRTVALGQCRGWVRISHLPEKQALK

SEQ ID NO: 121177 - protein, 172 aa, Glycine max
  Coding DNA Sequence Number=SeqID_29492
  Subcellular localization annotation: CTP_CleavageSite=38; ConfidenceScore=5.05e-01
KDLGSTGGPHYAQSQNKHAFPPYGLPPNYTPPNVAYTPSENVNNSTPILIESRQPQTDHAHVSQPMGDTYEMPHHNLADFEPCLGYATEGQAIGGIPLQNPLEGPQYHPQLHLLHSTTSKNPHAMAEMGKLDHLEERLRAIKGCEDYAFANLEELFLVPNIITPPKVQGFGL

SEQ ID NO: 121178 - protein, 185 aa, Glycine max
  Coding DNA Sequence Number=SeqID_29493
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
GAEPMEKRQQRGLFTGPGLLLAFAHMFFLRYPLILWITVLPPLSELIPLAAAERPSAATGTTGFPTGKRAVSATQLIYDHDYEFELGTPSDLPSLDDKGADNDIANETFSQSRPEDTDISGKGADNNTSRPAGMQAWHWPSFYNVVTGKTLALPNLIALQHIPLSPAGVIAKRPAPIALPNSCAA

SEQ ID NO: 121179 - protein, 158 aa, Glycine max
  Coding DNA Sequence Number=SeqID_29494
  Gene Ontology: Mol. function=aspartic-type endopeptidase activity; Cellular component=integral to membrane; Biological process =cytochrome complex assembly
  Homolog annotation: Hit_ID=A0ST23; Match level="QueryCoverage=29%, HitCoverage=93%, E-value=3e-20, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVTTLIPFFGAVSYLTVAVTPFCIVFAVLWGIYRRVSFAWIGQGLTHINCVALTARFPVGKPVVPAALMNRPTRGERRFAYWALFRFLAH

SEQ ID NO: 121180 - protein, 265 aa, Glycine max
  Coding DNA Sequence Number=SeqID_29495
  Homolog annotation: Hit_ID=Q2HW90; Match level="QueryCoverage=82%, HitCoverage=57%, E-value=6e-13, Identity=25%"; Hit description =Putative uncharacterized protein
MVEEFEEILGCPLGGRRPYLFSGFYPSLARISKIVQISAQELDHRKQVKNGVVGIPRKCLEAKARILVGRGEWAPFIDILALLIFGGVLFPNVDGLVDLAAIDAFLAYHDHMENSIVAMLADLYDTFNRRCEKSRFPNVPLMGTRGCISYNPVLAIRQLGYPMRGAPLEEELAPVISRGFNKTNVETLQKVRKAWEVVQKKDKELRGSNNGPIDGYRKWLKAHVQGLDWLLSLRTAEREEVEAPKEDEEVQALRAELEQAQTVKE

SEQ ID NO: 121181 - protein, 101 aa, Glycine max
  Coding DNA Sequence Number=SeqID_29496
  Subcellular localization annotation: CTP_CleavageSite=35; ConfidenceScore=5.07e-01
MCTYAIFDSQSALSMHVCKFSKGNACDVGMAPRKLASKRSRKDKATEGTSSAPEYDSHRFKSAVHQQRFEAIKGWSFLRERRVQLRDDQYTDFQEEIRAPT

SEQ ID NO: 121182 - protein, 66 aa, Glycine max
  Coding DNA Sequence Number=SeqID_29497
MLQCTPTNVNPLELFVSSLPVAVVLPELLAALHHAPQVLLNAPTGAAAQAGRTQRGAAPGVPSSNS

SEQ ID NO: 121183 - protein, 103 aa, Glycine max
  Coding DNA Sequence Number=SeqID_29498
MGAKYLKVVKRGSHPNNGWSPDEIRTQNDHNLSLRFVGNDRAWAARYRMTIICLCMPPDTIASGWRKGRRLVSARLSPNMQNLNDKGRKICLFAFITRLAASE

SEQ ID NO: 121184 - protein, 161 aa, Glycine max
  Coding DNA Sequence Number=SeqID_29499
RGKFDYVSPVGASGRSVGTTGAKKKEGDAHTVTSTPAWPKPPQTPDGTHQYAQHHPSFLARAGGSPDTALAQPRAPTPLEGGAPQAPAPTRPHSTNNAHLGSSSNTARNFLPRQAQIFTLIPMTYGDLLPSLITNQLAMVIPGRVLQPPFPKWYNPSVTCA

SEQ ID NO: 121185 - protein, 100 aa, Glycine max
  Coding DNA Sequence Number=SeqID_29500
  Subcellular localization annotation: CTP_CleavageSite=19; ConfidenceScore=5.27e-01
MATPSASPPPPPAVALASPCTLKWTRKATWLRSLATRPPGAERPVVHVDLVTDKVDGPHKKKLGTYLGIVAHDKVEFDIPETSDCRTKKKVLQTVGKQLR

SEQ ID NO: 121186 - protein, 64 aa, Glycine max
  Coding DNA Sequence Number=SeqID_29501
MLLSSNVIYICVRVVMLVRMVRTLLFAAARVKSCPVGPPPISGGGPGTVKRKRTGPLTGSASLG

SEQ ID NO: 121187 - protein, 319 aa, Glycine max
  Coding DNA Sequence Number=SeqID_29502
  Homolog annotation: Hit_ID=A5ZQM3; Match level="QueryCoverage=17%, HitCoverage=51%, E-value=4e-20, Identity=82%"; Hit description =Putative uncharacterized protein
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 121188 - protein, 154 aa, Glycine max
  Coding DNA Sequence Number=SeqID_29503
MPISPCKSISWSVCRPDMGIATTETPSGPEEVKQGPGVSSSGYGPLSTLQGARSPQQGLCPQDTYSRECLSPAARSSGPPTNRAFIKKYCAPRQAQGETPQQPGDGRQRATDAPPSPLEFTSAHPQKGLSIAYTTWPTNRRPSPKPKVSKVLGQ

SEQ ID NO: 121189 - protein, 120 aa, Glycine max
  Coding DNA Sequence Number=SeqID_29504
MELQNVAMARQRDDDVNVSIVEFATCTQHYCWGTQQTVKWRNCPSAIILPEEGSSGKVPEIIFPESFWKNLLPEDQFVSSGNTHRQFPEERHPECFRKKLLPEEFRCLPEEASSGRSFFR

SEQ ID NO: 121190 - protein, 496 aa, Glycine max
  Coding DNA Sequence Number=SeqID_29505
  Gene Ontology: Mol. function=protein phosphatase type 2A regulator activity; Cellular component=protein phosphatase type 2A complex; Biological process=signal transduction
  Homolog annotation: Hit_ID=A7P5G8; Match level="QueryCoverage=100%, HitCoverage=98%, E-value=0.0, Identity=71%"; Hit description =Chromosome chr4 scaffold_6, whole genome shotgun sequence
  Pfam annotation: Domain name=B56; Domain location=70-481; Score =1005.4; E_value=2e-299; Accession=PF01603.11; Description=Protein phosphatase 2A regulatory B subunit (B56 family)
  Subcellular localization annotation: CTP_CleavageSite=78; ConfidenceScore=5.20e-01
MLKQFLSKLPRKAPKPDSDESCRADSSRSDDSPRAASRNIRPPGGGGSSAAKKTSSSAVFPASTVSLIEPLVPFKDVPSSEKMNLFVSKLSLCCVTFDFTDPGKNTVEKEVKRRTLVELVDFVSSCGSSRFSEPAILAVCRMCAINLFRVFPPNYRSNRGGENDDDEPAFDPAWPHLQLVYELLLKFITSNCLDAKVAKKYIDHSFILRLLELFDSEDPRERDCLKTILHRVYGKFMVHRPYIRKSINNLFYNFVFETERHNGIAELLEIFGSIISGFALPLKEEHKIFLWRVLIPLHKPKSIGVYFQQLSYCVTQFIEKEPKLASIVIRGMLKYWPITNSQKEVMFLGELEEILETINMVEFQRVMVPLFWRIGCCINSLHFQVAERALFLWNNDHIVNLIAHNRQVILPIIFPALEKNSQGHWSQSVLNLTYNVRKMFVEMDEKLFLASHSQFKEEEVMLNMAAEKRKEAWKQLEHAASLQPAIGNTPVLVSPI

SEQ ID NO: 121191 - protein, 243 aa, Glycine max
  Coding DNA Sequence Number=SeqID_29506
MVRSRLTSSLFHDINGAEGDELLEVVGEGLAAEVDPLDGVVEGEVVEDGGGVGEGEPGVEDEAALGLGEEPVGVVAAGLVEVDEGGGVGHVQGPEVEVLEDELVHRALDGGGSEERLREEERGLGRVYVEDGREEVGPDFALEVGVYEVAAVHGAAHGGGGEVLVAGVEVEPLLRRRGAVEAVRDYGGGVALAADARLDQPAAVVQDYHVRRGRHLAQPIKSVVLLHRSSPKDPSIQLLSMSN

SEQ ID NO: 121192 - protein, 341 aa, Glycine max
  Coding DNA Sequence Number=SeqID_29507
  Gene Ontology: Mol. function=oxidoreductase activity; Cellular component=cytoplasm; Biological process=gibberellic acid mediated signaling
  Homolog annotation: Hit_ID=Q4A3R2; Match level="QueryCoverage=99%, HitCoverage=99%, E-value=1e-129, Identity=65%"; Hit description =Gibberellin 3-oxidase
  Pfam annotation: Domain name=2OG-FeII_Oxy; Domain location=200-300; Score=126.0; E_value=1.1e-34; Accession=PF03171.11; Description=2OG -Fe(II) oxygenase superfamily
MNTLSEAYKAHPLHLSHIIPLDFSSALSLPDSHAWPHCQPNDDASSSSSSSSIPIIDLMDPNAMDLIGHACEKWGAFQLKNHGIPFGVIEDVEEEAKRLFALPTEQKLKALRSPGGATGYGRARISPFFPKFMWHEGFTIIGSPSHDAKKIWPNDYARFCDLMENYEKQMKVLADRLTEMIFNLMDISEEKRKWVGASNISEAVQLNFYPSCPEPNRAMGLAPHTDTSLFTILHQSQITGLQIFKEGKGWVPVHPHPNTLVVHTGDLLHIISNARFRCALHRVTVNRTWERYSVAYFYSPPMDYVVSPLVHSVARFRDVTVKEYIGIKAKNFGEALSFIST

SEQ ID NO: 121193 - protein, 40 aa, Glycine max
  Coding DNA Sequence Number=SeqID_29508
MEEKILIILNDHWGAINLGVVQPNENPNRSFCVSLQMAAG

SEQ ID NO: 121194 - protein, 342 aa, Glycine max
  Coding DNA Sequence Number=SeqID_29509
  Gene Ontology: Mol. function=oxidoreductase activity; Cellular component=microsome; Biological process=electron transport
  Homolog annotation: Hit_ID=A7P5M1; Match level="QueryCoverage=91%, HitCoverage=77%, E-value=1e-131, Identity=71%"; Hit description =Chromosome chr4 scaffold_6, whole genome shotgun sequence
  Pfam annotation: Domain name=FMO-like; Domain location=19-335; Score=- 448.0; E_value=0.001; Accession=PF00743.10; Description=Flavin -binding monooxygenase-like
MESLKGEEVKCVWVQGPIIVGAGPSGLAVAACLSHHGVPYVILERSHCITSLWQHRTYDRLKLHLPKHFCELPLMPFPLHFPKYPSKNQFISYLNSYASRFNIRPRFNQSVQTAEFDPSSQLWLVRTNGFQYISPWLVVATGENAEPVVPSISGMDMFHGPIVHTSVYKSGSDYNNQRVLVIGCGNSGMEVSLDLCRHNANPYMVARNTVHVLPREMFGFSTFGIAMALLKWLPIKVVDKLVLAAARLMLGDTARYGVRRPKTGPIELKLVTGKTPVLDVGQVAQIRSGNIKVMEGVKEITRNGAKFMDGKDRARIRNHGHSCFLCEIVIRSQFHTTYEPEA

SEQ ID NO: 121195 - protein, 150 aa, Glycine max
  Coding DNA Sequence Number=SeqID_29510
  Homolog annotation: Hit_ID=A7P5K8; Match level="QueryCoverage=88%, HitCoverage=86%, E-value=3e-16, Identity=41%"; Hit description =Chromosome chr4 scaffold_6, whole genome shotgun sequence
  Subcellular localization annotation: CTP_CleavageSite=44; ConfidenceScore=5.53e-01
MRTTCLLSLPPLTSNQPSNASFNPAKPPQLSSVKNETCWKRQCVMMGVASIIGLEMCNLVALAHEAIEITTMPIGNQVVSNSNSYGGAKWSQKRTCSPWQGNSLETIMPENLPRPSARRRYEAVRSSTKTVPPPSAPIIVQSNKGSCFSM

SEQ ID NO: 121196 - protein, 673 aa, Glycine max
  Coding DNA Sequence Number=SeqID_29511
  Gene Ontology: Mol. function=1-deoxy-D-xylulose-5-phosphate synthase activity; Cellular component=type II protein secretion system complex; Biological process=terpenoid biosynthetic process
  Homolog annotation: Hit_ID=A7P5N0; Match level="QueryCoverage=91%, HitCoverage=99%, E-value=0.0, Identity=67%"; Hit description =Chromosome chr4 scaffold_6, whole genome shotgun sequence
  Pfam annotation: Domain name=Transket_pyr; Domain location=393-516; Score=16.9; E_value=1.6e-07; Accession=PF02779.15; Description =Transketolase, pyrimidine binding dom
  Pfam annotation: Domain name=Transketolase_C; Domain location=530 -653; Score=151.4; E_value=2.5e-42; Accession=PF02780.11; Description= Transketolase, C-terminal domain
  Pfam module annotation: Pfam domain module=Transket_pyr::Transketolase _C; Domain location=393-516::530-653
  Subcellular localization annotation: CTP_CleavageSite=24; ConfidenceScore=5.32e-01
MAATAPSSAYPFGIPFHSHSRRVDCSTSTSMFPIHADLSTISMCPRSASKGLVDQVYAQLDNDDYYREKVPTPILDMVENPLCLKNLSLQELKQLAVEIRSDLSSIMSGTQISPKASMAVVELTVAIHHVFNAPVDKILWDVGDQTYAHKILTGRRSLMTTMRRKNGLSGVTSRFESEYDAFGAGHGCSSISAGLGMAVARDIKGRRERVIAVISNWTTMAGQAYEAMSNAGYLDSNMVVILNDSRHSLLPKIEEGPKTFVNALSSTLSKLQSSKSFRRFREAAKGVTKRIGRGMHELAAKVDEYARGMMGPLGSTLFEELGLYYIGPVDGHNIEDLICVLQEVASLDSMGPVLVHVITDENQGDENSQKSDISDGQQDEGSVKSDSLDNPVRPQTYGNCFVETLVVEAEKDKDIVVVHAGLTMEPSLELFQEKFPDRFFDVGMAEQHAVTFASGLVGSDGPLQCGAFDINFMSCLPNMIVMAPSDEVELMHMVATATRINSQPICFRYPRGALVGRGYTISDGIPIKIGRGRVLVEGKDVAFLGYGSMVQNCLKAHSLLAKLGIEVTVADARFCKPLDIKLLRQLCKHHSFLVTVEEGSIGGFGSQVAQFIAVNGLLDGRIQWRPIVLPDRYIEHASPNEQLDQAGLSGHHIAATALSLLGRTREALLFMCS

SEQ ID NO: 121197 - protein, 391 aa, Glycine max
  Coding DNA Sequence Number=SeqID_29512
  Gene Ontology: Mol. function=RNA binding
  Homolog annotation: Hit_ID=A7P5N7; Match level="QueryCoverage=100%, HitCoverage=99%, E-value=2e-67, Identity=42%"; Hit description =Chromosome chr4 scaffold_6, whole genome shotgun sequence
  Pfam annotation: Domain name=Agenet; Domain location=3-66; Score =45.4; E_value=2e-10; Accession=PF05641.3; Description=Agenet domain
  Pfam annotation: Domain name=Agenet; Domain location=75-125; Score =1.1; E_value=0.19; Accession=PF05641.3; Description=Agenet domain
  Pfam annotation: Domain name=ENT; Domain location=330-390; Score =25.2; E_value=0.00024; Accession=PF03735.5; Description=ENT domain
  Pfam module annotation: Pfam domain module=Agenet::Agenet::ENT; Domain location=3-66::75-125::330-390
MRLRKGNKVEIRGNADGLTVEWRCARIISGDGHTYSVQYDCSSTTSGASTERVSRKAIRPCPPLIKGIESQAANDHVEVYNAGSWRVATVLKVIGGDFYLVRLWVSCKELKVRKVNMRPRQSWQNGQWVVVPKGSGKSSWCLISNSYKDQPENQCRNIFSPGLDASGLQESRLASSSTLKRMSPYSSVIEAYPRKLRAVENMGECERFKAVTTAPLLQKVDAVAYPQNIMGEKCMHTSFTNGTNQCYETGKVNPCNVSTHFFERIEEPDYSCSDLSSVGSCSVISSNSNKFSSDTLAGPCQEEDTLYSDAESLDVGDVDKGGSTSPKEVVAEIIHRLELHAYHSTLEVLYASGPLSWEHEELLTNLRISLHISNDEHLMEIKNLVSSGQNF

SEQ ID NO: 121198 - protein, 239 aa, Glycine max
  Coding DNA Sequence Number=SeqID_29513
  Gene Ontology: Mol. function=transporter activity; Cellular component= mitochondrial inner membrane; Biological process=transport
  Homolog annotation: Hit_ID=A7P5R3; Match level="QueryCoverage=93%, HitCoverage=70%, E-value=2e-95, Identity=57%"; Hit description =Chromosome chr4 scaffold_6, whole genome shotgun sequence
  Pfam annotation: Domain name=Mito_carr; Domain location=144-236; Score=119.9; E_value=7.7e-33; Accession=PF00153.18; Description =Mitochondrial carrier protein
  Pfam annotation: Domain name=Mito_carr; Domain location=50-138; Score= 119.7; E_value=8.4e-33; Accession=PF00153.18; Description =Mitochondrial carrier protein
  Pfam module annotation: Pfam domain module=Mito_carr::Mito_carr; Domain location=144-236::50-138
MALQNWTSNRGKNCVIMVVLPTPKTEYKLFAFDTVNKNLSPKPGEQSKIPIPASLIAGACAGISSTICTYPLELVKTRLTVQSDIYHGLLHAFVKIIREEGPAQLYRGLAASLIGVVPYAATNYYAYDTLRKAYQKIFKEEKVGNIETLLIGSVAGAFSSSATFPLEVARKQMQLGALSGRQVYKNVFHALACIFEQEGIHGLYRGLAPSCMKLVPAAGISFMCYEALKRILLENDEED

SEQ ID NO: 121199 - protein, 373 aa, Glycine max
  Coding DNA Sequence Number=SeqID_29514
  Gene Ontology: Mol. function=sequence-specific DNA binding; Cellular component=nucleus; Biological process=regulation of transcription, DNA-dependent
  Homolog annotation: Hit_ID=A7P5Q4; Match level="QueryCoverage=46%, HitCoverage=78%, E-value=3e-61, Identity=65%"; Hit description =Chromosome chr4 scaffold_6, whole genome shotgun sequence
  Pfam annotation: Domain name=Homeobox; Domain location=304-362; Score= -2.5; E_value=0.019; Accession=PF00046.20; Description=Homeobox domain
MYGSANYDLEMLKYFILVKSLMVIYMKINIKETSLSGLVTPKSQPEEEKRRMAVVFQCLWCARSDPFLTLPFQRKPLLCSVFLSSRPRNLCSSIVAAASKNKNKQKKSRDHVTKDDEDGVDAFELLFKQLEEDLKRGDLSDDDGEDEISEEDMALLERELENALGDFDGELLNSDVIDIETGGDPENDDDIEDGGDERSLNLRNWQMKKLARALKAGRRKTSIKNLAADLCLDRALVLQLLRDPPPNLLMMSLSIPDEPTTTVVSLETKPSEIVHKETSIDHAEIESEPKAKVPVHTLQRNWHAQKRLKKAHVDTLERVYRRSKRPTNAMISSIVHVTNIPRKKVVKWFEDKRAEEGVPDRRVPYQRSVPETA

SEQ ID NO: 121200 - protein, 424 aa, Glycine max
  Coding DNA Sequence Number=SeqID_29515
  Gene Ontology: Mol. function=phospholipase D activity; Cellular component=membrane; Biological process=phosphatidylcholine metabolic process
  Homolog annotation: Hit_ID=Q2HWT8; Match level="QueryCoverage=92%, HitCoverage=65%, E-value=8e-86, Identity=56%"; Hit description =Phospholipase D alpha 2
  Pfam annotation: Domain name=C2; Domain location=9-98; Score=27.4; E _value=5.1e-05; Accession=PF00168.21; Description=C2 domain
MRHLLHGRLDVIIREIDTLPSLNEWNFNLCCKFVETGLYATVDLDEARVGRTKLLNDQSSNPTWNETFHIYCAHLISYVIFTVKQKDPIDATLIGRAYVPVEQVLRALVDRWFQILDENLRWFCAMDLLVKWKTLDPMKPRTRITLGELPKMKAEEGVKVLMLVWDDRTSVLDFKKNGLMAAHDQETADYFKNKKVNCVLCPRNPDDGKSIVQVAGAATGQQGQKRTILSFVGGIDLCDGRYDIQEHPLFSTLDTVHKDDFHQPNFSGASIKKGSVAWDVLLNFQQRWEKQVGNQLLFSSSKLDEYFVPRSTVATTNENETWNVQLFRSIDGGAASGFPQDPEDAAELGLVSGKDNITDRSIHDAYINAIRRAKNFIYTENHFVRSSHGWQAYEIGIDIRKNPNPTLIKDKIKIEYISERLVSF

SEQ ID NO: 121201 - protein, 620 aa, Glycine max
  Coding DNA Sequence Number=SeqID_29516
  Gene Ontology: Cellular component=mitochondrion
  Homolog annotation: Hit_ID=A7P5U1; Match level="QueryCoverage=43%, HitCoverage=83%, E-value=6e-93, Identity=63%"; Hit description =Chromosome chr4 scaffold_6, whole genome shotgun sequence
MPPMKCWVTRLSGKPNKQQHAVKLTQLKLELGLFGARLGAANDRIAFEITGIATKKETTPLPLVPFSKRRYTHSHTTCSRRFLSSKSPSLAWEARDLCGFHLLLKDHSLDVCDIAFHVLYGEGNAGESKAKMTAVGKAEMSVAVAELVVRKEKKTQFTSHHDFQRRLPIKLKVNGLCIEATLLVSMRLLKLRDSNGDSAGPFGKNWVQSEKKRGIIKEVKYLASLGKKNKGKFDESEQTSPHDSDRSPVFDSDDSYDSTTSSGSSSNSGGIPNARSTLSNGSESFTTSETAKTRLSHLPRNRSLNTQTSYPAPFTKSDKLSPQLLYQKGNSRSWEYKDFSSRDGQTKLKTNVFFASFDQMSERASGESACTVLVALIAHWLHTNHGMPTRAQFERLITQGSSEWRRLCNSDDYSKLFPDKHFDLETVIEANLRPLVVLPQKSYTGFFSPEKFQCLKGAMSFDEIWNEIKSKVGDKESRVYIVSWNDHFFVLKVEADAYYIIDSLGERLYEGCQQAFILKFDDSSVMYGKIDKAKEVPISGASREKICRGKECCKEFIKRFLAAIPLWQLEKEEKEEKKWSVSSPYLHRQLQIDFHYSSSSSSSASADSLWSLLESGSLEA

SEQ ID NO: 121202 - protein, 624 aa, Glycine max
  Coding DNA Sequence Number=SeqID_29517
  Gene Ontology: Mol. function=DNA photolyase activity; Cellular component=mitochondrion; Biological process=protein-chromophore linkage
  Homolog annotation: Hit_ID=A7P504; Match level="QueryCoverage=91%, HitCoverage=93%, E-value=1e-170, Identity=56%"; Hit description =Chromosome chr4 scaffold_6, whole genome shotgun sequence
  Pfam annotation: Domain name=DNA_photolyase; Domain location=115-307; Score=61.2; E_value=3.5e-15; Accession=PF00875.9; Description=DNA photolyase
  Pfam annotation: Domain name=FAD_binding_7; Domain location=348-614; Score=-47.5; E_value=3.2e-08; Accession=PF03441.5; Description=FAD binding domain of DNA photolyase
  Pfam module annotation: Pfam domain module=DNA_photolyase::FAD _binding_7; Domain location=115-307::348-614
  Subcellular localization annotation: CTP_CleavageSite=71; ConfidenceScore=5.43e-01
MGCHVSHFQLLDYSHPQQNPTPTLYMAILHCTSLPFLSLRTTISSSKSTLTSTRIPLFLAMNSFAKSEPVSSSASSSSSTYQQVPEQDANNDLDRVADNTFRRYTSNVTKGSGKGTAIVWFRNDLRVLDNEALYKAWLSSETVLPVYCVDPRLFATTYHFGFPKTGALRAQFLLECLADLRKNLMKRGLNLLVQHGKPEEILPSLAKSFQAHTVYAQKETCSEELNVERLVMRGLKQVVTSPEESSGITVSNNIPKLQLVWGTTMYHLDDLPFDATSLPDVYTQFLLLMLANGIQNLQLVETKCTIRSCIKLPASLGPPPTVQDWGCLPSLEQLGLSSQSVNKGMKFVGGETAALSRVYEYFWKKDLLRVYKETRNGMLGPDYSTKFSPWLASGSLSPRFIYEEVKRYENDRLANSSTYWVLFELIWRDYFRFLSVKYGNSLFHLGGPRKVQRNWSQDKNLFESWRDGCTGLCVHFLFVIWALIGAWEQNGLRHVFWIMIHVLIMETGLMDQELGMIPEKIVISASQNKEILTFTNKCYNCKNSVHWVVLILGGHMAQTYDPEGEYVAYWLPQLRKIPKEKRNFPGNLIYIPQIVPLKFGTTSGHNKDKFFGARRTNDRGSKRR

SEQ ID NO: 121203 - protein, 60 aa, Glycine max
  Coding DNA Sequence Number=SeqID_29518
MKEGFSTPDATNGDKGDDEKTNVVLLVVFGVLENPNNNEKFDPISCTNFAFYGHDATRKS

SEQ ID NO: 121204 - protein, 229 aa, Glycine max
  Coding DNA Sequence Number=SeqID_29519
  Subcellular localization annotation: CTP_CleavageSite=49; ConfidenceScore=5.46e-01
MVQPSPAQPSPGHLPIQYTSCLAYRLAFPDAVLQKTTVSHVAASTLNVRPSTVPTTAQIPPCPIRSAKPLSSARILGCDDDDEEDAETKSSEAQARRDFAAASRHGLEPCASKMGDLNHFHSFLRVLPSSAGIYGGESQKVPHTPALMECGDLYHFCSFLRVLPSPASIYGGECWKGISMVFIVSFVYHLVQQPSMESSVRKSHIAHLNYLDAVYTPFGQFHLMPIGLR

SEQ ID NO: 121205 - protein, 379 aa, Glycine max
  Coding DNA Sequence Number=SeqID_29520
  Gene Ontology: Mol. function=transmembrane transporter activity; Cellular component=membrane; Biological process=transport
  Homolog annotation: Hit_ID=A7P636; Match level="QueryCoverage=91%, HitCoverage=88%, E-value=1e-136, Identity=72%"; Hit description =Chromosome chr4 scaffold_6, whole genome shotgun sequence
DIFTDYKQPFAVTYLGASLMVVYLPIAFIKDWFCNLLKSRSSKSGKNAECVDEFSVRISSPLKSNGVHKNFELELGSVNRKDSDLDLSTLAEVKPLVAKYNDNTVLKVERQLTGKEVAAYGFYIAPIWFITEYLSNAALARTSVASTTVLSSTSGLFTLFIGAFMGQDSLNVAKVVAVLVSMAGVVMTTLGKTWAADESQLSDAGKHSLVGDLFGILSAMSYGLFTVLLKKFSGEEGERVDVQKLFGYIGLFTLVALWWLIWPLMALGIEPKFTIPHSAKVDEVVLANGFIGSVLSDYFWALCVVWTTPLVATLGMSLTIPLAMVADMVIHGRHYSAVYILGSVQLMMRHKPRLRTKLGMKMGVSLDFINGAEYIQQLC

SEQ ID NO: 121206 - protein, 1063 aa, Glycine max
  Coding DNA Sequence Number=SeqID_29521
  Gene Ontology: Mol. function=protein binding; Cellular component =membrane; Biological process=primary shoot apical meristem specification
  Homolog annotation: Hit_ID=Q8H6S5; Match level="QueryCoverage=98%, HitCoverage=97%, E-value=0.0, Identity=50%"; Hit description=CTV.2
  Pfam annotation: Domain name=LisH; Domain location=8-34; Score=28.3; E_value=2.9e-05; Accession=PF08513.2; Description=LisH
  Pfam annotation: Domain name=WD40; Domain location=297-335; Score =1.5; E_value=21; Accession=PF00400.23; Description=WD domain, G-beta repeat
  Pfam annotation: Domain name=WD40; Domain location=359-396; Score =0.1; E_value=31; Accession=PF00400.23; Description=WD domain, G-beta repeat
  Pfam annotation: Domain name=WD40; Domain location=404-444; Score =31.5; E_value=3e-06; Accession=PF00400.23; Description=WD domain, G -beta repeat
  Pfam annotation: Domain name=WD40; Domain location=448-488; Score =21.2; E_value=0.004; Accession=PF00400.23; Description=WD domain, G -beta repeat
  Pfam annotation: Domain name=WD40; Domain location=538-577; Score =0.4; E_value=29; Accession=PF00400.23; Description=WD domain, G-beta repeat
  Pfam annotation: Domain name=WD40; Domain location=773-809; Score =5.2; E_value=7.2; Accession=PF00400.23; Description=WD domain, G -beta repeat
  Pfam annotation: Domain name=WD40; Domain location=813-852; Score =4.3; E_value=9.4; Accession=PF00400.23; Description=WD domain, G -beta repeat
  Pfam annotation: Domain name=WD40; Domain location=856-894; Score =26.1; E_value=0.00013; Accession=PF00400.23; Description=WD domain, G-beta repeat
  Pfam annotation: Domain name=WD40; Domain location=948-986; Score =2.3; E_value=16; Accession=PF00400.23; Description=WD domain, G-beta repeat
  Pfam annotation: Domain name=WD40; Domain location=999-1038; Score =2.1; E_value=17; Accession=PF00400.23; Description=WD domain, G-beta repeat
  Pfam module annotation: Pfam domain module=LisH::WD40::WD40::WD40::WD4 0::WD40::WD40::WD40::WD40::WD40::WD40; Domain location=8-34::297 -335::359-396::404-444::448-488::538-577::773-809::813-852::856 -894::948-986::999-1038
MEKSILNKELVFLILQFLDEEGLKETAHKLERESGIYFDMKYFEDMLLAGKWDDSERYLSGFTRVDDNRHSTKVYFEIRKQKFLEALDMDDRAKALDILIKDLKVFSSGHEELFNEMTQLLIINNIREHASLSTYGDTNSVRKIVADDIKKVIEANPVFHGKLKCPVFKSQSLNWQHLLCKDPLPVPGVKTLLEDHVCKPSLNLSSLQSEESDSIENSDSDQHLSNHNSGPSTITDSVPFPATLTNPVIISILAYDGVVHGLSIETTMEDPSVISLKGRQCQTSNEVTSAIANVLPENVVQMLKEDSLPVTMDFHPIGHTLLLVGTNIGSIGLWDVNSGEKLFSENYRIWGIGASSINFKEAQEKDFRVSVKKIKWSPDGSLFGVAFSKHFVQLYSYHHGNDIISQHLQIDAHDGSVNDLAFSSLNKQLLVITCGDDKKIKVWDAVSGVRCYTFEGHDAPVCSICPHVKQHVDFIFSTSTDGKIKAWLYDSLGARVDFDAPGYGYTTLAYSADDNRLFSCGTGKDGEPYLVEWDESEGYIKRTYKGLKKPCFSAIHFDSTQKGLLAAGDGHKVKFWNMDSVELWTSTDVDAELLENPCIRFNKKGTLLAVAAKGNKIKILAIDDILQKQNETHSIHVPNNQHEALKCTQSPILVDAGAGVAGEGIVMNGYQKGLEDGRYNSIEESHNNSKFWNVSEICEPSQCQFLQLPVHPKINKIVRLTYTNAGNGILALTSNGDHLLWKWPRDNLNLDGKATAQVSPHIWQSRSGLQLMSNKLTSSYSGVPVSCFSLSKNDSYLMSTSGGAISLFNMLTFKTVTTIMTPPPMATCLTFYPRDNNILAVGMDNYSIIIYNVRTNKIISKLEGHSKRVTALAFSSSFDLLVSGDINAQIFVWNTNEWKKQKDGSLQIHGQKVPEVLSDTHIQFHLYQRHFLAVRSNYLAMYEAIELKCCNQWVPEVSMAISQATFSFDGQAVYASFVDGAVAIFDTLKLQMRCRINPSAYLSTTPSSSIYPLAIAAHPQKPSQFAVGLTDGRVIVFEPQKTGEDWSKFSLDDEAIKQGCGSE

SEQ ID NO: 121207 - protein, 427 aa, Glycine max
  Coding DNA Sequence Number=SeqID_29522
  Homolog annotation: Hit_ID=Q8H0U2; Match level="QueryCoverage=94%, HitCoverage=79%, E-value=1e-125, Identity=52%"; Hit description =Putative uncharacterized protein At2g12400
MQSVAYTAVPLFSIAAVWFSWICITNCTFLCVNRIGCAVLYIGQGSFHHSMTNTLQYVVHQADSTVDKLRNVSDYLAQAKQVGIDRVFLPTNVQTDIDQAETDINNSASILADKTKENSDNIHDLLDSATLALIIIAAVMLVLTFLGFLFSIFGIQLLVYILVIAGWVLVTGTLVLCGLFLVLHNVTADSCVAVNEWIQYPTAHTAMDDILPCVDNATAQETLSRSKEVTSELVNLVNQVITNVSNLNFAPNFTPLYYNQSGPLMPLLCNPFHPDMTDRQCDAGEVTLSNATQVYGNFVCRVSPSEICMTQGRLTPTFYNQISAGINVGNSLYNYAPSLIELQDCTFVRETLSDISKDHCPDLRRHSRWIYIGLVMVSFAVMFSLIFWIVYGRERRHRLHRKESKDLIPAHAPAPGHALALVQIPEG

SEQ ID NO: 121208 - protein, 763 aa, Glycine max
  Coding DNA Sequence Number=SeqID_29523
  Gene Ontology: Mol. function=cysteine-type peptidase activity; Cellular component=cytoplasm; Biological process=ubiquitin-dependent protein catabolic process
  Homolog annotation: Hit_ID=A7P551; Match level="QueryCoverage=100%, HitCoverage=69%, E-value=0.0, Identity=59%"; Hit description =Ubiquitin carboxyl-terminal hydrolase
  Pfam annotation: Domain name=ubiquitin; Domain location=651-725; Score=10.6; E_value=0.023; Accession=PF00240.14; Description =Ubiquitin family
MRHRMSELSQFNLVYDLSAVLIHKGTGANSGHYIAHIKDVNTGQWWEFDDEHVTNLGFHPFGEESSSSTTKSIKTDAIHSDNSEAMVADSNGNGLNATHSLSSQVETFLSSDAYMLMYHLKQTKNVGESGGVICGANHKESEGVVVAVQNGVPLPSHIYDEIQSFNASYDDACRRYNNRKELELSLISERRQEVRSVLAEAPVQPLEQPFYWISSEWLRQWADNIIPMVLTLQCICSPLDNTPVQCSHGKVPVSKVTSMKRLSAKAWDTLFSKYGGGPALSHDNHCRDCLIHGAMTVVSADTYRDRRESMKSLARDILDGNCLDGKYYISRPWLQQWWKRKVLDAPSEADAGPTAAISCPHGQLMPEQAPGAKRVLIPEIFWLFLYEDAVSVKPDDPLGGPTFSSDSDECSQCSNELSEVACLEDSLRLVKQKQRQNHEKLFQAKSLQLSLHSKYFLVPLSWISKWRNYISPTLKNSDKPETLDGVIDSLLCEKHSRLIERPPELVFRRGAIIQRESSAGGLTIVSENDWKCFCEEWGGIETKGISATIDHVNDSENVLTGSSEEMQVCKDQLSTADKMNFENGTGQNLIKTCPEVCESCIGERESCELMQKLNYCNEDICVILVRGKEVPRSILEASKGFVETDRRVSKRSRKSKNGNSISLKVSASTSLYQLKMMIWESFGVVKENQILHKGDRIIVGDDECATLADVNIFAGDQIIVRDSEIHENRDIADELCDDKMDLQHTEEGFRGTLLTANVSSQVV

SEQ ID NO: 121209 - protein, 2565 aa, Glycine max
  Coding DNA Sequence Number=SeqID_29524
  Gene Ontology: Mol. function=binding; Cellular component=anchored to membrane; Biological process=carbohydrate metabolic process
  Homolog annotation: Hit_ID=A7P540; Match level="QueryCoverage=69%, HitCoverage=94%, E-value=0.0, Identity=60%"; Hit description =Chromosome chr4 scaffold_6, whole genome shotgun sequence
  Pfam annotation: Domain name=Glyco_hydro_17; Domain location=28-347; Score=304.2; E_value=2.5e-88; Accession=PF00332.9; Description =Glycosyl hydrolases family 17
  Pfam annotation: Domain name=LisH; Domain location=1726-1752; Score =30.6; E_value=5.9e-06; Accession=PF08513.2; Description=LisH
  Pfam annotation: Domain name=Rtt106; Domain location=2305-2413; Score= -18.4; E_value=0.043; Accession=PF08512.3; Description=Histone chaperone Rttp106-like
  Pfam annotation: Domain name=WD40; Domain location=2053-2092; Score =7.8; E_value=3.5; Accession=PF00400.23; Description=WD domain, G -beta repeat
  Pfam annotation: Domain name=WD40; Domain location=2096-2135; Score =16.4; E_value=0.11; Accession=PF00400.23; Description=WD domain, G -beta repeat
  Pfam annotation: Domain name=X8; Domain location=367-451; Score =139.0; E_value=1.4e-38; Accession=PF07983.4; Description=X8 domain
  Pfam module annotation: Pfam domain module=Glyco_hydro_17::LisH::Rtt10 6::WD40::WD40::X8; Domain location=28-347::1726-1752::2305-2413::2053- 2092::2096-2135::367-451
MGGGKFSRCFVVVVVVGVLFLVGSVSGIGVNWGTQSTHPLSPSKVVKMLKDNGIQKVKLFDADAGILDALKKSGIQVMVGIPNDMLYTLANSVEAAEKWVSKNISKHVSSGGVDIRYVAVGNEPFLSTYNGSFEATTLPALQNIQAALTRSGLSNRVKVTVPLNADVYQSSSEKPSDGGFRPDINNVMLQIVKFLNDNGAPFTVNIYPFISLYADPNFPVDYAFFNGYQPTINDNGRAYDNVFDANHDTLVWALQKNGFGNLPIIVGEIGWPTDGDRNANLQYAQRFNQGFMSRYMSGKGTPMRPGPIDAYLFSLIDEDAKSIQPGNFERHWGMFYFDGQPKYQLNLGSARGNGLVGASGVDHLAKKWCVLKPSANLNDDQLAPSVAYACQNADCTSLGYGTSCGNLDVHGNISYAFNSYYQINDQMDSACKFPGLSMITDKDPSVGDCKFRIMIQTDSAEPHGKVGYLTTVNFVATSKCKKENAKKIAENGHFQDRFKEAGRISPEASDPSSVSLMMEDQANQVPPPRDEEEDSQKEEVIAKVNKLMEKITSAPDNPNATVLHALASILEAQESRYMEENGHSSSITARAAHIIGRLGGLIRENDEFFELISSKFLLETRYSTSIQAAAGRLLLVNGQYPHVFEESVMENIKNWVMDDNTGLPAEEQNLKHNPDRRDAASDSEMLKTYSTGLLAVCLVGQGPIVEDVLTSGLSAKLMRYLRISVLRETSGNQKDVTHITESRHASANTSGRGRDDGRGRFRQLLESNHLDDTRMIDERSLDDVTLERGPDRSISGQTCQEGSWIDGEPPDGLGGEGADVHEVDSDGEDRWHCRDIRDGRIKYGEHDDNIRDDSSRRRANRGWGRSRGKGRLSEGVVESDPILSSPGSGSRLGQGRSVRDRSILRNADIRRVTDSKKTLGRTTPSEASASASEREDNDDCFQECRIGSKDITDLVRKAVRAAEAEARSANAPEEAVKAAGDAAADLVKTAASEEYKSTNDEEAAFLAASRAASTVIDAASAVEVSRSSICDSTVTENVSGKEMETNEDVEEYFIPDTQSLAQLREKYCIQCLELLGEYVEVLGPVLHEKGVDVCLALLQQNSKHWEASKVALLLPDIMKLICALAAHRKFAALFVDRGGMQKLLDVPRMPQTFFGLSSCLFTIGSLQGIMERVCALPSKVVERVVELALQLLDCNQDQARKNAALFFAAAFVFRAVLDAFDSLDGLQKLLGLLNDAASVRSGVNSGALSLSNSGSLRNDRSSAEVLTSSEKQIAYHTCVALRQYFRAHLLVLVDSIRPNKSNRSAARNIPSVRAVYKPLDISNEAMDAVFLQLQKDRKLGPAFVRTRWLAVEKFLASNGHITMLELCQAPPVERYLHDLLQYALGVLHIVTLVPSSRKMIVNVTLSNNRVGIAVILDAANIASNHVDPEIIQPALNVLVNLVCPPPSISNKPAMFAQGQQFASSQTSIGPPSEARDRNAERNVSDRAVHSTSQIDPRERSGEPNAVDRGSAAGFSTQPVHSTPQTPVASASSGLVGDRRISLGAGAGCAGLAAQLEQGYRQAREVVRSNNGIKVLLHLLQPRIYSPPAALDCLRALACRVLLGLARDDTIAHILTKLQVGKKLSELIRDSGSLTLGTEQGRWQAELSQAAIELIGDWTSVSGPIAGGMIEQKIARIGSDTILKGFTIVTNSGRASTLAATDAATPTLRRIERAAIAAATPISYHSRELLLLIHEHLQASGLAQTASMLLKEAQLTPLPSLVPPSSLAQQPITQEVSSTQIQWPSGRAPSGFLTYRVMFNAKDEDAGLKSDSVSAKKKSLTFSSSFHSRLQLLDSQSSARKLSNTGKESSETSVVETTYGSSVKHNIDTGSQFKTPITLPAKRKLSDLKDISMFSSSGKRLNIGDQGLRSPICSSAIRKSSLQTDAVGLFTPTCNLKQSRCTIDLVDENQSISNLGQMTPSSQVLNDLQPNNAERVTLDSLVVQYLKHQHRQCPAPITTLPPLSLLHPHVCPEPKRSLDAPSNVTARFGTREFKYMYGGVHGNRRDRQFVYSRFKPWRTCRDDAGALLTCITFVGDSSHIAVGSHNGELKFFDSNNSNVVESYTGHQSPLTHVQSFVSGETQLLLSSSSQDVRLWDATSILGGPSHSFEGCKAARFSNSGNVFAALSSESARREIRLYDIQTCHLESNFSDTFAASTGRGHVYSLIHFNPSDSMLLWNGVLWDRRDSGPVHRFDQFTDYGGGGFHPAGNEVIINSEVWDLRKFRLLRSVPSLDQTSITFNARGDVMYAILRRNLEDVMSAVHTRRVKHPLFAAFRTVDAINYSDIATIPVDRCVLDFAAEPTDSFVGLITMDDQDEMYASARIYEIGRRRPTDDDSDPDDAESEEEDEDDDDDDPDVDPLLSPGLGGDSGSDADDMSNDDDDNFDGGPGILEIVTEGDEEDDDSQLLESLSSSDDEDFVGGVVFAHTNMQVASESGDFMHERHVASAGGRAKLVVQQPRRKAAGLQQKSQMPLAICVGLKSQRPLAICVLLRLKAGSWHSFLAFEFACVNRESEIACVEGELVACY

SEQ ID NO: 121210 - protein, 257 aa, Glycine max
  Coding DNA Sequence Number=SeqID_29525
  Homolog annotation: Hit_ID=A7P5Z7; Match level="QueryCoverage=99%, HitCoverage=99%, E-value=2e-17, Identity=32%"; Hit description =Chromosome chr4 scaffold_6, whole genome shotgun sequence
  Subcellular localization annotation: CTP_CleavageSite=49; ConfidenceScore=5.06e-01
MADDTVVVELLLRLKQGTVSHKSHHQLIPFSWGVKQPRSRSRLSAAVSRCDAAVSTRCSPTTPLSWSAGTDSYEDSSRHHHHHAAISKYEPRATLSSVGELWYFGAVQMAWRASRNILCLPNDTFAELKEEESSLLKESIYLKKEIATVNANFEAQRAKNESLKRMKLDVGLKYHQNNPSSTSVEPQCVLAGQPHQRIVVSSEALIRPIQDDTHSHASESRPNKIESTTGKSFFLIPDLNMMPSEDVSCTDNLCGMS

SEQ ID NO: 121211 - protein, 225 aa, Glycine max
  Coding DNA Sequence Number=SeqID_29526
  Gene Ontology: Mol. function=metal ion binding
  Homolog annotation: Hit_ID=A7QDI0; Match level="QueryCoverage=50%, HitCoverage=53%, E-value=8e-20, Identity=47%"; Hit description =Chromosome chr10 scaffold_81, whole genome shotgun sequence
  Pfam annotation: Domain name=zf-C3HC4; Domain location=161-218; Score= 16.1; E_value=0.0013; Accession=PF00097.16; Description=Zinc finger, C3HC4 type (RING finger)
MDQHRSEVLDPVHDGNLSHSAEGVAIARDNISGEAGTSGEVGEDLGSDKEPKEEVKGQDKRDQENISDNLPGVDQGTSYNSRHLANQEVIETVVVIESVQTEYANEDNRKLEAIVDESGLSLVSMKTPKGVSETDKNSCVIDIKCSSRKEFYESSEGERICRICHLTSGQSLNATTVGTVESATSEDLIQLGCACKDELGIAHGHCAEAWFKLKGNSCLDNMEHL

SEQ ID NO: 121212 - protein, 468 aa, Glycine max
  Coding DNA Sequence Number=SeqID_29527
  Gene Ontology: Mol. function=transporter activity; Cellular component= integral to membrane; Biological process=transport
  Homolog annotation: Hit_ID=A7QDI4; Match level="QueryCoverage=99%, HitCoverage=99%, E-value=0.0, Identity=76%"; Hit description =Chromosome chr10 scaffold_81, whole genome shotgun sequence
  Pfam annotation: Domain name=Xan_ur_permease; Domain location=31-382; Score=105.7; E_value=1.4e-28; Accession=PF00860.11; Description =Permease family
MAAPKPEEISHPPMDQLQGLEYCIDSNPSWVETIVLGFQHYILALGTAVMIPSFLVPLMGGSDDDKVRVVQTLLFVEGINTLLQTLFGTRLPTVIGGSYAFMVPIISIIHDSSLKRIEDPHLRFLNTMRAIQGAMIVASSIQVILGFSQLWGICSRFFSPLGMVPVIALAGFGLFDRGFPVVGHCVEIGIPMLILFVVFSQHLELLPMTLEHVAYRIKIPYPLEWGAPTFDAGHAFGMMAAVLVSLIESTGAYKAASRLASATPPPAHVLSRGIGWQGIGILLNGLFGTLTGLLGSTRVGSRRVIQISAGFMIFFSMLGKFGALFASIPFPIFAAVYCVLFGLVASVGLSFLQFTNMNSMRNLFIVGVALFLGFSVPEYFREYTSKALHGPTHTRAGWFDDFLNTIFFSSPTVALIVAVFLDNTLDYKDSAKDRGMPWWARFRTFNGDSRNEEFYTLPFNLNRFFPPR

SEQ ID NO: 121213 - protein, 306 aa, Glycine max
  Coding DNA Sequence Number=SeqID_29528
  Homolog annotation: Hit_ID=Q9XE43; Match level="QueryCoverage=33%, HitCoverage=12%, E-value=9e-08, Identity=31%"; Hit description =Putative non-LTR retrolelement reverse transcriptase
  Subcellular localization annotation: CTP_CleavageSite=44; ConfidenceScore=5.48e-01
MGKNKGCQSHSAAKQIMVKGTTSGSGKSQTFATSGLACCLDVVQANQNAYTASQDNLVGKVLVKKAGTSSAKTDDVAHQVFDNLLECSAESESSPEVSCTLGNNDSTTDDDSSHSCGSKSSPQLDDNKAPTPWVNLFKDNRNPSKSFGMKFSPPPSDDEAWGHNLIGYVAGRFPGKKVLLDCCQKWGVKFSYSAHESGWLMYKFESEDDLNQVLSVGPYFIFQRPLLLKVMPTFFDFGNEELNKIHVWVKLRNLPLELWNPQALGKILSKIGSPIQFDHLTASKGSISFARTLVEVNASLELTDEV

SEQ ID NO: 121214 - protein, 115 aa, Glycine max
  Coding DNA Sequence Number=SeqID_29529
MECDRGVAVTRKHWIRQRRRSRCPVSDTKTIYTNTGANEIRENEVVVDMNMRDESNGLSGNKPDEDAITPPFPHRAKLRQRQSHDEDKYVTVTEMNLLQHSKLCHSSETLLLKTS

SEQ ID NO: 121215 - protein, 362 aa, Glycine max
  Coding DNA Sequence Number=SeqID_29530
  Gene Ontology: Mol. function=SNAP receptor activity; Cellular component=integral to membrane; Biological process=intracellular protein transport
  Homolog annotation: Hit_ID=A7PEU9; Match level="QueryCoverage=97%, HitCoverage=84%, E-value=2e-54, Identity=60%"; Hit description =Chromosome chr11 scaffold_13, whole genome shotgun sequence
  Pfam annotation: Domain name=SNARE; Domain location=319-360; Score =9.7; E_value=0.035; Accession=PF05739.10; Description=SNARE domain
  Pfam annotation: Domain name=Syntaxin; Domain location=52-158; Score =93.2; E_value=8.3e-25; Accession=PF00804.16; Description=Syntaxin
  Pfam module annotation: Pfam domain module=SNARE::Syntaxin; Domain location=319-360::52-158
  Subcellular localization annotation: CTP_CleavageSite=59; ConfidenceScore=5.37e-01
MHVKSAQSSFRDRTQEFHSITERLKKSGSGPNGPSSSSTSSRSEEQRSAIANQSEFNRRASKIGYGIHQTSQKLAKLAKLAKRTSVFDDPTMEIQELTGVIKQDITALNSAVVDLQLVCSSRNETGNVSADTSSHSSTVVDDLKTRLMSTTKEFKDVLTMRTENMKVHENRRQLFSSSASKDSANPFIRQRPLAARAAASTSSAPALPWANGSPSSSQAFPKILVACVCCFLAICCVMQTLCCWPSLAQRNSRTIETLPGQEYLVGQTGWSKMHVEKQAGPLKTFSFVGKQVDGESQPLLQQQQQQQEVVPLQDSYMQSRAEALQNVESTIHELSNIFNQLATLVSQQGEIAIRQYKTFQYI

SEQ ID NO: 121216 - protein, 712 aa, Glycine max
  Coding DNA Sequence Number=SeqID_29531
  Gene Ontology: Mol. function=zinc ion binding; Cellular component =intracellular
  Homolog annotation: Hit_ID=A7P5I4; Match level="QueryCoverage=99%, HitCoverage=99%, E-value=0.0, Identity=72%"; Hit description =Chromosome chr4 scaffold_6, whole genome shotgun sequence
  Pfam annotation: Domain name=SWIM; Domain location=598-632; Score =16.4; E_value=0.0076; Accession=PF04434.8; Description=SWIM zinc finger
MEDILNLPVQDPLYPEFSAAHINWVKLEGGRQGGDDIALIPFARVDDFVKGESSNPECPASFRIESRRKRPVGSIAKPRVDGYLEYTLYWCSYGPEDYRESDSGVGDGTSTKPASGKGSRPGRRHMMRGCLCHFTVKRLYTRPLLALIIYNQRRHVDKSGAPCHGLLDRDAVGTRAMYAPRISDELRQKVMSMLYVGISLDKIIQHHAEGMQKQGGPQNRDDFLTRNDVRNMERTVRNSSHELHENDECSVKIWVQRHQKHVFYFQDNSGSEPFVLGIQTDWQLQQMLRYGNNSFISFHSSFGLKKLKYPICSLLVFNSSQNAIPVAWIITSSSVGKAIHKWIVLLCERLRTKDPRWRPNAILLDDPSLDYSIIREAFQCRILLCAWHVRRTWIKKLLKKCCNIEVQREMFKQLGWILYCTKCGPNAMDAVEELMQIFVDQCAFMDYFKSHWLASIGILQVMIHFVFIEEIPALAVVASHHNMWINAIKSLSVTTPEPHAAIESYHLKLKSMLLKENYANFWPRVDWLIHALTTEFHSLYWLDQYSLETGYFENLRDNSFSSNAWYHALHIPDVDVILDEQNLHLAKVLSQTDRSLVYTVSNPGSEFSLCDCSWSRLGNLCKHVIKVATFCRSRQVARPSLSAQVYKQALLTLLHNPPDDPLVLDHTILHVAHLQQDIKALEDLSNNGLLQPIAPDLSSQMAENPLLFQRIQ

SEQ ID NO: 121217 - protein, 421 aa, Glycine max
  Coding DNA Sequence Number=SeqID_29532
  Gene Ontology: Mol. function=SNAP receptor activity; Cellular component=integral to membrane; Biological process=intracellular protein transport
  Homolog annotation: Hit_ID=A7PEU9; Match level="QueryCoverage=95%, HitCoverage=93%, E-value=4e-59, Identity=66%"; Hit description =Chromosome chr11 scaffold_13, whole genome shotgun sequence
  Pfam annotation: Domain name=SNARE; Domain location=336-398; Score =73.7; E_value=6.2e-19; Accession=PF05739.10; Description=SNARE domain
  Pfam annotation: Domain name=Syntaxin; Domain location=50-156; Score =96.0; E_value=1.2e-25; Accession=PF00804.16; Description=Syntaxin
  Pfam module annotation: Pfam domain module=SNARE::Syntaxin; Domain location=336-398::50-156
  Subcellular localization annotation: CTP_CleavageSite=5; ConfidenceScore=5.15e-01
MYTKSAQSSFRDRTHEFQSIAERLKKTGSAPNGQSSSSSRSEEQRSAIANQSEFNRRASKIGLGIHQTSQKLAKLAKLAKRTSVFDDPTMEIQELTGVIKQDITALNSAVVDLQLLCNSRNESGNASTDTTSHSTTVVDDLKTRLMSTTKEFKDVLTMRTENLKVHENRRQLFSANGSKDSANPFVRQRPLATRSAANTSNAPAPPWATGSSSSQLFPKPYYTATLESHTVQLDPNIPFVALAHTWAGYAVPLWLVFGEHCNAGVAIHTVHLYFVAKRHLEGSKSLRPIDKNVERITPLKQAVVLKQVDGESQPLLQQQQQQQQEVVPLQDSYMQSRAEALQNVESTIHELSNIFNQLATLVSQQGEIAIRIDENMDDTLANVEGAQGALLKYLNSISSNRNENEDTYDALITGDKPFVFH

SEQ ID NO: 121218 - protein, 1382 aa, Glycine max
  Coding DNA Sequence Number=SeqID_29533
  Homolog annotation: Hit_ID=A7P5H4; Match level="QueryCoverage=96%, HitCoverage=61%, E-value=0.0, Identity=54%"; Hit description =Chromosome chr4 scaffold_6, whole genome shotgun sequence
  Subcellular localization annotation: CTP_CleavageSite=33; ConfidenceScore=5.28e-01
MDTLFFGIKLRAPLEVNNTIKRVFPRSKRCNVSAKHVRYPSRHAFRFCSQNVNLLRKPHVSASGSRLKCFKEKEPPFSLSVSYFTSLWKEGVLLMRASVFTVVISGLCLLVWFGRNKAKGFVETNILPSVCSVISEYVQRDVCFGKVVRISPLSVTLESCSFGPGEEEFSCGEAPTAKVRFRPLASLWRGKFVFDAVLSHPCVLVVQKKDYSWLGIPLSQGGIQRRLSTNEGLDHRTKVRRVAREEAAAKHVRDRDDAAREAAEMGYFVSEKNCGPSKGDDNLKEIATHSVGGTNSKGFFCMKKVEQHGHRCVDTGVDYDMKHADLEESFRVKFPEKGLKFWKRVIKGHRKHKFKQKAKRSDISASGIALRKRILERGAFAANAYFHSQSHGMFEHPLSSSGCFHSRDHDRQWVKSDFDKNAVSVASGDDNRNDDNRNGTQFRDLGVWSPSANENINGNSKDLNFFGDLSSQTRESKHENLQSSEDVAEHANANISTEKKEELRLHVAHNPIDVSATRGQRDLVSVKPRSVLATYFQVSFETLIMKFGLTSFFRNIEGLTSFFLAGPIEKLKSEMSLKVEGTVAENVDGVDVLQSEDLTKILPVTLDSVQFRGATVMLLTYGDREVRVMENANGHVKFHNHYYNRINVKLGGNCKTWRSDDICEGDGWLSVIVFVDTVEQKWHANLKIDHFFVPLFERILDIPITWSKGMASGQVHLCMSKGETFPNHHGQLDVTGLNFQILNAPSCFSDISGSLCFRGQSIFLHNACGWFGSIPLEASGDFGIHPEEGEFHLMCQVPSVEVNALMRTFNMRSLLFPLAGSITALFNCQGPLDTPIFVGTGTVSRTFSSLHVDTPTTVASEALAKSKEAGALAAFDRVPFSHVSANFTFNTDSCIADLYGIRASLVDGGEIRGAGTVWICSEAVNDETAIDANFSGSLAFEKIMLRYIPSYHHLVPLKFGVLSENTKLSGSLLRPRFDIKWTAPTAEGPFSDARGDIIISHDFITVNSASAALDLYMKVQTSFSDNFSSKREEFYAPRASLFTVGGVEFDLHMRGFEFFSLVTPYTLDFPRALILKATGRIKFQGKVLRPSTTIIEHNFDKNKQHVQMLEKGSAASLVGEVSISGLKLNQLMLAPQMSGSLSVSPDCIKLNASGRPDESLVMDFVGPLQLSGESGLKSGQLMSISLHKGQLRANVDFQPCHSASLEVWHFPLDELELASLKGTIQRSCLNDDLVKALFNGHAEIQLNLQKRRGHGIISVLQPKFNGVLGEALDVAARWSGDVITIEKTILEQSYSYYEMQGEYVLPGTRDDNPVDIKGDGFLKRFLSGHLGSVISSMGRWRMKLEVPRAEVAEMLPLARLLSRSMDPAVLSRSKVVLCFICH

SEQ ID NO: 121219 - protein, 159 aa, Glycine max
  Coding DNA Sequence Number=SeqID_29534
MSVASSFLSLGGAYLHRIAWLFWYGNGIGLTTKGYRGVWGAASLVKYITKGFPRPSSSADCMHMCYSSPPPHCRLSVVLGLSSVATSLLLLNMLPCYVARQESSSGPPWGITPPFWPGTIRWSGSGFSHGIRKLRQGYTTLGKEVGRSFWEISQPSGWR

SEQ ID NO: 121220 - protein, 28 aa, Glycine max
  Coding DNA Sequence Number=SeqID_29535
MMVARVMLGYGYEPEMGFGMNNDGRTSL

SEQ ID NO: 121221 - protein, 178 aa, Glycine max
  Coding DNA Sequence Number=SeqID_29536
MSASSGRDYFSRTPISQELRANEPVDMQRLTSSAAPFVTQRQQVRWHAEIPKRLSVQTICVNPDSGSQVAGRETNIVFCTFCHLETASPMTCGDTQAVIQTNIVYCTFCQPGANKPVDTQRLTSSSAPFVTQRQWGYLTVLRTFCQPEANEPVDTQRLTSSSAPFVNQWQASPLTRRD

SEQ ID NO: 121222 - protein, 122 aa, Glycine max
  Coding DNA Sequence Number=SeqID_29537
  Homolog annotation: Hit_ID=UPI0000F1FC32; Match level="QueryCoverage =81%, HitCoverage=15%, E-value=2e-08, Identity=46%"; Hit description =PREDICTED: similar to Olf-1/EBF-like-2(OS) transcription factor
MMAHQRACSPLKARVCGPLKARTCSPLKASTCDPLRTCDPLKARMYDPLKARACGPLKARVCSPLKAMTCGPLKARACSPLKAISTSIKGSTLMRKQEIDSLIDPFIPNSKDWTSDAGNLCS

SEQ ID NO: 121223 - protein, 412 aa, Glycine max
  Coding DNA Sequence Number=SeqID_29538
  Gene Ontology: Mol. function=quinolinate synthetase A activity; Cellular component=cytoplasm; Biological process=NAD biosynthetic process
  Homolog annotation: Hit_ID=Q8FQK3; Match level="QueryCoverage=43%, HitCoverage=40%, E-value=3e-61, Identity=67%"; Hit description =Putative quinolinate synthetase
  Pfam annotation: Domain name=NUDIX; Domain location=12-153; Score =56.2; E_value=1.1e-13; Accession=PF00293.19; Description=NUDIX domain
  Pfam annotation: Domain name=NadA; Domain location=308-412; Score= -161.2; E_value=0.00019; Accession=PF02445.7; Description=Quinolinate synthetase A protein
  Pfam module annotation: Pfam domain module=NUDIX::NadA; Domain location=12-153::308-412
EVKVPMTRSADIRVAVSTVILTLRRTDDGRAVLALPLVRRTREPFAQQWALPGGWLTTAESPVDAAARTLAETTGLAPSYLEQLYAFGAVDRSPTRVVSIVYWALLRQDDVTAQIDAHRASGHAPENVQWLDVDQLPQLAFDHAKIVEYALWRLRNKVGYSRVAQGFLPTEFTLAELREAYESILGRSLDPANFRRQVEAAGNLLPTDRFRTGSHRPARLNEHPMSITFVPAPAVPPRDASVDHAIQAIVSGASTDATCTTDLAAGPWEFDARPGYGPGSSMGDVIPTDAPRQGELPLEYREAEEEDLHRRIRAAKATLGDRVVILGHFYQREEVVQHADYVGDSFQLATAAKGRTDAEAIVFCGVHFMAETADLLSRPEQAVILPNLAAGCSMADMADIDQVEECWEPLGE

SEQ ID NO: 121224 - protein, 131 aa, Glycine max
  Coding DNA Sequence Number=SeqID_29539
MGIAPTKTPSGPEEVQQGPGVSSSGYGPLDCARKTPSGPEEGQQCLGVASSKYGSLSVQGSACCPQQGHQAPYQSSFHLEVLRLQAGAGRNTTAAWGWPAAGNRRTAITSRVHLSSSTKRLERCLRPMADQ

SEQ ID NO: 121225 - protein, 58 aa, Glycine max
  Coding DNA Sequence Number=SeqID_29540
MSNRKLSAISYGITFHPDVRFRCPIQAHNISRCSKLNIEAQGIVKQPYLLIRMSDSGQ

SEQ ID NO: 121226 - protein, 54 aa, Glycine max
  Coding DNA Sequence Number=SeqID_29541
RDRGRRHFKEMSLEEAHRHRRPWIRVWRKKEMNERRGREEHEILCSKRVLKFEV

SEQ ID NO: 121227 - protein, 173 aa, Glycine max
  Coding DNA Sequence Number=SeqID_29542
MDIQAKFEIPKASDSRTKKKILQTVDEQWRQFKSDLTRKWALTADKDGVDNTVCEKYGISQEKWAQFCQTRRDPSWEDVWKKAQAIQKQNTAPHVLSRGGYEYLEQKLMAEKTKKRLEEAAQSGSTEGIIDPPSPIRCHVKWKMARTKKTGQMTSEAAMEIAEKIDSLEEQAS

SEQ ID NO: 121228 - protein, 124 aa, Glycine max
  Coding DNA Sequence Number=SeqID_29543
MVGYMPLSFADLVFAGERIEVGLKRGKFDYTTSMNSGDRKPGANGGSKKEGETYVVVVVPTWPNFPLAQQYQYSANISPSHYPPPYKPRTPNHPQRTPPNRPQNPADSYPRPNTTPNTSQNTNQ

SEQ ID NO: 121229 - protein, 237 aa, Glycine max
  Coding DNA Sequence Number=SeqID_29544
  Gene Ontology: Mol. function=DNA-directed DNA polymerase activity; Cellular component=mitochondrion; Biological process=DNA replication
  Homolog annotation: Hit_ID=Q39432; Match level="QueryCoverage=87%, HitCoverage=28%, E-value=1e-30, Identity=37%"; Hit description=DNA polymerase
MVSYLTNPDTDSIVLGNPLPEEDVSSSVLGKFKLEDKILEGFFLAPKCYSYTTEESDGNKKVYKYKGPGRNVITPEWYKEQYADPSRSLIKKVTYQFRPDWKELSVKKKESTTTLRTLSNSKRIPFFNEKGKYVSTDPLDIDDLSSLNYIGTKLLESFKRKTAILEKENSALSQKLQKLEQERGIIAQRRVEEGNNTEDNNTLEQNNPKRAEDTINGDLLDPDTMPRDKSPPDHGCG

SEQ ID NO: 121230 - protein, 153 aa, Glycine max
  Coding DNA Sequence Number=SeqID_29545
ADMEAMKEHMTTMMEEMMSMRKMMEDNTAIVVAASIATKMDPIHPAGFNQVNRPVSDVVGQGGETVKNACGPHHVQVQRKHSFPPYRLPPNYTSPIIVYASGENCGSNAFQDYFDDAKDSSQESRVKKVSRIKESFNQSFKNQRVVQSRFKIH

SEQ ID NO: 121231 - protein, 312 aa, Glycine max
  Coding DNA Sequence Number=SeqID_29546
  Homolog annotation: Hit_ID=Q6WAY6; Match level="QueryCoverage=92%, HitCoverage=51%, E-value=5e-36, Identity=31%"; Hit description =Putative uncharacterized protein
MGTNQTGKRFNQVKVKSLDTTSIKELGRMMEPLQMHAFHKTYGKILELTIAEVSIEAIASLTQYYDQPLRCFTFGDFQLVPTIEEFEEILGCPLGGRKPYLSSGCLPSLSRIATMVKDSARGLDRIKQTRNGIAGLPRRYLEDKARGMANQGDWVPFMDVLALLIFGVVLFPNVDGLVDLAAIDAFLAYHHSKESPVVAVLADLFDTFDRSFALVPARHKASMSAPQPPRSCTEKRRIDWDQLLAGIGGRTINWFPRWKEGKEGVLFSCGGYPNIPLIGTRGCINYNPALAIRQLGYPMRGAPTEESMSPFL

SEQ ID NO: 121232 - protein, 163 aa, Glycine max
  Coding DNA Sequence Number=SeqID_29547
MQSQLQSQMQSQGLALPPEPEVGPSAARVSTKGSCVDPSSTDPKTRDSEKCGLYIKENPSHLVKVGVEEVKDVKALIPVPTNEAAVSPAKPLDKPDPEVDDPLYLMTLTIPQLFLKPLQVMWDSTMFGVFNPDFPLYIKHENLSEIAHGGQCLSISVIQLWIL

SEQ ID NO: 121233 - protein, 142 aa, Glycine max
  Coding DNA Sequence Number=SeqID_29548
MGDFISRLSFPGRRIVFTQKAYAALIGWNICLFAKACVRFSGENTETFSSLTSYPELRRSEFLIGGYVGAKASLLSTTPLSVTMTQELVARGDTLRLSAPCHSVTPSVIDEQRPMWSSAPFPEMSASSGGDFFKFHKLSRTT

SEQ ID NO: 121234 - protein, 228 aa, Glycine max
  Coding DNA Sequence Number=SeqID_29549
  Pfam annotation: Domain name=Transposase_23; Domain location=39-109; Score=-11.2; E_value=0.02; Accession=PF03017.5; Description =TNP1ENSPM transposase
MQSQGVAVPPEPVVGPGPSGPRVSTKGSCVDPSGNDPETGDSDRCGLYIEADPAHLVAIRRVYEGSTVVHNTPLLPGQVKVSMEEVRDADAPILVPTDEVSLVGQALHTFLAWPTHLVAVSPPKPPPKPNPEVDDPLYLMTLTIPELFLRPYQVRWDATVFGVVNPDFPLYIKHEDLSEIAHGGQCLSISVLQLWILHLTETCMRAGNSDIYGFLEPQSIQRSGKMAV

SEQ ID NO: 121235 - protein, 110 aa, Glycine max
  Coding DNA Sequence Number=SeqID_29550
  Homolog annotation: Hit_ID=A6FJQ2; Match level="QueryCoverage=34%, HitCoverage=84%, E-value=3e-11, Identity=92%"; Hit description=50S ribosomal protein L5
MTVVTCDTCSSRRRSQLVCKRMPGADKPVRARQRMRKEKIPHQAPFAIQAAQLLGRAIGAGLFAITPAGERGMCCKAIKLGNARGLEVINPEGGTEDAEEEAKKGRWKQE

SEQ ID NO: 121236 - protein, 23 aa, Glycine max
  Coding DNA Sequence Number=SeqID_29551
NFAKVSTVLRRSSFVLHRSSIFN

SEQ ID NO: 121237 - protein, 165 aa, Glycine max
  Coding DNA Sequence Number=SeqID_29552
MEESMSPFLVRDFGAQNFKAIQRIHKAWETPLRKDQELRGIRNGIIGDWLAKLKVVSEESFEAPEEDEEVQTLKNELGKAKLAKEKFKLAVTHIRKECAGLREENATTARALEQETKRARKEEYGRNKFCGAVWGSNNELKLRREERDQSRAHSTVLKEELVACS

SEQ ID NO: 121238 - protein, 15 aa, Glycine max
  Coding DNA Sequence Number=SeqID_29553
MALERTWMPRVLLEQ

SEQ ID NO: 121239 - protein, 191 aa, Glycine max
  Coding DNA Sequence Number=SeqID_29554
  Gene Ontology: Mol. function=protein serine/threonine kinase activity; Biological process=protein amino acid phosphorylation
  Homolog annotation: Hit_ID=Q2HT01; Match level="QueryCoverage=91%, HitCoverage=31%, E-value=8e-48, Identity=54%"; Hit description =Protein kinase; Calcium-binding EF-hand
MGICHGKPIETQQSQRETNNPSEFPSDHPTPTKPPKASSKFPFYSPSPLPNWFKNSPSSNSNPSSVSSTPLRIFKRPFPPPSPAKHIRALLARRHGSVKPNEAAIPEGSECEVGLDKSFGFAKQFSAHYELSDEVGRGHFGYTCSAKGKKGAFKGVDVAVKVIPKAKVSIIILLIAMIKYVIFGCLKYFEI

SEQ ID NO: 121240 - protein, 79 aa, Glycine max
  Coding DNA Sequence Number=SeqID_29555
  Gene Ontology: Mol. function=nucleic acid binding
  Homolog annotation: Hit_ID=Q1SKZ9; Match level="QueryCoverage=89%, HitCoverage=14%, E-value=1e-17, Identity=56%"; Hit description=Zinc finger, CCHC-type
MVYIEDSVFEGLCKPWQDALVVKLLDKHIGYNIMKDKLSRIWKLKVGFDMIDIGNDFFVVKLNLDEDRKKIIENAFRFS

SEQ ID NO: 121241 - protein, 142 aa, Glycine max
  Coding DNA Sequence Number=SeqID_29556
MDPITILVVQKFIALKGHFSRDCQTHPIPCKETKVVSQPSQAAEVTREATTNTGKTQYSSPLNENPDINSKFQPDVDNDDPTHGEWLVVKRKSRKNGGAQNKKGNAQLEDQSLAKGKEDNIGTKFTWLLLGAPNKIAGAPSN

SEQ ID NO: 121242 - protein, 78 aa, Glycine max
  Coding DNA Sequence Number=SeqID_29557
MAISSFKRRKVELIRRLGRVNHSSRLIFQNAQLNHILDGLRPQSKQLLDALARGKIKMKTPDEAMYLIESMATSDIAF

SEQ ID NO: 121243 - protein, 153 aa, Glycine max
  Coding DNA Sequence Number=SeqID_29558
  Gene Ontology: Cellular component=chloroplast
  Homolog annotation: Hit_ID=Q49KT9; Match level="QueryCoverage=39%, HitCoverage=53%, E-value=5e-14, Identity=70%"; Hit description =Putative uncharacterized protein ORF113
MSPHGGDMDGVEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 121244 - protein, 131 aa, Glycine max
  Coding DNA Sequence Number=SeqID_29559
VTHTQRRCTGDILGIFVRISQVQPNGLINYPNKNEYNASMRGNETHFKTAQLFANRSRQTQAMINSDSQYSEVVFDAKHLPCSHVMAACKSVNEYEGDKWGPDPRRKRTVKGHPVSTRIHTEIDEYENDRT

SEQ ID NO: 121245 - protein, 87 aa, Glycine max
  Coding DNA Sequence Number=SeqID_29560
MPSETLPTEHIMCYMGIYRTGFIIQRTMMADNSELSMGPLGGSPGAAGTSVVVGPGALSAEGNPGYTSTERPYYFDMQMALAWAPPA

SEQ ID NO: 121246 - protein, 52 aa, Glycine max
  Coding DNA Sequence Number=SeqID_29561
MSLPSAVHVSSIIKREASEEKRRSRDESCHHGKAGRTKSVSYLCFPLIFDER

SEQ ID NO: 121247 - protein, 119 aa, Glycine max
  Coding DNA Sequence Number=SeqID_29562
  Subcellular localization annotation: CTP_CleavageSite=48; ConfidenceScore=5.40e-01
MPISPCKSISWSVSSRHGDRTHKTPSGPGKVQQGPGVSSSGYGPLSVLQGARTPRQGHVIIGIAPARHPVDPKNSTEYLSPPARASGPLLIELSSRSTVPPGRRRAKHHSSIGMAGSGQ

SEQ ID NO: 121248 - protein, 84 aa, Glycine max
  Coding DNA Sequence Number=SeqID_29563
MGAAIALHSEPVITSPKDLPGHSMPIGMMVPLTKKPVANLLNVLLSLSEIPGGYSLFSTYYLMLKYHGLPSRSSSIAQQCAGLP

SEQ ID NO: 121249 - protein, 117 aa, Glycine max
  Coding DNA Sequence Number=SeqID_29564
  Subcellular localization annotation: CTP_CleavageSite=64; ConfidenceScore=5.63e-01
MSPLSHASNQLAWFTGSTENSHLLKRSIVRFRRRARKVSFFFRFGAAAFLNEVYPNRISTSQIRLGLSSGAGRRGPGCASDRHIGGGCPGFSAWYPAPRVHDIYIQLCPGDTVEARP

SEQ ID NO: 121250 - protein, 57 aa, Glycine max
  Coding DNA Sequence Number=SeqID_29565
MLVRMVRTLLFAAARMKSCPSMHNSCVIASLSGCARTVGPPPISGGVDVEHTENKDT

SEQ ID NO: 121251 - protein, 85 aa, Glycine max
  Coding DNA Sequence Number=SeqID_29566
  Gene Ontology: Mol. function=hydrolase activity, hydrolyzing O -glycosyl compounds; Biological process=carbohydrate metabolic process
  Homolog annotation: Hit_ID=A7P476; Match level="QueryCoverage=78%, HitCoverage=12%, E-value=4e-19, Identity=67%"; Hit description =Chromosome chr1 scaffold_5, whole genome shotgun sequence
MCKFCRLMGTTIGELLLNRYMVKGAEAVHAANPDVLVILSGLNFDTSLSFIQDRPVSLTFKGKLVFEVNRYGFTDGGAWVDGNLN

SEQ ID NO: 121252 - protein, 68 aa, Glycine max
  Coding DNA Sequence Number=SeqID_29567
MMLDLRQNDGQMENIQLQGRWRTKRARKLRWRRRQREGDETYLGMGAKEKNQRLVTMLECDEDDAQVR

SEQ ID NO: 121253 - protein, 62 aa, Glycine max
  Coding DNA Sequence Number=SeqID_29568
MRKEKIPHQAPFAIQAAQLLGRAIGFSQSRRCKTTASAKLACLQVDSRGSPRHEGHAQCVTI

SEQ ID NO: 121254 - protein, 103 aa, Glycine max
  Coding DNA Sequence Number=SeqID_29569
MPKRRNLMIKEVHEGSFGKHANGHAMGQEDPESNLLLAHHGNVIAAPIRHRGHRTQGFERSSLHSRGNRLFHQMGRSGFLHQCHEECSGQIHKEGADLSVRTP

SEQ ID NO: 121255 - protein, 215 aa, Glycine max
  Coding DNA Sequence Number=SeqID_29570
  Gene Ontology: Mol. function=triose-phosphate isomerase activity; Cellular component=cytoplasm; Biological process=pentose-phosphate shunt
  Homolog annotation: Hit_ID=A7ZUD3; Match level="QueryCoverage=48%, HitCoverage=41%, E-value=1e-49, Identity=95%"; Hit description =Triosephosphate isomerase
  Pfam annotation: Domain name=TIM; Domain location=1-114; Score=26.3; E_value=2.1e-12; Accession=PF00121.9; Description=Triosephosphate isomerase
ENEAGKTEEVCARQIDAVLKTQGAAAFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKAARHSNIPALAGTLPNPIATTIGDACNGKPVASAKLCAKVVYSAGTPLAVIIKFSALVIPVSARKLVNGLSLSSGITCSNALPTAPPIPVWVT

SEQ ID NO: 121256 - protein, 71 aa, Glycine max
  Coding DNA Sequence Number=SeqID_29571
MAKKQSKATLSSWTSFILPYYKKNDLYLRTKTVTINKKICSPPNLSPKNDDLGLIHRWIVVKFEHQVRTQF

SEQ ID NO: 121257 - protein, 149 aa, Glycine max
  Coding DNA Sequence Number=SeqID_29572
  Homolog annotation: Hit_ID=UPI0000ECBAF8; Match level="QueryCoverage =27%, HitCoverage=48%, E-value=1e-16, Identity=100%"; Hit description= UPI0000ECBAF8 related cluster
  Subcellular localization annotation: CTP_CleavageSite=76; ConfidenceScore=5.16e-01
GRSLWKNASNAAFLRFLAFCWPFAHMFFPALSPDSVDNRITAFEKRKSAQYANRLSPRVGRFINAAGTTGFPTGKRAVSATQLIGSTICVSNLSFGGMQAWHWPSFYNVVTGKTLALPNLIALQHIPLSPAGVIAKRPAPIALPNSCAA

SEQ ID NO: 121258 - protein, 85 aa, Glycine max
  Coding DNA Sequence Number=SeqID_29573
MEKSEKKNHSEKKLKKAYITWDENDLESSDDSENEEINLCLMAKSYESDEEKRTWHINLLLQKNYSNIKMIWVPKDPQLYYMQDP

SEQ ID NO: 121259 - protein, 214 aa, Glycine max
  Coding DNA Sequence Number=SeqID_29574
MGSKIYPEVRENPRAFFSNSSPILLESSIQYPSGYIQRAKENQGQETRGPYYFSSTKDSRTFFIHSSSTSQFDSSYSCSISISASSSFIFWTIKVFIYTRDASFYAPELTQGVAWLEALPSPSEGGGASAAQEPEPEEPTAAAEEPVEGEDELTPPEPFYYDTDVHMAQEEETSTDQMPEPPPAPASKDTLPSVLAMEPEQPILQDVPTALVLD

SEQ ID NO: 121260 - protein, 172 aa, Glycine max
  Coding DNA Sequence Number=SeqID_29575
  Homolog annotation: Hit_ID=Q6L477; Match level="QueryCoverage=62%, HitCoverage=17%, E-value=1e-10, Identity=28%"; Hit description =Putative uncharacterized protein OSJNBa0009L15.8
  Subcellular localization annotation: CTP_CleavageSite=21; ConfidenceScore=5.57e-01
HGFSTCLHYSSSSSSFSFAVKRTRKASRLRLLSTRPPGVERPVVHVDPATGKADGPHKKKLRTYLGIVARDKVDITYENWKEVPTAQKDLIWEDIQMEFDIPEASDSRTKRKLLQTVGERWRQFTSDLTRKWALVADQDGVEDTVCDKYSISKEKWAQFCQTRRDPSWEMCA

SEQ ID NO: 121261 - protein, 140 aa, Glycine max
  Coding DNA Sequence Number=SeqID_29576
  Homolog annotation: Hit_ID=A5BSR3; Match level="QueryCoverage=45%, HitCoverage=20%, E-value=4e-08, Identity=46%"; Hit description =Putative uncharacterized protein
MAHTKKTGQMTTEAAKEIAEKIDSFEEQATQGSFVPHGRQDVLAAAIGRPEHPGRVHAAGAGVTIKQYFGSAPRTSRSSSSLPPDELPQLTQQIRDQLEESITEKVTRQVMASFSQLQSQMQSQGLAMPPEPLVGPSGPR

SEQ ID NO: 121262 - protein, 26 aa, Glycine max
  Coding DNA Sequence Number=SeqID_29577
MVNETGIVVLLRPFWVSAGKRKVRCE

SEQ ID NO: 121263 - protein, 96 aa, Glycine max
  Coding DNA Sequence Number=SeqID_29578
MYSTKGNRGRKELVLNDGGVDIEEEELTDLRSNPLQGEEDDAILPRKGPDTRAMSKRLQEDWAKAVEEGPRVPMNLKVDFEPIGQGWVQLSLYILD

SEQ ID NO: 121264 - protein, 118 aa, Glycine max
  Coding DNA Sequence Number=SeqID_29579
MQNSGVTLRAKSQHFASVHDDNTYVPSIPYFGFIDEIWELIYVKFIVFYVQDPSDERWCVVLHGKTIGVNVEDDHSYMDNYVSPLSTQMTPNIIGEKEVDDVHANRNDHDEGELINIV

SEQ ID NO: 121265 - protein, 168 aa, Glycine max
  Coding DNA Sequence Number=SeqID_29580
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=64%, E-value=1e-32, Identity=100%"; Hit description=LacZ protein
MVVWSTGIGARPEVVEFMKQLGQVNRRALVTDEWLRVEGSDNIYALGDCATINQRRVMENSIRLLSASSYHIMDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 121266 - protein, 92 aa, Glycine max
  Coding DNA Sequence Number=SeqID_29581
LQVVPSVVRLMKQANVFPVKNTLKKFTIWEINRDKDILKEDFQASSRVLITNKDSGDHTLAINSTKTKVDLLTGQSNKGQISFKGLLSWRRL

SEQ ID NO: 121267 - protein, 52 aa, Glycine max
  Coding DNA Sequence Number=SeqID_29582
MLQPYGISIGLKEHSNPVTPKAYTPKSPSWPLPPDSDTAHKLYNTHDLTLVF

SEQ ID NO: 121268 - protein, 121 aa, Glycine max
  Coding DNA Sequence Number=SeqID_29583
MARAKKTGQMTSKSAKEIAEKIDSLEEQASQGSFVLHGCQDVLTTAIGRPEHPSCVRAARAGVTINALKGLDDTPQPKSKTGVRWIVVKCNRKKGSTECGYYVMHWMTTIILGTFRNNWET

SEQ ID NO: 121269 - protein, 130 aa, Glycine max
  Coding DNA Sequence Number=SeqID_29584
MLDYAIRAGRPFAKGRCYFYFCVTTDSDDLLHSRYRRLLRLMGRSKGGEAWPERWRSSAPSTTGSRDYLPEESSLTQPNYSSVPSKALSKQLFQYSQCAVHVYQPQKRLPEKGLCSNPGEDLSPSEAVEQ

SEQ ID NO: 121270 - protein, 258 aa, Glycine max
  Coding DNA Sequence Number=SeqID_29585
IAIVKEFYVNLYDPKDKSPKQTPVILAYIKKNGWNLDDPIVTFIGPRKARGKRSEVPTTSVAPETLAPSSSTALVPPIQTPVIPPTSTQIPLPALSYAGPLNFIFTPQMLHSMLQSLHRGQSIIMQSLQGLGLPSIMSMDEFDVQVAWPGAQPSPFGGDGASTAQESIPEEPATVAAEGEDELTPPEPFYFDPGEHMAQEEETSTDQIPEPSSVPIPDDAIPSAQAYELEQPIPQDSPTAQVLDLNEHTKEQPQEQDI

SEQ ID NO: 121271 - protein, 40 aa, Glycine max
  Coding DNA Sequence Number=SeqID_29586
MAFVDNWAVGKEKVPLELPGLSTFGRILLKDSCPLFAHVL

SEQ ID NO: 121272 - protein, 209 aa, Glycine max
  Coding DNA Sequence Number=SeqID_29587
MQLPQEPLNKRPRGLARKSMAVTNFTELCGVATVNSSCEGKRRDQSRAHSMVLKEELVACSRSKRSLSQRLCETETNMLAIIAKYQEELGLATTHEHRIADEYAQVYAEKEARGRVIDSLHQEATMWMDRFALTLNGSQELPRLLAKAKAMADTYSAPEEIHGLLDYWKNTITKRATRHPYRTRSKSRTMGDQEETQEQMKADMSAGIL

SEQ ID NO: 121273 - protein, 15 aa, Glycine max
  Coding DNA Sequence Number=SeqID_29588
GECCEIFPDAQNGLG

SEQ ID NO: 121274 - protein, 86 aa, Glycine max
  Coding DNA Sequence Number=SeqID_29589
  Subcellular localization annotation: CTP_CleavageSite=56; ConfidenceScore=5.05e-01
MSACAIFGTPKCFEYACMKWPRGSLPQRGPGRTRQPKELVPLRSMIVTALGVLYTSSASRPSRDGRFSGSDASSSGTTSILISRRK

SEQ ID NO: 121275 - protein, 142 aa, Glycine max
  Coding DNA Sequence Number=SeqID_29590
MSPFLVRDFGAQNSKSIQRIHKAWETPLRKDQELRGIRNGIIGGYHEWLKVHIRGLDWLPKLKVVSEESFEAPEEDEEVQALKSELGKAKPCQGEVQFGPCTHWLRNRECPGSGKRMISSARALFEQELTNEGCKDQSYGPE

SEQ ID NO: 121276 - protein, 217 aa, Glycine max
  Coding DNA Sequence Number=SeqID_29591
MARGGTGPMGSMRRPSASCYVYRGKILPGLLPGDGNILPTDHNSDLPLPKCQLVYAILTRMSIHVAQLIADAIYIFAGMAPTRHPLDPDKSSRALGFPALITGLCQSFGVPVTPSKVIQPPITRAFIEKYCTQRQVQGDAPQAADEPPPHQAGPAGSFNTEQYLRHLVRQQAANHRAHVQTHDCLYQMSLSLQSQGLLLSHAYSDQFRAESHGLRLA

SEQ ID NO: 121277 - protein, 108 aa, Glycine max
  Coding DNA Sequence Number=SeqID_29592
MVGQGGEALGSMGGPHFVQVQSKHFFPPCGLTPNYTSPNVAHAPDENIDNSAPIPIESQKPQSGHAQVPQPMGETHEVTRDRTLADFKTHLEYATEGQAFCGIPLSNT

SEQ ID NO: 121278 - protein, 475 aa, Glycine max
  Coding DNA Sequence Number=SeqID_29593
  Gene Ontology: Mol. function=transferase activity, transferring nitrogenous groups; Cellular component=cytoplasm; Biological process= biosynthetic process
  Homolog annotation: Hit_ID=Q41688; Match level="QueryCoverage=100%, HitCoverage=100%, E-value=0.0, Identity=89%"; Hit description=1 -aminocyclopropane-1-carboxylic acid synthase
  Pfam annotation: Domain name=Aminotran_1_2; Domain location=40-425; Score=447.7; E_value=1.6e-131; Accession=PF00155.12; Description =Aminotransferase class I and II
MRLLSTKATCNSHGQDSSYFLGWQEYEKNPYDEVHNPKGIIQMGLAENQLSFDLLESWLAKNPDVAGFKRDGKSIFRELALFQDYHGLPSFKKALVDFMAEIRGNKVTFDPNHIVLTAGATSANETLMFCLAEQGEAFLLPTPYYPGFDRDLKWRTGVEIVPIQCNSSNNFQITEAALQQAYEDAMKLNLRVKGVLVTNPSNPLGTTMSRSELNLLVDFIKEKNDIHLISDEIYSGTVFSSPGFVSVIEILKERNDVTDGDWNRVHVVYSLSKDLGLPGFRVGAIYSENDTVVAAATKMSSFGLVSSQTQYLLSAMLGDKKFTRNYIAENKKRLKRQQKMLVSGLLKTGIPCLDSNAGLFCWVDMRQLLYSNTFEAEMELWKKIVYQVGLNISPGSSCHCTEPGWFRVCFANMSEETLALAMKRLKNFVAAESQRNSGSNGGALFNNNGSSKRKSLTKWVFRLSSRDHRREQEER

SEQ ID NO: 121279 - protein, 82 aa, Glycine max
  Coding DNA Sequence Number=SeqID_29594
MEEPLGIPLSIDFQVQAIGQFARATCAPEFGLPRLFNQRLLVLHIGGVAVKQRVKFKTNSKTNKFQKEKKEHLIDCVFKTFM

SEQ ID NO: 121280 - protein, 107 aa, Glycine max
  Coding DNA Sequence Number=SeqID_29595
MHHRPRTRRHLIRLVKPDHLTRSGICGIWFASRRPTTGHIAQGFTSFPCPTPDQFRAEVAWPRDWPKAQAGEAPAGAPVEAPDEADEAREDKEMTDLLGFLGGSGTT

SEQ ID NO: 121281 - protein, 169 aa, Glycine max
  Coding DNA Sequence Number=SeqID_29596
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
VGTGERTRELPGGNAGIFIVLSGFATSDLSVDFCDARQGGGAYGKTPATRPFYADTARRSRTTERSESVSEEAEERPIRKPPLPARNSYDHDYEFELGTRGILGGRGRQMKGYCSHSMQAWHWPSFYNVVTGKTLALPNLIALQHIPLSPAGVIAKRPAPIALPNSCAA

SEQ ID NO: 121282 - protein, 96 aa, Glycine max
  Coding DNA Sequence Number=SeqID_29597
  Subcellular localization annotation: CTP_CleavageSite=35; ConfidenceScore=5.03e-01
MVVSKDFHNLCVLPSPKRVILSILSSFNPLFVKPHAEKKGSSWNKGNQSFNQGEMGPFQVLERINDNAYKVELPGEYNMEIRFVDKSFSEGEMMRT

SEQ ID NO: 121283 - protein, 169 aa, Glycine max
  Coding DNA Sequence Number=SeqID_29598
  Gene Ontology: Mol. function=aspartic-type endopeptidase activity; Cellular component=small subunit processome; Biological process=DNA integration
  Homolog annotation: Hit_ID=A5AX96; Match level="QueryCoverage=94%, HitCoverage=22%, E-value=1e-17, Identity=31%"; Hit description =Putative uncharacterized protein
  Pfam annotation: Domain name=zf-CCHC; Domain location=126-143; Score =12.1; E_value=0.022; Accession=PF00098.14; Description=Zinc knuckle
MKVTTLKQTSHDMIAHVGKARAAVEELRKFLVADSLEEVNRKLDKFYMVLILRSLHSDFDHMRDQVLAGDQVPSMDFLITRFLRVPHVSKDENPAEGVETSAMVASHGREGGRNSRGGRSGRGECLHCTYCKRMGHTQENCYSLHGFPDKVAQVSRSEKAESKFSDEEY

SEQ ID NO: 121284 - protein, 74 aa, Glycine max
  Coding DNA Sequence Number=SeqID_29599
MPHKSIPQTSNTPLIQGRLIWLEAYKKKMPKSSPNMHMKQEVSIRVKPRLLCKQSMWQNTPNKIDDDGSNSHQG

SEQ ID NO: 121285 - protein, 62 aa, Glycine max
  Coding DNA Sequence Number=SeqID_29600
MTKARQKGVREVNEMKIKARKWGRCLPPSSPRRARWLPPEATTIWRIFGGPKWACAICTPFY

SEQ ID NO: 121286 - protein, 169 aa, Glycine max
  Coding DNA Sequence Number=SeqID_29601
  Subcellular localization annotation: CTP_CleavageSite=57; ConfidenceScore=5.21e-01
MVRVTIIGKPGQWRNHPGNQFNRDQGGPSTRPSQQRPSLYDRTTKLEETLAQFMQVSMSNQKSTKSAIKNLEVQVGQLAKQLTDRSSSSFTANTEKNPKEECKVVMTRSRMAIQRDDSEDGKKMEEHKQQLAPKPSLEHVSDFVELKEINEETEDDKEEEAPIKEEEKK

SEQ ID NO: 121287 - protein, 51 aa, Glycine max
  Coding DNA Sequence Number=SeqID_29602
MLTKAPVLALPDFSKTFELECDASGVGVPPGAAASLPNRPAYRTNPQRLRR

SEQ ID NO: 121288 - protein, 77 aa, Glycine max
  Coding DNA Sequence Number=SeqID_29603
  Subcellular localization annotation: CTP_CleavageSite=30; ConfidenceScore=5.59e-01
MAASSSNSSNAAGSITLLQITLKTKHNRVMATRTFTGKIPRMATDMFANLVILGATVLLYPFQPSPDDTSNHPLFFL

SEQ ID NO: 121289 - protein, 166 aa, Glycine max
  Coding DNA Sequence Number=SeqID_29604
  Subcellular localization annotation: CTP_CleavageSite=30; ConfidenceScore=5.19e-01
MASFSQMQSQMQSQGLALPPEPLVGPSGPRVSTKGSCVDPSGNDPETGDSDMCSLYIEVDPARLVALGRVYEGSTVVHHTPLLSGKVKVGVEEVIDADAPVPVLSDEFESESYIKTWMQSSKRDVYLGAYLNGPDNYLKGIINSALKRVDDAPKPKSKAPARWIVV

SEQ ID NO: 121290 - protein, 42 aa, Glycine max
  Coding DNA Sequence Number=SeqID_29605
MVICPEIKPPMFMSILVIKPYTNLALSVFKSEVRQELMKHWA

SEQ ID NO: 121291 - protein, 69 aa, Glycine max
  Coding DNA Sequence Number=SeqID_29606
MGNQQRQGILKEDFQASSRVPIINKDSGDTPWQSVQQRQSGPSNRPIQQGPNIFQRTTKLEETLTQFMQ

SEQ ID NO: 121292 - protein, 136 aa, Glycine max
  Coding DNA Sequence Number=SeqID_29607
MKENNKGWSRPTVATYPSAGGRRETRGMRVPRKEYARSRHQRLFEENVGKTGKDAIYELLSERFGSCIYARGRGDQDRTHVRCICERHNTGMYTVRQYSQTNISKRVHDTYAWQCEKWHVTCLLRAPILGTYKGGS

SEQ ID NO: 121293 - protein, 184 aa, Glycine max
  Coding DNA Sequence Number=SeqID_29608
YIMNSIITVLYFNGRVYEDNDGVIFECSKKAIQIKCGISFNALKKNLEIRFLVSRKYVALQICDDEDVETMIESFQQQQMSVLELYVENDVAGGSMFHSVNSVTSCRHNLSHHESELLRNIRNLHDDEDDDDDYLASNSYVEESLDEDDSVEGISDTDDEVTDIIELVSIVHPTKGVPGIQNPF

SEQ ID NO: 121294 - protein, 125 aa, Glycine max
  Coding DNA Sequence Number=SeqID_29609
GTSFVVQVEGTSTWVVVTENKRGYISCGSVQVEGFYKVEKKSQGPQVAWGLDVGAELKLMVEKTKKKLEEAAQSGSTEGVINPPSPTRRHVKWKMACTKKTRQMTSEAAKDIVEKFDSLEEQASQ

SEQ ID NO: 121295 - protein, 263 aa, Glycine max
  Coding DNA Sequence Number=SeqID_29610
  Homolog annotation: Hit_ID=A5AZ88; Match level="QueryCoverage=44%, HitCoverage=10%, E-value=1e-09, Identity=32%"; Hit description =Putative uncharacterized protein
MAYHASSKANQNSMQNHEIHFGKSYSLEDYQREPELQTYYQKEVERGFNLDNLLMQFKDTIKSIQRAFKSTEIQVSKLVEEVTQAVGRREEEFVEVEAQEESPVNEHDLKEEDEEKVQQREQCSQVHTQQENNLQVKTFPHQLIVKEERHEDHEVLIILGQPCLSTASCVLDMGKGKLELSVEDQKISFNLFEAMKHPDDSEACFEEETLEHEIELTASTMVLQSPLEEEFNNLTKCLVSENEGEELACIEEMDGPEDKSAGH

SEQ ID NO: 121296 - protein, 293 aa, Glycine max
  Coding DNA Sequence Number=SeqID_29611
  Homolog annotation: Hit_ID=Q652R5; Match level="QueryCoverage=30%, HitCoverage=36%, E-value=1e-16, Identity=53%"; Hit description =Putative uncharacterized protein P0603C10.50
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVNSAVGHPVTQLPVHPASPVLLTKNGPLGALDSMARLNRAAAPSYLFKV

SEQ ID NO: 121297 - protein, 85 aa, Glycine max
  Coding DNA Sequence Number=SeqID_29612
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=78%, HitCoverage=15%, E-value=2e-26, Identity=89%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTVYGGQYGSAVVRKSPVCRIMLLSTLLLF

SEQ ID NO: 121298 - protein, 607 aa, Glycine max
  Coding DNA Sequence Number=SeqID_29613
  Gene Ontology: Mol. function=N-acetyltransferase activity; Biological process=metabolic process
  Homolog annotation: Hit_ID=A8GIA4; Match level="QueryCoverage=47%, HitCoverage=32%, E-value=1e-105, Identity=67%"; Hit description=GCN5- related N-acetyltransferase
  Pfam annotation: Domain name=DTW; Domain location=1-137; Score=61.7; E_value=2.5e-15; Accession=PF03942.6; Description=DTW domain
PLAGRAPSPDAALLAAVQTADYQPMVVFPGAYADADRQVLTTPPTGGKPPLFIMLDGTWTEARKMFRKSPWLDSFPVMSLNVATPSRYTLREAHAPVQHCTAEVAAALLEQAGDVPAAQALLQHFERFRQAYLAAGSQPDIDKSATGVKAFTIMPIPRAGANDEPTWTGSAVTTEINCGAGCVGKTGPRWLSDDAQSAGGRLWRSGVAGHAQIQGGQRRAGLAGRGQPAFRPRPGDYMHPRQTQPGTVTAAGRKRLLCQPVADAPAGPQQSGPVSPLAGAECQLLTGTDCERTHRLYFAIGGGDSLDIDVDDLLDFLARDGKTSAILLYLEHLSDARRFVSASRSAARNKPILVIKSGRSHQAQAMIGTASGLDAAWDAAIQRAGLLRVQDTHELFSAVESLSHMRPLRGERLMIISNGAAPAALALDELYARNGKLATLDEPTLQALAALLPEGIGRGNPLDLKDHATPALYVACVTQLLDSHELDALMIIHSPSAVSPASETAAQIIAAVAAHPRGKQVTLLTNWCGEHSSQEARRAFTQAGIPTWRTPEGTVTAFMHQVEYRRNQKQLRETPALPLGLTQNSAEAHQLLQQALDSGITTLDTHE

SEQ ID NO: 121299 - protein, 336 aa, Glycine max
  Coding DNA Sequence Number=SeqID_29614
  Gene Ontology: Mol. function=protein transporter activity; Cellular component=1-2nm peptidoglycan-based cell wall; Biological process =response to antibiotic
  Homolog annotation: Hit_ID=Q57KV8; Match level="QueryCoverage=78%, HitCoverage=69%, E-value=4e-99, Identity=68%"; Hit description =Multidrug resistance secretion protein
  Pfam annotation: Domain name=HlyD; Domain location=67-311; Score =137.7; E_value=3.4e-38; Accession=PF00529.11; Description=HlyD family secretion protein
MANVENDMSATAEAQSPQQPANKKKKRKGALILLAIVFIVIGVGYLAYWYLVLRHFQETDDAYVAGNQVQVMAQVSGSVNKVWFEDTDRVKKGDILVSLDKTDAQQAFEKAQTALATSVRQTHQLMINGKQPNPDLKRREPLGAANLIGREELQHARDAVATAKAQLDVAIQQYNANQAMILNTDLENQPAVKQSAAELRDAWLALQRTDIRSPMDGYVSRRSVQVGSQISTSTPLLAVVPATNLWVDANFKETQLAGVRIGQPATVNSVISTAMMWSITAKWLVWIWAPVALSRCCQRRTPPVTGSKWYSACRCVSNSIRSKWRNIRCVSASPRW

SEQ ID NO: 121300 - protein, 333 aa, Glycine max
  Coding DNA Sequence Number=SeqID_29615
  Gene Ontology: Mol. function=transporter activity; Cellular component= integral to membrane; Biological process=transport
  Homolog annotation: Hit_ID=A6TCU5; Match level="QueryCoverage=92%, HitCoverage=93%, E-value=1e-160, Identity=86%"; Hit description =Glycine/betaine/proline transport protein
  Pfam annotation: Domain name=OpuAC; Domain location=31-316; Score =209.3; E_value=9.1e-60; Accession=PF04069.3; Description=Substrate binding domain of ABC-type glycine betaine transport system
MTMRKTALFAAVLTTVAATHVSAADLPGKGITVKPAQSTISEETFQTLLVSRALEKLGYTVEKPSEVDYNVAYTTIAGGDATFIATNWQPLHDDMYKAAGGDNKFYRQGTYVSGAAQGYLIDKKTADQYHITNIEQLKDPKLAKLFDTNGDGKADLTGCTPGWGCEAVINHQIEAYKLSDTVVHNQGNYSAMIADTITRFKQGKPILYYTWTPYWVSDVLKPGKDVVWLQVPFSSLPGAQSKVDTRLANGANYGFPVNTMHIVANKAWAEKNPAAAKLFAEMKLPIGDINAENAAMHAGHASEADINGHVDGWIKAHQAEFDKWVSDAMAAAK

SEQ ID NO: 121301 - protein, 293 aa, Glycine max
  Coding DNA Sequence Number=SeqID_29616
  Gene Ontology: Mol. function=ribonucleoside-diphosphate reductase activity; Cellular component=cytoplasm; Biological process =deoxyribonucleoside diphosphate metabolic process
  Homolog annotation: Hit_ID=A7MEI0; Match level="QueryCoverage=91%, HitCoverage=84%, E-value=1e-126, Identity=80%"; Hit description =Putative uncharacterized protein
  Pfam annotation: Domain name=Ribonuc_red_sm; Domain location=3-282; Score=317.4; E_value=2.6e-92; Accession=PF00268.12; Description =Ribonucleotide reductase, small chain
MALQGTEIQAINWNRIQDEKDLEVWNRLTSNFWLPEKVPLSNDLPAWQSLDPQQQQLTIRVFTGLTLLDTIQNVIGAPGLMEDALTPHEEAVLSNISFMEAVHARSYSSIFSTLCNTADVDAAYRWSEENAALQNKAKIVLEHYRASDPLKKKISSVFLESFLFYSGFWLPMYWSSRGKLTNTADLIRLIIRDEAVHGYYIGYKYQKALETVDDARRAELQQFAIDLLLALYENEVVYTEALYADVGWAEEVKTFLHYNANKALMNLGYESAVPGGADGGESGDSVGAVAQRR

SEQ ID NO: 121302 - protein, 101 aa, Glycine max
  Coding DNA Sequence Number=SeqID_29617
  Gene Ontology: Mol. function=amino acid transmembrane transporter activity; Cellular component=integral to membrane; Biological process=amino acid transport
  Homolog annotation: Hit_ID=A7MLT5; Match level="QueryCoverage=100%, HitCoverage=21%, E-value=6e-50, Identity=96%"; Hit description =Putative uncharacterized protein
MKVRHLVMLSLGGVIGTGLFFNTGYIISTTGAAGTLLAYLIGALVVWLVMVCLGELAVAMPETGAFHVYAARYLSPATGYTVAWLYWLTWTVALGSSLTAA

SEQ ID NO: 121303 - protein, 310 aa, Glycine max
  Coding DNA Sequence Number=SeqID_29618
  Gene Ontology: Mol. function=homocysteine S-methyltransferase activity; Cellular component=cytoplasm; Biological process =methionine biosynthetic process
  Homolog annotation: Hit_ID=Q6D3E7; Match level="QueryCoverage=99%, HitCoverage=99%, E-value=1e-121, Identity=70%"; Hit description =Homocysteine S-methyltransferase
  Pfam annotation: Domain name=S-methyl_trans; Domain location=15-310; Score=402.5; E_value=6.6e-118; Accession=PF02574.7; Description =Homocysteine S-methyltransferase
MSRNPIAAALTHTDTLILDGALATELEARGCNLADTLWSAKVLMENPELIYQVHYDYFAAGANVAITASYQATPLGFAARGLDSGQASALIRQSVALAQRARDDYRATTGSQAPLLVAGSVGPYGAYLANGAEYRGDYALPAAEMKDFHRPRVAALLEAGVDLLACETLPSFGEIQALISLLAEFPHSSAWFSFTLRDAQHLSDGTPLSKVAEVINAAPQVVAVGLNCVALESVTPALQTLQALTDKPLLVYPNSGEQYDAVSKSWHSAPSGCTLHDKFPEWQQAGARLIGGCCRTTPQDIAAIAACCQP

SEQ ID NO: 121304 - protein, 363 aa, Glycine max
  Coding DNA Sequence Number=SeqID_29619
  Homolog annotation: Hit_ID=B0IFG6; Match level="QueryCoverage=92%, HitCoverage=66%, E-value=2e-21, Identity=27%"; Hit description =Putative uncharacterized protein
MAEARVDAIVDVIASQQLKRFRQRAAQPVARMQRSVGILKHHLHIAPQLAGKGFARLHGGIRQRHLAAPVRVQSGHHPQQRRFTAAGRPHQTETLAGRHLQVHIVHHGAQFITLFVRNAQRAGIRMAGVRQLRRRQGVQQAAFVHHHHPLTVLGDLLQIVTDQQQAHIALLHQATNQRQHLIAHGVIERRGWLIGNQQSGIGNQRDRQHHALAHAAGELMRIALHQLARLGQAHRVQHLAHFLFALGAAQLAVQHQRLFNLPANGARRVERVFRILHDHRHFAAAQADPVALAQVQGVCARHLQPVSLQLQRGRQQAHQRTRGQGFARAGFTDQRHAFAAKGKADVIHQQRVVAANRQPLRIN

SEQ ID NO: 121305 - protein, 834 aa, Glycine max
  Coding DNA Sequence Number=SeqID_29620
  Gene Ontology: Mol. function=hydrolase activity, acting on acid anhydrides, catalyzing transmembrane movement of substances; Cellular component=integral to membrane; Biological process =magnesium ion transport
  Homolog annotation: Hit_ID=P22036; Match level="QueryCoverage=57%, HitCoverage=52%, E-value=0.0, Identity=75%"; Hit description =Magnesium-transporting ATPase, P-type 1 (EC 3.6.3.2) (Mg(2+) transport ATPase, P-type 1)
  Pfam annotation: Domain name=Epimerase; Domain location=616-825; Score=-56.5; E_value=0.0059; Accession=PF01370.12; Description=NAD dependent epimerasedehydratase family
  Pfam annotation: Domain name=Hydrolase; Domain location=36-334; Score= 55.4; E_value=1.9e-13; Accession=PF00702.17; Description=haloacid dehalogenase-like hydrolase
  Pfam annotation: Domain name=adh_short; Domain location=614-775; Score=18.0; E_value=8.1e-07; Accession=PF00106.16; Description=short chain dehydrogenase
  Pfam module annotation: Pfam domain module=Epimerase::Hydrolase::adh _short; Domain location=616-825::36-334::614-775
MLPMIVSSNLAKGAIAMSRRKVIVKRLNAIQNLGAMDILCTDKTGTLTQDNIILEHHLDCAGVENSRVLMLSWLNSHYQSGTPNLMDRAILRYGKGRISADMSDYYSKVDELPFDFVRRRVSVVVRDRRLNQQMLICKGAVEEMLSIASAEREGKLIQPLNETRRAELLALAHQYNQQGFRVLLVASRALAEPGLQQALSVANEQGLTIEGLLTFLDPPKESAAKAITALNENGVTVKVLTGDNPVVTARICQQVGIDCGEILTGEAIAAMSDEQLAQAAARSSVFAKLTPLQKSRILRALQQQGHTVGFLGDGINDAPALRDADVGISVDSAADIAKESSDIILLEKDLMVLEEGVMKGRETFGNIIKYLNMTASSNFGNVFSVLVASAFIPFLPMLAIHLLIQNLMYDLSQLALPWDKMDREFLRKPRKWDARNIKRFMLWIGPTSSIFDITTFALMWYVFAANTPAMQSLFQSGWFVGRAAVADAGGAHAAHAQNSVYPEPRGAAGAADHRLRNDCRHSAAVLAARRDGRPGAAAMELFPVAAGHAARLLPGGAGHENAVHQALWPVVLSAGGAMKQRNLDKTCSGKDNRAGYPALFRGTPTSERQMSQQQRALIIGASKGIGLAVVQQLLQAGWQVTATYRSTAVSFQHPQLQWLALDITDGAQRDALVRQLGDAPFDCILINAGILGPHASQLRDVDDAQLSELFFTNAVAPVRLAESLLPLLRDKQSVLGLTTSRLASLNENRDAAMPFYSASKAALNMLSRALATQMHQQGSTLLSLHPGWVKTDMGGEGADITVAESAQGMVTQLQQFSGRGGHHYVDYRGQLLNW

SEQ ID NO: 121306 - protein, 104 aa, Glycine max
  Coding DNA Sequence Number=SeqID_29621
MGHLSDQGIPTNPKRIKVIPEWPTPPTPLIELVRNHVPSWEDAREMGFQTLPYSNIPNTANIYVFILFRDVEGRSPEFQEPLDLRSNPFQGRGNDAILSPKGIG

SEQ ID NO: 121307 - protein, 127 aa, Glycine max; identical to SEQ ID NO: 97488
  Coding DNA Sequence Number=SeqID_29622

SEQ ID NO: 121308 - protein, 177 aa, Glycine max
  Coding DNA Sequence Number=SeqID_29623
  Homolog annotation: Hit_ID=A5BTM1; Match level="QueryCoverage=64%, HitCoverage=4%, E-value=6e-12, Identity=35%"; Hit description =Putative uncharacterized protein
MTRGNPSDLQPFDPEIDRTFHRLVRHHFIPFDHSEHSITGESVHSVIGDFEHPDLEHYNFEHSDSEHSDFAHSENMTQPPPRERTLREMAAPDFTYESLCIQYPDEDVPYVLKTGLIHLLPKFHGLVGEDPHKHLKEFHIVCSTMKPPDVQEDHIFLKAFPHSLEGVAKDWLYYLAP

SEQ ID NO: 121309 - protein, 129 aa, Glycine max
  Coding DNA Sequence Number=SeqID_29624
  Homolog annotation: Hit_ID=Q6VPE8; Match level="QueryCoverage=50%, HitCoverage=7%, E-value=3e-08, Identity=44%"; Hit description =Putative gag-pol polyprotein
MVVSFFLTHLLLEVASPLSLPSPFHCHSSSKKQRNPLMMKILGLQAPMELTLGRPWKFDRKIICNGLTNEITHTHLGTKFVLHPQTPSQVAKDQLTMKDKRDEEEKLENQKKKKDSKALSSKAKGKEKE

SEQ ID NO: 121310 - protein, 165 aa, Glycine max
  Coding DNA Sequence Number=SeqID_29625
TGSAERRYQILFSSVAVVRPPLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 121311 - protein, 154 aa, Glycine max
  Coding DNA Sequence Number=SeqID_29626
MESSNVKNKSSGKRKMSSEDTRSYFTWNLEMDRVLADRFGVHLMADNVKNRFKLWRTWYGIVSDILSQSGFDWDSTKYMIISHEKAKRFRFKVIPNWDDIVDLCAKDRAIGLGAENALDADDIMSKETNEEETINSVSFDLEGSSSATRKNIRP

SEQ ID NO: 121312 - protein, 157 aa, Glycine max
  Coding DNA Sequence Number=SeqID_29627
MACTKKTGQMMFEVAKEIVEKIASRGSFVAHGRQDVLTAAIRQPEHPGHVRSARASVMIKKYFGPTPRTSHTSSSMAPEDLEQLMQKIRDQLEESITEKMQSQGPSAAHVSTKESYVDPSENNPNTNDSDKCGLYVKENPPCLVRDADAPILVPTEE

SEQ ID NO: 121313 - protein, 59 aa, Glycine max
  Coding DNA Sequence Number=SeqID_29628
MEVCDDIAERLECHLSLGVVTPGSSTHEVIEECLRLARSVTQDHLVYVRSRRRRRTDQA

SEQ ID NO: 121314 - protein, 78 aa, Glycine max
  Coding DNA Sequence Number=SeqID_29629
PLGPSRFFLQKVVASGGSNLARLGELGGKLLPYFAINRGRSEGRRGSAFLALLILSKLLRKMGFREENPSGGASVTFP

SEQ ID NO: 121315 - protein, 92 aa, Glycine max
  Coding DNA Sequence Number=SeqID_29630
MLSGTEASSTLQTSSHRSQRSFIKRLLAHYRHRLKDPNGQIMEKCLVKFNTKFREDPTVNEGWEAFLPRQLHVAFSRSFIKRLPLEASSWLL

SEQ ID NO: 121316 - protein, 241 aa, Glycine max
  Coding DNA Sequence Number=SeqID_29631
GLHVLTFRGLHTLTFRGLHVLAFRGLHVLAFRGLHVLAFRGLHICAFRELKGTIVDDWKFDYSSHDARCMVCNDQADMTGKLLVGSLTFDCCIMHYIIVRILLFRSSNLAQAFEEDLILMWAFLTSRQIDWAHLIRYRMHKALRANAPLPYPHLVTLFLHHFKIPLEDEPFVQVKRSFAIGVGAIILFGYRKDDDGQWVRKQDLPQPIPDERTLSPPPQRVDSSSLLNDVLSELHSLRAFV

SEQ ID NO: 121317 - protein, 29 aa, Glycine max
  Coding DNA Sequence Number=SeqID_29632
MDAMHEEMHMGGTGRTRILPPSVLSEGIN

SEQ ID NO: 121318 - protein, 103 aa, Glycine max
  Coding DNA Sequence Number=SeqID_29633
  Homolog annotation: Hit_ID=Q2HW90; Match level="QueryCoverage=78%, HitCoverage=16%, E-value=5e-10, Identity=38%"; Hit description =Putative uncharacterized protein
MGTNQTGKRFYQVKIKGLDITSIKELGRLMGPLQMQAFRKAYGNILDLTISEISTEAVVSLTQYYDQHLRCFTFGDFQLVPTVEEFEEILGCPLGGRKLYLFS

SEQ ID NO: 121319 - protein, 41 aa, Glycine max
  Coding DNA Sequence Number=SeqID_29634
MNEKEVSKWRKEKTDGKLTIDLESVNLRHEKYAYMRNATYC

SEQ ID NO: 121320 - protein, 68 aa, Glycine max
  Coding DNA Sequence Number=SeqID_29635
MYPYLCHKGCTFQCVKTKNSQAVSPLNLCKGKQKISYVGEGRHKRIQAVSPSILLEKGEERNKKNSSA

SEQ ID NO: 121321 - protein, 74 aa, Glycine max
  Coding DNA Sequence Number=SeqID_29636
MSRFTRNSPQISVSPHQLDLAPYASEPYHAQWNAPGLLRDKHTLRSSHILGEMEVDEPYQVDMGASQHRTLELG

SEQ ID NO: 121322 - protein, 138 aa, Glycine max
  Coding DNA Sequence Number=SeqID_29637
AAASGDKSCLPGWTQDDSYRDKAQRATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 121323 - protein, 185 aa, Glycine max
  Coding DNA Sequence Number=SeqID_29638
  Homolog annotation: Hit_ID=Q9AVH2; Match level="QueryCoverage=22%, HitCoverage=14%, E-value=7e-17, Identity=97%"; Hit description =Putative senescence-associated protein
MTEGCGEGFCLANLPGDAFSLWGNFFEAKKQMMADAKSWQAVGEILPPGQLRGFARCGLLGSAVLGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQ

SEQ ID NO: 121324 - protein, 109 aa, Glycine max
  Coding DNA Sequence Number=SeqID_29639
MHMAQMHFMNMGAQGIVPFLDTTFGQHGARRMHLRSVFALCPYFRDLYGRKLKGLLVIIPKVVISLLMGSRGIIPFEEHIAAVGTTSNNMLSKRKTLDEGSLLSSKSKT

SEQ ID NO: 121325 - protein, 197 aa, Glycine max
  Coding DNA Sequence Number=SeqID_29640
  Gene Ontology: Mol. function=methyltransferase activity; Biological process=methylation
  Homolog annotation: Hit_ID=A6TIS6; Match level="QueryCoverage=68%, HitCoverage=48%, E-value=7e-56, Identity=81%"; Hit description =Putative uncharacterized protein
MVCALEAKFHDFLGAIFMELELGDDRNGQYFTPYHLQSLMAKLLMPDVEQTIRREGFVTVSDPASGAAGMIVAYAENLLEAGYNPSEHMFASCIDIDPIAADMAFIQLSLLGIPAEVVTGNTLTMQLNRVRYTPGHDCREQSQQAVSALRASILTQIQIHACCILKGCAAFTVAVINSRLFNGRNGNSSCDDFPFRD

SEQ ID NO: 121326 - protein, 83 aa, Glycine max
  Coding DNA Sequence Number=SeqID_29641
  Homolog annotation: Hit_ID=UPI000069F178; Match level="QueryCoverage =92%, HitCoverage=23%, E-value=1e-07, Identity=35%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=49; ConfidenceScore=5.13e-01
MARTCSPLKVRTCSPLKVHDPLTARTCSPLKLKVHDPLTARTCSPLKVKARTYSPLEVRACSPLVVRTCSPLKARTCSPLTVR

SEQ ID NO: 121327 - protein, 107 aa, Glycine max
  Coding DNA Sequence Number=SeqID_29642
AVDALDFLEGDEDPLLEVDSPEEVMSTDVPKLRRAPGVNREIKGKQIKQGGLWRLKPPLWTLALESTYGRKLGRPSKVTRGADFGAPFDSRLLLWCIQMNLHGRFSA

SEQ ID NO: 121328 - protein, 55 aa, Glycine max
  Coding DNA Sequence Number=SeqID_29643
GIAQAERHPPISKSVEGAGVQASAVRIRGKGPLCSALISNLLCQTLGARASIGST

SEQ ID NO: 121329 - protein, 140 aa, Glycine max
  Coding DNA Sequence Number=SeqID_29644
  Subcellular localization annotation: CTP_CleavageSite=70; ConfidenceScore=5.03e-01
MIPACKSLVISFFTTSRITGLSLLCGCLTGLAPSSKFIRRIHVDGLIPGMSARVQPIAFLCFLRTDNNFSCSSAREADIITGKLLLSSKLQFWCGRLDSGRRRWFLSLYLIKKVRGKTPPPPDMQSISISNSLSTSNSDI

SEQ ID NO: 121330 - protein, 164 aa, Glycine max
  Coding DNA Sequence Number=SeqID_29645
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
GGGAYGKTPATRPFYGSWPFAGLLLTCSFLRYPLILWITVLPPLSELIPLAAAERPSAARNSYDHDYEFELGTLFAQRLSKLLEVPHISMATLLSQDLNPRSSLYQQSRPAGMQAWHWPSFYNVVTGKTLALPNLIALQHIPLSPAGVIAKRPAPIALPNSCAA

SEQ ID NO: 121331 - protein, 105 aa, Glycine max
  Coding DNA Sequence Number=SeqID_29646
  Homolog annotation: Hit_ID=A6FJQ2; Match level="QueryCoverage=36%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARDPRPDLIETTQVQIGVPSSNS

SEQ ID NO: 121332 - protein, 71 aa, Glycine max
  Coding DNA Sequence Number=SeqID_29647
MHTHTHTYLLSYDRSRIVLGDGQIPSQIQRHRQIEVRGTQGRTRVEARPMIEGSSSHVQLQTSRKRCWEAA

SEQ ID NO: 121333 - protein, 44 aa, Glycine max
  Coding DNA Sequence Number=SeqID_29648
RNSALKGLDDAPQPKSKAPARWIVVKYFNDPRPLEPERLKALRI

SEQ ID NO: 121334 - protein, 121 aa, Glycine max
  Coding DNA Sequence Number=SeqID_29649
MTRGNPSDLQPFDPEIDRTFHRLFRHHFIPFDHSEHSITGESVHSVIGDFEHPDLEHYNFEHSDSEHSDFAHSENMAQPPPRERTLREMAAPDFTYESLCIQYPDEDVPYVLKTGLIHLLP

SEQ ID NO: 121335 - protein, 202 aa, Glycine max
  Coding DNA Sequence Number=SeqID_29650
MYVIVSLGRSLTFTARRKMKNILASSLSYFVQKGKDQFFSVPTTGQSSTTIHNIPLLHDQVKVGVEEIRDANALIPVPTKVVKGVVGPAKPVDRPDDEVDDPLYLMTLTIPQLFLKPLQVMWDATLFGLFYENFPLYIKHEDLSEIAHGGQYLSISVIQLWILHMTETSMRAGNIDVYGFLEPQSIQRSGQSQFESESYIKN

SEQ ID NO: 121336 - protein, 119 aa, Glycine max
  Coding DNA Sequence Number=SeqID_29651
  Subcellular localization annotation: CTP_CleavageSite=38; ConfidenceScore=5.38e-01
MSISPCGSISWSVPSRHRDRAHKTPSGPKKVQQGSEVSSSGYGPLSVLQGARTPPPRQRIAPTKTPSGPGEVQQGPGVSSFGYGPLSVQQGARSPSKGSRPQDTQWTRRSPTGSWGFQL

SEQ ID NO: 121337 - protein, 20 aa, Glycine max
  Coding DNA Sequence Number=SeqID_29652
RKKKERQKSSYTNHGESEDR

SEQ ID NO: 121338 - protein, 77 aa, Glycine max
  Coding DNA Sequence Number=SeqID_29653
MVNSMLSYSGLSEGFWGEAMLTVCYLLNRIPNKRNKRLKHIIESIPKGARKKMTTYISMKFSRFKKLRLGFDMLMIG

SEQ ID NO: 121339 - protein, 75 aa, Glycine max
  Coding DNA Sequence Number=SeqID_29654
  Subcellular localization annotation: CTP_CleavageSite=18; ConfidenceScore=5.06e-01
MMKNDGKPSQNRPRKCLRSVTEAPRLGFSSRKQFFSLILREKREVVAAQLAQAGWVASTRRHRLLLEHPGRSKWT

SEQ ID NO: 121340 - protein, 121 aa, Glycine max
  Coding DNA Sequence Number=SeqID_29655
MDNHLGISAYHLTHGSRSTDVVRPKESQPEEADISGKGTHDQIGLRLSIRLGVSKLRGANNRKASPHATELVATCPFVGVRGEAHGCAFQRRKDARSRHQRRQKRGSCSYVPSIEEEIGPT

SEQ ID NO: 121341 - protein, 147 aa, Glycine max
  Coding DNA Sequence Number=SeqID_29656
MTILVTSVKLLELGGLPRTGCTLSGRDEPVWEPKNIIIQEVRYLKNLAWDELLGILRVHEVDLQNKDHLQKKNFFALKYEETSYRRKEKKSQFKALKVQMNEYDGSIDDEVVLMSKNFKWTMKKERKVSTLLQKKGYTIQKEKQRGE

SEQ ID NO: 121342 - protein, 89 aa, Glycine max
  Coding DNA Sequence Number=SeqID_29657
MVTGLCQSYRVPVPPASSCHHDIGKYTRIAPTRHPVDPKKSNRVLELTSYNYVLQSVVSDRQVIKRPAQDVKEALLGGNLVPFKSVLVI

SEQ ID NO: 121343 - protein, 208 aa, Glycine max
  Coding DNA Sequence Number=SeqID_29658
MARRDKIWSFCTLCHPEAAGPMTCGDKIWSFRTPLPFRHSRVRWRAETKIWSFCTLCHPEAAGPMTCGDKIWSFRAPLPFRHSRVRWHAETKFGHSAPFSSRGGGPDDMRRQNLVIPHPFAIQTQTCPMAQRQNLVILHPLSSRGDGPDDMRRQNLVIPRPFAIQTQSCPMARRDKIWSFCTLRQSWPISPLIRGDLHYLPHSQDLSY

SEQ ID NO: 121344 - protein, 126 aa, Glycine max
  Coding DNA Sequence Number=SeqID_29659
MPLKGKQLVVYPLKTLWRALSFARNYTIAFCGGKSPSCYGRKGKVGSFRGKAQGIEGGCNYRTFAKRGTDLSKNTPKRWRDLAAQVVPPMMERETIIVMVDTLSILYYEKMVGYAPSKLCGFGLRQ

SEQ ID NO: 121345 - protein, 17 aa, Glycine max
  Coding DNA Sequence Number=SeqID_29660
MADTYSAPEEIHGLLKC

SEQ ID NO: 121346 - protein, 111 aa, Glycine max
  Coding DNA Sequence Number=SeqID_29661
  Gene Ontology: Mol. function=transferase activity, transferring phosphorus-containing groups; Cellular component=integral to membrane; Biological process=two-component signal transduction system (phosphorelay)
  Homolog annotation: Hit_ID=A6TGR0; Match level="QueryCoverage=99%, HitCoverage=23%, E-value=1e-44, Identity=82%"; Hit description =Sensor protein
MSWLLTGTVVLLVLLFSAMIVRDYGRETAAARQNIEEKGSVLIRALESGTRVGMGMRMHHAQLQALLEEMAWQPGVLWFAVTDENGKIIAHSDPQQVDTALYSPAQMRELK

SEQ ID NO: 121347 - protein, 32 aa, Glycine max
  Coding DNA Sequence Number=SeqID_29662
MGENFDRPYVHLRLMHGALIAQCKALRREPIG

SEQ ID NO: 121348 - protein, 86 aa, Glycine max
  Coding DNA Sequence Number=SeqID_29663
MTSSSSCLSSIPTRSGPIEGDVLWMQPKHVSKHVWNREPNRKLHIRRAVPTYQGEEQILEEIVPLLWQSEFWIMKMGYLKIPVALI

SEQ ID NO: 121349 - protein, 64 aa, Glycine max
  Coding DNA Sequence Number=SeqID_29664
MSGKPNMNDVAERRNRTLKDIVRSMISHSSLSKSLWGEALRPQFTSLIGYQVKQLTKPLMNFGL

SEQ ID NO: 121350 - protein, 47 aa, Glycine max
  Coding DNA Sequence Number=SeqID_29665
MTKSKGKDPLEGLGGPMTRARARKAKEALQQVLSILFEYKPRLVGHY

SEQ ID NO: 121351 - protein, 203 aa, Glycine max
  Coding DNA Sequence Number=SeqID_29666
  Gene Ontology: Mol. function=helicase activity; Biological process =viral genome replication
  Homolog annotation: Hit_ID=Q2R1R7; Match level="QueryCoverage=98%, HitCoverage=12%, E-value=6e-39, Identity=47%"; Hit description=AT hook motif-containing protein, putative
MMFAFTSTGIKLDKSINETKGPPTIRIQGQPCHRIGSLLPMPGKQPKFAQLYIFDTQNEVENRINTMSQHVAIQPHIVSTLSQMLDDHNVHAKNFRMARDRLTNSQVDNVKLRLIVSREKDGRTYNLPNVSEVAALIVGDFDANSRRDIIVETQNGELQRIHELHSSYLGLQYPLLYPYGEDGYRPDILHRSTFDNKKGREIV

SEQ ID NO: 121352 - protein, 161 aa, Glycine max
  Coding DNA Sequence Number=SeqID_29667
  Gene Ontology: Mol. function=transaldolase activity; Cellular component=cytoplasm; Biological process=carbohydrate metabolic process
  Homolog annotation: Hit_ID=Q3Z606; Match level="QueryCoverage=36%, HitCoverage=18%, E-value=5e-27, Identity=100%"; Hit description =Transaldolase 1
  Pfam annotation: Domain name=Transaldolase; Domain location=1-104; Score=-101.2; E_value=0.016; Accession=PF00923.10; Description =Transaldolase
LEKEGINCNLTLLFSFAQARACAEAGVFLISPFVGRILDWYKANTDKKEYAPAEDPGVEYTRQLLKPHSAVRLADISGWGIAMVPDVERENSGAKKARQLRRETSSYGRTMNNEIAGLSSPTLRCKGGGGNSNEEYQQEYSPLYHNVDERDEKLKAEITLP

SEQ ID NO: 121353 - protein, 148 aa, Glycine max
  Coding DNA Sequence Number=SeqID_29668
MPISPYGSISRSVLFRHRDRTHKTPSGPGEVQQGPEVSNFGYGPQSVLQGAHSPQQGVAPTRHPVDPEEPNRALGFPALVTSLCQSYRAPIPPTSSCHRDIGITPARHSMDPEKSNMVLGFPALIIGLCQFYGVPISPNKVIKTPGSL

SEQ ID NO: 121354 - protein, 188 aa, Glycine max
  Coding DNA Sequence Number=SeqID_29669
  Gene Ontology: Mol. function=oxidoreductase activity; Biological process=electron transport
  Homolog annotation: Hit_ID=A8GFK4; Match level="QueryCoverage=54%, HitCoverage=33%, E-value=4e-42, Identity=75%"; Hit description =Oxidoreductase domain protein
MLYAEHHFACGDTQVTTSMHRRGGSQRESVQAVTDGALYQLTDMRHWLREDAQGELEQPVPGWQSTLVQRGFDGAVRHFLDAVANQSAPETGGEQALAAQRALIFTVPIRQPHEPTQILGCRQLDDDVFAGVGLCPRCDRRARVRGRHGNGRLFRGVQTPESVTPYLCRRGVFAGLRADPGRIQEPAG

SEQ ID NO: 121355 - protein, 81 aa, Glycine max
  Coding DNA Sequence Number=SeqID_29670
  Homolog annotation: Hit_ID=A6FJQ2; Match level="QueryCoverage=46%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGKINNKLSLCFCRCHGKINILTTTRIMFGVPSSNS

SEQ ID NO: 121356 - protein, 133 aa, Glycine max
  Coding DNA Sequence Number=SeqID_29671
  Homolog annotation: Hit_ID=A5ATA8; Match level="QueryCoverage=99%, HitCoverage=6%, E-value=1e-15, Identity=35%"; Hit description =Putative uncharacterized protein
MECPKDVEKYNNMINSQRVYVFLASLDSHLDAVHGRILATTPLPNANRQEAMLDSESTIGTTFVVKKYFKKEIRKCTHCNGDNHVVETCFKLHGYPDWHPKGKTTPNTKVDATSKSHISTAARFVTKSGVVSG

SEQ ID NO: 121357 - protein, 210 aa, Glycine max
  Coding DNA Sequence Number=SeqID_29672
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
YPVNGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTNPTLAGTCRRRNPLKRSKKKNNNKSNTEGNTHIPIVIAKCRPAGMQAWHWPSFYNVVTGKTLALPNLIALQHIPLSPAGVIAKRPAPIALPNSCAA

SEQ ID NO: 121358 - protein, 130 aa, Glycine max
  Coding DNA Sequence Number=SeqID_29673
MSTSISLKYSSTPLLPWSASARKDDRSRSNIQASPDDADRTFPNRHHPIVIQGLNRINNGRCRSLYGPVATYPSAGGRRVTRGMRVPRKEYARSRHQRLFEENVGKTGKDAIYELLSERFGSCIYARGRY

SEQ ID NO: 121359 - protein, 34 aa, Glycine max
  Coding DNA Sequence Number=SeqID_29674
MAQCRLKNISRDTSRPMSAIEFSVQSLNEICMMS

SEQ ID NO: 121360 - protein, 77 aa, Glycine max
  Coding DNA Sequence Number=SeqID_29675
MASAITWATWTLIRVRMAYTNWHLGRGRSELLSLGKTLLSSSIIHVWVKVVMLVRMIHTCLPTAVRAKSYPGVHNSW

SEQ ID NO: 121361 - protein, 108 aa, Glycine max
  Coding DNA Sequence Number=SeqID_29676
VDSRGSPHPEQPARTLQQPVEWILPTPTPYRLVEPVQLIEVSSSKEDLEEDPGELSPEPAMDAPDLPEDDEDPLPDVDSPEDIMPASEANSTEESGPRGTANSDDSSS

SEQ ID NO: 121362 - protein, 145 aa, Glycine max
  Coding DNA Sequence Number=SeqID_29677
MVMGDFINILSFPGGRIVFHSKKHIAALISWNICLLLKHVCIFSGENTKTFSSLTSYPELRRSEFLIGGYVGARASLLSTAPLFVTMTQELVARGDTLRLSAPCHSVTPTVIDEQRPMWSSAPFPEMSASSGGDFFKSHKLSRTT

SEQ ID NO: 121363 - protein, 158 aa, Glycine max
  Coding DNA Sequence Number=SeqID_29678
  Gene Ontology: Cellular component=chloroplast
  Homolog annotation: Hit_ID=A7Q8B9; Match level="QueryCoverage=48%, HitCoverage=15%, E-value=2e-24, Identity=72%"; Hit description =Chromosome chr14 scaffold_63, whole genome shotgun sequence
KTDLTPSCMLHSARGDIAQLVELRSCNWVVAITGWMSNCPGGNDSILYLNRGSLFLSNGKEDRYMPLKDSTETKTGCQERRGGRMASWSDLGFLIWDPGEEDQAGPCEQLDALSPFNPLSEMWQKEKESMDRPHRLHPVGTTRSPQGRLRHPGVADRP

SEQ ID NO: 121364 - protein, 295 aa, Glycine max
  Coding DNA Sequence Number=SeqID_29679
  Gene Ontology: Mol. function=nucleoside-triphosphatase activity; Cellular component=chloroplast
  Homolog annotation: Hit_ID=Q2PMM5; Match level="QueryCoverage=99%, HitCoverage=12%, E-value=1e-171, Identity=99%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSIIQYDSTRSSFIQVNGF

SEQ ID NO: 121365 - protein, 30 aa, Glycine max
  Coding DNA Sequence Number=SeqID_29680
MAGTPQKTPTHGFFEPIQLNIFIDGLRPQS

SEQ ID NO: 121366 - protein, 151 aa, Glycine max
  Coding DNA Sequence Number=SeqID_29681
  Subcellular localization annotation: CTP_CleavageSite=48; ConfidenceScore=5.12e-01
MAVQLQYPMKRFSTFCRVGLPRSLSRIGHVRSLKEPKTSLSGKFSEVDAGLASVCPQELSVKRCILLKPEVTQNSYTASRRGYSLTKTGILVEGRAPQLLYPEVGTSKMVIPSQTTKRTQNQSNHSRLLIQLKDKTTRKGDLSRKYELGYF

SEQ ID NO: 121367 - protein, 101 aa, Glycine max
  Coding DNA Sequence Number=SeqID_29682
MNGDECVYESIMSEEINMNKDNGEEPVVFEYIDCFDTFNTSQVFATCDNSLQWTPIIAYDIGFVVVIMRPDTSIGKRERISFILISCERSEKYRAYKKNLI

SEQ ID NO: 121368 - protein, 137 aa, Glycine max
  Coding DNA Sequence Number=SeqID_29683
MPLHRDHLALGVEDRKSGRAALADIGDRHDDPALADVIDPLDRIRLLGLQGKRRRQQQCRACGNHEKRADRAFAKCHGEKSFAGQPVTFRIIQTGQIMLIICDQERISDREAPAKKAKKCIRCLSRFRATETGFVRC

SEQ ID NO: 121369 - protein, 197 aa, Glycine max
  Coding DNA Sequence Number=SeqID_29684
  Homolog annotation: Hit_ID=A2Q4L4; Match level="QueryCoverage=34%, HitCoverage=6%, E-value=3e-10, Identity=39%"; Hit description=RNA -directed DNA polymerase
MAIKRALQQELWDISNAYESLLRQKSRAKWIKEGDRNTAYIHKLINLRRSSNVVHGILIDGAWVQQPDLVKNAVTYFGWGLFSLYLAISKRGAEIDSRITDTKINQKEYGEGMFLHSPELAGKTPKQDCPSQSPATNNSFNNSYFENEEDLHREIARDLGVSYADKNTCKDKMKYDVINSSIFPQSAAVMGTKQNDP

SEQ ID NO: 121370 - protein, 137 aa, Glycine max
  Coding DNA Sequence Number=SeqID_29685
MGDSISGLSFPENTETFSSLTSYPELRRSEFLIGGYVGARASLLSSTPPFVVMTQELVARGDTLRLSAPRHSVTPSVIDEQRLVWSLHPFRRCQHLPVETFSSLTSYLELRRSEFLIGGYVGARALLLSHAPQDLSY

SEQ ID NO: 121371 - protein, 102 aa, Glycine max
  Coding DNA Sequence Number=SeqID_29686
MAFLQTSSFVLPQTFEVHRQKIQHLRTLDSVCVAFLIFEVVVVGLLLLLLAGAIGDGGSVHGLGLVTSCVSLTSVLHCQLAPSSKMTSLEMISCFESGLNNR

SEQ ID NO: 121372 - protein, 141 aa, Glycine max
  Coding DNA Sequence Number=SeqID_29687
MHKALRANAPLPYPQLITLFLRHFQIPLDDEPFVQVKRSFAIGAGAVTSFGYRKDQNGQWLKKDALPPQDERTPSPPPQRDDSALMTEVFSELRGLHSYVGERFDSLDTHFAGMDIRLTQLKEDVGYIRQSFDLPPPPPPS

SEQ ID NO: 121373 - protein, 107 aa, Glycine max
  Coding DNA Sequence Number=SeqID_29688
TYQGNPCGVYPDLSSFIGSGVYPDLSSLTGSGVYPDLSSFTGSGVYPDLSSFIGSGVYPDLSSFTGSGVYPDLSSFTGSGVIQKTLQPVSSDPPRMVHIIWYQSFGS

SEQ ID NO: 121374 - protein, 132 aa, Glycine max
  Coding DNA Sequence Number=SeqID_29689
MLEIGLTFGRPLVLDLVNPTRIDRVLTNKDLLADSYPDLEAFNLDEKEFLLLKVISTLPELSCLICSMVGAGLGTDNVALSMTHFPKRVASSHFMVLGRETLAFVISVINKVVSPLCGFKKTLVSQVFMTLY

SEQ ID NO: 121375 - protein, 295 aa, Glycine max
  Coding DNA Sequence Number=SeqID_29690
  Gene Ontology: Mol. function=ribonucleoside-diphosphate reductase activity; Cellular component=ribonucleoside-diphosphate reductase complex; Biological process=DNA replication
  Homolog annotation: Hit_ID=Q7VUU1; Match level="QueryCoverage=98%, HitCoverage=29%, E-value=1e-157, Identity=92%"; Hit description =Ribonucleoside-diphosphate reductase alpha chain
  Pfam annotation: Domain name=Ribonuc_red_lgC; Domain location=1-280; Score=-119.4; E_value=4.3e-11; Accession=PF02867.6; Description =Ribonucleotide reductase, barrel doma
MRMLDNVIDINYYAVDKARNSNARHRPVGMGIMGFQDCLQMMRVPYASQAAVEFADRSMEAVCYHAYWASSLLAEERGRYQSYEGSLWSRGILPQDTLKMLRDERGGHVEVDESSTLDWDALRARIKQHGMRNSNCIAIAPTATISNIIGVSACIEPTFQNLYVKSNLSGEFTVVNDYLVRDLKKLGLWDEVMVADLKYFDGSLSRIDRVPSELRELYATAFEVEPSWLVECASRRQKWIDQAQSLNIYMAGASGKKLDDTYKLAWKRGLKTTYYLRTLGATSAEKSTGRGGGIL

SEQ ID NO: 121376 - protein, 103 aa, Glycine max
  Coding DNA Sequence Number=SeqID_29691
MGGATCAARSLHRCAYSLKLRRSGAQLSELYSKILLRKAVIKILNVTEYWRSFQISVPETNRGNPASIEGWIFELQWGPLMVIFHHGDAAEDKGKEVRGGAIH

SEQ ID NO: 121377 - protein, 174 aa, Glycine max
  Coding DNA Sequence Number=SeqID_29692
  Gene Ontology: Mol. function=RNA-directed DNA polymerase activity; Biological process=RNA-dependent DNA replication
  Homolog annotation: Hit_ID=Q0ZCD0; Match level="QueryCoverage=89%, HitCoverage=13%, E-value=7e-09, Identity=28%"; Hit description =Integrase
MERSMIDAASDGALGDMTPAEARNLIEKMASNSQQFSARNDAIVIRGVHEVATNPSASSETKKLEGKLDALVNLVTQLALNQKSVPVARVCGLCSSADHHTDLCPSMQQPGAIEQPEAYAANIYNRPPQPQQQNQPQQSNYDLSSNRYNPGWRNHPNLRWSSPQQQQQQPAPSF

SEQ ID NO: 121378 - protein, 33 aa, Glycine max
  Coding DNA Sequence Number=SeqID_29693
MRRGAGTLKKKIYCCEFLKFLHWVFIHGFWKMQ

SEQ ID NO: 121379 - protein, 129 aa, Glycine max
  Coding DNA Sequence Number=SeqID_29694
MASNSQQFSARNDAIVIRGVHEVATNSSSSAETKKLEAIEQPEAYAANIYNRPPQPQQQNQPQQNSYDLSSNRYNPEWRNHPNLRWSNPSQQQQQPYFQNVAGPSRPYVPPPIQQQQQQQQQPQKKENS

SEQ ID NO: 121380 - protein, 342 aa, Glycine max
  Coding DNA Sequence Number=SeqID_29695
  Homolog annotation: Hit_ID=A4W671; Match level="QueryCoverage=30%, HitCoverage=13%, E-value=2e-31, Identity=61%"; Hit description =Phosphatidylglycerol-membrane-oligosaccharide glycerophosphotransfera se
SNANLAPEVNIEYVDPLPARFDVVITARAYGANAHRPIPVRVGDQVQQLNLGDAFSTQTLHFTNPGASRNLIITPPEPQLSNLGNITGQDPRKLGIGMAEIKIIPQPEKQQERRPGATGMIPTMMNTHKAFKALQQAGVADHQAEVMVDIFAEMQQENSLTKTHLSQAMEGVMRANHATAQRVDKLAQSLRHFENEVRHTFKAIELRFDNVDEQFRKIDQRFKKVDEQFRLIDQRFEKVDAQFREIDKRFEKVDAQFRTIAQRFEQIDEQFRKIDQRFEQIDERFRQIDKRFEKVDERLLDLDHRMQLGFNELKRDNLWHRRLMMAMASAFVLSAAKYIFAG

SEQ ID NO: 121381 - protein, 47 aa, Glycine max
  Coding DNA Sequence Number=SeqID_29696
GVCHLVGNSLVAQADHRGGGGSSYGARLGDLDKYYIVSLSEGSCGHT

SEQ ID NO: 121382 - protein, 62 aa, Glycine max
  Coding DNA Sequence Number=SeqID_29697
MSNEKLKPSDAQNNMKKGQIIFNYPQAYSKQNLISALESLLSKVIGEVGQGEEVVVCQAHDH

SEQ ID NO: 121383 - protein, 83 aa, Glycine max
  Coding DNA Sequence Number=SeqID_29698
MRVPRKEYARSRHQRLFEENVGKTGKDAIYELLSERFGSCIYAWGSKIGEVVAAQLAQASSARPGEPGCFLQKQQPSRGMGIL

SEQ ID NO: 121384 - protein, 37 aa, Glycine max
  Coding DNA Sequence Number=SeqID_29699
MPTIDCFSPMFKLYVSYPNFVRGPLLDDMRPFFGPCE

SEQ ID NO: 121385 - protein, 97 aa, Glycine max
  Coding DNA Sequence Number=SeqID_29700
  Subcellular localization annotation: CTP_CleavageSite=35; ConfidenceScore=5.13e-01
MRGYVMVSRTFRQRGGNEPVDARRLTSSSAPFVVLTREVRGKRARWRTETNIVLCTFCVLTREVSRTFRQRGGNEPVDARRLTSSSAPFVVLTREVR

SEQ ID NO: 121386 - protein, 199 aa, Glycine max
  Coding DNA Sequence Number=SeqID_29701
  Gene Ontology: Mol. function=nucleotide binding; Cellular component =intrinsic to membrane; Biological process=defense response
  Homolog annotation: Hit_ID=Q2YE88; Match level="QueryCoverage=99%, HitCoverage=20%, E-value=3e-84, Identity=67%"; Hit description=NBS -LRR type disease resistance protein Rps1-k-1
MAEDLLKKPRNGRTLEEVGHEYFDDLVSRSFFQRSSTNRSSWSDRKWFVMHDLMHDLATSLGGDFYFRSEELGKETKINTKTRHLSFAKFNSSFLDNPDVVGRVKFLRTFLSIINFEAAPFNNEEAPCIIMSKLIKLTKLPSDMRNVVNLRHLEICETPIKEMPRGMSKLNHLQHLDFFVVGKHKENGIKELGGLSNLH

SEQ ID NO: 121387 - protein, 138 aa, Glycine max
  Coding DNA Sequence Number=SeqID_29702
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFVGTELEFVIMVIAVSFGKPVVPAALMNRPTRGERRFAYWALFRFLAH

SEQ ID NO: 121388 - protein, 74 aa, Glycine max
  Coding DNA Sequence Number=SeqID_29703
MAEEGSTLNNTGSETICNRIEAVHYLLHAQSWSSIIAPLCSFMFGLHVGTSIILLYLLHFTRYSSSSTGSVRAP

SEQ ID NO: 121389 - protein, 160 aa, Glycine max
  Coding DNA Sequence Number=SeqID_29704
VPLQRTLADGGHPAQGTPSCLRVLMMLHSANIKGSSASRLDCRQDVSLHRNFHCIYISLCVCTVSILTILDHGPQRLKASVGRWAHSLYLMTLTIPELFLRPYQVTWDVTVFEVFNPDFPLYIKHEDLSEIAHGGQCLSISLLQLWILHLTENKYASAEF

SEQ ID NO: 121390 - protein, 107 aa, Glycine max
  Coding DNA Sequence Number=SeqID_29705
AVHVSSTFEFGAEFHDCLSADPQGNPPYSTFVRSTMNIGSFAKYKEKEEVEMRVVITKRAGRTKSVSYLCFPLISDERLAQSVKFRNVAEIERVVFAQSVSFRNFFK

SEQ ID NO: 121391 - protein, 51 aa, Glycine max
  Coding DNA Sequence Number=SeqID_29706
MACTHIPVEAKMSYNAQWNASRLLHDIHMLRSSRILGKMEVRKPSRVYGYH

SEQ ID NO: 121392 - protein, 121 aa, Glycine max
  Coding DNA Sequence Number=SeqID_29707
MWLFRIFFKNSLTGNRLQLLGNRLHNYVLNGHDFSKLTSKVSSLVIDYRQVTYQGNPCGVYPDLSSFTGSGVYPDLSSFTGSGVYPDLSSFTRSGVYPDLSSFTGSGVIQTFVACIKRSAP

SEQ ID NO: 121393 - protein, 19 aa, Glycine max
  Coding DNA Sequence Number=SeqID_29708
MAEKDALPPQMNVLLHSPH

SEQ ID NO: 121394 - protein, 104 aa, Glycine max
  Coding DNA Sequence Number=SeqID_29709
  Homolog annotation: Hit_ID=A5C499; Match level="QueryCoverage=39%, HitCoverage=3%, E-value=8e-10, Identity=70%"; Hit description =Putative uncharacterized protein
MSIRCDSQATLAKAYSQVYNGKSRHLGVRHNMVRELIMHGVEFNVESLTCRDWNTSSKVSQKECVRFSFTGARKKRTTYISMKFSRFKKLGLGFDMLMKDRDTG

SEQ ID NO: 121395 - protein, 121 aa, Glycine max
  Coding DNA Sequence Number=SeqID_29710
  Pfam annotation: Domain name=Transposase_23; Domain location=56-121; Score=-10.9; E_value=0.019; Accession=PF03017.5; Description =TNP1ENSPM transposase
MDVRMSCLLPLGDQNTLVVCVLLEPGLALPPEVGPLAARVSTKESCVDPTRNNSGTGDSDKCGLYIEENPPRLVALGRIYEGSTTVHNIPLLHDQVKVGVEEIKVGDALIPVPTNEVILVG

SEQ ID NO: 121396 - protein, 147 aa, Glycine max
  Coding DNA Sequence Number=SeqID_29711
MGCPIGCLDDGGGSQRSFEAIKSLFASVIKVKLHLLLQQVGQWKGYFAKIPYKAPVESCMTKKRSHLSHTEGAFAQAERHPPIGKSAEGTGVHALWSMNGRGNRSFLAGLLQDYLDGTHPLTVRDRINDSSLQKLGYLLLHYIKNHR

SEQ ID NO: 121397 - protein, 379 aa, Glycine max
  Coding DNA Sequence Number=SeqID_29712
  Gene Ontology: Mol. function=binding; Cellular component=cytoplasm; Biological process=metabolic process
  Homolog annotation: Hit_ID=Q688Q3; Match level="QueryCoverage=78%, HitCoverage=70%, E-value=1e-52, Identity=40%"; Hit description =Unknow protein
  Pfam annotation: Domain name=TPR_1; Domain location=164-197; Score =26.5; E_value=9.7e-05; Accession=PF00515.19; Description =Tetratricopeptide repeat
  Pfam annotation: Domain name=TPR_1; Domain location=92-125; Score =28.3; E_value=2.8e-05; Accession=PF00515.19; Description =Tetratricopeptide repeat
  Pfam annotation: Domain name=TPR_2; Domain location=127-163; Score =2.0; E_value=17; Accession=PF07719.8; Description=Tetratricopeptide repeat
  Pfam annotation: Domain name=TPR_2; Domain location=164-197; Score =17.2; E_value=0.062; Accession=PF07719.8; Description=Tetratricopepti de repeat
  Pfam annotation: Domain name=TPR_2; Domain location=92-125; Score =24.2; E_value=0.00048; Accession=PF07719.8; Description =Tetratricopeptide repeat
  Pfam module annotation: Pfam domain module=TPR_1::TPR_1::TPR_2::TPR _2::TPR_2; Domain location=164-197::92-125::127-163::164-197::92-125
MAQLLSAFWIQANLPDNLPSNIEAVAHSFILTLIVLRIKVSSSRITGSVGVKKASKGDTIFFYNARNSPGQYDLSRINHLHSSFVPEDVPDAASEKDLGNEFFKQKKFKEARDCYSRSIALSPTAVAYANRAMANIKLRRQAYVLFQEAEDDCTEALNLDDRYIKAYSRRATARKELGKIKESMDDAEFALRLEPNNQEIKKQYADAKSFYEKDILQKASGVLRSTVQGTQKVGKSEEKVNGDSIHPISHSTQKSGLAEVHHHKKDNERKILVKESLLTEDVDSREIKARSRPQSQGDDGSKGGLSASNSLEQRNHRITKPEMKASVEQLASRAASRAMSEAAKNVTPPTTAYQFEVSWRAFSGDLALQARLLKAISPH

SEQ ID NO: 121398 - protein, 197 aa, Glycine max
  Coding DNA Sequence Number=SeqID_29713
MQPQGLAQPPEPEIGPSVTRVNTKESFVDPSGNDPNTGDLDKYELYIKENPPRLVALGRVYKGSTTAHNIPLLHDQIKVGVEEVRDADAPILVPTEYVMLVGEALNTFLAWPTHLVKHLSEQGDVGPAKPADRPDHDVNDPLYMMTLKIPQVFLKPLQVMWDATVFGMFNEDFPLYINHEDLFEIAYSSQCLSISII

SEQ ID NO: 121399 - protein, 91 aa, Glycine max
  Coding DNA Sequence Number=SeqID_29714
MAYCLEASKTVIYFGVDIGSVHRPDSVYLRLNRLFVPIRKVLKERRVPFDYPGSLPSPSKLSKAWGFSLPDDLQPALCPSRIPCRVDVTLT

SEQ ID NO: 121400 - protein, 121 aa, Glycine max
  Coding DNA Sequence Number=SeqID_29715
MDKSLKLWFIPLIQDRVQDSPLSVLRCHEASHGHEIYPKAHENLGPSFSSLAQSSWSLPSNALRGRIASNIIMVSLSDAILPRRGPITRAMARRLQEDWARDAGEDPRVLMSLMVDFGPMG

SEQ ID NO: 121401 - protein, 127 aa, Glycine max
  Coding DNA Sequence Number=SeqID_29716
MRVHCNQASRRPSMTTDSPPLLMFSWTRNIRKKDKEKEQKGSQSKESTLIDWPNSLTIVPSGVANCLNLPFGGRATRGLTGASSKKGKCAESPPTFIQGKHRKTRKRRGLRTLSERFGSCIYARGRY

SEQ ID NO: 121402 - protein, 93 aa, Glycine max
  Coding DNA Sequence Number=SeqID_29717
ELAQQRPIMSVEQFIEKKNDHSSKAIIPEAVEFSKRKLETRSNEVAHPGPVPVPADVPFPGALDTSPPTTSVLHLTDKEDVQAQDTQDQLQEF

SEQ ID NO: 121403 - protein, 156 aa, Glycine max
  Coding DNA Sequence Number=SeqID_29718
  Homolog annotation: Hit_ID=A5C365; Match level="QueryCoverage=70%, HitCoverage=13%, E-value=8e-08, Identity=28%"; Hit description =Putative uncharacterized protein
TLASIATPLGLEFIPQVKKLLDEGLVRKSLNPCALLVPKIGIIRHQIPKIGGMMNVLSGATLFCKITHAPNIFMICVHRDPLGSDQGVPMNPKRIKVIPEWPTPPSIRKIWGFHDLTNFYKSVEGRSPEYEKPRDLRSNPFQGGGNDAILSRKGIG

SEQ ID NO: 121404 - protein, 75 aa, Glycine max
  Coding DNA Sequence Number=SeqID_29719
  Homolog annotation: Hit_ID=A6FJQ2; Match level="QueryCoverage=50%, HitCoverage=84%, E-value=3e-11, Identity=92%"; Hit description=50S ribosomal protein L5
MTVKTLTHAAPGRRSQLSMRKEKIPHQAPFAIQAAQLLGRAIGAGLFAITPAGERGMCCKAIKLGNARVFPVTTL

SEQ ID NO: 121405 - protein, 82 aa, Glycine max
  Coding DNA Sequence Number=SeqID_29720
MGVQIETRPTWALQKAVASGGSHLARLGELGGKHLPHFPINRGRNEEEFRSGLLVSVGIFAKIFSRSSTFFVRSSLFFGLQR

SEQ ID NO: 121406 - protein, 88 aa, Glycine max
  Coding DNA Sequence Number=SeqID_29721
  Gene Ontology: Mol. function=catalytic activity; Cellular component =cellular_component; Biological process=metabolic process
  Homolog annotation: Hit_ID=Q9MB42; Match level="QueryCoverage=62%, HitCoverage=7%, E-value=4e-16, Identity=74%"; Hit description=Beta -amyrin synthase
LLNPTEFLGNIVVEHDYAECTGSAIQALVLFKKLYPRHRETEIKNSIANVVHGMEVGEFATFMALGLHYVVLQRRVKLTLLVLPFTKP

SEQ ID NO: 121407 - protein, 115 aa, Glycine max
  Coding DNA Sequence Number=SeqID_29722
  Homolog annotation: Hit_ID=A1IW39; Match level="QueryCoverage=55%, HitCoverage=93%, E-value=1e-08, Identity=53%"; Hit description =Putative uncharacterized protein ophh-69
MNGAKRSAEAVGCKKESVGERSALEGRTRASSAGRSGSEKLGLSNANVGENPMPQKTLRVPFPQGSFHGAGRENASSQSSSTRRYSAEVIHAILPGKARTTFNKWVPVPETDTGG

SEQ ID NO: 121408 - protein, 74 aa, Glycine max
  Coding DNA Sequence Number=SeqID_29723
  Pfam annotation: Domain name=zf-CCHC; Domain location=22-39; Score =31.2; E_value=3.8e-06; Accession=PF00098.14; Description=Zinc knuckle
REDREASKFQPWKRFQEDFPTLRCYKCNQLGHIKANCPSNEQWPEKNEKKSHEERRSKKAYIAWDDNDSSDGSD

SEQ ID NO: 121409 - protein, 251 aa, Glycine max
  Coding DNA Sequence Number=SeqID_29724
  Homolog annotation: Hit_ID=A6H5B3; Match level="QueryCoverage=26%, HitCoverage=84%, E-value=2e-27, Identity=88%"; Hit description =Putative ribosomal protein S3
GKESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGVKHCFGAGRESDDGDKLHRQEGNSPDHQLRPLNDRSVIKEMNGAKRSAKAVGCKNESVGECTILEGRTHASSAGRSRSGNVGLTNANVGKNPMPRKPKGSFVRFIHG

SEQ ID NO: 121410 - protein, 260 aa, Glycine max
  Coding DNA Sequence Number=SeqID_29725
AEMKRHNLHKHLANLQDGSIDVTVVKEFYANLYSPEDQSPKQVRVRGHLIKISADSLNTILETPVVLEEGETLPTYSRFTRMRIDPQEFAARLYIPGRGFVLNAEGHPWKLLRKDLTTLAQTCSVFSYNNLTLTSHTSDLNMDRAGLVYGLVTGMDMNFGALISGQISTIAQSNSFRLEFLALTTTLSRARGVTTDSLTYESLSPAINLAYIKKNCCDVSSIGACRPRIFFVNGFLYFLDDEWQRNGEGRERGDATSRRR

SEQ ID NO: 121411 - protein, 54 aa, Glycine max
  Coding DNA Sequence Number=SeqID_29726
MPKIGGDCHHQKGGDCRQRIKLNVLMMPKDHMLLKALFKTKKLKIFKMDDQDSL

SEQ ID NO: 121412 - protein, 193 aa, Glycine max
  Coding DNA Sequence Number=SeqID_29727
  Gene Ontology: Mol. function=transition metal ion binding
  Homolog annotation: Hit_ID=A2W732; Match level="QueryCoverage=19%, HitCoverage=12%, E-value=4e-14, Identity=97%"; Hit description =ATPase component of ABC transporter
MEKDIPWDKFDASLLTDEQAKTIKMNAITEWSALPATENVPARQPARQRLFRVHERLVLRGAEALARADGIPAPLQAGDGADRRGTARGALPVRSGAAARDADAALLRRDSPEPLVPLCGRLAHRARHQADLRNDFARRSASWRRVPALHEEGVEQLRRRRPCRIREDRRADGVGAPHREAAAPDQPAREPGA

SEQ ID NO: 121413 - protein, 63 aa, Glycine max
  Coding DNA Sequence Number=SeqID_29728
MKENNKGSPVESPTVATYPSAGGRRVTRGMRVPRKEYARSRHQRLFEENVGKTGKDAIYELLS

SEQ ID NO: 121414 - protein, 172 aa, Glycine max
  Coding DNA Sequence Number=SeqID_29729
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPNAAPYPVTIVLSPT

SEQ ID NO: 121415 - protein, 111 aa, Glycine max
  Coding DNA Sequence Number=SeqID_29730
MSLPSAVHVSPLSCAKLLVTGKHKEKEEVEVRVVIAKRAGRTKSVSYLWFPLISDERLVQSVKFRNMAEVEKRFLQKAVASGGSNPARLGELGGKHLPYFAINKGGSEKEK

SEQ ID NO: 121416 - protein, 109 aa, Glycine max
  Coding DNA Sequence Number=SeqID_29731
MVVGVAVNSGCKMDEDHWIYDNIMFEEVDMNEEKLGVNEENVEEPGVHQHVFDTHDDVLHWAQSVVYDIGFVMVIMRLDTNTGVRGRTLFILIGCEMSGKYRDRKKVLI

SEQ ID NO: 121417 - protein, 620 aa, Glycine max
  Coding DNA Sequence Number=SeqID_29732
  Gene Ontology: Mol. function=phosphoprotein phosphatase activity
  Homolog annotation: Hit_ID=A7UQU7; Match level="QueryCoverage=53%, HitCoverage=72%, E-value=5e-23, Identity=27%"; Hit description=IMP dehydrogenase/GMP reductase, putative
  Pfam annotation: Domain name=DUF1723; Domain location=344-393; Score =60.6; E_value=5.3e-15; Accession=PF08330.1; Description=Protein of unknown function (DUF1723)
MDLCLLKKVEMILGYKFRNKKLLEEALTHPSFTKVVSYKRLEFIGNSILSATFTDCLFILYPFFKLGQHLHQEACSRYHYYYKMLDLTHKTFPCMSTNHAMSIILLWDMLGAPNNVVGAPTAIVALLRSFRGAVATFLSSRVEDMEIASKWRRATVPILPEELLPITSLEEGSSSRTKVLPEKLPEEVLPIMVRTRGLGHVLARVIGRGRQDEHDAVDVPQRRRPTASTRRRRVHITVDKGVPQVTEDVPQMSENAPQMTVDIDATVAEDLGRDGAEGSHADEGFPGGPCDPSVLTSFAEHERPELKLVSHRRKVALIGKPVPAIEGLVVTTGLSPLIECSVVTDDPGLISAFVERWHRETSTFHLPVGELTITLYDVSSLLHLPISGALHNFEALSVDETIFLLIELLEVSGEEARAETAFRDMGQSGGYAWGAAALVHMYDQLDEVSRTMTWQIGGCWIYEHFSSVHQCIINDAYEETSSRASRWLTMKAHMKGITGALYRARCDALTVTDVCWLPYSDHRGLRWGPMVLTVRPERVLRQFGYIQSIPPPPDSASLSYDDIDDRWMHFSDHVVVVSDLCVVLGQVSKDYMEWFFQTFHPFMIPTQAGDQPRHDPSAAC

SEQ ID NO: 121418 - protein, 377 aa, Glycine max
  Coding DNA Sequence Number=SeqID_29733
  Homolog annotation: Hit_ID=A6BLN7; Match level="QueryCoverage=62%, HitCoverage=45%, E-value=3e-07, Identity=23%"; Hit description =Putative transposase
MACAPDNIKSINGSKETLKLVVRITDLWFVGTPNRSEQAEMVIIDSHGDAIHNDGQFRICDHRYKLVFTGATVVRQSDLEDLPFKKYKFADFTNVIVGLFQPELLVGGLPPCGIKEYKGCFQTQGLEFLDYLNESENNVPICANQRSPGASKLLINEAVFEIQEFRKRFVGHGLGPVFINFLNYMGVRSFQVQANCRQRMHFFQKLKQRQYEINNIFEEIVCVTVGTINRIVMDNHSWCYSACSYSYKKVDVETAAFTCACGKYNDQPVLRYRLEVMVNHKEESTKFLLWDRECTELIGQSTNEEGDVDLNVSPQALDKLLSYVLAFKVKVQPKFNNVVVLRYSNDIDLINAVVDMLPDAEAPILDSDDPFQLESVS

SEQ ID NO: 121419 - protein, 67 aa, Glycine max
  Coding DNA Sequence Number=SeqID_29734
  Subcellular localization annotation: CTP_CleavageSite=46; ConfidenceScore=5.42e-01
MTILDSFTVGLSRNLSTTEKNKSHGDSTSGGFNPFSVSLTFRNSIGAARGKKFEESQRTARDGAIAG

SEQ ID NO: 121420 - protein, 82 aa, Glycine max
  Coding DNA Sequence Number=SeqID_29735
MNLDEDDAVMGDATARSDATSDAIAGEAGVPFFYRAGSEFEEINQNSHQESAFACHHVAAGHAAAGATADPDAGGEVVVVDE

SEQ ID NO: 121421 - protein, 144 aa, Glycine max
  Coding DNA Sequence Number=SeqID_29736
MNLRVEDAGKNGGSLVTVSLPEDPLGVLPELPEEDLPEDFRKKGSFGSNETNSGRTGLPKSSWNTSSGMFPEDVLLPETFRKRVLPDDLLVVPEDPSSGMFPEEIMVRTRGFGRAIGRVVGRDKPADEDAADVPERRRPTISAR

SEQ ID NO: 121422 - protein, 56 aa, Glycine max
  Coding DNA Sequence Number=SeqID_29737
MTYPWASLMMLGRGNLVLMFNANYGVQKAKVVSKGGHMVENIENCILKNLMQKVPP

SEQ ID NO: 121423 - protein, 67 aa, Glycine max
  Coding DNA Sequence Number=SeqID_29738
MSSFQKLEHTIQRQSGGDGGVYGGIVVTEDIYPSADEEDDEDVIDVPFKPCPNIPVDAENYDRWCRP

SEQ ID NO: 121424 - protein, 186 aa, Glycine max
  Coding DNA Sequence Number=SeqID_29739
MVSRYALNQIVVEFEHVHYAGKNPSSCGCFMRTTQVFLVHSKLREIAYPDQNSMCPPPTKVNTKGAPKKPMNRNQRLTKHDPSYWEYVDALHFLQNSNSSVKRSASSSDQPNPRRIMPMLDQFQSFIHDFIDYIVDVKADSNCGYQSITALLGMGEDCWSLTYLKDRCPLPPLALLWSRNCHPQAK

SEQ ID NO: 121425 - protein, 538 aa, Glycine max
  Coding DNA Sequence Number=SeqID_29740
  Homolog annotation: Hit_ID=Q2HTA0; Match level="QueryCoverage=30%, HitCoverage=25%, E-value=2e-14, Identity=32%"; Hit description=IMP dehydrogenase/GMP reductase, related
  Pfam annotation: Domain name=DUF1723; Domain location=201-252; Score =13.1; E_value=0.015; Accession=PF08330.1; Description=Protein of unknown function (DUF1723)
  Subcellular localization annotation: CTP_CleavageSite=46; ConfidenceScore=5.05e-01
MTVVFMMPKMPTFQARAKLDAPSIIAVVSFSLALGASSPPLGVSIEDMHLATPPSTVEIMVKTRGLGRALGKVIGKALGRQDHHDSDDGPQRRRPTTSARRQQEVASVAEDEPVVAEDVHAHGAEAGLDAKGFLGGSRDPSVLTEYGDHVAVIVWNGEERPELKLSSHGRKVQKLGRPAPEIEGLVVVTRLSPLITCSVDTGDRELIFAFVERWHKETSSFHLLVGELTSPWMIYLKSLVRKLELRQYSVMGHTYAYLGYEIFIRGDVRPDIGLLQLVPIQSGSYAWGAAALVHMYDHLNYACKSEGRQLAGYITLLQASLKSLPASTYRKRSVVRKFGSLLDGCWMPYDEHRGVREFDLISCFSGHLRWGPVVVRHRLERVMQQFRYVQTIPIEATGFRLSFEEIDDKWMHYSDYLAVTGQICVVPGQCASDYMDWFFMISHPFMTPEQPANPARHPPVPMAPAAPAHASSDVEQPRHVVVFQAIAERLKHLLNLRIVTTGTKIHKVMEDCIRIAKGVTPYDNVYVRARRRRHTDQS

SEQ ID NO: 121426 - protein, 206 aa, Glycine max
  Coding DNA Sequence Number=SeqID_29741
MGEKKKKQLEETAKSKSPDNVIDPPFPIRRHVKWKMTRTKKTSQMTSEVAKEIANKIKTLLWTDSKDLPHDQTILWTDSKDLPHVFIHGSRRLGVADAKNQGPMQSRGLALSPELEVGPLAACVSTKESFVYPSWNNPDTGDSEKCRLYIEENPPRLVGVEEVRDVDAHIQVPTQEVQLVGQTLNTFVAWLTHLVKCFSEHIFHYH

SEQ ID NO: 121427 - protein, 871 aa, Glycine max
  Coding DNA Sequence Number=SeqID_29742
  Gene Ontology: Mol. function=protein binding; Biological process =protein metabolic process
  Homolog annotation: Hit_ID=A5C486; Match level="QueryCoverage=100%, HitCoverage=99%, E-value=0.0, Identity=49%"; Hit description =Putative uncharacterized protein
MRAGVCSIQLQALTSEAATLVKQAVTLATRRGHAQVTPLHIATVMLATSTGLLRKACLQCHSHPLQYKALELCFNVSLNRLPASTPNPLLISPPYNSTTTTPSLSNALVAAFKRAQAHQRRGSIDQNQQQPILTLKIKVEQLIVSILDDPSISRVMREAGFSSSLVKTRVEQAVSMELVCSQQQAYSKENTTELQVLGGGTSSMPPSRSFGHFGGSFKSMEDLVHDDAGDHVVDDVTSVLSELVSKRRNTVIVGESLASPEGIVRGLIENLERGSVQGELRFVQFVSLPLVSFRNIGKKEVERKLVELRNLVKSHVGRGFILYLGDLKWLFEFWSSYCEQRTNYYCSVVHIVMELKKLISGNGENGRLWLMGIATFGTYMKGQACHPSLETIWDLHLFTVPVLLSSLRLGLTFDSDFQVQERSKVTFKDESFEERAKVRKYLTCCRDFSLNFEKEAKSTTNSITISKRDCTTNLPTWLQNCKEERSRIMENQENAKLRDICKKWNSFCSSAHGFPSNPEKQFFFISSSPSSPTSVSSHERKLSLNLKHLNWPLISEPKQVPKECELYTETTVSDDSYEGNLIMFMPEKNIPKPDLLSNPNSSPNSASSSEAVEGLDSTQIFKEHNDENLKILCDALLKKVSQQKEIVKEIASTVLLCRSGMREGVNHLVKRDDRQEIWFFFLGLDSQAKEMVSKELAKVVFGSYSNFVSIGISSFSSTHEESKNKRPRDEFGGSYLQRFGEALNENPHRVFFLEDLEQVDHFSKKGVKKGIESGTITLPGGESVPLKDAIVIFSSESFSSVPRACSPARTTSPFSDEDMEKNNINKSEEKTPCLSLDLNMAIEVDVQKNVHLDGDTAEILELVDKQINFKI

SEQ ID NO: 121428 - protein, 92 aa, Glycine max
  Coding DNA Sequence Number=SeqID_29743
  Homolog annotation: Hit_ID=Q7XZK4; Match level="QueryCoverage=33%, HitCoverage=5%, E-value=8e-07, Identity=80%"; Hit description =Calcium-dependent calmodulin-independent protein kinase isoform 2
MVLADSSPLHGVSWKFLLVDEGHRRKHFHFSSDLQNLIAPEHGKLLRELACKSISKKKLCTVIDIDDVRREVEIMRHLRQEGANLEGYLRGR

SEQ ID NO: 121429 - protein, 109 aa, Glycine max
  Coding DNA Sequence Number=SeqID_29744
MKKIRNSILLLSIFLAVSAAEPIPSAAYDRMLFPDRRCQKSVSENKTRGGSSAAAAAADLMEVSYRYPLAKTGIRSGSTRGVRLCDQSSLERTFPSRLILLASLPVICI

SEQ ID NO: 121430 - protein, 179 aa, Glycine max
  Coding DNA Sequence Number=SeqID_29745
MVGCSFINPLLCISMVISKKKNGVGMWILCLILTSRRRLTPSGPQKSTEQRVIDTSSKKLNDVEDDDVVVIDGVEARVEVVAEGEVKAVVEGEIMAEGQVDQQALVEVEPVEETNVQAQMEAEVHAEGEVGVQGEMEAEAEGEASVQADDVEAEEDDDDDSSEYSEVSDSDFEENWDWT

SEQ ID NO: 121431 - protein, 74 aa, Glycine max
  Coding DNA Sequence Number=SeqID_29746
  Homolog annotation: Hit_ID=A7PD03; Match level="QueryCoverage=52%, HitCoverage=7%, E-value=1e-07, Identity=64%"; Hit description =Chromosome chr17 scaffold_12, whole genome shotgun sequence
MGVKHFEVVKRRSHADKQWSLDKIRTQQLIVNGKSDYESRSVRYSFPPVSVEPSIAPHPKSYMEFTMLFFVCWY

SEQ ID NO: 121432 - protein, 191 aa, Glycine max
  Coding DNA Sequence Number=SeqID_29747
SRSEDADISEEGVDDDSRPEDVDISGEGVDDDVRITIRYLCMSSDLPSLDDKGEDDDMTKVQMTMLVTACQRARLPLAKKGVDNHKVSPHANGLTGHDSKKCARITISLYWKMMTSPERVQMTTLVSACQSDLGSPNDEVRITIRCLRMLPDSQHVGRLTVNGSSFLGDPTVPSSEDRDGNSHPGSRFMVV

SEQ ID NO: 121433 - protein, 86 aa, Glycine max
  Coding DNA Sequence Number=SeqID_29748
MVTSKVDRYKDVLKEKDDLAVKVEHSAKEREALDATVTEISANEVEKKMAKLKQRTRSSLKSYTRDLTNQKAYGRKNSLLDQVASE

SEQ ID NO: 121434 - protein, 333 aa, Glycine max
  Coding DNA Sequence Number=SeqID_29749
  Gene Ontology: Cellular component=peroxisome
  Homolog annotation: Hit_ID=A7PD03; Match level="QueryCoverage=54%, HitCoverage=40%, E-value=6e-40, Identity=47%"; Hit description =Chromosome chr17 scaffold_12, whole genome shotgun sequence
  Pfam annotation: Domain name=Pex14_N; Domain location=81-164; Score =14.6; E_value=2.8e-06; Accession=PF04695.4; Description=Peroxisomal membrane anchor protein (Pex14p) conserved region
MTEKEAKENTMCALVQLSQNKEEEEAMIGRAGAILHLVKLLEGEGLRGEIEQTENVDQHNRGEELGKQSLDTSVFVNSEPLREAQIHNAVKFLSHLKVRGSPVTHRRSFLEKKGLMKEEIDEAFRRVPDSPLSVQTSGINQVGLLAASGAGTIIVIKNSILPRLKSWIHNVVREKGHDQSKRTSSKPTLAEEAAQVAKAVAVAVADVDIAKASQELLSSKIEEKRYFVEVVNLLDKQVQEMKLMTNAIRRLEASGGLSISKQEDYCRNLPFSGRATRGSRVRLPRKENAHSCHQHLFEKNVRKTGKGVSLAPTYPQLRGGNHTYVVLSELNVG

SEQ ID NO: 121435 - protein, 315 aa, Glycine max
  Coding DNA Sequence Number=SeqID_29750
MELASLWGFHLTTYSRVGSGSHQRFFVGGGSLQGSSGLHAMIESPIALTEDQSSPIMTILPSPPWENPVIVEATGRDDGNEVRVSSSEETPRSRCCHGGNTPSPSPCINNFKWVRDDVLKYHLSIMSSLSVGFLWCQLDLTKHSDAHNMTLVACEEDKYPFLCILPLMVPIISMFTGIGPSVPVLMAISVGCRFKDRFFKVKAISVISDGLPLMYEESGSLSVEAKLHDESRLIQRCFDDNKDDNKGDDKKLKEHFKTQKEKLKKSSRFKRKVEFKNQESRFKDQTSRIKIKIQDSRIKRRLNQDKYENVFSKTE

SEQ ID NO: 121436 - protein, 633 aa, Glycine max
  Coding DNA Sequence Number=SeqID_29751
MEALKRHCGGETPSHSPCITDFELLRDDVLKYHSLITSSLSVGALWHQLELTKLGDAYKMTLVACGEDEYSFMCLSINCPHYFYVYQCMFEVLHLTLPLNDFQCALLRRLNVVPSQLHPNSWAVVRAFKILCPFFNISSSVRIMGDFEWWPLVKQVRPVDSDVPPPPFSVNEPSRGAAKRKISEENGGTGLRKNPYASATFALDPAAFAPISSIALPLLSVGLTTKSVITSMPPPSSIVPPLTLTIPNSGMPSSSSCPIVWPEKRMHAGFVAPFEEKLIRSIWVQNSNNVAKVSLQRRKFPSGGPLSGQYGEWSVPRWKKLLLPLLRLSSRITNCSPGSTMFLSSKVEYSAKERETLDATVTNSARVIVDLQLRDYELAASNLQAMLNEGEGGLFTEDLDLNLFDLFKEVKDKQLLDEDGIVVVEESDGGEEDDEADNIREARFLSMERLTKDEPWPLEIRPGTCSSWVWQDSPRIDLGFDELLEIQLGRRLWRFDQEHVRPRLAMTLNGPSQLGPSFLARGIFLASPQTHHTRSPVSKVRGRTLVLYLLEAWSLVASSLIAAISWTSSLISRIMASIPYVRQKESPWLLFGANSGDDKKAQKSRTLHDNKDDDLKNQRISSRCSRLNQEHFK

SEQ ID NO: 121437 - protein, 97 aa, Glycine max
  Coding DNA Sequence Number=SeqID_29752
SWVRCERLSAVKVKVPVLSVAVISGGKQGTQKMDEDEWMYEIMSEQADMDYENEEACGANEPHVDCSDAFNTSQVFECREDVLRWARSVAHENGFVG

SEQ ID NO: 121438 - protein, 63 aa, Glycine max
  Coding DNA Sequence Number=SeqID_29753
MAGAGGGGDEYHQLDGAQRLLLDAMNAQMQRLLDRTNEEVYGRLKALENEANQNARRNIDGNR

SEQ ID NO: 121439 - protein, 135 aa, Glycine max
  Coding DNA Sequence Number=SeqID_29754
MANDYLHNLPVKQTNIFTNATNSWVPGALHCCHVYNIICVCSTVSSLGASDGVAAGVIYGVSSAEVPESIGGAGMGAGGASGVGAGGAEEEGVEVSGGALRVPEKVRESGTTPLAMHKAMTSAGKPSRQELDWAI

SEQ ID NO: 121440 - protein, 138 aa, Glycine max
  Coding DNA Sequence Number=SeqID_29755
MESSIVDASTASRKRRRDEEEDEELEQAFFIIVSVATMLLDAMTWYHDKYFVKEPARNLELERHSFLNRLYMGTEIDCIEQLRISKKAFLSFVEFYKRKGNWQFKNVLRAIMKVRKEYLKFHDYNLEGSMENKWRWFK

SEQ ID NO: 121441 - protein, 68 aa, Glycine max
  Coding DNA Sequence Number=SeqID_29756
MYKCPRCGVSRYKVKDDNECSSDESTKKDPPAKMTQKTLDDMHIGETTMECFAIWLIPPSGRRLIVCI

SEQ ID NO: 121442 - protein, 229 aa, Glycine max
  Coding DNA Sequence Number=SeqID_29757
  Gene Ontology: Mol. function=RNA-directed DNA polymerase activity; Biological process=regulation of transcription, DNA-dependent
  Homolog annotation: Hit_ID=A7QSG9; Match level="QueryCoverage=90%, HitCoverage=32%, E-value=7e-43, Identity=41%"; Hit description =Chromosome chr12 scaffold_159, whole genome shotgun sequence
MKSYSPVSLHAREFPAAIAVKTDLNGKVITNDEDKEIPDAINTLIFTIAQNFIGDPSLWKDRSAELLSNLKCRTLADFRWYRDTFLTRVYIREDNQQSFWKEKFLAGLPRSLGDKVRDKIHSQSSNGDIPHESLSYGQLISYVQKVALKICQDDKIQRQLAKEKAQPKKDLGSFCEQFGLPACPKEKKKQSSRREIHDSKPVNKKRFPRRRYSHKPSTSKEMENPRQNK

SEQ ID NO: 121443 - protein, 42 aa, Glycine max
  Coding DNA Sequence Number=SeqID_29758
MDKNLKVEEDEGKEKEGRSTKFCASNEPTNPRSSPRFSTKCA

SEQ ID NO: 121444 - protein, 57 aa, Glycine max
  Coding DNA Sequence Number=SeqID_29759
MSKRLQEDWARVDKEGLRVLMNLRLLKEVFSKKLLKEVFLRKLLKEVFLRKLLKEAT

SEQ ID NO: 121445 - protein, 30 aa, Glycine max
  Coding DNA Sequence Number=SeqID_29760
MDKSLKVGEDEWRERERGEQNFEREKRENE

SEQ ID NO: 121446 - protein, 88 aa, Glycine max
  Coding DNA Sequence Number=SeqID_29761
MSICSGKPLKRRTSKDQSSKNAVGLESSFPAGETDMLEKDDGISATIIRSHPDRDSVPSMSDCDQAVLQFAKTRKLSIERPDPRKYVL

SEQ ID NO: 121447 - protein, 167 aa, Glycine max
  Coding DNA Sequence Number=SeqID_29762
  Subcellular localization annotation: CTP_CleavageSite=31; ConfidenceScore=5.51e-01
MAEPLKKRKGSSSRSQQSFGSQDTRIPPSISSSTLFSFEEQSFQNSGLIPFMSLKILVYPELVKVFYSNLEIQEGSLISEVYGIKMVIDQSLFFELTQLSSDGVPFEGTLDDDWKFDFSVSDAHRLVCISQADMTGRLLAGSLAFDCRILHYLNVRIFLPRSSNLAQ

SEQ ID NO: 121448 - protein, 225 aa, Glycine max
  Coding DNA Sequence Number=SeqID_29763
  Homolog annotation: Hit_ID=A7Q568; Match level="QueryCoverage=96%, HitCoverage=54%, E-value=1e-73, Identity=66%"; Hit description =Chromosome undetermined scaffold_52, whole genome shotgun sequence
  Pfam annotation: Domain name=DUF676; Domain location=1-144; Score =72.6; E_value=1.3e-18; Accession=PF05057.5; Description=Protein of unknown function (DUF676)
MCKISFVAHSVGGLVARYAIGRLYRPPEKGSMADSCNEESKESSVGTIGGLEAMNFIAVAAPHLGSRGNKQVPFLLGVPAFEKVASCVIHFIFRRTGRHLFLTDDDEGKPPLLKRMVQDYGDLYFMSALRAFKRRFAYSNVDYDRIRLICFFFKLILDIVGWRTSSIRRQSELANWKDTNNEKYPHVVYEEHCKACSDAEQCDSTEGNSYDKIEDRHLSIKIIVV

SEQ ID NO: 121449 - protein, 184 aa, Glycine max
  Coding DNA Sequence Number=SeqID_29764
  Subcellular localization annotation: CTP_CleavageSite=48; ConfidenceScore=5.19e-01
MSSIFGPDVLDIVSDIVDPAASMLLATPVFSGRMSWNCIRHRGSCSFNAFSNSSIFGQDVLDIVSDIVNPAASILHLTFHLALCIVHDEFGYNSVVFQWKVLELYIEKDLAGGSIFHSANSLTSCGNYLSNDETQPPTNMNNLNLDEDDDHDDDDYLVSNSYVEVPDMIPPVRIVHPAEGMISS

SEQ ID NO: 121450 - protein, 67 aa, Glycine max
  Coding DNA Sequence Number=SeqID_29765
MSPQRIFHEVEKELSLKNDHQKIQDEVQPRQEMESDQSYLSSMDRVEDKEKYVKLICHSTSPLHFDF

SEQ ID NO: 121451 - protein, 59 aa, Glycine max
  Coding DNA Sequence Number=SeqID_29766
MAKSPMGMAGSSVQQTRQFDWRFAWGLHNFVIFAIECKNKIKRGVTQGEMVEKNVISIK

SEQ ID NO: 121452 - protein, 404 aa, Glycine max
  Coding DNA Sequence Number=SeqID_29767
  Gene Ontology: Mol. function=identical protein binding; Cellular component=extracellular region; Biological process=negative regulation of catalytic activity
  Homolog annotation: Hit_ID=A7PIM2; Match level="QueryCoverage=97%, HitCoverage=55%, E-value=1e-129, Identity=60%"; Hit description =Chromosome chr13 scaffold_17, whole genome shotgun sequence
  Pfam annotation: Domain name=PA; Domain location=19-117; Score=44.7; E_value=3.2e-10; Accession=PF02225.13; Description=PA domain
  Pfam annotation: Domain name=Peptidase_S8; Domain location=3-246; Score=-85.1; E_value=0.033; Accession=PF00082.13; Description =Subtilase family
  Pfam module annotation: Pfam domain module=PA::Peptidase_S8; Domain location=19-117::3-246
MLFVAFSILSFHGVSVNTFDLKNESYPLIYGGDAPNITGGYNSSISRLCLQDSLDEDLVKGKIVLCDGFRGPTSVGLVSGAAGILLRSSRSKDVAYTFALPAVHLGLNYGALIQSYINLTSDPTATIFKSNEGKDSFAPYIASFSSRGPNAITPNILKPDLAAPGVDILAAWSPIVPPSNVKGDKRIANYTIQSGTSMACPHATAAAAYIKSFHPNWSPAAIKSALMTTATPMSVALDPEAEFAYGAGQIHPIKALNPGLVYDASEIDYVNFLCEQGYDTKKLRSITNDNSSCTQPSDGIGWDLNLPSFAVAVNTSTSFSGVVFHRTVTNVGFATSTYKARVTIPSSFLKFKVEPDVLSFSFVGQKKSFTLRIEGRLNFDIVSSSLIWDDGTFIVRSPIVMFAA

SEQ ID NO: 121453 - protein, 226 aa, Glycine max
  Coding DNA Sequence Number=SeqID_29768
  Gene Ontology: Mol. function=molecular_function; Cellular component =cytoplasm; Biological process=multicellular organismal development
  Homolog annotation: Hit_ID=A7PEA8; Match level="QueryCoverage=72%, HitCoverage=54%, E-value=4e-49, Identity=54%"; Hit description =Chromosome chr11 scaffold_13, whole genome shotgun sequence
  Pfam annotation: Domain name=Ndr; Domain location=60-226; Score=-1.9; E_value=9.7e-09; Accession=PF03096.5; Description=Ndr family
MCPSQTTKRRETTLFIIDMTKAHVSLLRTIKWDEVTLPEKWIMDKATPSIPKPAPNSLKKHHIRTGYGIMSVIVYGDPDKPALITYPNLALNYMSCFQGLFFCPEAASLLLHNFCIYHISPPGHEVFFPRKLPQEFLKLGANAICAEDPVPSPEDLADQIIEVLKLGAVMCMRVTVGVYILTLFAIFLYEFSDMITYLEPLEVRGNVEVAESEIVQACRKVSAKLI

SEQ ID NO: 121454 - protein, 145 aa, Glycine max
  Coding DNA Sequence Number=SeqID_29769
MYPLLFLVTITQVDVPSTCTTKGCTLQCVKTKFSGGEESKEFSNCVILNSLTRQKGDTKEFRWLVLRSFGKGRRETQKEFRRLVLGDSFWQKEKGMKKMNSTSFVFKVWKTKKLKKAFAKEEEEEDVQRDSKVVKDCNNCYESIE

SEQ ID NO: 121455 - protein, 93 aa, Glycine max
  Coding DNA Sequence Number=SeqID_29770
MVSRSESGVEWYSKNWVILNTQLEGSEPSNLGTADEEEGEGSGSRIRGLGPPEQGIEKLHFIASRRQPLTAKESWIASRTLLTWLQAQLHLAT

SEQ ID NO: 121456 - protein, 50 aa, Glycine max
  Coding DNA Sequence Number=SeqID_29771
MAYMSVATCPFAGERGEAHGCAFQRRKDVRSCHQRLFLENVGKTEGNRSK

SEQ ID NO: 121457 - protein, 138 aa, Glycine max
  Coding DNA Sequence Number=SeqID_29772
MGEFPKENSDTLWAMPVPNHVKYVFRGILHVGGGNENRSNKGANMGRGKERVKGIPTPPHDQRRDIGGGCNTNDGGSDDVVVAAAAMMVVVANGNDISGGGGLDEGDISGGEDVGGGGSDEGIVSNGGGQGCQTHDST

SEQ ID NO: 121458 - protein, 170 aa, Glycine max
  Coding DNA Sequence Number=SeqID_29773
WIDVIKDVLYLTMFQCSMLSPGLLNPDVSHMFSLILIKRRPQMSLGSFFYNNEKRKIKTEEVQVVGMSSPPLEISQSLKISSKAPQDGFLIKLSHLSVSPQPKPKANFLKSSPPLPISSCSVRRIAGGALRKLPLTQHICTTHPSSRFFSGLSQQWSRLAGIARSAEELT

SEQ ID NO: 121459 - protein, 153 aa, Glycine max
  Coding DNA Sequence Number=SeqID_29774
MNNSGWRQELNPYNQYEEKRAPDLESVFEGFMAYHASSKANQNSMQNHEIHFGKSYSLEDYQREPELQPYYQNEALRGFNLDNLLMQLKDTIESIQRAFKSVEIQVGKLVEDVTQVVVRREEVFVEIEAQEESPINEHDLREKDEEKSEEKVQ

SEQ ID NO: 121460 - protein, 157 aa, Glycine max
  Coding DNA Sequence Number=SeqID_29775
  Gene Ontology: Mol. function=sucrose-phosphatase activity; Cellular component=cytoplasm; Biological process=metabolic process
  Homolog annotation: Hit_ID=A7Q6X2; Match level="QueryCoverage=94%, HitCoverage=36%, E-value=5e-44, Identity=60%"; Hit description =Chromosome chr12 scaffold_57, whole genome shotgun sequence
  Pfam annotation: Domain name=S6PP; Domain location=1-113; Score= -50.8; E_value=7.4e-07; Accession=PF05116.4; Description=Sucrose-6F -phosphate phosphohydrolase
MNFAISLFIRSTDVKIIYSNDIALDILPQAAGKGRALAFLLEKLKVDRQGPLNTLVCGDSGNDVELFTVPEVSNEQEELLQWYAGNARGNPQIIHATERCATSIMKAIGNFFLGPNASPRGIRDSMFNRKILCPSHEVVMFYIFCERWGCDDVEKPE

SEQ ID NO: 121461 - protein, 190 aa, Glycine max
  Coding DNA Sequence Number=SeqID_29776
MARRHWTQLAEPMTKYDPKVVMEALHLLGTQWTRKVQKSTGISYIDSGLYQFYGIPITPTKLIWPPINRSFIEKYYMPRQVQQLGQDQQQQSATDALPLPPHQPPSLESISAQMQRMELQMHTYMRHLADQQATNHRGQMQATVAWPGDRPNFQEEVGPADAQGATQGDEDGAKNDGDMAYLLDYFIRGG

SEQ ID NO: 121462 - protein, 69 aa, Glycine max
  Coding DNA Sequence Number=SeqID_29777
MKLGMIRVRKWPPVVETRDSASTVALPEPGNAASFTAVVIACSSQTFMDALYIREKKTLLKKAMGCDCY

SEQ ID NO: 121463 - protein, 123 aa, Glycine max
  Coding DNA Sequence Number=SeqID_29778
MACQQDKSKEYAICKSSIVLENRSTRDVPSLVLSQTQVDVPSTCTTKDVPSNVLRQRSQAVKPLILCEGIQKNSQAGEGRHKRIQAVIPLFFWKREKRDTKRIQAVSPWRILFGKGRRDEKNE

SEQ ID NO: 121464 - protein, 108 aa, Glycine max
  Coding DNA Sequence Number=SeqID_29779
MAFFMFSFIHFIPKFRDSCKDYYSQLVVHSQFKFTNSPLPQQSIQLEKSEPSSMLQDGESGGAAASSAESSGMIIRGGAGGDNVSSSGEVGGSTTGGCGSADVGLVLA

SEQ ID NO: 121465 - protein, 150 aa, Glycine max
  Coding DNA Sequence Number=SeqID_29780
MASKKRKAPATPSQARYDRSRFTSPEAWERYSNIAVPRKILPERNVILHYTEFDEFTKEIEHRNWHKELANFMDGSIDVAILKEFYANLYDPGDKSPKQVRVRGHLVKFDADTLNTFLKTPVILEEGENFPVYSRFCRSKPEPQELAARL

SEQ ID NO: 121466 - protein, 59 aa, Glycine max
  Coding DNA Sequence Number=SeqID_29781
MVGACSVRIVPSGKWRLINPSRAHYCHWLLSKYGSRLAYGIGIGGMDFVGDVGEVSAVG

SEQ ID NO: 121467 - protein, 218 aa, Glycine max
  Coding DNA Sequence Number=SeqID_29782
MMLGLAPPSRLTVQGIAWLKKLEGLNGEETEVPEESEEVQVLKDELEKTKVTKEKLKVVVTRVRKECDRLKDINMFAAEVLEQEMKKARKEEWSRNKFRGALLGSSNELKLRKVEKDKSRMENVMLKDELRNCQESKGSLKEQLSKMEKNMVIIIDQYKEKVNLATGWGQVLRDEQTKASSLQVEREAREEVIELLHWSHSKWKSRASKAASQSQDGG

SEQ ID NO: 121468 - protein, 213 aa, Glycine max
  Coding DNA Sequence Number=SeqID_29783
  Gene Ontology: Mol. function=structural constituent of ribosome; Cellular component=ribonucleoprotein complex; Biological process =translation
  Homolog annotation: Hit_ID=P56791; Match level="QueryCoverage=44%, HitCoverage=34%, E-value=1e-30, Identity=76%"; Hit description =Chloroplast 50S ribosomal protein L2
  Pfam annotation: Domain name=Ribosomal_L2_C; Domain location=132-213; Score=65.3; E_value=2.1e-16; Accession=PF03947.9; Description =Ribosomal Proteins L2, C-terminal domain
MAINWTLRSLMCNATCNGLFRRRVGATFGVHPCRCGPRIFGVRVWCDWRKILVLQLVVPKVKILVKKGQSWGNFISNPILKYVGGDKTLLLDIDEDKWYFFELVGILFQSFKEGRTVWEEVLIDQKEESTSTDMPLGTAIHNIEITLGKGGQLARAAGAVAKLIAKEGKSATLKLPSGEVRLISKNCSATVGQVGNVGVNQKNLGRAGSKCWL

SEQ ID NO: 121469 - protein, 262 aa, Glycine max
  Coding DNA Sequence Number=SeqID_29784
  Homolog annotation: Hit_ID=A7PKA8; Match level="QueryCoverage=62%, HitCoverage=25%, E-value=1e-23, Identity=43%"; Hit description =Chromosome chr15 scaffold_19, whole genome shotgun sequence
MSRCLCDMDKHGILVSVLAESGSAVAVAQNGEINLDREVKTRESSEGSPEQSNPTKILATSNAFDAATHNVGSHLQGNFIEPSSVSLFKEFMTKFRSSLRSHSNLSLLLITIVALIFFIQQFSILVLLARPQHIHMNTPVDIMNRMNNEVTRSPSDIAWLEKRIHHLKDEMYMVESRLERMRTFIDVIVNHHGTFIDVIVNHNGFELFLENRLAMAARVASGIDLGPPRALLRAPSVIAGTSCNFVLFSFYPSVKGYGSANP

SEQ ID NO: 121470 - protein, 82 aa, Glycine max
  Coding DNA Sequence Number=SeqID_29785
  Subcellular localization annotation: CTP_CleavageSite=71; ConfidenceScore=5.38e-01
MASTVVAAAARSDVPPRQPVVDPSPSSSPDNAANRSDSFNSSPNHFSDAEIQLQTPDVLKSEEYRQLFRLPQEEVSDVPPLR

SEQ ID NO: 121471 - protein, 126 aa, Glycine max
  Coding DNA Sequence Number=SeqID_29786
MAAEWRRKRERRCHFKEKMSLEEAHHHRRPWIRAWRKKEMNEGRGREEHEILCSKRALKSERHNRRHGRKLKNWRVSLSALPSLSAPPSLSAPPSHSVISHMGSQTSRACALMIWCALSTWPLIPH

SEQ ID NO: 121472 - protein, 165 aa, Glycine max
  Coding DNA Sequence Number=SeqID_29787
  Gene Ontology: Mol. function=protein dimerization activity
  Homolog annotation: Hit_ID=Q9C761; Match level="QueryCoverage=87%, HitCoverage=19%, E-value=6e-07, Identity=30%"; Hit description =Transposase, putative
  Pfam annotation: Domain name=zf-BED; Domain location=52-100; Score =55.8; E_value=1.5e-13; Accession=PF02892.6; Description=BED zinc finger
MASEIVNRVDYVDDIEFMEDEEEARVEPKPNAKENRRDNDEKESKKVKVCTSIAWKYFTKIGVVDGKEKAECNACGQQYVIGGSKVGTSHLLRHVKLLCKKKAKFHDVGGMIIDHAGKLRYREVDQKHALELLTMCIVRHGFPFNFVEYKWVRELLSYINSDVKH

SEQ ID NO: 121473 - protein, 179 aa, Glycine max
  Coding DNA Sequence Number=SeqID_29788
MASKKRKAPSTPTQARFDRSKFSSQEAWERYTDIVVPRKILPERNVIIHHTEFDEFTEELERRNWHKELTNFVEGSIDVAIVKEFYLNLYDPEDKQPKQVKVRGHLVKFDADTLNSFLKTLVILEEGENFPIYSRFCRSKPKPQELVARLCIPGRGFELNANGLPLKILRKNLTMLAQT

SEQ ID NO: 121474 - protein, 90 aa, Glycine max
  Coding DNA Sequence Number=SeqID_29789
MSSRTRCMLVSSFVMGSRKVHITFLTAHMGHCTPKCASILESFIFVKCCRSIGDRNCHSLDYRVEPSSCFLEKVHQVKVKYESNQLANWK

SEQ ID NO: 121475 - protein, 45 aa, Glycine max
  Coding DNA Sequence Number=SeqID_29790
MDTSEPYTGAMKGTMHKPQANLGVMTKDNDWYFKALHWGNKGHRA

SEQ ID NO: 121476 - protein, 80 aa, Glycine max
  Coding DNA Sequence Number=SeqID_29791
MAPTRHPLDSEKSNGALGFPAMITGLCQFYEVHVAPSKAANHRGQVQIHECLYRFSLNQQGQGSTPFVCPTPEYFGAEVA

SEQ ID NO: 121477 - protein, 151 aa, Glycine max
  Coding DNA Sequence Number=SeqID_29792
MVDSGGVLECLRVCPKVPLCIEGHSFGEYLFVLGLNKADIVLGVQWLKQLGPVLTDYTTLMMTLIRQALKSVVFHLLAKPICKLSESPLSATHGLSARKTLEEDELYRRLPGYGKLNPLLDLPWSFNSGNWSDSKVLDSTGLSCRTITRNQ

SEQ ID NO: 121478 - protein, 139 aa, Glycine max
  Coding DNA Sequence Number=SeqID_29793
MQEESGNWRPMVGQNYVCLPVSRHVIVLRLSIREPVEDDFGGFKGSSASTRPLSLWTADSSAESHLTRSRRREGTRESAWLVQQLAATTRVAELGPRDEVQRERGGVSVGGDVREGRVGALLMEACLWGFYGGWIFELQ

SEQ ID NO: 121479 - protein, 63 aa, Glycine max
  Coding DNA Sequence Number=SeqID_29794
MVNSWTWESLVSKVFLVGIVGATIGYLWTENDFRLRGRLSYGRDSHLRGKLLEYKCDVKFGIG

SEQ ID NO: 121480 - protein, 70 aa, Glycine max
  Coding DNA Sequence Number=SeqID_29795
MSPRGRSILEVIFSPHTSDTRSSQKNDDLGLIHRWIVVKFEYHVRNPIPKILAVGNFKIMSKLRGKTFAL

SEQ ID NO: 121481 - protein, 364 aa, Glycine max
  Coding DNA Sequence Number=SeqID_29796
  Gene Ontology: Mol. function=phosphoprotein phosphatase activity
  Homolog annotation: Hit_ID=A2Q4S5; Match level="QueryCoverage=54%, HitCoverage=31%, E-value=2e-21, Identity=32%"; Hit description=IMP dehydrogenase/GMP reductase, putative
  Pfam annotation: Domain name=DUF1723; Domain location=155-204; Score =53.0; E_value=1e-12; Accession=PF08330.1; Description=Protein of unknown function (DUF1723)
MVRTRGLRRVVGTGRGRDLSQDVAEDVPRRRRPTGSAHRQRVTQRVEDLAEDVPHASDGSPERTGAADGAETDRVASDGITADDEWFPGGPRDPSVLIGFADHVAHNIWSGRERPDLKLVSHGRKVDKFGRPTAEIKGMIAATGLDPLIRCSVITTDPRLISAFVERWHRETSSFHLPVGEVMITLDDVSSLLHIPITSALHSFEPLVTSDAVALLTELLEVTADEATAETRQAGGPHVRLSWLRDMYQSIQRPGPGRGILFVTPTEDTVESRPAPPPLTHDDDFVEPPIAEVPVASDPLMHSVVDCTACVRMGRIAEHLERAINLRMVTAGTDLYDIMDLCLRIARDDDPDDSLRLRQRPCID

SEQ ID NO: 121482 - protein, 96 aa, Glycine max
  Coding DNA Sequence Number=SeqID_29797
MEDDARGEEEQLQPGRGEKKKNSLLDAWSSGRGRRRTRRWKKLLVAEEEEEIEGGRRSAFGRGRRISNRNILIAGLKRLRIKSILESKRERNVKRE

SEQ ID NO: 121483 - protein, 114 aa, Glycine max
  Coding DNA Sequence Number=SeqID_29798
  Homolog annotation: Hit_ID=A5ADP2; Match level="QueryCoverage=89%, HitCoverage=26%, E-value=3e-09, Identity=33%"; Hit description =Putative uncharacterized protein
MRAFLLCIKCIVDALGSCGDPVLLCEHLDAILEGVPEEYGLVISVVENKFEPLSIGEVEALLLAHEAHMKKFQKRFTDSPSINVARAKHISHAEGTSVSKQFFKHLRFRTKSVN

SEQ ID NO: 121484 - protein, 391 aa, Glycine max
  Coding DNA Sequence Number=SeqID_29799
  Gene Ontology: Mol. function=ubiquitin thiolesterase activity; Cellular component=nucleus; Biological process=ubiquitin-dependent protein catabolic process
  Homolog annotation: Hit_ID=A7QNS3; Match level="QueryCoverage=86%, HitCoverage=33%, E-value=1e-136, Identity=66%"; Hit description =Chromosome undetermined scaffold_134, whole genome shotgun sequence
MSKLLGNTCFRFKFDDERVTKEESKRALEEQYGGEEEKEQDEKELKRKEKAEAHLYTTIKVACDEDLREQIGNNIHFDLVDYDKVRSFRVQINMPFMVFKVGLLREVSTKANNAALKLFLELEMGQDLRPIPPPEKSKENLLLFLKLYEPSNEKLRYVGRLFVNSSGKPEDILVKLNEMAGYDPDQDIDMFEEIKFVPNVMCERVDKKSTFRESQQLEDGDIICFQKSSPQTGSGERYRYPDVPSFLEYVHNRLVVRFRTLEKPKEDEFSLELSKLDSYDNVVEEVAQHIGLHDPSKIRLTSHNCYSQQPKAQSIKFRGMEHLTDMLIHSNQTSDILYYEVLDIPLPELQCLKTLKITFHHATKDEVVIHTIRLPRHSTVSDVINDLKSKV

SEQ ID NO: 121485 - protein, 123 aa, Glycine max
  Coding DNA Sequence Number=SeqID_29800
MQSLQSLGLQPIMSLDEFIRQVARPGVQPSPLGGSEAFAAQEPVPEEDEPIPSESFVDETDPASAHEEVASPEPVPQSSLAPVLDDPQPSAPASVVDQSIVQDPPSALVLDLNEHVEDHPQDD

SEQ ID NO: 121486 - protein, 79 aa, Glycine max
  Coding DNA Sequence Number=SeqID_29801
MGGSAVSATGESGGATASSDDASEMTIREGDGGTTSSSGEEGGCTIGYCGLAGSELTCIGVGSSGAASLGLTNGSWASG

SEQ ID NO: 121487 - protein, 102 aa, Glycine max
  Coding DNA Sequence Number=SeqID_29802
MTPTHDALLYYNGRWNMPHKHDFVGYSFTRKNPKEFHIPSGCTIDKLKDLIMQVVPHEIPPYGIHESQTLKANDDVLNVLVQFNYWKQFGPIEILVVFSKHD

SEQ ID NO: 121488 - protein, 107 aa, Glycine max
  Coding DNA Sequence Number=SeqID_29803
  Homolog annotation: Hit_ID=Q51617; Match level="QueryCoverage=37%, HitCoverage=57%, E-value=1e-11, Identity=85%"; Hit description =Putative uncharacterized protein
  Subcellular localization annotation: CTP_CleavageSite=48; ConfidenceScore=5.50e-01
MAIGVSRGPFVSRVSLMTLKTSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 121489 - protein, 100 aa, Glycine max
  Coding DNA Sequence Number=SeqID_29804
MKKQQWKRRRRGERRRHALGNKQWKKELCHQECALDKKLGEDASMEEKKGRRGEHEIEGIKEGEKWNFEVCLIRLSFIKVTTSVTRASIYRLGSFLEKLP

SEQ ID NO: 121490 - protein, 97 aa, Glycine max
  Coding DNA Sequence Number=SeqID_29805
AVREVLTDYLAQQPSRLSAMHPEFPDEDIMAWAVLVSPDDQCIPFTARLVSYPNFVRGPLLDDMQLLFGPGPLGPSRRFLQKAVASGGSNPARLGEQ

SEQ ID NO: 121491 - protein, 112 aa, Glycine max
  Coding DNA Sequence Number=SeqID_29806
GVVGPVKPADRSDHDVDDPLYLMTLTISQLFLKSLQVMWDAIVFGLFDDNFPLPDNYLKGIINSALKGFDDNPQSKSKAAARWIVVKTKRKDRVRILCHALDVNYNLRNFQE

SEQ ID NO: 121492 - protein, 91 aa, Glycine max
  Coding DNA Sequence Number=SeqID_29807
MSGFTRNSPQISASPHQLDLAPYASEPYHAQWNAPGLLRDKHTLRLSHILGEMEVDEPWIGLWLPLNYHVVFVMGSAVDRLCGRFRDGLCG

SEQ ID NO: 121493 - protein, 234 aa, Glycine max
  Coding DNA Sequence Number=SeqID_29808
  Gene Ontology: Cellular component=viral envelope
  Homolog annotation: Hit_ID=Q84VI1; Match level="QueryCoverage=79%, HitCoverage=27%, E-value=3e-90, Identity=90%"; Hit description =Envelope-like protein
STLEDPPAKRVQHWPKKGKLSAGKLSVKYAILHRIGAANWVPTNHTSTVATGLGKFLYAVGTKSKFNFGNYIFDQTVKHSESFAIKLPIAFPTVLCGIMLSQHPNMLNYTDSVMKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 121494 - protein, 86 aa, Glycine max
  Coding DNA Sequence Number=SeqID_29809
LIKVILVASNLELSDLSSFTGSGVYPDLSSFTGSGVYLDLSSFIGSGVYPDLSSFTGSGVIKTFVACIKQSAPTQVYIIWYQSFGS

SEQ ID NO: 121495 - protein, 200 aa, Glycine max
  Coding DNA Sequence Number=SeqID_29810
  Gene Ontology: Mol. function=hydrogen ion transporting ATP synthase activity, rotational mechanism; Cellular component=proton -transporting two-sector ATPase complex; Biological process =mitochondrial electron transport, NADH to ubiquinone
  Homolog annotation: Hit_ID=Q0JIM3; Match level="QueryCoverage=94%, HitCoverage=9%, E-value=2e-61, Identity=69%"; Hit description =Photosystem I P700 chlorophyll A apoprotein
  Pfam annotation: Domain name=ATP-synt_DE_N; Domain location=97-170; Score=90.3; E_value=6e-24; Accession=PF02823.7; Description=ATP synthase, DeltaEpsilon chain, beta-sandwich domain
  Pfam annotation: Domain name=ATP-synt_ab_C; Domain location=12-113; Score=160.6; E_value=4.1e-45; Accession=PF00306.18; Description=ATP synthase alphabeta chain, C terminal domain
  Pfam module annotation: Pfam domain module=ATP-synt_DE_N::ATP-synt_ab_ C; Domain location=97-170::12-113
MLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVVKEIILSTNSGQIGVLPNHAPIATAVDIGILRIRLLKDQWLTMALMGGFARINNNEITVLVNDAEKGSDIDPQEAQQTLEIAEANLNKGGRQETNN

SEQ ID NO: 121496 - protein, 239 aa, Glycine max
  Coding DNA Sequence Number=SeqID_29811
  Homolog annotation: Hit_ID=Q6WAY6; Match level="QueryCoverage=29%, HitCoverage=15%, E-value=4e-07, Identity=36%"; Hit description =Putative uncharacterized protein
MGTRGCISYNPVLAIRQLGYPMRGAPLEEEIVHVRKAWEVLQKKDKELRGSNNGPIGGYREWLKAHVQGLDWLPSLRATKREEDEAPEEDEGENAELRDVNIATTEALEQETKRARREEHSRNKFRGALWGSNSELKLQREERDQSRTNMLAIISKYQEELSLATAHEHRVADEYAQVYAEKETRGRVIDSLHQEATMWMDRFALTLRGSQELPRLLTKAKAMADTYFAPKEIHGLLSY

SEQ ID NO: 121497 - protein, 225 aa, Glycine max
  Coding DNA Sequence Number=SeqID_29812
  Gene Ontology: Mol. function=hydrolase activity; Biological process =isoprenoid biosynthetic process
  Homolog annotation: Hit_ID=A9DQW2; Match level="QueryCoverage=100%, HitCoverage=100%, E-value=7e-74, Identity=60%"; Hit description =Putative uncharacterized protein
  Pfam annotation: Domain name=NUDIX; Domain location=4-140; Score =89.0; E_value=1.5e-23; Accession=PF00293.19; Description=NUDIX domain
MQNIKVAVDAVIFGYFDKKDLQVLLIKRKIDPFKGGWALPGGLVLDDENLDDAVKRELYEEAGIKPDFLEQLYTFGNVGRDPRNRVVSIAYLGLVNPSYYELFADSDAEDAQWFSVNQLPKLAFDHKGILDIALKRLRTKIQYQPIGFNLLNEEFPFSDLENLYKTIIGQEIDRRNFRKKIMSYGLLNETNNLKKEGSGRPGKLFTFNQEKYKELEEQGFYFEIK

SEQ ID NO: 121498 - protein, 167 aa, Glycine max
  Coding DNA Sequence Number=SeqID_29813
  Homolog annotation: Hit_ID=A6GYJ9; Match level="QueryCoverage=99%, HitCoverage=49%, E-value=3e-66, Identity=74%"; Hit description =Putative uncharacterized protein
MARALETETREKLQQQADEAIYERRNFAVEQERKIKESELNTEIAVEEKQKQIEEKRMETEIQQEENNKILREMKIAADISVENQRKQLIEQKTENDRKEAETQGYVLETSLKPYKEMDWRVLSALSGNQDARSNIALAFRELAENAGKIGNLNISPDLLENLLKQH

SEQ ID NO: 121499 - protein, 114 aa, Glycine max
  Coding DNA Sequence Number=SeqID_29814
  Gene Ontology: Mol. function=NAD+ kinase activity; Biological process= metabolic process
  Homolog annotation: Hit_ID=A6GYK0; Match level="QueryCoverage=100%, HitCoverage=37%, E-value=2e-39, Identity=68%"; Hit description =Putative uncharacterized protein
MKPEYAIIIKNKTRLEALIERFNTKAQARFYIESSGGDFQEYVTEHEKFYQSFLEVQTKLSKIIKNKVVEREFVPSFIFSQKNLIVVVGQDGLVGNVAKYSKNIPIVAINPDQE

SEQ ID NO: 121500 - protein, 80 aa, Glycine max
  Coding DNA Sequence Number=SeqID_29815
  Subcellular localization annotation: CTP_CleavageSite=20; ConfidenceScore=5.12e-01
MMTKVMTKSSKINQRTTQVNQEQFKSSRKESRRIQDSRRKPRIKNQDSRFKISRIKIKIQDSDSRMKKDSIKIVLKVFKL

SEQ ID NO: 121501 - protein, 129 aa, Glycine max
  Coding DNA Sequence Number=SeqID_29816
MFHPATTIPISPYGRIAPTRHPVDSEKPNKALGFPAQVTGLCQSYRVPVPPARSCHRDIGITPARHPVDPEKPNRVLGFLALITGLCQFYEAPVTPNKVIRPPINRAFIKKYCAPRQAQGETPQQPGDG

SEQ ID NO: 121502 - protein, 112 aa, Glycine max
  Coding DNA Sequence Number=SeqID_29817
EPVQTLQRTVEWILPMPTPYRLVEPVQVIEVTSSEEDPEEDLEELPPEPAVDALEFLEWWGIAQTKLESSRPPGHSRSVRTCDVPKQASSWQSTDKRNKDHKARRLVVAGQL

SEQ ID NO: 121503 - protein, 80 aa, Glycine max
  Coding DNA Sequence Number=SeqID_29818
MSGLIRDSPQISVSPHQLDFAPYASGPYNAQWNAPGLLHDKHTEIAVSRIAFMDKWVVGNENGWYWLSNDDVELVGNLAV

SEQ ID NO: 121504 - protein, 84 aa, Glycine max
  Coding DNA Sequence Number=SeqID_29819
  Homolog annotation: Hit_ID=Q6DAD0; Match level="QueryCoverage=100%, HitCoverage=100%, E-value=4e-34, Identity=85%"; Hit description =Putative plasmid stability protein
  Pfam annotation: Domain name=PhdYeFM; Domain location=8-80; Score =56.8; E_value=7.4e-14; Accession=PF02604.10; Description=Phd_YefM
MPFQILSNTAASITDLKRDPMGTVRSAEGETIAILNRNEPAFYCVPPAVYQYLMELAEDAELGRIADERISELADAKEISLDDL

SEQ ID NO: 121505 - protein, 289 aa, Glycine max
  Coding DNA Sequence Number=SeqID_29820
  Gene Ontology: Mol. function=O-methyltransferase activity; Biological process=metabolic process
  Homolog annotation: Hit_ID=Q39B09; Match level="QueryCoverage=65%, HitCoverage=86%, E-value=3e-62, Identity=65%"; Hit description=O -methyltransferase, family 3
  Pfam annotation: Domain name=Methyltransf_3; Domain location=22-197; Score=-42.3; E_value=4.3e-09; Accession=PF01596.8; Description=O -methyltransferase
MAHPTNEAFRVMSDEEQTRLLQSKTDYPELYGHLKDVPLAVSRETGKLLYMLARSSRAQHIVEFGTSFGLSTLHLAAAVRDNGGGRIITSEFEPGKVALARNHFADAGVSDLIEIRVGDALDTLSQDLPASVDMLVLDGAKAIYPEILQLVQPWLRPGALIVADDADFSPEYLEMVHGSRLYTSLPFADGVEVAAMKVTVPLLVIAFASAKAGAFQAKIDPLKLALKPANALASTDQAQPLAIAEAHARLAAAVRRRTARCAATHQSNHGWNGSGNCAQPSGPSAISSS

SEQ ID NO: 121506 - protein, 684 aa, Glycine max
  Coding DNA Sequence Number=SeqID_29821
  Gene Ontology: Cellular component=integral to membrane; Biological process=transport
  Homolog annotation: Hit_ID=A8DGE7; Match level="QueryCoverage=93%, HitCoverage=92%, E-value=2e-72, Identity=29%"; Hit description =Fusaric acid resistance protein conserved region
  Pfam annotation: Domain name=DUF939; Domain location=14-275; Score= -162.5; E_value=0.019; Accession=PF06081.2; Description=Bacterial protein of unknown function (DUF939)
  Pfam annotation: Domain name=FUSC; Domain location=350-468; Score =46.9; E_value=7.3e-11; Accession=PF04632.3; Description=Fusaric acid resistance protein conserved region
  Pfam module annotation: Pfam domain module=DUF939::FUSC; Domain location=14-275::350-468
  Subcellular localization annotation: CTP_CleavageSite=74; ConfidenceScore=5.03e-01
MKWFSRSAVLFSAKTCLAAFLAFYLALELNLDKPAWSLTTVYVASQLYSASTVSKSVFRFFGTVLGGLFTLLIYPATVQSPMLFSLCISLWVAVCLYLSLHDRTPKSYVFMLAGYSAAIMGFPDVTSPGAITYTVISRIEEITVAIVCSSLVHRLIFPVSMRHLLEQSVGLWYQNARKLCSELMTAMPAAKSLEREDILVQMANYPLNVETLITHCVYEGDAARRLVRLVSVQYQHLSYLIPTLTAIESRLNLLAQQQIRFPDYVATAFQQFLQWLNGDAQQPVRDRLTGAQEQLQQAWRAGRLNSEESILLIGLLERLLNFVRIADAYHSVSERVSDWTPAVKPGKASRAHKHVDKGLLLLSCFTAFIATFASCLFWIGSGWRDGSTAPMMAAVLCSFFAGLDSPIAPMKLFLKGVLISMAISLIYVTLLIPQAVTFEALVICLAPGLFALGLVIANPSTNLIGLIVATQIPGLIGMSHHFKPDLQLIVNAMISTLVGIAVALVLTLLIRNKRPAWTATRALRKGIRDLLQFITALRMNTATLTARQQFVARTLDRVNVILPRKRVDPAPELVAGGNLIAEAWLGANCYDYYTRHRHLLLANQIESATMFHELSQFLKQRLKTLYSTPSPALLHELDVLLLRLEAATQQENALFAPLFHLFNIRLSLFPGARWPQPLAEQNRT

SEQ ID NO: 121507 - protein, 113 aa, Glycine max
  Coding DNA Sequence Number=SeqID_29822
MKKSIVPEEFQHYYHDWHFSPVIEADGTLYLSGVTAARKDKPISTHPEEQFHDAFYKLGQRCVYQSPLPGMVCHRRVRVHSGKRPGGNADCGEKGASGGWAKITATAAYVTGL

SEQ ID NO: 121508 - protein, 797 aa, Glycine max
  Coding DNA Sequence Number=SeqID_29823
  Gene Ontology: Mol. function=nucleoside-triphosphatase activity; Cellular component=membrane; Biological process=carbohydrate transport
  Homolog annotation: Hit_ID=A8GKZ7; Match level="QueryCoverage=49%, HitCoverage=87%, E-value=1e-151, Identity=67%"; Hit description=ABC transporter-related protein
  Pfam annotation: Domain name=ABC_tran; Domain location=207-369; Score= 43.1; E_value=2.2e-10; Accession=PF00005.18; Description=ABC transporter
  Pfam annotation: Domain name=ABC_tran; Domain location=7-159; Score =77.0; E_value=6.3e-20; Accession=PF00005.18; Description=ABC transporter
  Pfam annotation: Domain name=BPD_transp_2; Domain location=402-674; Score=68.7; E_value=1.9e-17; Accession=PF02653.7; Description =Branched-chain amino acid transport system  permease component
  Pfam module annotation: Pfam domain module=ABC_tran::ABC_tran::BPD _transp_2; Domain location=207-369::7-159::402-674
AAITLDGKLFHTLTPQLSSYYGIQVIYQDLSLFPNLSVAENIVIHRYLPGGDFWVHRESMRKKALAAMQRVGVALDPDRKVEKLSIADRQLVAICRAIAADASLVIMDEPTASLTRSEVNGLLRVVNELKAAGICVVFVSHRLDEVMEVADRISVMRDGKLPSAAPGARRCDATAGNQPAEPQRAVSQYFAVAAPGRNHVDYRPARQPDSGEIRINGKVVKFHSNRDAIRHGIAYVSEDRLTQGLIMDQSIYDNTLLHTGAGLMDHRKAAAVVKDLIRDLNIKVPDSSLPVKTLSGGNAQRIAIAKWVATRPHILILDSPTVGVDIANKEGIYRIARDLAESGMAVLMICDEIPEAYYNSHRVLVMRKGELVAEFAPHQSSEAQIAEVINGASSSEFMTLGNLTDVATSYAILGILACGLFVVLIAGGIDISFPAVTSIGQYVMASYIIHHGGSFPLAFAMSMGIGLLLGLVNGFLVYWLRVPAIIITIATLNLFYGLLVYLTNGTWLYGFPDWFMNGISWFSFTAADGYDYGLTLPLLCLLGVIIVTGVLMNRTRVGRQIYAMGSNRDAASRLGLNILRLHFYVYGFMGLLAGIAAVHDRRARLANRHHSGRDAAGLPAKWHDPAEHFILLASGVQRRDHSVANHCGRCRAVLLYAGWQFLQRRQFPVDLLAVTDSGHAGAGDGHYHADRRDQPFDHCRCQRVFAGDGGDSGGASEPAGICRAGAACGSGGGAGDWGAQWRADRLYRGFTNSGDARHHDADRRAEYSADQRRGHFRFPAGNSVPQQRQPAGYSGRP

SEQ ID NO: 121509 - protein, 93 aa, Glycine max
  Coding DNA Sequence Number=SeqID_29824
MSGPIIDEVTGARGADVRMALLELAEPSAPYIPGYAHLAFTVEDLDTLLSKASDYGWKTPGKPQTVLLAIDNQRTGQIQIPNREGRGGIEFLF

SEQ ID NO: 121510 - protein, 108 aa, Glycine max
  Coding DNA Sequence Number=SeqID_29825
ILARRDKLWSFCTLCHPEATGPMTCGDKIWLFRTPLPFRHSRVRWHAETNYGHSAPFCHPEAVGPMTAEQNLVYLHPLCIEDEKPDSTQRHKFGHSANPFVNQAANAR

SEQ ID NO: 121511 - protein, 129 aa, Glycine max
  Coding DNA Sequence Number=SeqID_29826
MGEIEEVQKEMKADMEAMKEQMTTMMSMRKMMEVNMVIVVAASAAIEVDPTHPSSINQASCPVPDMVQSKHPLPLYGFPPNYTPPNVAHTPDENVDNFAPIPIESQKANLIMHMSLNPWGRMKHPKTTI

SEQ ID NO: 121512 - protein, 70 aa, Glycine max
  Coding DNA Sequence Number=SeqID_29827
MWLQDREKDRLFLLLSQVLLTQPGVDDDSTFSRVSIRSGDSSCFSWAIESTENGITAVRVSAASLSKSGT

SEQ ID NO: 121513 - protein, 102 aa, Glycine max
  Coding DNA Sequence Number=SeqID_29828
MTSKWISPHIQTVLLKRQPSRINQALYFVLEGHTLLYGMPRNTTVIGAGCVGIVPPRGCINESANARGEAVCVLGALPLPRSLTRCARSFGCGERYQLTQRR

SEQ ID NO: 121514 - protein, 140 aa, Glycine max
  Coding DNA Sequence Number=SeqID_29829
MATIVVQNYWSNLTAEQAEKLAAKVGGTIAGKMAFNYIALSQILILFFEKAIARFIFSLGIGSIFSIGAAASDSVYSSNDLKARNPKIYNELRSNGDLDLLYFLLKEYLDPYLEAIELQSASPTLSNNIFNVYVDGIRNV

SEQ ID NO: 121515 - protein, 134 aa, Glycine max
  Coding DNA Sequence Number=SeqID_29830
  Gene Ontology: Mol. function=nucleoside-triphosphatase activity; Cellular component=integral to membrane; Biological process=protein catabolic process
  Homolog annotation: Hit_ID=A7NYK3; Match level="QueryCoverage=69%, HitCoverage=20%, E-value=8e-13, Identity=43%"; Hit description =Chromosome chr6 scaffold_3, whole genome shotgun sequence
PKQQCRPSICIGEIDNQVDTAHSHDSHMCRLSMLKHNLTLDETELELHKAKPHGQIREGADVRSCAAMIMNEGQMRINDMIVPMLDPLISLQGIEEKTAKLKGSEKALVARHEASHAVLGTAVPNLLAGQPHVE

SEQ ID NO: 121516 - protein, 109 aa, Glycine max
  Coding DNA Sequence Number=SeqID_29831
MVVSIVDHLMSTASSMDPVEKKIVRSHDVKFMEDQIIEDIDKNMNTDVQNDVDVQQPGDEVDVPVDDDDEEEHDMSQDENLGDATKPPQVQLRRSNGERQPSKRYSPNE

SEQ ID NO: 121517 - protein, 20 aa, Glycine max
  Coding DNA Sequence Number=SeqID_29832
MRTLKFYESFQSIGTEDVES

SEQ ID NO: 121518 - protein, 130 aa, Glycine max
  Coding DNA Sequence Number=SeqID_29833
  Homolog annotation: Hit_ID=A2Q3D2; Match level="QueryCoverage=65%, HitCoverage=15%, E-value=3e-08, Identity=31%"; Hit description =Putative non-LTR retroelement reverse transcriptase, related
VQDMVIQQHGPDVWEWTTDPTGQYTANNAYKVIMGGATEITQEECFVKLWSIKVPRKIAIFAPRLIRNRLPTRQSLQWRQVQVADTSCQFCRDSEDDAIFILWTWLRNFEKGFTEHFNHWCSSIRQAFLY

SEQ ID NO: 121519 - protein, 76 aa, Glycine max
  Coding DNA Sequence Number=SeqID_29834
MAGEEKRNKKELIQHLQPELDQQIQEGGRQLVQPINTVSTWKADDILLLTVQPVNLKSMKKRWKKSFRRKLCKMIC

SEQ ID NO: 121520 - protein, 141 aa, Glycine max
  Coding DNA Sequence Number=SeqID_29835
  Homolog annotation: Hit_ID=UPI0000ECBAF8; Match level="QueryCoverage =29%, HitCoverage=48%, E-value=3e-16, Identity=97%"; Hit description =UPI0000ECBAF8 related cluster
MRKRHASRREKGGQGETPGIFIVLSGFATSDLSVDFCDARQGGGAYGKTPATRPFYADTARRSRTTERSESVSEEAEERPIRKPPLPARMQAWHWPAFYNVVTGKTLALPNLIALQHIPLSPAGVIAKRPAPIALPNSCAA

SEQ ID NO: 121521 - protein, 95 aa, Glycine max
  Coding DNA Sequence Number=SeqID_29836
  Homolog annotation: Hit_ID=A6FJQ2; Match level="QueryCoverage=40%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARAKRGVKSHIAT

SEQ ID NO: 121522 - protein, 86 aa, Glycine max
  Coding DNA Sequence Number=SeqID_29837
MMKKVMTKSSKINQRTTQVNQRSIKNNSRVQDKNQEEFKTQEESLETRIKIQGSKISRIKIKIQDSRFKNKEKTQSRQVLKSFSKL

SEQ ID NO: 121523 - protein, 76 aa, Glycine max
  Coding DNA Sequence Number=SeqID_29838
  Subcellular localization annotation: CTP_CleavageSite=44; ConfidenceScore=5.59e-01
MAESSKKRKGSSASASASRAHRSGATSASKAPIPPSLSSSPLFSSEEQQKRYSNLFSSHSIIDPKFIDMDSSLMNL

SEQ ID NO: 121524 - protein, 223 aa, Glycine max
  Coding DNA Sequence Number=SeqID_29839
  Homolog annotation: Hit_ID=UPI0000ECBAF8; Match level="QueryCoverage =18%, HitCoverage=48%, E-value=3e-16, Identity=100%"; Hit description= UPI0000ECBAF8 related cluster
PRFPEGRKADRYPVSGRVGTGERTRELPGGNACLWKNASNAAFVRFLAFCWPFAHMFFPALSPDSVDNRITAFEKRKSAQYANRLSPRVGRFINAAGTTGFPTGKRAVSATQLIYDHDYEFELGTHGPWVQIATRLQGESKRVSLGMQGRETILERGVREVKQETLTDSEGMQAWHWPSFYNVVTGKTLALPNLIALQHIPLSPAGVIAKRPAPIALPNSCAA

SEQ ID NO: 121525 - protein, 247 aa, Glycine max
  Coding DNA Sequence Number=SeqID_29840
  Gene Ontology: Mol. function=protein binding; Cellular component =plasma membrane; Biological process=metabolic process
  Homolog annotation: Hit_ID=A4W9U1; Match level="QueryCoverage=88%, HitCoverage=85%, E-value=3e-78, Identity=69%"; Hit description =NLP/P60 protein precursor
  Pfam annotation: Domain name=NLPC_P60; Domain location=161-246; Score= 95.2; E_value=2.1e-25; Accession=PF00877.10; Description=NlpCP60 family
IDGLCKSHAGIIDGLHISGDCPVARINKISITLCALLFTSLTFTPVANASQQARHSAVQKNHLVKTTERKKKTTAKNDKKKTPANTKQTASSKTKTTSSRTARTAKSKASQTAANLVTEKCITRKGHKAKCTKVTKLAEVHKVRVQKAQKTAMNKLMGQIGKPYRWGGTSPRTGFDCSGLVYYAYKDLVKFRIPRTANEMYHLRDASPVNRGELENGDLVFFRTQGRGTADHVGVYVGNGKIHPVAA

SEQ ID NO: 121526 - protein, 34 aa, Glycine max
  Coding DNA Sequence Number=SeqID_29841
LSPIRPPTNRAFIKKYCAPRQAQGETPQQPGDSR

SEQ ID NO: 121527 - protein, 101 aa, Glycine max
  Coding DNA Sequence Number=SeqID_29842
MKLAKYRLKAQVEKDKAPEWRRMKAQVEKDEGPEAETLSRQLITYQGNPCGVYPDLSSFTGSGVYPDLSSFTGSGVYPDLSSFTESGGIQISVACIKRSAS

SEQ ID NO: 121528 - protein, 46 aa, Glycine max
  Coding DNA Sequence Number=SeqID_29843
MEERKSKRRHKQQVLALVMGPPMPCIGLGLPSGHGPGAGDCHGLGL

SEQ ID NO: 121529 - protein, 64 aa, Glycine max
  Coding DNA Sequence Number=SeqID_29844
VDSRGSPTVPGPPPDIGGGPTVRAQPEREAITQLLCIPGQDFTRAAAKRRVRIMRTNMTTLTQI

SEQ ID NO: 121530 - protein, 31 aa, Glycine max
  Coding DNA Sequence Number=SeqID_29845
MASGKFEADSLDNASISKSKGTKLPVGDLCI

SEQ ID NO: 121531 - protein, 223 aa, Glycine max
  Coding DNA Sequence Number=SeqID_29846
MGDQEETQEQMKADMSALKEQMASMMEAMLGMKQLMEKNAATAAAVSSAAEADPTPLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPATEERRKLDLLEERLRAVEGFGDYPFADMTDLCLVPDVVFPRASKCRLRQV

SEQ ID NO: 121532 - protein, 166 aa, Glycine max
  Coding DNA Sequence Number=SeqID_29847
MPWDISTVVYPVIFLHLASLAPENLDNSKIRPVVILFHYGESWNLLRADQRLIFAKSWPRASRYQQGHQDLFILRSDLPSQHRRTSALASVAVTLRVTTTPAALNAPLQGASHSPFRLRNCWEGRSVRASSLLRQLAKGGCAARRLSWVTPGFSQSRRCKTTASEL

SEQ ID NO: 121533 - protein, 169 aa, Glycine max
  Coding DNA Sequence Number=SeqID_29848
ENFSPISPSGFNLLKRSAGIIEKRKALYVLVLGAPVKGLTSDVWKYVVEVNSSEMQPEGNLSFDPHMAMVQIQTKDFLSCFDLSGSRLFKIFRIVTAPFIAIRETALFPQDGPSCFCLMETRVQVQTFRNQDMAGAGFEPAIFSYEPDEYQLLYPASSPSLSFLSRFPP

SEQ ID NO: 121534 - protein, 64 aa, Glycine max
  Coding DNA Sequence Number=SeqID_29849
MGVQIATRPTWALLACLGELGGKLLPHFLINKGRSEEKFRSALLVFDRSSTFFIRSSSFFGLQL

SEQ ID NO: 121535 - protein, 179 aa, Glycine max
  Coding DNA Sequence Number=SeqID_29850
MIMRGQDIYSSQDKATTSPSSSESEKSKGEESSEEIYPQEEGQPLVVKEKCKEVSVSSKRLAKKETHFTIKTNIEETFPLRQPPHFLFCKKTLASIATPLGLEFIPQVKKLLDEGLVRKSFIPCALLVPKIGIIRHQVPKICGMMNVLSGATLFCKITRTPNIFMVLREGAQSMKNLGI

SEQ ID NO: 121536 - protein, 128 aa, Glycine max
  Coding DNA Sequence Number=SeqID_29851
  Subcellular localization annotation: CTP_CleavageSite=32; ConfidenceScore=5.27e-01
MAEPSKKRKGTLSQSQRHSGSQKMPIPSSIPSGSLFSSEEQCIRYTKLFSSRSIIDPKFIDMDFFSNESFECFQAFENSNLIPFMSLKLPVYSELVKAFYSNLEIHEGTLMSKVYGIKMVIDQSLFYD

SEQ ID NO: 121537 - protein, 157 aa, Glycine max
  Coding DNA Sequence Number=SeqID_29852
MAKFDPDIVLEFYANAWPIEEGVRDMRSWVKGQWIPFDADALSQFLGYPLVLEEGQECKYGQRRNRADGFNEEAIAQLLCIPGQDFAWTATGRRVQIMRTNMTTLTQIWMTLLLSNIQPSDHNYDLPLLKCQLVYAILTRMSIHVAQLIADAFYLFA

SEQ ID NO: 121538 - protein, 98 aa, Glycine max
  Coding DNA Sequence Number=SeqID_29853
MTKLVSAVMGPRLWMTKGWRHMPQGQYDKDYGAADKSKALALHLKSLHRKMLTSPERAQMTILVSARESHLGSLNDEVRITVRCLRGLPALELWQQKA

SEQ ID NO: 121539 - protein, 70 aa, Glycine max
  Coding DNA Sequence Number=SeqID_29854
MTTGSSVYSTSIHHFELYTEVMEAIVPTVDKIRAPGSAHSQGLDSHVQTSHASRCGHHHRYSRYCVWRGG

SEQ ID NO: 121540 - protein, 143 aa, Glycine max
  Coding DNA Sequence Number=SeqID_29855
MPPTRHPLDPNKSNRALGFPALITGLCQSFGVPVTPSKVIRPPITRAFIEKYCTPRQPAANHRAHVQTHDCLYQLSLSLQSQGFTSFPCPTPDQFRAEVAWPGDWPEAQAGEALVEVPGDADEARMDEEMTDLLDFLGGSGAT

SEQ ID NO: 121541 - protein, 270 aa, Glycine max
  Coding DNA Sequence Number=SeqID_29856
VDSRGSHPRLSSWQGKPGRRHFGHEGRIKILSSCEGCPMRGVPSDESITPFIARGFSDHNARDRELRGSSNGIIGGYHKWLRVRIQGLDWLPNLKTVRDDEVKASEESDEVQALKAELERAWVVEEKFKSIAIKGSIVSSSSEEVKGIITGQRHDLKDELKVCLRSKRNLSQQLSETEGNMWAIIDKCKENLNLAVTHEQRLEDEYAKISAEREARERVIDSLHQEATMWTDRFALTLNRSQELPPLLAKAKAVADTYSAPEEIHGLLSY

SEQ ID NO: 121542 - protein, 361 aa, Glycine max
  Coding DNA Sequence Number=SeqID_29857
  Gene Ontology: Mol. function=protein binding; Cellular component =chromosome; Biological process=chromosome organization and biogenesis
  Homolog annotation: Hit_ID=A1FSC1; Match level="QueryCoverage=98%, HitCoverage=30%, E-value=1e-146, Identity=79%"; Hit description =Chromosome segregation protein SMC
MTRPALVDALGELGEGHIALVANDGADLKVAPTSLAARVRGPAAIRRLLAHLHGARDLAEAKALQASLPEGDSTITQGGERLGEGWLRVSRSGAAQQGALLREREINELREQIEQLQDREAELEEQLSGFREQLQAAEQQREDAQRALYQAHRAVSELAGQLQGQQGKVEAARTRIDRIEGELKQLQDTLEANNEQAREARSRLENAVSSMGDLESTRQRLEGERRQLTEARDLARDAARAVRERSHSLALTLESQRAQLASLSQALERMGTQRGQLDSRLGELHSQLDEGDSPVESLQAEHQNALEERVRADRVLTEARTLLDGIDAELRNYEQTRHQRDEQALAQRERISQRKLDQQAL

SEQ ID NO: 121543 - protein, 92 aa, Glycine max
  Coding DNA Sequence Number=SeqID_29858
  Homolog annotation: Hit_ID=A7QL08; Match level="QueryCoverage=42%, HitCoverage=53%, E-value=1e-11, Identity=92%"; Hit description =Chromosome undetermined scaffold_116, whole genome shotgun sequence
MLHSARGDIAQLVELRSCNWVVAITGWMSNCPGGLKKDLRVSRVVPGGSLNAFLFLLIGVISQRLAMVKKKGEQAHLESAVQRIVVCCVREG

SEQ ID NO: 121544 - protein, 69 aa, Glycine max
  Coding DNA Sequence Number=SeqID_29859
  Subcellular localization annotation: CTP_CleavageSite=46; ConfidenceScore=5.17e-01
MGVQIATRPTWALQKIPPEGCCFWRKQPCSPGRAGKSKPRRFHNVSVSDFAKVFIRSSPFFIRSSFFNV

SEQ ID NO: 121545 - protein, 85 aa, Glycine max
  Coding DNA Sequence Number=SeqID_29860
GGRIASGLPSAVEGREKNNLIEERLRVVEWFGDYPFANMTNLCLVSDVVIPPKFKVERLGGSSGTSYAGKGDDCHDSRHSAGVLL

SEQ ID NO: 121546 - protein, 273 aa, Glycine max
  Coding DNA Sequence Number=SeqID_29861
  Homolog annotation: Hit_ID=Q2HW90; Match level="QueryCoverage=63%, HitCoverage=39%, E-value=3e-20, Identity=30%"; Hit description =Putative uncharacterized protein
MGSSQKPSLKKKFYQVKIKSLEVTSLQELGQLMGQLQRQAFRKAYGKIWDLARVEVSTESIASLSQYYDQPLRCFTFEDFQLVPTVKEFEEILGCPLGGRKPYLFSGFYPSTTRVAKVVKISAQELDRVKQNRNGVVGVPRKCLEGVLFPNVDGLVDLVAIDIFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFP

SEQ ID NO: 121547 - protein, 133 aa, Glycine max
  Coding DNA Sequence Number=SeqID_29862
TLVSTATPLRLEVIPQVKELLDEGLVHKSLNPCAFLVPKIVMHPTSGEIHVHRDSLGRLVLIFGFNTNIGAHMGHLSDQGVLMNPKRIKVIPEWPTPPSVEGRSPKFQEPLDLRSNPFQGGGNDAILPPKGIG

SEQ ID NO: 121548 - protein, 105 aa, Glycine max
  Coding DNA Sequence Number=SeqID_29863
MIFLGSLYRQNQFLLYESDHHTPRDIGIRSHFDPFGEIIYRHENEAMTVRSFGFDGPNDIYPPHGKRPRGGHDVQRMGRNIDIVCVRLTFIDGSLLVGLLWRLDL

SEQ ID NO: 121549 - protein, 36 aa, Glycine max
  Coding DNA Sequence Number=SeqID_29864
GGGGGVGKSFQLLDLIAALAELVAKVLEMTTYKWDS

SEQ ID NO: 121550 - protein, 69 aa, Glycine max
  Coding DNA Sequence Number=SeqID_29865
MEEGVSPPRSALDKKLREDASMEEKKEGEKERGGSTKLKEEKGREVASLRSFLEKTSLRSFFEKTSLRI

SEQ ID NO: 121551 - protein, 101 aa, Glycine max
  Coding DNA Sequence Number=SeqID_29866
MGFNRRYSPQAYPYGLPPDFTPHTTPDNLSQAPTFEGQLPPHADYPLEEDDKGDAHLGPLLPPREPTPHELPQPNIIHHASVSIRTHLEEPVPPKDKGKIV

SEQ ID NO: 121552 - protein, 169 aa, Glycine max
  Coding DNA Sequence Number=SeqID_29867
  Homolog annotation: Hit_ID=UPI0000ECBAF8; Match level="QueryCoverage =24%, HitCoverage=48%, E-value=1e-16, Identity=100%"; Hit description= UPI0000ECBAF8 related cluster
VSYEKAPRSRREKGGQVSGSGRVGTGERTRELPGGNACLWKNASNAAFLRFLAFCWPFAHMFFPALSPDSVDNRITAFEKRKSAQYANRLSPRVGRFINAAGTTGFPTGKRASRPAGMQAWHWPSFYNVVTGKTLALPNLIALQHIPLSPAGVIAKRPAPIALPNSCAA

SEQ ID NO: 121553 - protein, 204 aa, Glycine max
  Coding DNA Sequence Number=SeqID_29868
MDNEKGVQEQMKADLSALKDQMASISEVMLKLQKTIEDKATSTASNTARKAEPVLQPALNLGRDRNTTVFGRRYSPQAYPYGLPLDFTPRAAPEDLSQAPTFEGQLPPYADYPVQDDEEGDTHLGPLLHLKDPSPHELPQPNIVRHVPSSPAPVIESIPFAEDKGKIDALEERLRAVEGLGNYPFSDLADLCLVPNIVIPPKFK

SEQ ID NO: 121554 - protein, 112 aa, Glycine max
  Coding DNA Sequence Number=SeqID_29869
MGEVEEVQNHKKADMEAMKEQMATMMEAMMSMKKIMEANAVVVAATRAIATVNPMPPSDLNKMNHPTSDMVGEDLGSTDDPMMCKFKTSTLSHHMACLPTIRHPMWRTLPMR

SEQ ID NO: 121555 - protein, 93 aa, Glycine max
  Coding DNA Sequence Number=SeqID_29870
MKQTSRSAFIARSQQPVPDIKKATIEELFNLEKIFEKDHLKSYISLIFYSERVTDTLVIGNQLPESKNSGNLENFEKIFCLREKESKFSTVLF

SEQ ID NO: 121556 - protein, 145 aa, Glycine max
  Coding DNA Sequence Number=SeqID_29871
  Subcellular localization annotation: CTP_CleavageSite=41; ConfidenceScore=5.34e-01
MVWGSSPLVLSKSDTLNLGGVMILGTRNNSSRGISLTACPSVHMGASGVVIGSAVDRLCGRFRDGAFVDNWVVGKEKVCYWLSKDIVGLSGKLGRTGWQSQHGFLLSSSPSLFAPVFSVVLVGSNLPLFGPTLILSLAKTKSAKL

SEQ ID NO: 121557 - protein, 152 aa, Glycine max
  Coding DNA Sequence Number=SeqID_29872
METCLGVEELLQQMIDQGRLEVSSEGREEQHICMQSTDGSSVTKPKPLVIYFTKGTASQKPGHPLATKPVLSHTKIATQSHGDIHLRRGRKKKPPTSARCRLSGRVFAPPDLPVQPANVKGKGKVVEEQDGEAPHASNKDVPGERSSGEKGW

SEQ ID NO: 121558 - protein, 69 aa, Glycine max
  Coding DNA Sequence Number=SeqID_29873
MTSETVNRVDSVDDIEFMEDEEEARVEPKPNAKENKSDNDEKKSKKVKSPEWLVHNSIRSHFFLITHNL

SEQ ID NO: 121559 - protein, 67 aa, Glycine max
  Coding DNA Sequence Number=SeqID_29874
MKMLLIPHDVTPCGACRPWIFFINGVLSFLKFNGSEMEKEKDDWRCHFKEKMSQEEAHHHKKPWIRA

SEQ ID NO: 121560 - protein, 183 aa, Glycine max
  Coding DNA Sequence Number=SeqID_29875
MASLVDWLTKLKVVSEESFEAPEEDEEVQALKSELGKAKLAKEKFKLAATHIRKECTGALEQETKRARKEEYGRNKFRGALWGSSSELKLRREERDQSRAHSMVLKEELVACSRSKRSLSQRLCETETNMLAIIAKYQEERVGNQLTVLPPIPAKCWSQSTLFFRHMSDGFGVQTWMPYVLLE

SEQ ID NO: 121561 - protein, 50 aa, Glycine max
  Coding DNA Sequence Number=SeqID_29876
MHSQDVFANETTHPVFPDESHKPIKPDPDTPYQPIEPEEPDVQPEIIGDQ

SEQ ID NO: 121562 - protein, 132 aa, Glycine max
  Coding DNA Sequence Number=SeqID_29877
  Homolog annotation: Hit_ID=Q949K7; Match level="QueryCoverage=37%, HitCoverage=57%, E-value=1e-08, Identity=50%"; Hit description =Putative gag polyprotein
MGEYAKDEELLIHFFQESLTGVVVTWYTYLEPSRVHTWKDLMVAFTHYRYSTMKRWWAAHPQSFADLVFASERINVGPKKGKFDHPTRTTEKTGANKEGEKEGETHVVTAIPAIPKSTTKSVYRTSNDEHHL

SEQ ID NO: 121563 - protein, 173 aa, Glycine max
  Coding DNA Sequence Number=SeqID_29878
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPARGWGKCCVSGCSDILVNDAEKVNMDFLFM

SEQ ID NO: 121564 - protein, 40 aa, Glycine max
  Coding DNA Sequence Number=SeqID_29879
MYIRVWKWPRGNLPQRDPGRIKRSKELVLLLSMTITALGA

SEQ ID NO: 121565 - protein, 41 aa, Glycine max
  Coding DNA Sequence Number=SeqID_29880
MGRGQVVRQRVLVPLFGDIIENLQQLATKAKMIKRVKVLLA

SEQ ID NO: 121566 - protein, 74 aa, Glycine max
  Coding DNA Sequence Number=SeqID_29881
  Subcellular localization annotation: CTP_CleavageSite=45; ConfidenceScore=5.08e-01
GLVGACTLSATLDRLACISEFRLSARLLTQRMDSSGALGGMSPRSANMHSSSFFQIFPRAQPREWCALEDPRVS

SEQ ID NO: 121567 - protein, 78 aa, Glycine max
  Coding DNA Sequence Number=SeqID_29882
MGLRIRFDGGGCTNSARQSIRGALDSMAINSWSSGLDGGGCMNGNQFMGLRIRFDFGGYTNSARQSIRRAPDSMVEDA

SEQ ID NO: 121568 - protein, 72 aa, Glycine max
  Coding DNA Sequence Number=SeqID_29883
MDRQKFLTGRLSYPNFVRGPLLDDMRPFFGPCEKAVASGGSNLARLGELGGKHLPYFAINRGGSEEEKGSAP

SEQ ID NO: 121569 - protein, 151 aa, Glycine max
  Coding DNA Sequence Number=SeqID_29884
MASKKLFAKRSKRDAAAEGTSAAPEFDSHHFRSAEHQQRFEAIKGWLFHRERRVQLRDDEYTDFQEEIARRHWTSLATHMAKFDPEVVLEFYANAWPPEEGVWDMRSWLRGQWIPFDVDAFSQFLGDPLVLEEGQECEFGQRRNTADGSTR

SEQ ID NO: 121570 - protein, 69 aa, Glycine max
  Coding DNA Sequence Number=SeqID_29885
MWWSIDIVRERLTLMAFPYKDAAITFHGEPVITCPQDLPGHSMPIGVHSKRTLMDFLDHVVRLFGIIAS

SEQ ID NO: 121571 - protein, 80 aa, Glycine max
  Coding DNA Sequence Number=SeqID_29886
MSKSYGFGMTGPLDESISCFLIRRTTHPRLQRTARPHLERTTRPRLQRTTRPHHQRATRPHLQRTTCPRLERLHALTFGY

SEQ ID NO: 121572 - protein, 91 aa, Glycine max
  Coding DNA Sequence Number=SeqID_29887
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=98%, E-value=2e-09, Identity=37%"; Hit description =UPI00006A17C9 related cluster
  Subcellular localization annotation: CTP_CleavageSite=57; ConfidenceScore=5.58e-01
MVRTCSPLKVRACSPLKARTCSPLEVRACSPLMVRTCSPLKVRACSPLMARTLPKVRACSPLKARTCSPLKVRACSPLMARTCSPLTGEGN

SEQ ID NO: 121573 - protein, 38 aa, Glycine max
  Coding DNA Sequence Number=SeqID_29888
GLLYGPGVGQGTAAGQAVEGIARQPEAEGKIRGNLPID

SEQ ID NO: 121574 - protein, 240 aa, Glycine max
  Coding DNA Sequence Number=SeqID_29889
  Subcellular localization annotation: CTP_CleavageSite=86; ConfidenceScore=5.59e-01
MSDKKGSTSNHGLNLNIPPPRVANQIPDSPTRLPIAPPTSPSSSCVSSELSQDDNSSNNNNNNNRGCTRSPEDISMVLVGCSRCLMYMMVNEGEPNGADVDYGSGGGNIDDNCVFGEDGSRCIGGDHSSSVGAYGYGGGGSGADGGGGNSDSGADDNVGGGRGAGAGGSIVAQSVKFRNIPEAKAGMITGVQIAIRPTWAFQKVPPEGGAFWRMRWVASSSLFSPIDRGRRAEGKCSTLL

SEQ ID NO: 121575 - protein, 99 aa, Glycine max
  Coding DNA Sequence Number=SeqID_29890
  Subcellular localization annotation: CTP_CleavageSite=51; ConfidenceScore=5.07e-01
MVVVVVSMSVMAMVVAILTTIVVVATMVVVALVVIVVAILMVVVVVVVAIKMKMVKSLALDTRSLLCKERVGTTNTFCNISSEEYSLPVFHIAQSSLSM

SEQ ID NO: 121576 - protein, 29 aa, Glycine max
  Coding DNA Sequence Number=SeqID_29891
MGAKYLEVVKQRLHAIKQWSVDEIRGSIM

SEQ ID NO: 121577 - protein, 161 aa, Glycine max
  Coding DNA Sequence Number=SeqID_29892
  Homolog annotation: Hit_ID=Q6WAY6; Match level="QueryCoverage=49%, HitCoverage=13%, E-value=1e-10, Identity=37%"; Hit description =Putative uncharacterized protein
EGVLFSCGSYPNIPLIGTRGCINYNPALAIRQLGYPMRGASMEESLSPFLVRDFGAQNFKVIQRVHKAWENPLRKDKELRGICNGIIGDVRKECAGLLEENAATAKALEQETKRARKEEHGRDKFRGALWGSNSELKLRREERDRSRAHSMVLKEELAVCS

SEQ ID NO: 121578 - protein, 50 aa, Glycine max
  Coding DNA Sequence Number=SeqID_29893
PPTNQAFIKKYYAPRLAQGETPQQPGDGLQRETDAPPPPLEFTSAHPQKG

SEQ ID NO: 121579 - protein, 151 aa, Glycine max
  Coding DNA Sequence Number=SeqID_29894
  Gene Ontology: Mol. function=aspartic-type endopeptidase activity; Cellular component=small subunit processome; Biological process=DNA integration
  Homolog annotation: Hit_ID=A5C163; Match level="QueryCoverage=80%, HitCoverage=9%, E-value=9e-22, Identity=40%"; Hit description =Putative uncharacterized protein
  Pfam annotation: Domain name=zf-CCHC; Domain location=108-125; Score =12.0; E_value=0.023; Accession=PF00098.14; Description=Zinc knuckle
MAPIIVEELRKFLVADSLEEVNRKLDKFYMVLILRSLHSDFDHVRDQVLAGDQVPSMNSLVTRLLRVPHVLKDENPADVVETSAMVAPHRRRGGRKNREGHSGKGGRPHCTYCKRMGHTQENCYSLHGFPDKVVQVSRLEKSESRFYDEEY

SEQ ID NO: 121580 - protein, 32 aa, Glycine max
  Coding DNA Sequence Number=SeqID_29895
MDEWNGFERTRLKMKWWKERITLSSEGNTQRM

SEQ ID NO: 121581 - protein, 77 aa, Glycine max
  Coding DNA Sequence Number=SeqID_29896
  Subcellular localization annotation: CTP_CleavageSite=68; ConfidenceScore=5.35e-01
MGVQIATRPTWALQKIPPEGCCFWRKQPGSPGRAGRKSQLRRFRNVSVTLSVKEFREGFDRSSTFFIRSSSFFDLQR

SEQ ID NO: 121582 - protein, 135 aa, Glycine max
  Coding DNA Sequence Number=SeqID_29897
MKQAKYSLKAQVEKDEGQVEKDKAPEWRRMKAQVEKDEGPEAETLSRLLIVAEGPSNPYGIYPDLSSLTRSGVYPDLSSFTGSGVYPDLSSFTGSGVYPDLSSFTGSGVIKTFVACIKRSAPTQVHIIWYQSFGS

SEQ ID NO: 121583 - protein, 199 aa, Glycine max
  Coding DNA Sequence Number=SeqID_29898
  Gene Ontology: Mol. function=protein dimerization activity; Biological process=DNA integration
  Homolog annotation: Hit_ID=A3BRV8; Match level="QueryCoverage=92%, HitCoverage=25%, E-value=5e-37, Identity=44%"; Hit description =Putative uncharacterized protein
  Pfam annotation: Domain name=zf-C2HC_plant; Domain location=18-76; Score=5.5; E_value=0.0095; Accession=PF07567.3; Description=Protein of unknown function, DUF1544
MSASSPSQAKEQDDDTKPLWTYVTKIKSVAGGGNYEIKCNICDFTFNGSYTRVRAHLLKMTGKGVRVCQKVTVAKLIDLKKIDKKATLRVERSKTKSVSLPPVSTQHQMDTNTLGVDPKKRKTSSVENAFNLQARETLDHEIARMFYSSGLPFHLARNPHYRKAFAYAANNQISGYQPPGYNKLRTTLLQNERRHLGIL

SEQ ID NO: 121584 - protein, 154 aa, Glycine max
  Coding DNA Sequence Number=SeqID_29899
LIKVILVASTLTYLPSLEVASTLTYLPSLEVASSKLCNMYQAIRPAGTRRGTTAAWVTANSGQQTHCHHLQSSPKLIHKKARALPATHVRPEGDQVQSQSSSRSGPGRAPLNRVPVRPHKPTQALTNTDSRAWNISSVLRPSRDGHSSDRDRGS

SEQ ID NO: 121585 - protein, 114 aa, Glycine max
  Coding DNA Sequence Number=SeqID_29900
  Subcellular localization annotation: CTP_CleavageSite=9; ConfidenceScore=5.24e-01
IPTFKRSARPSIGRNSPPLLISPNPLNSLKNDSKNGEERRRTCRDTFAKCETRGMRVPRKEYARSRHQRLFEENVGKTGKNAIYELLSERFGSCMCARGKVLAPHTSVPRDDSL

SEQ ID NO: 121586 - protein, 118 aa, Glycine max
  Coding DNA Sequence Number=SeqID_29901
GGEPMEKRQQRGLLRFLAFCWPFAHMFFPALSPDSVDNRITAFEKRKSAQYANRLSPRVGRFINAAGTTGFPTGKRAVSATQLIYDHDYEFELGTLIECKRVWPNSVFHSPRKPVFTR

SEQ ID NO: 121587 - protein, 66 aa, Glycine max
  Coding DNA Sequence Number=SeqID_29902
MGHCFTTPYRTRARARVMGEVEEIKRRFLRLSTWRPLRENGHQYGGHDREEDNGSQCCLPLTIVAK

SEQ ID NO: 121588 - protein, 164 aa, Glycine max
  Coding DNA Sequence Number=SeqID_29903
LALVKEFCANLYSSEGPSPKQSRVRGHLVKIDAGSINTFLETPVVLAEGETLPTYSRYYRLPTDYREIEAALCILGRGFILNTEGHPRKILKKDLTTLAQVWRVLSYSNLAPTSYTSDLTVDRARARARPLELLSTFAAPTPASTSVASSVPAQTDSQCFEAML

SEQ ID NO: 121589 - protein, 85 aa, Glycine max
  Coding DNA Sequence Number=SeqID_29904
MQQGQADILIARFPDPNYGVKMGSSQCGFSMENNDGLWWLMEDTKFREDLTVNEGWAAFLPRQLHVAFSRSFIKRLPPEASSWLL

SEQ ID NO: 121590 - protein, 86 aa, Glycine max
  Coding DNA Sequence Number=SeqID_29905
MRGIVHEPQVNLGANQKFSPIEYLSPSEDYMSSPSKDYMSSPSEDFMSSPSEDFTSSPPEDYMPSPSEDYTSSPSEGHTPSPSEDY

SEQ ID NO: 121591 - protein, 78 aa, Glycine max
  Coding DNA Sequence Number=SeqID_29906
MARKGNPISKTTGRHPGPEHVVKEAHWACFDRVSGAQLNVDIMNARCRIPGRETRATTPYVPIASASRAPAPSSAGEA

SEQ ID NO: 121592 - protein, 119 aa, Glycine max
  Coding DNA Sequence Number=SeqID_29907
LITALCQSFGVPVTPSKVIRPPITRAFIEKCCTARQAQGDAPQAADAPPPPHQADPVGSFGMERYLQHLVRHQAANHRGQVQIHECLYQLSLSQQSQGFAPFACPTPDQFRAEVTWPGD

SEQ ID NO: 121593 - protein, 44 aa, Glycine max
  Coding DNA Sequence Number=SeqID_29908
ENEVGACHPARPGELGCFLQKAPSSGELPGRPKWAWLLFAPPVY

SEQ ID NO: 121594 - protein, 83 aa, Glycine max
  Coding DNA Sequence Number=SeqID_29909
MNALSGATLFCKITRTPNIFMICVHRDSLGSDQGVPMNPKRIKVIPEWPTPPSVRKIWGFHDLTNFYKKVLRKKAQIFKNLGI

SEQ ID NO: 121595 - protein, 144 aa, Glycine max
  Coding DNA Sequence Number=SeqID_29910
GQLKEVKILCDFAPIPTEELYYPSTQEYSPGDYLPQEPSKDALSGVGGIRKRCRLIVDTFLSESLMRENCYLVLILGTSQEIHSHGANVKAVVRCRRIMASIRISQEWWVQAIGLFASERIDVGLKTGKFSHPAWTMRKLGQMK

SEQ ID NO: 121596 - protein, 72 aa, Glycine max
  Coding DNA Sequence Number=SeqID_29911
MGVQGYDHLESKNGGLPQILDSRTWKAVIIKAGNIPRLRASTRTSSTDRTLADRGKLRAWEDHERGDHSELK

SEQ ID NO: 121597 - protein, 331 aa, Glycine max
  Coding DNA Sequence Number=SeqID_29912
MERSMIDAASGGALGDMTPAEARNLIEKMASNSQQFSARNDAIVIRGVHEVATNPSASSETKKLEGKLDALVNLVTQLALNQKSVPVARTFALPCSNLEQLSNLKLMLQIFTIDLLNLNSKITTAEHYDLSSTRYNPGWRNHPTLRWSSPQQQQQQPAPSFQNAAGPSRPYIPPPIQQQQQPQKQPTVEAPPQPSLEELVRQMTKQNMQFQQETRASIQSLTNQMGQLATQLNQQQSQNFDKLPSQVVQNPKNVSAISLRSGKQCQGPQPVALSSSANEPAKLHSTPEKGDDKNLPNNFCAEAAHSPSSIPSKSSFQQKNGRGRERDLGNV

SEQ ID NO: 121598 - protein, 107 aa, Glycine max
  Coding DNA Sequence Number=SeqID_29913
  Gene Ontology: Mol. function=protein binding
  Homolog annotation: Hit_ID=A6T8L0; Match level="QueryCoverage=100%, HitCoverage=40%, E-value=2e-26, Identity=54%"; Hit description =Putative uncharacterized protein ydcF
MATFARVWQEAPAQPQWWSYPGCSPRLENSAAGLRFSGDNSGLWPVGRYLALLLGELPRLLDNAQGYGPNGKGFITHVDFPRDVSAAWQCLREDTLLSEALNARTLG

SEQ ID NO: 121599 - protein, 157 aa, Glycine max
  Coding DNA Sequence Number=SeqID_29914
  Subcellular localization annotation: CTP_CleavageSite=34; ConfidenceScore=5.06e-01
LGTVTQLPVHPASPVLLTKNGPLGALDSMARLNRAAAPSYLFKGNFGGNQLLDGSISLSPLYPSQTNDLHVCSHSNPSQKIRVGRRCNPQGDPTNQLPCALRADARSAQCRGTPRARAAIHNRDDDVSTSISTARAWATIAIRVGQCPESIGGPALT

SEQ ID NO: 121600 - protein, 163 aa, Glycine max
  Coding DNA Sequence Number=SeqID_29915
MYKDNWTQPWPMGSEIYPKVHENPRAFFSSSSPIFLEPLAHGSIDWSLPREDCINMLIIINQYKDKVNLAASHGQMLEDEQAKVLALHIEREAKERVIELLHGEAMKWMNRFDLTLNESQELPRLLSRAKVVADTYSAPNEVHGLFDYYQHMVELMTHIIQSH

SEQ ID NO: 121601 - protein, 38 aa, Glycine max
  Coding DNA Sequence Number=SeqID_29916
MDKSLKVGEDEWKEKERRSTKFCASNEPTNPRFSTKCA

SEQ ID NO: 121602 - protein, 38 aa, Glycine max
  Coding DNA Sequence Number=SeqID_29917
MDIRLTQLEEDVDDANGLFKLKFKTMIQEYKPQHQDDH

SEQ ID NO: 121603 - protein, 45 aa, Glycine max
  Coding DNA Sequence Number=SeqID_29918
VDSRGSPPEAQAGEAPPEAPGDGEEAHEDEEMADLLDFLGGSGDT

SEQ ID NO: 121604 - protein, 215 aa, Glycine max
  Coding DNA Sequence Number=SeqID_29919
  Homolog annotation: Hit_ID=A8XZZ5; Match level="QueryCoverage=57%, HitCoverage=50%, E-value=3e-08, Identity=23%"; Hit description =Putative uncharacterized protein
MSRNFTDYATIPSSTSGMLRNFTDCAIIFPFDSRHVAKLHRLLNDGCQVPRSGQAKGYTSSPTEGCTSSPSESCMPSSLEGYVSSTSKVCTPSPHKATHPRLQRTARPCTFQRASSPRLPELTVLTLRGLHVLAFRGLHDPHLQRATCPRLQRTSRPPLQRTSRLGLKRTARPCLQRTARPHLQRTTRPYHQLTTCPRLERATRPRLQRTARPRL

SEQ ID NO: 121605 - protein, 135 aa, Glycine max
  Coding DNA Sequence Number=SeqID_29920
MDINLGYLISHQISLIAQHDTSRLGFLALITTLCKARGVQSDSRSLESLSPAINLAYIKNNYWNLDDPIVTFRGQRKARGKRSEAPATSSPETPAPSSSTTPLPPTQTPFIPPTSAQIPLPAPISARPSDFIFTP

SEQ ID NO: 121606 - protein, 70 aa, Glycine max
  Coding DNA Sequence Number=SeqID_29921
MQDSRVRFPKEERCAESPPTFICGKRRKNRRESVKMKILSSGVVFTFEEGRQKRGFCSYVPSIEEEIKPT

SEQ ID NO: 121607 - protein, 124 aa, Glycine max
  Coding DNA Sequence Number=SeqID_29922
MRGTVHEPQANLGADQKFLTSNVRSFEFGKNVPLNESISCFLIRVYPWVVVPSPLEDYTSLPSEGCTPSPSKGCTPSHSKSCMSSPLEDFTSSSSEGCTPPPSEGCTPSRATRPHLQRTTHPRL

SEQ ID NO: 121608 - protein, 100 aa, Glycine max
  Coding DNA Sequence Number=SeqID_29923
MYAFLEPQSLVCSKDRRSECEQYLERWLKESDREVYIGPYFHHVMTKLKKTLSPETKAVAPKWIEVKWFANDTPLDIGIITTIRKKWATFFLKTTISQNG

SEQ ID NO: 121609 - protein, 173 aa, Glycine max
  Coding DNA Sequence Number=SeqID_29924
  Gene Ontology: Biological process=biosynthetic process
  Homolog annotation: Hit_ID=A9H8P4; Match level="QueryCoverage=72%, HitCoverage=21%, E-value=8e-14, Identity=40%"; Hit description =Glycosyltransferase-like protein
MSIDKTLLKRGLKRVAAKVLSINWFAPVPDRLKLLVARRAGCCDWHWYARFILRSPGAAAEGPSHFLSFGNAEGKSPSPLFDPAWYCARFGLRASPLDALMQYLCIGDRLGLAPSPWFDPRYCRRTAPSSSGLRPVLGQYLVDYRSSGTPHPLFDQDWYLNQYPDVRDSAPIR

SEQ ID NO: 121610 - protein, 232 aa, Glycine max
  Coding DNA Sequence Number=SeqID_29925
MAEPSKKRKGSSSRSQWHFEAQDTPIPSSISSSSLFSSEEQCTWYTNLFSSHSIIDPKFIDMDFFSDESFKCIQAFHNSNLIPFMSLKLPVYSELVKAFYSNLEIQESTLIFEVYGIKMVIDRSLFYDLTQLSSDGVPFEGALDDDWKFDFSVHYARRLVCTNQADMTGRLLVDSLALESRILHYLIVLILLPRSSNLAQVSDEDLIVMWAFHTGRQIDWVHLVRYRMHKAL

SEQ ID NO: 121611 - protein, 138 aa, Glycine max
  Coding DNA Sequence Number=SeqID_29926
  Subcellular localization annotation: CTP_CleavageSite=62; ConfidenceScore=5.22e-01
MSARRLLTRILLPTPCHCHSAPTNKVRDHHRMMHAPDSTLRCNVVRTNNNQTSGNSLSVSTRHSHLGNCAEFVEITAKTSAKDPERSVHSAPHDHTQHPTYERGQKLVPKTLEEKSACNRDRQISSQLGSLTLAMVLK

SEQ ID NO: 121612 - protein, 102 aa, Glycine max
  Coding DNA Sequence Number=SeqID_29927
MRKCAKYSKWGKNGHFGDIFQPLGPLGNLEVKKQAPHLGELLCNLCRSKLHEMNQAILMMPKAKVSDSRLIQDFKIKHQESNPRFKIQEKKSRSNKSKLPIR

SEQ ID NO: 121613 - protein, 33 aa, Glycine max
  Coding DNA Sequence Number=SeqID_29928
VHPLSATLAINAMSSRTKPELARTKHFDPSSVG

SEQ ID NO: 121614 - protein, 165 aa, Glycine max
  Coding DNA Sequence Number=SeqID_29929
MGDQEETQEQMKADMSVLKEQMASMMEAILGMRQLMEKNVATTAAVSSAAEADPTLLATAHHPPPNTLGQGRNTLGHNNNPHLGYNRAAYPYGLPPNYTPPFMQDDAGHISSPILEREPPQQPDEVHEDHQEYAQGDVEFYPPIPVEGPAPNTLAQHNLTAQPII

SEQ ID NO: 121615 - protein, 177 aa, Glycine max
  Coding DNA Sequence Number=SeqID_29930
  Gene Ontology: Mol. function=nucleoside-triphosphatase activity; Cellular component=plasma membrane; Biological process=peptide transport
  Homolog annotation: Hit_ID=A4AGB7; Match level="QueryCoverage=79%, HitCoverage=52%, E-value=7e-26, Identity=44%"; Hit description =Oligopeptide porter
  Pfam annotation: Domain name=ABC_tran; Domain location=7-154; Score =21.8; E_value=1.2e-08; Accession=PF00005.18; Description=ABC transporter
MRAARDAGIASSRIARGSCRRGRAPICPPRLTVNEVIAEPILIRERKVNSRALSIRVATLLDELHLPLGTAAKFPYELSAGMRQRVAIARSFVLEPRVLIADEVLANLDLEVRPVVFDAITRRRKEQSMAALLVTNDADFIRELNAETLMLRAGHVVARGVGKDLLWVPNAESDSRR

SEQ ID NO: 121616 - protein, 141 aa, Glycine max
  Coding DNA Sequence Number=SeqID_29931
MKPWNEKPRRPERKNTCQQSFEGLYRAAILSETEGNMWAIINECKEKLNLAATHEQRLEDEYAKISAEREVRERVIDSLHQEATMWTDRFALTLNRSPELPPLLAKAKAVVDTYSAPKEIHGLLSYCQHMIDLMDHMIRNR

SEQ ID NO: 121617 - protein, 52 aa, Glycine max
  Coding DNA Sequence Number=SeqID_29932
MGHLSDQWVPMNPKRIKVIPEWPTPPSVRKIWGFHLQKVLQKKTQSFKNLGI

SEQ ID NO: 121618 - protein, 99 aa, Glycine max
  Coding DNA Sequence Number=SeqID_29933
  Subcellular localization annotation: CTP_CleavageSite=54; ConfidenceScore=5.48e-01
MLQSYSAQWNAPGPSSMISQCCPFKPYPQQKGGFHRRKPSRGGLALVVMRGFVALNELGSGALWIIGWWGRRRNGSHSMGFSLILTLFICPSFFIHQAG

SEQ ID NO: 121619 - protein, 38 aa, Glycine max
  Coding DNA Sequence Number=SeqID_29934
MWTTTGEKLAAQLAQASKVASSKSNSLLEESSGRSKWA

SEQ ID NO: 121620 - protein, 104 aa, Glycine max
  Coding DNA Sequence Number=SeqID_29935
  Homolog annotation: Hit_ID=B0HC01; Match level="QueryCoverage=29%, HitCoverage=65%, E-value=1e-09, Identity=100%"; Hit description =Putative uncharacterized protein
MENASNAAFYGSGLLLAFAHMFFLRYPLILWITVLPPLSELIPLAAAERPSAARNSYDHDYEFELGTLISDQGIHFYNRSMYALLKKYGVMHKISTPYHPQTNG

SEQ ID NO: 121621 - protein, 236 aa, Glycine max
  Coding DNA Sequence Number=SeqID_29936
  Homolog annotation: Hit_ID=A2Q142; Match level="QueryCoverage=57%, HitCoverage=46%, E-value=8e-07, Identity=31%"; Hit description =Ovarian tumour, otubain
MCHPPEKVKTKGALKKPLAKQQKSTKRNPSYWEYVDALHSIQNSNSLVKRSASSSQDPIQRRNIPMLNQFHPCIQYSIENIIDVKAYGNYGYCAIVALLGMSEESWSLVRNHRLAGPKSYHGQVDEYYGYGIRHCFTIQRDRCFSFTTTKHDIFSLRSQSPPDSSVHRVICIGHAYGNHFVQILLRDHCPLPPVALLWSTHCHFKAKQWPTPYISRMQCYTTLCRLNTEFVDLGEP

SEQ ID NO: 121622 - protein, 76 aa, Glycine max
  Coding DNA Sequence Number=SeqID_29937
MAFRGLHALTFIGLHVLAFRGKHVLGFTELQALAFRGLHALAFRGLHVLAFRGLHALAFKGLHVLTFRGLHALAFR

SEQ ID NO: 121623 - protein, 73 aa, Glycine max
  Coding DNA Sequence Number=SeqID_29938
MNLSKRKGNALWRPYQTRARARVMGEAEKVQEKMKAKNGGHKRANGHNDEGHDEREEDNGSQCGCNCRYQRCR

SEQ ID NO: 121624 - protein, 75 aa, Glycine max
  Coding DNA Sequence Number=SeqID_29939
HTLRCPYRTCARARVMGEVEEIQEKMKADMEAIKEKMATMMEAMMSVKKILEANAVAIAAPASSKVNPTSPLRGI

SEQ ID NO: 121625 - protein, 252 aa, Glycine max
  Coding DNA Sequence Number=SeqID_29940
MGDYLLQLRGKSHIFVLFTLRLLRFLLQIDGRVPGISTFEGLVVGSGVLSETRRAWSYQIDPFGESSSHIATTWPLCPSLVLIKLLLMWQGGPPSIFRPNCEPWLPLFLLATLFLMLVLPPLFLPKPISGSLPFPNITRATIIAVSDRQGYPEKESTEAMLTTSKDWKAVSNDSSAASTYGIEDEQLTKMSSSPNTITKCPSTTNFNFWWSVEGTTPTEWIHGHPKRQLEVNLSPNFSTGAVEGTNHHGTWL

SEQ ID NO: 121626 - protein, 62 aa, Glycine max
  Coding DNA Sequence Number=SeqID_29941
  Subcellular localization annotation: CTP_CleavageSite=16; ConfidenceScore=5.15e-01
MRTRSPLKARACSPLQARTYSPLKVIGTSTQGSTFMRKQEIDSSRGQTHATFVVKFGNADRT

SEQ ID NO: 121627 - protein, 103 aa, Glycine max
  Coding DNA Sequence Number=SeqID_29942
  Subcellular localization annotation: CTP_CleavageSite=45; ConfidenceScore=5.53e-01
MSPPPLKPHNHSQTQLKLAGQLPLQALFSVGGLVGACALSATLARLARISEFRLSACLFAQRMDSSDALSGIRPCSEFMHSSSFFQILPHAQPKECCAQRMAR

SEQ ID NO: 121628 - protein, 88 aa, Glycine max
  Coding DNA Sequence Number=SeqID_29943
  Gene Ontology: Mol. function=nucleoside-triphosphatase activity; Cellular component=chloroplast
  Homolog annotation: Hit_ID=Q2PMM5; Match level="QueryCoverage=97%, HitCoverage=4%, E-value=4e-34, Identity=71%"; Hit description =Protein ycf2
MNSIGPKNDTLEESSESSNINRLIVPLLYLPKGKKISESYFLDPKESTRVLPITKKYIMPESNWGIRDLFKEKDIKYLEFLYHSYIIG

SEQ ID NO: 121629 - protein, 137 aa, Glycine max
  Coding DNA Sequence Number=SeqID_29944
MIMRGQDIYSSQDEASTSPSSSESEEAKGEESSKEIYPQEEGQLLMVKEECKEVSVSSKSLAKKESHFEIKTNIKEIYPLRQPPHFLLYKRHLLALSHLLGLEFIPQVKELLDEGLVCKSLNSLALLVRKIVIKGFP

SEQ ID NO: 121630 - protein, 124 aa, Glycine max
  Coding DNA Sequence Number=SeqID_29945
  Homolog annotation: Hit_ID=A6FJQ2; Match level="QueryCoverage=30%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGKEENDENEKKDGEDGDEDENAQEEDEEDISDDDYNQVPL

SEQ ID NO: 121631 - protein, 238 aa, Glycine max
  Coding DNA Sequence Number=SeqID_29946
  Gene Ontology: Mol. function=motor activity; Cellular component=cell projection
  Homolog annotation: Hit_ID=UPI00006A2D9E; Match level="QueryCoverage =86%, HitCoverage=85%, E-value=7e-19, Identity=16%"; Hit description =UPI00006A2D9E related cluster
MGETHEIPHHNQADFGPCLGYATEGKAVGLHVLTFRGLQVLAFRGLHVLSIRGLHALAFKGLDVLAFRGLHVLSFRGLHILAFRGLHVLAFRGLHALAFRGLHALAFRGLHALAFRGLHVLAFRGLHVLTYKGMHALTFRGLHVLALRGLHALAFRGLHALTIRGLHALAFRELHVLAFRGLHVLALRGLHAFTFRGLHALAFRGLHALAFRGLHVLAFRGLHVLAFKGLHAFVFRGL

SEQ ID NO: 121632 - protein, 156 aa, Glycine max
  Coding DNA Sequence Number=SeqID_29947
  Homolog annotation: Hit_ID=Q9SJS1; Match level="QueryCoverage=48%, HitCoverage=10%, E-value=8e-08, Identity=41%"; Hit description =Putative Athila retroelement ORF1 protein
MGTGLILKSLTVSPIGTLVPLDLEIEATLRRNRAERRRKLLQDRTVASILEEETYFSDSLSPDSPSSRESANQHSLATTMADEHDQRTTLEDYSSGSVPQFFTSIAHPEVQAHNITYPHSLIHLIQGNLFQGLPNEDPYAHLATFIEICNTVKIVD

SEQ ID NO: 121633 - protein, 144 aa, Glycine max
  Coding DNA Sequence Number=SeqID_29948
MEVPTAHKDLIWEDIQAEFDIPEASDSRTKRKLLQTVGERWRQFKSNLTRKWALAADQDGVEDTDVRKKAQTIQKQNTAPHVLSRGGYDYLEQKLLAEKTKKKLEEAAQSGSIDGVIDPPSPVRRHVKWKMARTKKTGEMTTEA

SEQ ID NO: 121634 - protein, 59 aa, Glycine max
  Coding DNA Sequence Number=SeqID_29949
  Subcellular localization annotation: CTP_CleavageSite=44; ConfidenceScore=5.03e-01
MEDAPVSPRVALPQKVRLRQLATPLGTFLTPTGLSKKGPYTRVHGNLRSGGGSMVMLGL

SEQ ID NO: 121635 - protein, 199 aa, Glycine max
  Coding DNA Sequence Number=SeqID_29950
MTGRLLAGSLAFESCTLHYLIVRILLPRSSNLAQVSEEDLIVMWAFHIGRQIDWAHLVRYHMHKALRLNAPLPYPHLVTLFLQHFNIPLDSEPYVPIKRSFLIGAAMIASFGYRKEHEGAQPIDDEGNLLVGEYSSLLQRILDRFDGLQTYVGERFDALELQVGMQFDEMDSRITKDEGDVTYIHTCFDLPPPPPSGIL

SEQ ID NO: 121636 - protein, 84 aa, Glycine max
  Coding DNA Sequence Number=SeqID_29951
  Homolog annotation: Hit_ID=A5AWG3; Match level="QueryCoverage=100%, HitCoverage=16%, E-value=1e-07, Identity=38%"; Hit description =Putative uncharacterized protein
MNIEASIHATFDESNAILSRKNMLDDIADSLEHMNIDEQDSKGNDKGNNEDPPEEVKSNDELPREWKASRDHPLDNIIGDISKG

SEQ ID NO: 121637 - protein, 111 aa, Glycine max
  Coding DNA Sequence Number=SeqID_29952
MPSKIILMMPKNQELSKFQSFKNQDSRFKIQESRFKNQDSRIKRRLNQDKGCYTENKRGYICCGSVQVEGTSTWLFKENKGGYIPCRSLAYKGFYKVERNIKNRRLVGDWM

SEQ ID NO: 121638 - protein, 96 aa, Glycine max
  Coding DNA Sequence Number=SeqID_29953
MEMPPQNKFVGCAFTGKNPKKFQIPSTCTIDELKNLIKQVAPKGIPPLGIHESQTVRRLFFRQPARFEYSDTVIKYEINELITNEELLKTRSVGHR

SEQ ID NO: 121639 - protein, 72 aa, Glycine max
  Coding DNA Sequence Number=SeqID_29954
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARMDEDEWMYEIMSERADMDYENA

SEQ ID NO: 121640 - protein, 27 aa, Glycine max
  Coding DNA Sequence Number=SeqID_29955
FGIDGLSLGLLFIDGIITTLATVSGSA

SEQ ID NO: 121641 - protein, 112 aa, Glycine max
  Coding DNA Sequence Number=SeqID_29956
MEDSPVSLASLTRKRKLKLHCEGTGPRGEGNFCKTEQLHPFLRRKLISPTYYHRIHHHQGNLPLNYLKPLPWQKSMIRGLPLGIIQVSQHHNFLPALHVLKCKLTTSTIHIP

SEQ ID NO: 121642 - protein, 205 aa, Glycine max
  Coding DNA Sequence Number=SeqID_29957
MTTLTQIWMTLLLSNILPSDHNSDLPLPKCQLVYAILTRMSIHVAQLIVDAIYIFAGMAPTRHPLDPDKSNRALGFPALITRLCQSFGVPVAPSKAQGDAPQAADAPPPHQAGPAGSFDTERYLRHLVRQQAANHRAHSQGFTSFPCPTPDQFRAEVAWPGDWPEARAGEAPAEAPAEAPDEADEAREDKEMTDLLDFLGGSGAT

SEQ ID NO: 121643 - protein, 45 aa, Glycine max
  Coding DNA Sequence Number=SeqID_29958
MPKVWTSQKIWSGADIEEEEPIDLRSNPLQGGGNDAILPKKGTSH

SEQ ID NO: 121644 - protein, 230 aa, Glycine max
  Coding DNA Sequence Number=SeqID_29959
MGEYAKDEELLIHSFQEKSYWDISTILIWFRIGCNYRTFAKRGTDLSKNTPKRWRDLAAQSGLMMSVKKIMEASNAVAIAATSVVAKSITNLLLYPLRANPTVIMHMSLKRGGTIPEIQPQSLADFEPCLGYATEGQAVGGIPLQNPLEGPQYHPQLHLLHSTTSKNPHAMAEMGKLDHLEERLRAIEGGEDYAFANLKELFLEPNIITPPKFKVLDLDKYKGLLVPRTI

SEQ ID NO: 121645 - protein, 70 aa, Glycine max
  Coding DNA Sequence Number=SeqID_29960
  Subcellular localization annotation: CTP_CleavageSite=11; ConfidenceScore=5.28e-01
MFLTSYCGGSSAFSVAGSTWTSGLSALTGLVTNDLSRVAFLVRFKVDGDCDAAPVEGGRGGELGGVAICL

SEQ ID NO: 121646 - protein, 77 aa, Glycine max
  Coding DNA Sequence Number=SeqID_29961
MTEARQKEVRKVNETRIEVHEANEDHHGKIGEELATQLAQASQVASSRSNHLLEEESGRPNFRKVTETDGLRNNTSF

SEQ ID NO: 121647 - protein, 51 aa, Glycine max
  Coding DNA Sequence Number=SeqID_29962
MEVKELIWEDWMRGSVILKSALMQGIFAHLDVEIVVHQPDHHLVPHVMGTP

SEQ ID NO: 121648 - protein, 116 aa, Glycine max
  Coding DNA Sequence Number=SeqID_29963
  Subcellular localization annotation: CTP_CleavageSite=87; ConfidenceScore=5.34e-01
VDSRGSPFYSTGNGASRSIPKAGNAESRIRQYKKRQRKTSQKPVLRQTQLGSKLGFAIPSRASISSLKGDSGKDRIGRRVSRTNKIRVERGKLAKLDKIGMGIGTCIDVPDRLMLP

SEQ ID NO: 121649 - protein, 64 aa, Glycine max
  Coding DNA Sequence Number=SeqID_29964
  Subcellular localization annotation: CTP_CleavageSite=23; ConfidenceScore=5.69e-01
MVRTCSPLKARTCSPLNVPKVRVCSPLKARTCSPLMVRACSPLMVRTRSPLKARTCSPLNGEGN

SEQ ID NO: 121650 - protein, 209 aa, Glycine max
  Coding DNA Sequence Number=SeqID_29965
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=57%, HitCoverage=18%, E-value=3e-52, Identity=82%"; Hit description=Mini -chromosome maintenance protein MCM3
  Pfam annotation: Domain name=MCM; Domain location=80-208; Score= -213.4; E_value=0.0012; Accession=PF00493.14; Description=MCM235 family
MKTRCPDGLFLYPENSAPGQLPRTVDVIAEDDLVDSCKPGDRVAIVGIYKALARKRTVLIANNVSLLNKEDNAPIYSVEDVKNIKEIATRDDAFDLLSGSLAPSIYGHSWIKKAVVLLMLSGVEKNLKNGTHLRGLEFSLDLLSLLNPTKFLGNIVVEHDYAECTGSAIQALVLFKKLYPRHRETEIKNSIANAVHGMEVGEFATFMAL

SEQ ID NO: 121651 - protein, 44 aa, Glycine max
  Coding DNA Sequence Number=SeqID_29966
MINVGMICPLWCHEEMHDAIKEQANGLPATMHHQKRKTLDEASL

SEQ ID NO: 121652 - protein, 62 aa, Glycine max
  Coding DNA Sequence Number=SeqID_29967
GADIEEDESTDLRSNPLQGRGNDAILPKKGLVTRAMSKMLQEDWARAVEEGLRVLMNLRVDF

SEQ ID NO: 121653 - protein, 62 aa, Glycine max
  Coding DNA Sequence Number=SeqID_29968
MSARVQPIAFLCFLRTDNNFSSCSLAREADIITGKLLLSSNGRRRWFLSLYLIKKVRGMCTS

SEQ ID NO: 121654 - protein, 105 aa, Glycine max
  Coding DNA Sequence Number=SeqID_29969
  Gene Ontology: Mol. function=helicase activity; Biological process =viral genome replication
  Homolog annotation: Hit_ID=A2Q378; Match level="QueryCoverage=73%, HitCoverage=4%, E-value=7e-17, Identity=51%"; Hit description =Putative uncharacterized protein
MVYDGNDKIQNATNQKDEIKEYIDCRSWHLRKKGYTIGRLIWVPPTIGELFYLRMMLTAYKGATSFKDIRTVTNIQYPIYRETCFVMGFLQDAREFVEAIKEAKD

SEQ ID NO: 121655 - protein, 70 aa, Glycine max
  Coding DNA Sequence Number=SeqID_29970
INIAPKLSHNNFNGLEIESTTLRPDMKLFNHTPCEVASKQETNSASIVEVAVKVCLALLQDTAPPANIKI

SEQ ID NO: 121656 - protein, 81 aa, Glycine max
  Coding DNA Sequence Number=SeqID_29971
MGRNVSALIGKSVPQIPEKCKDPGPLQSSDVVIHLANRSVAYLVGFIEDVFVRVGELIFPVDFYILNMEDGFSRQTLYENC

SEQ ID NO: 121657 - protein, 140 aa, Glycine max
  Coding DNA Sequence Number=SeqID_29972
  Gene Ontology: Mol. function=oxidoreductase activity
  Homolog annotation: Hit_ID=Q41399; Match level="QueryCoverage=40%, HitCoverage=17%, E-value=6e-24, Identity=91%"; Hit description =Chalcone reductase
MRKEKIPHQAPFAIQAAQLLGRAIGAGLFAITPAGERGMCCKAIKLGNARVEMNPSWQQGKLREFCKQKGIHVSAWSALGAYKIFWGSGAVMENPILQDIAKAKGKGTELEFVIMVIAVSCVKLLSAHNSTQHTSRKHKV

SEQ ID NO: 121658 - protein, 64 aa, Glycine max
  Coding DNA Sequence Number=SeqID_29973
  Homolog annotation: Hit_ID=A0ST23; Match level="QueryCoverage=70%, HitCoverage=91%, E-value=1e-11, Identity=73%"; Hit description =Putative reverse transcriptase
MAGGAVAKWLIQMNKFTGGTELEFVIMVIAVSFGKPVVPAALMNRPTRGERRFAYWALFRFLAH

SEQ ID NO: 121659 - protein, 88 aa, Glycine max
  Coding DNA Sequence Number=SeqID_29974
MVAITPAKVHQPQFLREYDSNAMCACHGEAPGHSIEHCRALKRKWVQAIGLFAQATCAPEFGLPRPFNQRLLVLRVGGVAVKQQMGIL

SEQ ID NO: 121660 - protein, 98 aa, Glycine max
  Coding DNA Sequence Number=SeqID_29975
  Subcellular localization annotation: CTP_CleavageSite=14; ConfidenceScore=5.02e-01
MGMRTMLNGSPIVYSSTTTKRTTCLQPDRVMRQFGMQQPIPGPVMQPNNIHDLTLKGKEGRNWMRLMQPTLNEWNSRYERRVEQTPPQTGTLSLNSDI

SEQ ID NO: 121661 - protein, 75 aa, Glycine max
  Coding DNA Sequence Number=SeqID_29976
MMTMIVDTLPVFYYGKWWVTHLQALRIWVFAGEMIKVSLKRGKSDHLALINAKKIGANEEGEDEGEARAVTAIPI

SEQ ID NO: 121662 - protein, 91 aa, Glycine max
  Coding DNA Sequence Number=SeqID_29977
GEIAETLHFMLSPIGRRVCTFEDLLSCIEKITLLSKEEDRILEAHEDASPSQPQFEHQQFNILRQSVETRGLARRRETVDAATYSLPPMPE

SEQ ID NO: 121663 - protein, 172 aa, Glycine max
  Coding DNA Sequence Number=SeqID_29978
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLNPT

SEQ ID NO: 121664 - protein, 108 aa, Glycine max
  Coding DNA Sequence Number=SeqID_29979
  Homolog annotation: Hit_ID=A6FJQ2; Match level="QueryCoverage=35%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVRVGGLIVIDNVLWHGKVSDPLVNDPGYRARIRNHGHSCFLCEIVIRSQFHTTYEPEA

SEQ ID NO: 121665 - protein, 215 aa, Glycine max
  Coding DNA Sequence Number=SeqID_29980
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=76%, HitCoverage=58%, E-value=3e-86, Identity=95%"; Hit description=Beta -lactamase TEM precursor
  Pfam annotation: Domain name=Beta-lactamase; Domain location=60-215; Score=-0.2; E_value=5.3e-06; Accession=PF00144.15; Description=Beta -lactamase
MAPDAVFSPYASVRYFTPHMTSCDRLRELHVSEVFTVITETRETKGPRDTPIFIETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAGNLLLTTIGGPKELTAFLHNMGDHVTRLDRWEPELNEAIPNDERDTTMPVAMAT

SEQ ID NO: 121666 - protein, 80 aa, Glycine max
  Coding DNA Sequence Number=SeqID_29981
MVAITPARFPQPPFFLGYDLNATCAYHGGALGHSIEHCMTLKHKVQSLIDVGWLKYEENRLLNPNTNKRYHTWGNFESCC

SEQ ID NO: 121667 - protein, 83 aa, Glycine max
  Coding DNA Sequence Number=SeqID_29982
  Homolog annotation: Hit_ID=UPI0000ECBAF8; Match level="QueryCoverage =49%, HitCoverage=48%, E-value=1e-16, Identity=100%"; Hit description= UPI0000ECBAF8 related cluster
MVTLRNPAHYVNGQSVQTPTICGNGQCLAKGMQAWHWPSFYNVVTGKTLALPNLIALQHIPLSPAGVIAKRPAPIALPNSCAA

SEQ ID NO: 121668 - protein, 63 aa, Glycine max
  Coding DNA Sequence Number=SeqID_29983
MRGTVHEPQGGPLGTSTPVFRGLHALNIRGLHVLTFRGLYVLTFRGLHVLTFRALHALTLGIL

SEQ ID NO: 121669 - protein, 52 aa, Glycine max
  Coding DNA Sequence Number=SeqID_29984
MPISPYGRIAPIRHPVDPEEPNRALGFPALGSRPQDTQWTRRSPTGSWGFQL

SEQ ID NO: 121670 - protein, 56 aa, Glycine max
  Coding DNA Sequence Number=SeqID_29985
MEKKGRRRRKGLNDARACVRKAEEVKIFFQSNQELETIKSRFQCFQLKPETSFWVK

SEQ ID NO: 121671 - protein, 156 aa, Glycine max
  Coding DNA Sequence Number=SeqID_29986
  Homolog annotation: Hit_ID=Q2HTA0; Match level="QueryCoverage=73%, HitCoverage=21%, E-value=6e-16, Identity=35%"; Hit description=IMP dehydrogenase/GMP reductase, related
  Pfam annotation: Domain name=DUF1723; Domain location=90-139; Score =51.6; E_value=2.7e-12; Accession=PF08330.1; Description=Protein of unknown function (DUF1723)
MPDVEADVFPDDPMAPTDVEDTGVDIHVDTGAQAAEDEHEGFPGGPSDPSVLTQYADHVACSVWTGEEHPELKLSSHGRKVHSLSDRVDTGDQGLLSSFVERWHWETSSFHLPVGEVTITLDDVSSLLHMPVVGNLHAFQPLHVDDAVQMLVDLLM

SEQ ID NO: 121672 - protein, 207 aa, Glycine max
  Coding DNA Sequence Number=SeqID_29987
MATATAISSAVEADPTLLVTTHHPPPNTVGRGRNTLRHNSYPHLGYNRAAYPYGLSPVMQDDAGHISSPILEGEPPRQPDEAHEDHQEYAQGDVEFYPPIPVEGPTPNTLPQPNLTTQPIILSTEGPPLATEERRKPDLLEERLRAVEGFGDYPFADMTDLCLVPDVVIPQNSKCCTLTSIMGRLVPRTISRCIVVRWARTLGMRSY

SEQ ID NO: 121673 - protein, 73 aa, Glycine max
  Coding DNA Sequence Number=SeqID_29988
MTYEHGPKQVPKTLEGQCTSPPTDIHNIQRMNVAQIKCQRPSKGQTIILIARFPDPNYGVKTVNFIINSPHLL

SEQ ID NO: 121674 - protein, 173 aa, Glycine max
  Coding DNA Sequence Number=SeqID_29989
  Subcellular localization annotation: CTP_CleavageSite=56; ConfidenceScore=5.54e-01
MPLSAAVDNLTVTSHCCSAGFTSTLPQSRSPLLIRTTTRIPRVHFGYTQTIPAPPVDSWVSYDDIHDRWMHYSDHIVPAGEPRVVPQPPQTNIPHVPEPGAPSTSARPAVEEPRHAVEVCHWIAERLERHLSLGVVTPGSSTHEVIEECLRMARSVTQDQLAYIRFRRRRHTD

SEQ ID NO: 121675 - protein, 39 aa, Glycine max
  Coding DNA Sequence Number=SeqID_29990
MSALMETELTTDQNGAAYQHPLPIPEDKVLVPGFRSGLK

SEQ ID NO: 121676 - protein, 440 aa, Glycine max
  Coding DNA Sequence Number=SeqID_29991
  Homolog annotation: Hit_ID=Q6WAY6; Match level="QueryCoverage=55%, HitCoverage=44%, E-value=4e-14, Identity=27%"; Hit description =Putative uncharacterized protein
MEVDLPVLYKVIACVWKKDKVNWEELLASVTGSSIRWFSRWKKGVTGVLCLCEEFLNVPLMGTRGCINYNPVLAIRQLGYPMKGFSEANTEILQKIHKAWNKVERKDKELRGISNGVIGGYHKWLKSRVQGIAWLKKLEGLNGKEIEVSEESEEVQVLKAELEKTKVAKEKLKVLVTRVRKECDRMKDINMSTVDALDNELKLRKAERDKSMMENIMLKDELRNCRESKDILKGQLSKTKKNMLIIIDQYKEKAREEVIKLLHEEGMKWMDRFAFTLNESQELPKLLAKAKAMNDVYSTPDETALYDTLTRHVKARIMSDIEQVQEQMKDDMKAMKEQMTTMIEAMMSMRKMMEVNVVTTVVASTATEMDPIHRPISINKYTFPPYGLPPDYTPLTVVYTPGENIAPQDHTLACFGVYPRYTTEGHAFSGVPMLNAPGGP

SEQ ID NO: 121677 - protein, 221 aa, Glycine max
  Coding DNA Sequence Number=SeqID_29992
MAGMGSMSNTWDQMLVYCSFKPRKNCIARSSSFLCAIMAKAEQEHLMLQVQAGSGLKFSISSQITRNLVKYSVTERAPCFNVDASCCKSEILRRSPSEYLDFRSLQMSSALSIQSTLCLIEAATECTIQDTTILLHRRQAPYVLSVLSGSGALPSTNSSLFLALSAHWGDKSSSWIFACMKIQIALDIVECSFVHDEQQTLGRKKDRKIVSAQQSSSFEEL

SEQ ID NO: 121678 - protein, 217 aa, Glycine max
  Coding DNA Sequence Number=SeqID_29993
  Homolog annotation: Hit_ID=Q2HTA0; Match level="QueryCoverage=64%, HitCoverage=21%, E-value=2e-20, Identity=40%"; Hit description=IMP dehydrogenase/GMP reductase, related
  Pfam annotation: Domain name=DUF1723; Domain location=130-179; Score =50.3; E_value=6.7e-12; Accession=PF08330.1; Description=Protein of unknown function (DUF1723)
IMVRTTGLDRALDRVIGRVLRKEREVAAVAKDVQHVDHADDEVHEQPEEAIVDDVVTDPEGFSGKPHDTSVLMEYVYHVAAKVWNGKECSELKLSSRGRKVEKFGRLAPKIEGLVVVTGLRPLIVCSLNTSDRGFMSTFVERWHKETSSFHLSVGEVTTTLDDVASLLHLPIAGTFHSFEPLHVDDVVFLLVELLEVSAKEARAETVQCHGSYVRLS

SEQ ID NO: 121679 - protein, 571 aa, Glycine max
  Coding DNA Sequence Number=SeqID_29994
  Gene Ontology: Mol. function=nucleotide binding; Cellular component =Golgi apparatus; Biological process=regulation of transcription, DNA- dependent
  Homolog annotation: Hit_ID=A7NUU4; Match level="QueryCoverage=75%, HitCoverage=78%, E-value=1e-174, Identity=69%"; Hit description =Chromosome chr18 scaffold_1, whole genome shotgun sequence
  Pfam annotation: Domain name=DUF246; Domain location=143-487; Score =680.7; E_value=1.2e-201; Accession=PF03138.5; Description=Plant protein family
  Subcellular localization annotation: CTP_CleavageSite=7; ConfidenceScore=5.15e-01
MKNPTLRERRGGSMQRRNNTVVPLGMLRRFLGASVFSIVVTSFFFVHVHVSPSPSDHKFNDKILSFRDPQSWTRELVPPHLSKAPLSVPKLKDSRKDSDYEKLWKPPSNHGFIPCTKPTPNYSILKSSVTVHPAPGRSRGYLSVHTNGGLNQMRTGICDMVAIARIINATLVIPELDKKSFWHDTSNFSDIFDEESFISSLANDIKIIKKLPKKLVNATKIVMQFRSWSGMDYYENEIAALWDNFKVIRASKSDSRLANNNLPPEIQKLRCRACYDALRFSPHIEKMGKILVERMRSFGPYIALHLRYEKDMLAFSGCTHELSAVEAKELWIIRQNTTYWKRKYINPIEERSKGFCPLTPKEVGIFLTALGYPSNTPIYIAAGEIYGGESHMTDLQSRYPLLMSKEKLASIEELEPFSSHSSQMAALDYIVSVESDVFVHSYPGNMAKAVEGHRRFLGSGRTISPDRKALVRLFDKLANGSMTEGKTLSNKIIDLHKKRYVIEEALIICEAWLQKEKRTRFWNKGLGQVGQDKAKAFSFNRSILVKELPHASSLYQRFNTNQLEGAKRLLA

SEQ ID NO: 121680 - protein, 99 aa, Glycine max
  Coding DNA Sequence Number=SeqID_29995
  Homolog annotation: Hit_ID=A5ATZ7; Match level="QueryCoverage=57%, HitCoverage=54%, E-value=2e-10, Identity=50%"; Hit description =Putative uncharacterized protein
MVFNLSNLTKYGTSSHTCILTVALLSRMQQQVSMALNSEPKFEDLLAHQGLLKVLRDSKPEKMKDLDWEGLQEKVVATIRLCLADEVLYYAMELTSPEG

SEQ ID NO: 121681 - protein, 1253 aa, Glycine max
  Coding DNA Sequence Number=SeqID_29996
  Gene Ontology: Mol. function=hydrolase activity, hydrolyzing O -glycosyl compounds; Cellular component=chloroplast isoamylase complex; Biological process=carbohydrate metabolic process
  Homolog annotation: Hit_ID=A4PIT0; Match level="QueryCoverage=22%, HitCoverage=36%, E-value=1e-131, Identity=81%"; Hit description =Isoamylase-type starch-debranching enzyme 3
  Pfam annotation: Domain name=Isoamylase_N; Domain location=111-209; Score=63.3; E_value=8.1e-16; Accession=PF02922.9; Description =Isoamylase N-terminal domain
  Pfam annotation: Domain name=RRM_1; Domain location=457-528; Score =18.9; E_value=0.0027; Accession=PF00076.13; Description=RNA recognition motif. (a.k.a. RRM, RB
  Pfam module annotation: Pfam domain module=Isoamylase_N::RRM_1; Domain location=111-209::457-528
  Subcellular localization annotation: CTP_CleavageSite=50; ConfidenceScore=5.78e-01
MLHHPFLYASKIATQSTLFPPVSSAGNSAGRSSLAGNSSARDVRSLRFMKQASGSKSNNELGVFSETMDRARHRTTTVYGGRAQEGVLEEETSKVIESRPSWKVFPGQAFPLGVSEVDNCMNFAIFSQHATAVTLCLVLPERGSIDALDGGMIEMVLDPDLNKTGDIWHICIEDLPRSNVLYGYRIDGPGDRGKGHRFDSSIVLVDPYAKLVEGRRYFGDISLKLSKFLGTYDFDSLPFDWGENYKLPNISEKDLVIYEMNVRAFTSDESSGLDSNIRGSYLGVIEKLSPSPTTRRELILMLEESKNGRARENESERERQSERDSVRESERDKARHSQRELLQNVKEREWRSERVGRPRERVRSHRERKAEQRVDHGWRTLNNRRTNWNGINGRSAERWNARMEEPNNDNSNHGDWVIVSRKRKNKVEDSRGRKQGNNYQRKEKQMTWRNKADVTTFYFSRFPEGIMEKDMWQIFQKWGKVWEVFIPRTKNKLGHRFGFVRFKEVMDEQGLERCLDNNIFIDGQKVFVNRPKFDRGKVPCTHVYGNATRRMEADQQVHKDAQVDKTTSVKKGGPRSYAEVVKELQPGHTRTKYMGEGVHRAVRDNYRPVTLSSNKEKYEWLYKSWVGRLKNRAMFERVEEELKWVVEDNVNPCYWVDDWVLFPNMDDSSAACLIQQEMDNGSTPLSELQKWSPEIRPTHRLTWVLLWGLPLTVWDVESMAKVLMEFGEVVEVDDFVEDRTRMDVARILLRTKMGPLFQATVSATIDGAQYVLHVAEDAPSLGIVKKQNRSDLWFPPSPFSTQPNTPVTAGDDIPGATFCDEFSGNVSDDPVGGFPDHRSMLPSSNARRDHWVQSLGRSVMDRSAIIRDELAQSQVDRAQSQHCPHLENVLENPNGHISGNGLALNASVEKAMQETNLIEKIPNLDCHADEGQWVNTHGEISGLTTKAKQGEFEKALPLKESLPHNSILNSTYPRRNCADYGQNLNKLPEEMDQQICGPTPSATKVYVRRKEVLRSNPKAQQSDKSKEMMRSNTKAQQTEEPIVDSNPASKGHPLFSVYEDPIKLQCDILKEMGLSYEEEDSKAWGGESSGLLLEGSLYSKKWILSASKKPRGRTLIKVFARPFGETPLAAGGLLCMWNNSTFVVERKKLIFVNVYAPCDLVGKKALWDELRQLKASNPSGMWCFLGDFNSIRSSQERISLSQRRADPYDIAAFNQWIDDMELQEIKCLIDSWSLRIGYLFGLRAAKLSFKEPL

SEQ ID NO: 121682 - protein, 90 aa, Glycine max
  Coding DNA Sequence Number=SeqID_29997
GVGDGGEEVGAVFETGAGAGGGGVVGGGAEEVVGGEALGEAACGGDGEDLGVAAGEADGDRERAEVASNMKKKRKSVLAIVRAKRRRINE

SEQ ID NO: 121683 - protein, 183 aa, Glycine max
  Coding DNA Sequence Number=SeqID_29998
MGIPVEVDIDWGSVITVARRRCECGRAHSHSGFEVNVVIGEDSRPRMHVGISLELDKLAFVNELHRATLGIDLDCHANLRALHFTTIADEDPECPMGHHLQSKGRSVRSSGGRGGGGFAGEGSKGKGEGGEGAEMESGVDGEEGKDGWMRVLRKSPETFPPTEGPSRRREPSSVAAELGLHGE

SEQ ID NO: 121684 - protein, 489 aa, Glycine max
  Coding DNA Sequence Number=SeqID_29999
  Homolog annotation: Hit_ID=A5B5G7; Match level="QueryCoverage=41%, HitCoverage=14%, E-value=8e-11, Identity=27%"; Hit description =Putative uncharacterized protein
MDIMRSETRSALSRCKTQQRIRSTRLAGAAAPSALIYLEARAKRAIVALSACQQQRAGWHQARGWALGPPVLMASRKRRAVPTPGEASNWDTSRFTSEIAWHRYQDNIQLRNILLERNVELGPGMFDEFLQELRRHRWDQVLTHLPEKRIDVALVKEFYSNLYDPEDHSPRFCRVRGQVVRFDADTINDFLDTPVILEVGEEYPAYTRYLSTHPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPRRTRTRASASASEAPLPTQSPSQPSQRPRHLPASTSASMDTHGQMLRSLHVGQQLIMENMHRLSLHLQMDPPLTTPEAYRQRVAWPGDQPSTDRGEEPSGAAEDPAVDEDLIADLATADWGPWADLGGGS

SEQ ID NO: 121685 - protein, 207 aa, Glycine max
  Coding DNA Sequence Number=SeqID_30000
  Gene Ontology: Mol. function=asparaginase activity; Cellular component=lysosome; Biological process=glycoprotein catabolic process
  Homolog annotation: Hit_ID=A7Q587; Match level="QueryCoverage=20%, HitCoverage=12%, E-value=9e-14, Identity=83%"; Hit description =Chromosome undetermined scaffold_52, whole genome shotgun sequence
GPGGSPDENGETTIDALIMDGVTMEVGAVATMRYVKNGIKAARKHQNLLFQVRIKYELEFLWIKYESTSTYADHLSLLRIIYNLCGSSTFYPITNADQINAYVDQLKKKGATEDEAKRKLKKKVYCHGGSFIIRIEFVVVVVMGVTVQRRRMTHGKNSGTIADTNEEHTRIDEDQAWIEEKMREFERRNPVSMNEWCRRIPKPYFTF

SEQ ID NO: 121686 - protein, 286 aa, Glycine max
  Coding DNA Sequence Number=SeqID_30001
  Gene Ontology: Mol. function=glycine hydroxymethyltransferase activity; Cellular component=nucleus; Biological process=regulation of transcription, DNA-dependent
  Homolog annotation: Hit_ID=A5BMY5; Match level="QueryCoverage=97%, HitCoverage=83%, E-value=7e-78, Identity=54%"; Hit description =Putative uncharacterized protein
MNLPRDVDDYFKQTLDDTLGIPVSSRTLESKLQASQESQWRLREHLLSLFPQLKRKDQLIDRFKYEAGMNARALKKFVEENQRLATDCEKLLARCHQLENDRALYDKDREALMEFGNDADERAREAQTRVLDLERDLLFMGNELNKYKNQHQLIFAFSMKVNPSVCTPGENILLDSVLATLTSKDDDSTYAFLQVNSENEACKQFLSMWNCINPSTRSVLSLVAKIKSLEKDKEHLRTNLHKAEEEVKLLFDENNVLEKENKRLLRIYKKRNHPDSGGSIPTARGG

SEQ ID NO: 121687 - protein, 78 aa, Glycine max
  Coding DNA Sequence Number=SeqID_30002
MVIHCGIQARQICLYAPWHVSPKSAFPVKLTCGRLETRPAYRRDGTRPTYRHDGSCWGPRCDRSCWGPRRDPVGSHFI

SEQ ID NO: 121688 - protein, 191 aa, Glycine max
  Coding DNA Sequence Number=SeqID_30003
MAAQLIHDRVVMECLEGVWETLEGNERCQFRGTVRLTATSLVHPEQPARTLQQPVEWILPTPTPYRLVEPAQLIEVSSSKEDLEEDPEELSPEPAMDAPDLPEDDEDPLPDVSYPYVIPPKEGEPPHPPVHLPLGQLLTEYVLGSILDGFRSHAKLARPLLLKSEKMKNIFPISLSGLSFINSYSTQPSLT

SEQ ID NO: 121689 - protein, 72 aa, Glycine max
  Coding DNA Sequence Number=SeqID_30004
MGFRGNRTKEVGDLLGAPSRIAGAEEFFHGTPRKNLLPQEEPSSVGLSHILGNPLPTCGGSGPMMARNILTK

SEQ ID NO: 121690 - protein, 425 aa, Glycine max
  Coding DNA Sequence Number=SeqID_30005
  Gene Ontology: Mol. function=drug transporter activity; Cellular component=membrane; Biological process=multidrug transport
  Homolog annotation: Hit_ID=A7NUS6; Match level="QueryCoverage=96%, HitCoverage=81%, E-value=1e-160, Identity=68%"; Hit description =Chromosome chr18 scaffold_1, whole genome shotgun sequence
  Pfam annotation: Domain name=MatE; Domain location=276-425; Score =49.7; E_value=1e-11; Accession=PF01554.9; Description=MatE
  Pfam annotation: Domain name=MatE; Domain location=56-216; Score =140.1; E_value=6.4e-39; Accession=PF01554.9; Description=MatE
  Pfam module annotation: Pfam domain module=MatE::MatE; Domain location=276-425::56-216
MGSLKGDSGHANGENLTEALLPTRDAQQQHQTDDEEQRFGDKLWLETRKLWLIVGPSIFSRLASFTMNVVTQAFAGHLGDVELAAISIANNVLVGFNFGLLLGMASALETLCGQAFGAKRYHLLGIYMQRSWIVLFMCCFLLLPFYVFATPLLKFLGQPDDVAEWSGVVAVWLIPLHFSFAFQFPMQRFLQCQLKTAVIAWVSLLGLVVNVVTSWLFIYVWDFGLYGAAISLDISWWVLVFGMYAYIAYGGCPLTWNGFSLEAFSGLWEFLTLSSASGVMLCLENWYYKILLLMTGQLENATIAVDALSVCMTINGWEMMIPLAFFAGTGVRVANELGAGNGKAAKFATQVSVAQSTIIGLIFCVLIMIFHEHIAYIFTTSTSVLQAVDNMSLLLAITILLNSVQPVLSDKNNGLLLALQRRFAT

SEQ ID NO: 121691 - protein, 111 aa, Glycine max
  Coding DNA Sequence Number=SeqID_30006
  Homolog annotation: Hit_ID=A7PD81; Match level="QueryCoverage=33%, HitCoverage=14%, E-value=8e-08, Identity=72%"; Hit description =Chromosome chr17 scaffold_12, whole genome shotgun sequence
  Subcellular localization annotation: CTP_CleavageSite=90; ConfidenceScore=5.37e-01
MEEEKAATYYDKLTRKGKRAARFKQGVGFSSSAPNATFQNPLPPSSPNSSKPPLSRRSKHSSNPSTTISRKSPLLSLGFQAGIGIAIEVEDESGAEKNEGKGAEAEIDTRK

SEQ ID NO: 121692 - protein, 25 aa, Glycine max
  Coding DNA Sequence Number=SeqID_30007
MVLLVKGVVVVVDMRVVETMIVVEE

SEQ ID NO: 121693 - protein, 110 aa, Glycine max
  Coding DNA Sequence Number=SeqID_30008
MAVAGNKGQNGTFKPRTQEEVCKRMRDKIPEITINVRNILKLATMLIKEFEKLQGIFGKDRANGRGAERCEDAMENQIGENQVSDDDEWLHQHDNSPSFIGNTFVGPPSK

SEQ ID NO: 121694 - protein, 322 aa, Glycine max
  Coding DNA Sequence Number=SeqID_30009
  Homolog annotation: Hit_ID=A2Q4W6; Match level="QueryCoverage=84%, HitCoverage=41%, E-value=1e-11, Identity=21%"; Hit description=RNA -binding region RNP-1
  Pfam annotation: Domain name=RRM_1; Domain location=51-121; Score =32.6; E_value=1.5e-06; Accession=PF00076.13; Description=RNA recognition motif. (a.k.a. RRM, RB
MSGERGERDTGWESVRNRRERREKGPRLSIDRKRNQDHHRYQRERNDITSFYFTRFPEEITKKDLWWHFKQVGDVREIFISPKRNKMGKRYGFVRFKGVQDVHQVEKKLDSMVFGGLKMFVNTPRYGRPKREYSQVEAKGRTGGKYHLEGSKELALTLKTGKKEHIQQGSYAEVVRRHSSRAAQRGILSNGELNCNSSRSSVNLEIQGIGQQWLKGAWIGRLKNMAMFERIEEYLWWDIGDNIYPKYIGDDMVLLHGLTEQKAKRMLEEDKEGWGEVFTSLEPWNLHIRAGSRLTWVHCWGIPLMAWDMQHIKKIVASIGEM

SEQ ID NO: 121695 - protein, 264 aa, Glycine max
  Coding DNA Sequence Number=SeqID_30010
MGISLSNNELEPPRNVSNLDDDEDEDDDYYFVSNSYVEEFLDEDDSVDGISDTDDKVTHMIEPVTIVQLRKGVEGIQNPFWNYVLHYNNINWSHPNEEDNYGLEMPSSFNVGQELYVGMIREDPSIKVSLIQERINNEFSYKVSYEKAWMAEQKAIAIEYDDWEESYAKLSSWPKHMPNNSLGSYFQILHDDFIVGNKVSREHRKEAFNYYVVYTNDHILKAYSAQWWPLGNEATIPPSDDSWTLISSLIQVQFVRKVGQNQQG

SEQ ID NO: 121696 - protein, 359 aa, Glycine max
  Coding DNA Sequence Number=SeqID_30011
  Homolog annotation: Hit_ID=A5AFS8; Match level="QueryCoverage=21%, HitCoverage=74%, E-value=9e-08, Identity=31%"; Hit description =Putative uncharacterized protein
MGAVKKLVVKEQVDMLCLQETKKEMVDKTVIGSGFISLEGTWKGDVDDFNCVRRQSERVGASQREQGGGIMTEFNDWIVDLEVEDMPSVGHKYTWYRLKSAFQDSRLPGFKIKLLGRQFGNVGERAQYKGEDRDLTEEEIKLRKELEEEVWVAAHSKESIMSQKARIKFEESSFERPRLDGVEFKTINQEANAKLVARFEEDEEFWNIMKIDVLRFSDEFHANGHFPKGSNASFLALIPRQKGVWDLASFNRALLGKWRWNLFHHTGELWGMDKGREAISIFNKIIFILLKTRRSGDGYEKEKKEDYVTFQYNSDYKNLLEKVETPEELMSHDGKHQNQDTKSESEWEQMMKWSDKSED

SEQ ID NO: 121697 - protein, 180 aa, Glycine max
  Coding DNA Sequence Number=SeqID_30012
MVSTSIPSPVSPPSSPPPQPTRLVEPVIRSHHLEGYIVNLKIPHKYSIWYEQDQFFLPVCNPTSPGTFFLETLLLASEVCIDRSHKQAIVSDNLTQGLGSVNLNSWNCRGGRNFGQNNRGGCGSGRGGGRGRFVDVQCQICHKFGHGVSYCYHRLEENYVPTLPPPASLAPTQSTSASNA

SEQ ID NO: 121698 - protein, 35 aa, Glycine max
  Coding DNA Sequence Number=SeqID_30013
MGTASLPHKFYTVVSHGCRRSSRACSSQSQLYLHT

SEQ ID NO: 121699 - protein, 325 aa, Glycine max
  Coding DNA Sequence Number=SeqID_30014
  Gene Ontology: Mol. function=alpha-glucan, water dikinase activity; Cellular component=chloroplast; Biological process=carbohydrate metabolic process
  Homolog annotation: Hit_ID=Q9STV0; Match level="QueryCoverage=93%, HitCoverage=23%, E-value=5e-62, Identity=40%"; Hit description=Alpha- glucan water dikinase 2 precursor
MEKNGQIYMLIIELRDPSIHAIEFVLKDGNHDRWLKLNHSNFRIEIPASDAPGISHSDSRIPKNLIEQKAYSRWEGRPISLPQQQKQNYDIALRELPNHLSKGITLTESRNSYLTGGIKPVNDNRDKLRSGIQYSYLNIEDWLQKHSEGHAKGTISTAALIENFIGGTDVLSKQIYHVHNYEIMVFSKTINGNNHIFIAANTKGTTVLHWGVCKSSPSEWLVPPQEIWPENSKLVSGACQSYFRDNFAGNRSFQVVYASALFHSPTIVDSWKRNFAGIQFVIWTGGYWIKHNGENFFAELKPINPTEKAIVPHAHPFGLLQLKSS

SEQ ID NO: 121700 - protein, 260 aa, Glycine max
  Coding DNA Sequence Number=SeqID_30015
  Gene Ontology: Mol. function=sequence-specific DNA binding; Cellular component=nucleus; Biological process=regulation of transcription, DNA-dependent
  Homolog annotation: Hit_ID=Q6J3Q5; Match level="QueryCoverage=31%, HitCoverage=22%, E-value=2e-22, Identity=62%"; Hit description=Male -specific transcription factor M88B7.2
  Pfam annotation: Domain name=GATA; Domain location=95-132; Score =56.1; E_value=1.2e-13; Accession=PF00320.18; Description=GATA zinc finger
MAHNPVLHAQTKHMEIDVFFVREKVLTKQLVVHHIPALDQWADALTKPLSTTRFMMHRKNGQFASLKESPGSSNWDSAQSSGQVGTSHSESVRRCHHCGVGENNTPAMRRGPAGPRTLCNACGLMWANKGTLRDLSKGGRNLSVEQSDLDTPIDVKPTSVLEGELPGIHDEQVESFTCCKFIFSSANGSSEDPSKSNAADGSSNHAVNPSDEELPETAEHFTNVLPLGIGHSSTNDSEQEPLVELSNPSDTDIDIPGNFD

SEQ ID NO: 121701 - protein, 189 aa, Glycine max
  Coding DNA Sequence Number=SeqID_30016
MVCTLEAMPESAPLSFYLSGWDAFLSDDLASSGQIIATASTSATTFADLKAAPARRWWWSINRLRCCVVTSCWFSSKLSRSERGRIVVVHRRDGACCGFAVSGLRWLVGGGFSGTSWWFRRGRGFTAVIALLGFLRLAVLVVTVVSAAVAALGGDDEDNTLLNDKDVTEMLNYYEGEKRANNVFLVDFV

SEQ ID NO: 121702 - protein, 99 aa, Glycine max
  Coding DNA Sequence Number=SeqID_30017
  Gene Ontology: Mol. function=sequence-specific DNA binding; Cellular component=nucleus; Biological process=regulation of transcription, DNA-dependent
  Homolog annotation: Hit_ID=A7NUK5; Match level="QueryCoverage=100%, HitCoverage=26%, E-value=4e-11, Identity=41%"; Hit description =Chromosome chr18 scaffold_1, whole genome shotgun sequence
  Pfam annotation: Domain name=GATA; Domain location=1-26; Score=15.9; E_value=0.0035; Accession=PF00320.18; Description=GATA zinc finger
MMRKGPSGPRSLCNACGLFWANRCGPADHSFLPYGIDVGVSPISAGTLRDLSKRNLEHSLTPPEQVDEGSNNNALDIRSGIPAQHNNLVNDSKALVSDR

SEQ ID NO: 121703 - protein, 187 aa, Glycine max
  Coding DNA Sequence Number=SeqID_30018
MNRLQRQQRYQDSWSGGGVIVGGGDVDDGSNRGVGGDEDDISGGGSGDDGNRGGNNDDNGVILVLVMATSDDHGGWDKVGGGCNSSDGGGIVRNGGDNDSSHDDGINGVGDDNNGASGGTTNAGDDGDISRTSGDNNDDDKGGMVVTMTKVSLVAAMIVIITIMIVVTITILMIAVVIGKSESVKIK

SEQ ID NO: 121704 - protein, 518 aa, Glycine max
  Coding DNA Sequence Number=SeqID_30019
  Gene Ontology: Mol. function=NADPH-hemoprotein reductase activity; Cellular component=endoplasmic reticulum membrane; Biological process=electron transport
  Homolog annotation: Hit_ID=P37116; Match level="QueryCoverage=94%, HitCoverage=70%, E-value=0.0, Identity=85%"; Hit description=NADPH- -cytochrome P450 reductase
  Pfam annotation: Domain name=FAD_binding_1; Domain location=110-335; Score=419.0; E_value=7e-123; Accession=PF00667.11; Description=FAD binding domain
  Pfam annotation: Domain name=NAD_binding_1; Domain location=371-483; Score=126.2; E_value=9.4e-35; Accession=PF00175.12; Description =Oxidoreductase NAD-binding domain
  Pfam module annotation: Pfam domain module=FAD_binding_1::NAD_binding_ 1; Domain location=110-335::371-483
MVPGIVRFNIFIKPSKKSNGYLLHGVVFAAGAKRLVTLGLGDDDQSIEDDFSAWKETLWPELDKLLRNEDDANTVSTPYTAAILEYRVVIHDPTVTSSYDNHINVANGNAVFDIHHPCRANVAIQRELHKPESDRSCIHLEFDISGTGITYETGDHVGVYADNCNETVEEAGKLLGQNLDLLFSLHTDKEDGTSLGGSLLPPFPGPCTLRTALARYADLLNPPRKAALVALAAHASELSEAERLKFLSSPQGKDEYSKWVVGSQRSLLEVMAEFPSAKPPLGVFFAAVAPRLQPRYYSISSSPRWFAPQRVHVTCALVYGPTPTGRIHKGVCSTWMKNAIPLEKSPDCCWAPIFIRPSNFKLPVDHSIPIIMVGPGTGLAPFRGFLQERFALKEDGVQLGPAILFFGCRNRRMDFIYEDELKNFVEQGSLSELIVAFSREGAEKEYVQHKMMDQAAHLWSLISQGGYLYVCGDAKGMARDVHRILHTIVQQQENVDSTKAEAIVKKLQMDGRYLRDVW

SEQ ID NO: 121705 - protein, 58 aa, Glycine max
  Coding DNA Sequence Number=SeqID_30020
MKVEAEPLRVGVQFCVHGRVGSGVSGGGGSGAARWWVCLGNRVVSVKGRGSRLCPIGA

SEQ ID NO: 121706 - protein, 178 aa, Glycine max
  Coding DNA Sequence Number=SeqID_30021
MGGEIAQLKEEIEMLRQEKLGRKIVTVRRKIFVEKYPSPTSAASLLGVQLIYLELQSRKEKLDFKYKKQGKLGLCLLSEESNDKIKMNTPEMSSASENSVKMEKTAEGLCCSCSKNSLCKTNKCRCRSSGGSCGASCGCKRFKCTNREPNQLEGNEPLKSDNTECTLEASAEDKDGSV

SEQ ID NO: 121707 - protein, 215 aa, Glycine max
  Coding DNA Sequence Number=SeqID_30022
  Homolog annotation: Hit_ID=A5BFT3; Match level="QueryCoverage=60%, HitCoverage=7%, E-value=9e-10, Identity=34%"; Hit description =Putative uncharacterized protein
MPFESQGFVSHSFPTSIAEKLDDFNYLHWRQHVKPTPMRAVSLEGKAMDEYLHKIKGYVDELADVGVLVRHEEYVDAILEGLPSDYAPVISVIKSKKRTPSIAEIEALLYYGHETRLVHYKKDTQFLNSPPLNYTQGYLHSSSYKSGDSGGSRGVYGQGVVVVADLPTSSAKSVSNMDILLIRSSNTWVNPNPKPIAQPTNQPSVMLTNSASHGN

SEQ ID NO: 121708 - protein, 168 aa, Glycine max
  Coding DNA Sequence Number=SeqID_30023
  Gene Ontology: Mol. function=small conjugating protein ligase activity; Cellular component=Golgi apparatus; Biological process =regulation of protein metabolic process
  Homolog annotation: Hit_ID=A1KXE3; Match level="QueryCoverage=33%, HitCoverage=7%, E-value=8e-20, Identity=73%"; Hit description =Putative ankyrin-like protein
MAWHRRELNAVFSAVSALELSMSKELHRFGVYGKPAPQDFTADYEHWKRVMSKSYLDGMGIKWSNVRNVIDMRSIYGGNFRLLEELQRGEKGIGDDTGSYGMDDGDDIYMHSWTGTIIGPHNDNRCRIGGYSTSIIRKINVGYLPWGDILRRFTATNDVELRTFYIGY

SEQ ID NO: 121709 - protein, 511 aa, Glycine max
  Coding DNA Sequence Number=SeqID_30024
  Gene Ontology: Mol. function=nucleotide binding; Cellular component =Golgi apparatus; Biological process=regulation of transcription, DNA- dependent
  Homolog annotation: Hit_ID=A7NUM5; Match level="QueryCoverage=99%, HitCoverage=100%, E-value=0.0, Identity=74%"; Hit description =Chromosome chr18 scaffold_1, whole genome shotgun sequence
  Pfam annotation: Domain name=DUF246; Domain location=104-475; Score =694.8; E_value=6.7e-206; Accession=PF03138.5; Description=Plant protein family
  Subcellular localization annotation: CTP_CleavageSite=51; ConfidenceScore=5.72e-01
MKLQIFTQLNQSQKSAFAVVFVILLPPFFSNLFQPLGRASPSTFSEWNAPRPMHVALLEGALQRQTSVELQTSIWSPLAFQGWKPCTERPKPPSLPEKSWGYIQVFLDGGLNQQKIGICDAVAVAKILNATLVLPHFEVNPVWQDSSSFADIFDVDHFIDDLRDEVSIVKELPSDYSWSTREYYGTGIRATRIKTAPVQATVDWYIENVLPVLQSYGIAAIAPFSHRLTFNNLPSDIQRLRCKVNFEALIFVSHIKELGNAIVHRLRHTTEGSDYPLEETDKFGKQQTGKFVVLHLRFDKDMAAHSACDFGGGKAEKLALVKYRQVLWQGRVLNSQFTDEELRNQGRCPLTPEEIGLLLAALGFNNRTRLYLASHKVYGGEARLATLSKLFPLMEDKKSLVSTEEMAKVKGKASLLAAVDYYVSMQSDIFISASPGNMHNALAANRAYMNLKTIRPSMGLLGQLFQNKSIGWSEFQRAILDGHKNRQGQIRLRKEKQSIYTYPAPDCMCRA

SEQ ID NO: 121710 - protein, 156 aa, Glycine max
  Coding DNA Sequence Number=SeqID_30025
MVRMVINEFQTWCSNFTKIQRHGFTATTTVTCDIFYGKNILHHRLPRRERNLWGNRTIRIVCAVSRVPRQCHMLTRRWCCRPENQILVSQWEHNHKRVVSKRWPQYGGATVKLQPPTTAHHLSSNGREIHSGSGGSRGGEETENAVVDDNGSKKSD

SEQ ID NO: 121711 - protein, 143 aa, Glycine max
  Coding DNA Sequence Number=SeqID_30026
MPYGDHCVVHDFDLISCFLGHIRWGPVVIKHRPKRVVRQFGYVQTIPPQTNDDTYVEPHIPKVPVAPAAAPAHAPSNVEQPRHAVEACQAIVERLDRLFNPRIVTTGTKIHEIMKDCLRIARGVIAEDNVYVRSRRRRCTDQP

SEQ ID NO: 121712 - protein, 116 aa, Glycine max
  Coding DNA Sequence Number=SeqID_30027
  Homolog annotation: Hit_ID=A5BEV8; Match level="QueryCoverage=97%, HitCoverage=14%, E-value=1e-15, Identity=40%"; Hit description =Putative uncharacterized protein
MGEDSWSLVHNQVGKELDKWSDDYIKLFGGTDRFEELRMSLLVDGLSMVTMDKWMDITEMRYVIASRYNVILVSLSLQQSMTFFPLRSQPPTDSSVHRIICIDHVYDNHFVQVDSR

SEQ ID NO: 121713 - protein, 39 aa, Glycine max
  Coding DNA Sequence Number=SeqID_30028
MYHLSYPNNIAKDRRKEIWTGKLDYCYIHACVEILEYLG

SEQ ID NO: 121714 - protein, 157 aa, Glycine max
  Coding DNA Sequence Number=SeqID_30029
MSERQSPENTISNPIPRRQPPPRIPLVQALSAIFGGEGGESGGAEAFAAREKEVLEGGEGVGEEGEVVVGEGHAFEVEFVEGGVVRLGECGDPGGEVGPPVQGHEVEVGEAWLALDGHGPDAGESAGGAAGGHGVAVSDEELGAGEGLGAVPGLADQ

SEQ ID NO: 121715 - protein, 105 aa, Glycine max
  Coding DNA Sequence Number=SeqID_30030
  Homolog annotation: Hit_ID=A5BYV1; Match level="QueryCoverage=79%, HitCoverage=7%, E-value=3e-16, Identity=50%"; Hit description =Putative uncharacterized protein
MPPLEDCSDAEPVNGDVIVTIRALNMQPKVGGDEEHKNIFHTGRHIEDKEFVGVFPKEISYGLPPSRGIEHQIDFIPSASLPNSQVQKKQRRFKGKLMSSCKRDF

SEQ ID NO: 121716 - protein, 666 aa, Glycine max
  Coding DNA Sequence Number=SeqID_30031
  Gene Ontology: Mol. function=protein binding; Cellular component =nucleus; Biological process=protein amino acid phosphorylation
  Homolog annotation: Hit_ID=Q94BQ3; Match level="QueryCoverage=61%, HitCoverage=54%, E-value=1e-172, Identity=73%"; Hit description =Putative uncharacterized protein At5g10940
  Pfam annotation: Domain name=WD40; Domain location=119-158; Score =16.1; E_value=0.13; Accession=PF00400.23; Description=WD domain, G -beta repeat
  Pfam annotation: Domain name=WD40; Domain location=184-226; Score =4.1; E_value=9.9; Accession=PF00400.23; Description=WD domain, G -beta repeat
  Pfam annotation: Domain name=WD40; Domain location=21-59; Score=35.7; E_value=1.6e-07; Accession=PF00400.23; Description=WD domain, G-beta repeat
  Pfam annotation: Domain name=WD40; Domain location=63-104; Score =23.5; E_value=0.00076; Accession=PF00400.23; Description=WD domain, G-beta repeat
  Pfam module annotation: Pfam domain module=WD40::WD40::WD40::WD40; Domain location=119-158::184-226::21-59::63-104
MVRDCNFGRNIKVFGVIVNTITIMASSDGHTGCVNAVAWNSKGSILISGSDDLRINIWSYSGWKLLHSIDTGHTANIFCTKFIPETSDELVASGAGDAGVRLFNLSRLSGSGFSDNAIIAPSAHYQCHTRRVKKLAVENGNPNVVWSASEDGTLRQHDFREGTSCPPAGSSHQECRNILLDLRSGSKRSLADPPKQVLALKSCDISSTRPHLLLVGGSDAFARLYDRRMLPPLSSCWKRMSPPPCVNYFCPMHLSDHGHPSLHLTHVTFSPDGHEVLLSYSGEHVYLMNVNHAGVNEMQYTSGDNSKLMTYSPTINGTEMQPCVSNVFPNGFPIKKNIAAKLDKCRKLIKYAKKSLDNGTPYYGIDACNEVLNGYSHIIGPALKHECLCTRAALLVKRKWKNDAHMVIRDCYAAREIDNSSYKALYYMSEALSQNGRVKRIEVEALVNDIDSHYCLVEPVIKAHKLQCFVASPQIPMRFLTEADCEPGNENPAYTDWEQQDQILLSWLQSTLLVSILSRIIGCVHSYKLWEQLHEYFQKQTCVKARILRAELKTTMLEQKTMREFLLRIKCIVDALGSKFEPLPIREVKALLLAHEARMKKFQKRFADSPSINVAQGSDSDRGGGYSHEGNGFGVLEVIVVATEPNMSLTLMEPVFQSNSSNTFGS

SEQ ID NO: 121717 - protein, 406 aa, Glycine max
  Coding DNA Sequence Number=SeqID_30032
  Gene Ontology: Mol. function=transcription regulator activity; Cellular component=nucleus; Biological process=regulation of transcription
  Homolog annotation: Hit_ID=A5C8Z8; Match level="QueryCoverage=88%, HitCoverage=89%, E-value=3e-74, Identity=45%"; Hit description =Putative uncharacterized protein
  Subcellular localization annotation: CTP_CleavageSite=50; ConfidenceScore=5.34e-01
MGGDCGTWVPHLQFGWQSPNLNPLDMGKPVGISAAMNPGFNMVSSNVTVPAFVSSALPHLQLGHSYEPSGWSYCLPPFRQGFSPALNFNAEGKTPADHVKTFGDKIGPYGESSSHQKQFLVIDQTGGQTTIVYSSMFGNPDECLASWHSKLHGANYLRGNEPSFRRDLNLNLNLKVNMTEPTLAHKVDENLKTSIESEMHEDTEEINALLYSDSYGYSTQDEDDDDEVTSTGHSPSTMTTHDNCEAFRGETAEEVASIAGKTKKRKQLDGYYDDIQLIDTGSSQNLNKSSATGDDAESRCSSNNNEGSLSGNKKMKKDKIRDVLSILRSIIPGGKDKDPAMLLDDAIHCLKNLKHKAQALRLDAFSVDLLVVHTSWSLQNKQGRALSELDCVRKDGSVQCIKRNKG

SEQ ID NO: 121718 - protein, 267 aa, Glycine max
  Coding DNA Sequence Number=SeqID_30033
MLQSPTSRSSAQFEAANRQTLSVLVEHPFTVVGATIITDDARVLAASTAYAFSPHLRLHQPPPLKISSFSKQRQSVVAGINRQGVALEAENIVEVVGDGGEGSQISLNNVYEVVMISSNIWWASTVSIIFIIPTRQICIPGTQGSGCDFILKGCCKEDLILCGFGGSYAGYLLLWIWSSTTSPNRPTNLHKTLAVLLLLCLHLDTSGRIAASIGIWFTFFLYLLTHRPSPLLPRFAIFGATEMHNARGKTTRLFTFSLSALFDPSLN

SEQ ID NO: 121719 - protein, 88 aa, Glycine max
  Coding DNA Sequence Number=SeqID_30034
  Pfam annotation: Domain name=zf-GRF; Domain location=16-62; Score =22.4; E_value=6e-05; Accession=PF06839.3; Description=GRF zinc finger
MERSSSSYTSEARSRVMCLCNVEAPLVTSWTEDNPGIHFYGYGLYMVTGRKGCNYFEWHDPVANSLQKRIIVALMKKVDELNLREKGM

SEQ ID NO: 121720 - protein, 348 aa, Glycine max
  Coding DNA Sequence Number=SeqID_30035
MDSLLAGISTGTPTSETLEDYNDNEDDGYFASVNGKTYYFARTSSGTEGSVSTTSDTTLCQLSTSAWWVSLDQWAKHTHAWCRQPTWRNDHAFTPSLHARMHAMHHMGAASLASETRAMGSANPIGETGHDEDKTKGKDHEALEGPMTRDILKKAQHSDEDTTKGKDHEALEGPMTRDRLKQAQHDIETRLKASLRVPVEPNSDLSRLIPCGVTVTYLPSLEVASLSANNPVSNVPPRKIRVRAPPAPSKTFEKAFACSYVEAKKLGNWLAHPDWQHSCDAWHASMHGGKRNPPCKRGKLTQCCVAGGAGGTLCAAAGLCEIGCFAIGTGETPLKIDSPKNFFTNRPL

SEQ ID NO: 121721 - protein, 169 aa, Glycine max
  Coding DNA Sequence Number=SeqID_30036
  Gene Ontology: Mol. function=transferase activity, transferring glycosyl groups; Cellular component=mitochondrion; Biological process=metabolic process
  Homolog annotation: Hit_ID=A5AX74; Match level="QueryCoverage=98%, HitCoverage=41%, E-value=3e-33, Identity=32%"; Hit description =Putative uncharacterized protein
  Pfam annotation: Domain name=PPR; Domain location=104-138; Score=2.2; E_value=4.3; Accession=PF01535.11; Description=PPR repeat
  Pfam annotation: Domain name=PPR; Domain location=12-46; Score=38.2; E_value=2.9e-08; Accession=PF01535.11; Description=PPR repeat
  Pfam annotation: Domain name=PPR; Domain location=47-81; Score=43.1; E_value=1e-09; Accession=PF01535.11; Description=PPR repeat
  Pfam module annotation: Pfam domain module=PPR::PPR::PPR; Domain location=104-138::12-46::47-81
MVSRDHIVPDPLTYNVLINEFCRRGKPDRARNVIEFMKSNRCYPNVYNYSALVDGLCKVGKLEDAKGVLAEMKGSGLKPDTVTYTSLINFLCRNGQIEKIDLRRLWICLRNSHNKAGMVDDAAVALFYLVEMGFQPGLESWEVLIGLICRERKLLYVFELLNELVITNS

SEQ ID NO: 121722 - protein, 966 aa, Glycine max
  Coding DNA Sequence Number=SeqID_30037
  Gene Ontology: Mol. function=ubiquitin thiolesterase activity; Cellular component=integral to membrane; Biological process =ubiquitin-dependent protein catabolic process
  Homolog annotation: Hit_ID=A5B0M8; Match level="QueryCoverage=96%, HitCoverage=75%, E-value=0.0, Identity=48%"; Hit description =Putative uncharacterized protein
  Pfam annotation: Domain name=UCH; Domain location=665-966; Score =131.6; E_value=2.3e-36; Accession=PF00443.20; Description=Ubiquitin carboxyl-terminal hydrolase
MRVTGDLGFSSLVLVVVCVVLPVIGFVIRRKWQVSEARKDEIKRLLVLAAEETARAEKEASYEYGTAVSAAPSNLCAVCYFPATARCAQCKSVRYWVENGNVDSDFLFWSASLLARFSISVLEELFDKCSPLCTGDQLAVPLYKPLAIVNGNKNHAATFASSFECQTVHWRQGHKLECRPPSTTCWSDDVASDHGRKLVEQGYSGIHVEKSESEGKECKVASEKSPISDICFSPKVSPGKDGNIRVESLAEGNITDSNSELSSNSFSGFSASTGSNDSSDDSSVCESIISNEHDGSKGHTFVDPTLDIPDNTSDDCMGVTMSTSPKFATLVDSVDGFSTMHKLNHTGPGFSKEESKLASNGNPGSSMWKGKTIEPSTVVSGFWDKALDSRGIKDDTKNDTHPSCSDESTGKRTVSESSFHFSFSTMSPLHVRDTKTNDSVSDDAFPNCIGNDMASSGSASSENDKMNSSKGRNFSFINSKVSSVRSYVTPSGSESDQLESKDSSGPPLSSFSPQSSSVDKNSVCADALNFHILQSTGSKVSNHVVDNRGSTLKSTEIGFLTRELADSNLASGTEEHSHSSTKQGNNDIESGTQTVTSSQVASCSANSKSGLKTSVLKVVDQFRGSNLSKHFPLAVGSDIAGRHNDKSFFPYELFVKLYNSNKVELCPFGLINCGNSCYANAVLQCLAFTPPLTAYLLQGSHSKSCANKKWCFTCEFERLILKSKDTKSAVSPMGIISHLQNIGSQLANGREEDAHEFLRHVIDTMQSVCLMEAGVNALGSLEEDTTLMGQTFGGYLLSKIKCMRCGGKSERQERMMDLTVEIEGEITTLVEALRRFTSTETLDGENKYHCVRCKSYEKAKKKLTVSEAPNVLTVALKRFQRFLFVTSVLQSGKFGKLNKPIQFPEILNLAPFMSGTSDKSPIYRLYGVVVHLDIMNAAFSGHYVCYVKNIQNKWFKVDDSVVSPSV

SEQ ID NO: 121723 - protein, 331 aa, Glycine max
  Coding DNA Sequence Number=SeqID_30038
  Gene Ontology: Mol. function=metal ion binding; Cellular component =integral to membrane; Biological process=ubiquitin cycle
  Homolog annotation: Hit_ID=A7Q6B2; Match level="QueryCoverage=64%, HitCoverage=47%, E-value=9e-49, Identity=51%"; Hit description =Chromosome chr11 scaffold_56, whole genome shotgun sequence
  Pfam annotation: Domain name=PHD; Domain location=117-162; Score= -3.7; E_value=0.036; Accession=PF00628.20; Description=PHD-finger
  Pfam annotation: Domain name=zf-C3HC4; Domain location=118-159; Score= 38.1; E_value=3.1e-08; Accession=PF00097.16; Description=Zinc finger, C3HC4 type (RING finger)
  Pfam module annotation: Pfam domain module=PHD::zf-C3HC4; Domain location=117-162::118-159
MLMPPSSFTLLLTLLLLFLTYEAESGETPPPTPPPPFRPGIAVLVCVLTTIISLTSLLLLYIKHCNGGIPDGGGGNSAPWTVAPFSGRKNSGIDRSVVESLPVFRFGALRGQKEGLDCAVCLNKFEAAEVLRLLPKCKHAFHVECVDTWLDAHSTCPLCRYRVDPEDILLVEDAKPFRQSHQQQRNKEEERVRLNLDLEKQEIVESRRRHSSVGVGEGETTEEQQQSRRWTTSFRRSLDSISATSRKKNESKRRDVVDARDGEGKRGTEVGAPDYCLPGPGPGPRPRPRSVWARAAVERLAGFGPAVSDVGDDNDEGQLEWQREWCLRSGD

SEQ ID NO: 121724 - protein, 235 aa, Glycine max
  Coding DNA Sequence Number=SeqID_30039
  Homolog annotation: Hit_ID=A5B0N4; Match level="QueryCoverage=37%, HitCoverage=26%, E-value=3e-07, Identity=35%"; Hit description =Putative uncharacterized protein
  Pfam annotation: Domain name=PWWP; Domain location=20-95; Score=-1.1; E_value=0.026; Accession=PF00855.8; Description=PWWP domain
MACGSKSGKSEISEGGANDSVAVGDVIFVKLRGSSWWPVQVVDENSVNKSVKPSKRTKRLPGDILALFPSAAHMLILLNVVMSLRGFQILERNDGSLKKVLLQTLEQGLSEHLTKKVEDIVVIERDEWKQDFESIRIQALTSLNFPNCKGESWRRCVAVEGVIEVTFTTLVVKQDGHTQDNYYSLHGFPYKIAKVSQSPNPAIEQKIKSEGNHLSLFSANEYKEYLQLKEAYSLY

SEQ ID NO: 121725 - protein, 83 aa, Glycine max
  Coding DNA Sequence Number=SeqID_30040
MEKSSSPGSKTNGGWLSCWGRLKLKLPWAKRTSTYKSIGGFKYDPLSYAQNFDEGWVEDDEESLHRGFSARYAAPSSHKLFKQ

SEQ ID NO: 121726 - protein, 560 aa, Glycine max
  Coding DNA Sequence Number=SeqID_30041
  Gene Ontology: Mol. function=oligopeptide transporter activity; Cellular component=integral to membrane; Biological process =oligopeptide transport
  Homolog annotation: Hit_ID=A7NUI7; Match level="QueryCoverage=100%, HitCoverage=79%, E-value=0.0, Identity=61%"; Hit description =Chromosome chr18 scaffold_1, whole genome shotgun sequence
  Pfam annotation: Domain name=OPT; Domain location=34-560; Score =460.1; E_value=3e-135; Accession=PF03169.6; Description=OPT oligopeptide transporter protein
MASIEMESAKEDDISPIEEVRLVVSNEDDPRQPVWTFRMWFLGIVAVILLSFLNTFFGYRKQPLLVTMISVQVATLPIGRFMARVLPPTKFRIRGRDFSLNPGPFNIKEHVLISIFANAGAAFGNGAAYAVGIVDIIRAFYGRKITFLAGWLLVLTTQVLGYGWAGIMKKYVVEPAEMWWPSTLVQVSLFRNYAKSRTLAASTSTRPYTSSNCPMARSPLSCLSFVLPQQIGSGEKGLGLGSFSLDWTTVAAFLGNPLVSPFFATANVLVGYILLIYLIIPVSYWGLNIYNAKNFPIYSSSLFVANGTEYNVKAIVNEKFEIDMLAYEKQGRVNLSAFFAISYGIGFAAIASSLTHVAIFNGREIYEQFRSSRSKKEDIHARLMKKYKRIPSWWFHVTLLVSFALALLLCIVMKDQIQMPWWGLIFASGIALTFTLPVSIITATTNQTPGLNIITEYIMGVILPGKPIANVCFKTYGYISMSQAVSFLSDFKLGHYMKIPPRSMFIVQVVGTLIAGTMDVGVAWWLLGSVKNICNQDLLPADSPWTCPGDKVFFDASVIW

SEQ ID NO: 121727 - protein, 69 aa, Glycine max
  Coding DNA Sequence Number=SeqID_30042
MVVGGWNSGVWLDGSIGWRWDLLGRGRGICVCSGLFGGTGSKKEESQGSDELEKRKNWGRMYSHLGLGV

SEQ ID NO: 121728 - protein, 108 aa, Glycine max
  Coding DNA Sequence Number=SeqID_30043
  Homolog annotation: Hit_ID=A5ANB2; Match level="QueryCoverage=67%, HitCoverage=24%, E-value=8e-08, Identity=38%"; Hit description =Putative uncharacterized protein
  Pfam annotation: Domain name=zf-CCHC; Domain location=53-70; Score =8.4; E_value=0.083; Accession=PF00098.14; Description=Zinc knuckle
MRAEGSVEGALQVKLQTNQGEENKWKKYKKKNFNTQEATANTSNNNEDNKGFPLCKHCGRMDHLPFKCWRRPDGIKGNGDLITVEGKRTIAIESCVDSSKLAKCGTID

SEQ ID NO: 121729 - protein, 159 aa, Glycine max
  Coding DNA Sequence Number=SeqID_30044
  Subcellular localization annotation: CTP_CleavageSite=53; ConfidenceScore=5.22e-01
MTHRFPPSCWFWSNGTSYPKKKRHGKPRKHCAQISTLRTRCLCQTRVLMQIINATTKEHPLAKLLERLREPLSEHDRVIPLVISALMDIGFMHVMIMPAFWRRWDNLFDLSSALPHHAKEHFLQNSHGLQEYTLIKIVYGIIACPPLGHGSKGIKRISR

SEQ ID NO: 121730 - protein, 118 aa, Glycine max
  Coding DNA Sequence Number=SeqID_30045
  Gene Ontology: Mol. function=phosphatidylinositol binding; Cellular component=clathrin coat; Biological process=clathrin cage assembly
  Homolog annotation: Hit_ID=Q8S9J8; Match level="QueryCoverage=74%, HitCoverage=12%, E-value=3e-10, Identity=39%"; Hit description =Putative clathrin assembly protein At4g32285
MKVDFGAYRRKLSDGVVESVEFRDEFGSTERERNKVTLVKEMGVERVLKRLNCLLRMFDRALGCRPNGAAKNNNLVLVALCQVVRDSFKLYAKSKDLPHEFAYIDKDLSHRHMTNSGN

SEQ ID NO: 121731 - protein, 275 aa, Glycine max
  Coding DNA Sequence Number=SeqID_30046
MASGKNLAWPLLCHHESSQGLVKECLLVVVFDDRLERVAQPVALCVEYPDGHQRWHAINEVASCENITPKMQGNIAIEEKSLGCFNKDRLDSEGWKRVFETHWQSQVPKDPRKIKEIQAIDLPVGLSSRLSGIIWRCLSYIGKRPNLLLWETRADESPMVDSGTSTVGSNEIRSNVADADCIVGAIVLEFRLSLGGDRGSGGGPTWARQIAKELGRSSSLCTCCITVEHHSCREHVPHSKPIHNLGYVFSGSSEMGFVAKPTNAQSDVGCPSRVV

SEQ ID NO: 121732 - protein, 60 aa, Glycine max
  Coding DNA Sequence Number=SeqID_30047
MSPCKFGSASVCARDLHQRFRDKDEAVMEVALQQQRICRGGRSVMSTMSLRVYTQDASIT

SEQ ID NO: 121733 - protein, 588 aa, Glycine max
  Coding DNA Sequence Number=SeqID_30048
  Gene Ontology: Mol. function=shikimate 5-dehydrogenase activity; Cellular component=cytoplasm; Biological process=tetrapyrrole biosynthetic process
  Homolog annotation: Hit_ID=Q9ZPK4; Match level="QueryCoverage=91%, HitCoverage=99%, E-value=0.0, Identity=80%"; Hit description =Glutamyl-tRNA reductase
  Pfam annotation: Domain name=F420_oxidored; Domain location=323-504; Score=-56.5; E_value=0.045; Accession=PF03807.8; Description=NADP oxidoreductase coenzyme F420-dependent
  Pfam annotation: Domain name=GlutR_N; Domain location=143-294; Score =289.8; E_value=5.3e-84; Accession=PF05201.6; Description=Glutamyl -tRNAGlu reductase, N-terminal domain
  Pfam annotation: Domain name=GlutR_dimer; Domain location=463-569; Score=189.4; E_value=8.9e-54; Accession=PF00745.11; Description =Glutamyl-tRNAGlu reductase, dimerisation domain
  Pfam annotation: Domain name=Shikimate_DH; Domain location=298-450; Score=229.6; E_value=6.9e-66; Accession=PF01488.11; Description =Shikimate  quinate 5-dehydrogenase
  Pfam module annotation: Pfam domain module=F420_oxidored::GlutR _N::GlutR_dimer::Shikimate_DH; Domain location=323-504::143-294::463 -569::298-450
  Subcellular localization annotation: CTP_CleavageSite=48; ConfidenceScore=5.29e-01
MEEGSFVVINYNSGRTFFPEFLRKNFFRAISRKNFFRRNPQKKGSPESAMAVSTTFSGAKLEALLLKCSSSSSSPPPSRSSFTTFPGQNRRTLIQRGVIRCDAQPSDASSVAPNNATALSALEQLKTSAADRYTKERSSIIAIGLSVHTAPVEMREKLAIPEAEWPRAIAELCSLNHIEEAAVLSTCNRMEIYVLALSQHRGVKEVMEWMSKTSSVPVSELSQHRFLLYNNDATQHLFEVSAGLDSLVLGEGQILSQVKQVVKVGQGVNGFGRNISGLFKHAITVGKRVRTETNIASGAVSVSSAAVELAYMKLPEASHDNARMLVIGAGKMGKLVIKHLVAKGCKKMVVVNRTEERVAAIREELKDIEIIYKPLSEMLTCAGEADLVFTSTASENPLFLKEHVKDLPPASQEVGGRRFFIDISVPRNVGSCVSDLESVRVYNVDDLKEVVAANKEDRLRKAMEAQAIIAEESKQFEAWRDSLETVPTIKKLRAYAERIRLAELEKCLGKMGDDIPKKTRRAVDDLSRGIVNKLLHGPMQHLRCDGNDSRTLSETLENMNALNRMFNLETEISVLEEKIRAKVEQNQK

SEQ ID NO: 121734 - protein, 509 aa, Glycine max
  Coding DNA Sequence Number=SeqID_30049
  Gene Ontology: Mol. function=sucrose transmembrane transporter activity; Cellular component=integral to plasma membrane; Biological process=sucrose transport
  Homolog annotation: Hit_ID=A3DSX1; Match level="QueryCoverage=77%, HitCoverage=77%, E-value=1e-163, Identity=71%"; Hit description =Sucrose transport protein SUF4
  Pfam annotation: Domain name=Sugar_tr; Domain location=55-491; Score=- 185.4; E_value=0.097; Accession=PF00083.15; Description=Sugar (and other) transporter
MPRGIGQNEIVNKLERETEGARNLEFKHNGESRNPTTTTTTSTPPPTPPGSAEDAAAGSVGCRWHSVRVGPAAISSHAVRAAARDPARVGQHHMALWAALWAPGPAPALSIVAAVLIIGHSADIGWWFGDTLEHRPWAVGVFVFGFWILDVANNVTQGPCRALLGDLTGKDQRRTRVANAYYSLFMAIGNILGYATGSYSGWYKVFAFTLTPACNISCANLKSAFFLDIIFIAVTTYISIVAAKEVPLSSSGAHPVEEAAAGESGTAGEAFLWELFGTFRYFSTPVWTILTVTALTWIGWFPFLLFDTDWMGREIYGGEPNEGPNYDTGVRMGALGLLLNSVVLGVTSVLLERLCRKRGPGFLWGISNILMAVCFISMLVVTYVANNIGYVGKDLPPTGIVIASLIIFTILGFPLAITYSVPYALISTHIQSLGLGQGLSMGVLNLAIVFPQMVVSLGSGPWDQLFGGGNSPAFGVAAVAALASGLIAVLFIPRPGGQKPRSPRNDENE

SEQ ID NO: 121735 - protein, 180 aa, Glycine max
  Coding DNA Sequence Number=SeqID_30050
  Subcellular localization annotation: CTP_CleavageSite=79; ConfidenceScore=5.75e-01
MAGHRAKAPTTPSSSLFTAISPLFLLCTRVVNASSSKLGWCHGVGSPLATKFKPGVRLRRIWVVGFGGEERMAVENLLPCDLAKELLLHESTEEGSSAVVIFNCGRTFFCEMTRKKVLSQLMLQLWKNLLPCDLAKEVLSQEFTEESSSVVVIYNYERTFFRGFLQNKFFREMAWKKVLP

SEQ ID NO: 121736 - protein, 127 aa, Glycine max
  Coding DNA Sequence Number=SeqID_30051
MWVSRERFLGDFRREEKEKSDFSMISSYDTSGLLHEALDLLRDTHVMRFKPSEIGMISITHVLAELAERVIGESHACLCNHKWQASIICWTAMRKAYIHCNNLNEGSGNRLPGSVIDYQKTGLRNSC

SEQ ID NO: 121737 - protein, 199 aa, Glycine max
  Coding DNA Sequence Number=SeqID_30052
YAWGVVALIDMYENLNDGSKRSASQIVGYITLLQCSIYEHFPTVVSSIVVEGYHERKPCACYWKSGKILPVSAYHKRLDTLASHVTILPHPIAQSLFIEDIDDRWIQFSKYLTLVGQICVALGQHPLVMHDDTFVEPYHPQQLVATTAMPEPPTAAPTDVDMHRHTLDGQGCDCARECIRSIEMKAAYARHMKIVRIFK

SEQ ID NO: 121738 - protein, 333 aa, Glycine max
  Coding DNA Sequence Number=SeqID_30053
GVWLEEEEDIKHMVSEYYHDLFIDNGVEKYAITEFTFLAVLLKEKISLNGPFKIEEIKNALFDMSLWKASGLDGLPASMVVPEVEREKLKEKDEKAGAIQQIDDVFGLVDSEVSDFCAVKVVKIKTVVGRMGGTVAGASVAVAVAVRHGVRREGSDREEGTLRGEIICVVHCCVVVVALMPRLIFPNQTRFIPTGSTYDRMQWPFIKNVMEEVVLPADLIKGLLQGGLLSPYLLILGMDKLFHLILKEVNNGEENLWTQVLKGKNGRSSNFEDALVLKPLDSTLRKVVASYYPFLKENEIISSLSYNKLPDLVNDGGDWNIELLRDILPREIV

SEQ ID NO: 121739 - protein, 537 aa, Glycine max
  Coding DNA Sequence Number=SeqID_30054
  Gene Ontology: Mol. function=kinase activity; Cellular component =cytoplasm; Biological process=carbohydrate metabolic process
  Homolog annotation: Hit_ID=A7NUF7; Match level="QueryCoverage=99%, HitCoverage=99%, E-value=0.0, Identity=75%"; Hit description =Chromosome chr18 scaffold_1, whole genome shotgun sequence
  Pfam annotation: Domain name=FGGY_C; Domain location=294-501; Score= -60.7; E_value=0.004; Accession=PF02782.7; Description=FGGY family of carbohydrate kinases, C-terminal domain
  Pfam annotation: Domain name=FGGY_N; Domain location=11-290; Score =14.8; E_value=5.7e-11; Accession=PF00370.12; Description=FGGY family of carbohydrate kinases,
  Pfam module annotation: Pfam domain module=FGGY_C::FGGY_N; Domain location=294-501::11-290
MAELSLPQDSYFLGFDSSTQSLKATVLDSNLNIVASELVHFDSDLPHYKTKDGVHRDPSGNGRIVSPTLMWVEALDLILQKLSKSNFDFAKVAAVSGSGQQHGSVYWKSGSSQILSSLDPKKPLLDQLENAFSIKESPIWMDSSTTAECRAIEKAFGGALELARVTGSRAYERFTGPQIKKIFDTQPEIYDGTERISLVSSFMASLCVGAYASIDHSDGGGMNLMDLKEKAWSKVALEATAPGLESKLGELAPAYAVAGNIAPYFVERYNFNKDCLVVQWSGDNPNSVAGLTLNIPGDLAISLGTSDTVFMITKDPNPGLEGHVFPNPVDAEGYMVMLVYKNGSLTREGGKLGFYYKEHEILPPLPVGFHRYIIENFSDTPDGLKEQEMEEFDPPSEVRNQVVRALIEGQFLSMRAHAERFGMPSPPKRIIATGGASANHCILSAIASIFGCDVYTVQRPDSASLGAALRAAHGWLCNKKGGFLPISDMYVDKLEKTSLSCKLSVSAGDHELVSKYATLMKKRIEIENRLVQKLGRF

SEQ ID NO: 121740 - protein, 188 aa, Glycine max
  Coding DNA Sequence Number=SeqID_30055
  Gene Ontology: Mol. function=secondary active sulfate transmembrane transporter activity; Cellular component=integral to membrane; Biological process=sulfate transport
  Homolog annotation: Hit_ID=Q9AT47; Match level="QueryCoverage=95%, HitCoverage=27%, E-value=1e-78, Identity=79%"; Hit description =Sulfate transporter 2
MGPPADENIETKKVDLRSMPSSSFGQAPQAHKVAIPPRQNLFKEFQDTIKETFFSDDPLRPFKDQPRSRKIRLGIEAIFPILSWGRSYNLKKFRGDLISGLTIASLCIPQDIGYAKLAHLAPQYGLYSSFVPPLIYAVMGSSRDIAIGPVAVVSLLLGTLLSNEIDPNTHPAEYQRLAFTATFFAGIT

SEQ ID NO: 121741 - protein, 248 aa, Glycine max
  Coding DNA Sequence Number=SeqID_30056
  Gene Ontology: Mol. function=secondary active sulfate transmembrane transporter activity; Cellular component=integral to membrane; Biological process=sulfate transport
  Homolog annotation: Hit_ID=A1Z0J1; Match level="QueryCoverage=99%, HitCoverage=37%, E-value=3e-99, Identity=76%"; Hit description =Sulfate transporter
  Pfam annotation: Domain name=STAS; Domain location=121-236; Score =135.1; E_value=2e-37; Accession=PF01740.12; Description=STAS domain
  Pfam annotation: Domain name=Sulfate_transp; Domain location=1-98; Score=-126.2; E_value=0.00049; Accession=PF00916.11; Description =Sulfate transporter family
  Pfam module annotation: Pfam domain module=STAS::Sulfate_transp; Domain location=121-236::1-98
MAGCQTAVSNIVMSVVVFLTLKFITPLFYYTPNAILSAIIISAVISLVDYEAAILIWKIDKFDFVACMGAFFGVAFVSVEKGLLIAVSISYAKILLQVTRPRTAILGKIPRTTVYRNIQQYPEASKIPGVLIVRVDSAIYFSNSNYVKERILRWLMDEEKGDYRTKIQFLIVEMSPVTDIDTSGIQAFEELHRSLEKKGVELVLANPGPAVTDKLYASSFANTIGEDKIFLTVAQAVAYCSPKVVEDP

SEQ ID NO: 121742 - protein, 407 aa, Glycine max
  Coding DNA Sequence Number=SeqID_30057
  Homolog annotation: Hit_ID=A7Q6S3; Match level="QueryCoverage=96%, HitCoverage=55%, E-value=1e-107, Identity=49%"; Hit description =Chromosome chr12 scaffold_57, whole genome shotgun sequence
KTFGSAAPDLDPSSVYGVWRIDDTDNSFSTQSFRIKYARQDVHLYMMIVFNLSRSEFVDLATTAVILKFELIYAPATEDGVNMQASLDDSSAAIHEFRIPPKALIGLHSYCPVHFDALHAVLVDGFGGVAFLDTGNVSLVKALLTSRDILVEELQKISKAINEALDISEFVSIMSNMKLLNSVLQVNQFAIDVEVVGQGKPQNGLKGGNEALDFLDVEKLHSLSQNELDNKSRILGFLRDAWVKDRKAEWSIWMLYSKVEMPHHYINSKSEESSHRGVHRRVSSLWKLPDDPLQTAATRAELHRRSIEQMRINNRSVQDMQIFGDLLHTPIVIVEHVMNVPRRCPSANSLLRHIGSIDSDGLPIGLSSDTIGKKFATQSNARVLKIVVFVHGFQACLVDFIAKPFSI

SEQ ID NO: 121743 - protein, 208 aa, Glycine max
  Coding DNA Sequence Number=SeqID_30058
MELSGRAFGVFSYPNPSIVEHCGFGYRSGEIQGNGNSAEESPGADAAGGAATAGVDRDFEAELGGEDGFAGELVEIGLAEVESSSDRMDQGVREEGIRRNEGNDGGLKRKILELDFAETGRRRRMNNGARGFGSDGNFEGEVANGESGERARIHGGRERRQFLKVMERDERAEKEDVVGFKHVDGANGNWIEDSVFVDGASHEDAGMG

SEQ ID NO: 121744 - protein, 49 aa, Glycine max
  Coding DNA Sequence Number=SeqID_30059
MVHQPYCWVHLATPVQFRGKGCKSPVSLASPSLLWETASLTSGLGSDLA

SEQ ID NO: 121745 - protein, 170 aa, Glycine max
  Coding DNA Sequence Number=SeqID_30060
MWVLYQLRQYSLDEERSAKRFENLKAGLETKKLGRKGLQPWTNYKPYELMDDTEENEHERDDVVVIHDGDKVEEEKSEEVEDLIDEQDKEKEEQNEDEEGEDMGKQMEGLMSLLEDEGEEDTHATTEKHNKEKVHPGFKKNKRGRGRKFKKGWNRKAAEENLGAKQFKSS

SEQ ID NO: 121746 - protein, 743 aa, Glycine max
  Coding DNA Sequence Number=SeqID_30061
  Gene Ontology: Mol. function=polynucleotide adenylyltransferase activity; Cellular component=nucleus; Biological process=RNA 3'-end processing
  Homolog annotation: Hit_ID=Q2V3C3; Match level="QueryCoverage=77%, HitCoverage=74%, E-value=0.0, Identity=74%"; Hit description =Uncharacterized protein At4g32850.8
  Pfam annotation: Domain name=NTP_transf_2; Domain location=82-179; Score=35.4; E_value=2.1e-07; Accession=PF01909.14; Description =Nucleotidyltransferase domain
  Pfam annotation: Domain name=PAP_RNA-bind; Domain location=370-506; Score=210.0; E_value=5.7e-60; Accession=PF04926.6; Description =Poly(A) polymerase predicted RNA binding domain
  Pfam annotation: Domain name=PAP_central; Domain location=20-369; Score=559.1; E_value=4.6e-165; Accession=PF04928.8; Description =Poly(A) polymerase central domain
  Pfam module annotation: Pfam domain module=NTP_transf_2::PAP_RNA -bind::PAP_central; Domain location=82-179::370-506::20-369
MAVSDSPSGGSTPPQQEQQPNKYAFTKPLSLAGPTDADLQRNNELDKFLLDSGLYESNEESAARKEVLHRLDQIVKNWVKQLTRQRGYTDQMVEDANAVIFTFGSYRLGVHGPGVDIDTLCIGPSYVNREEDFFVILHNILAEMEEVSELQPVPDAHVPVMKFKFQGISIDLLYASISLLVVPEDLDISHGSVLYDVDEPTVRSLNGCRVADQILKLVPNVEHFRTALRCLKFWAKRRGVYSNVTGFLGGVNWAILVARICQLYPNAIPSMLVSRFFRVYTQWRWPNPVMLCSIEENELGFPIWDPRRNPRDRFHTMPIITPAYPCMNSSYNVSASTLRVMMEQFRYGNKICDEIELNKAQWSALFQPYIFFEAYKNYLQVDIIASDADDLLAWRGWVESRLRLLTLKIERDTNGMLQCHPYPNEYVDTSKLCAHSAFFMGLQRKEGVRGQEGQQFDIRGTVDEFRQEINMYMYWKPGMDIFVSHVRRKQLPAFVFPGGYKRTRMPRHISHQAEKTGDDATKCYSGSGSGSSERCIKRKSCPEMVDKKPGKPDKRASISPQRLECVSPESCTSKSGGTTQMSIECIEVVRLAGSTTKDANDNCEVKSSDALPGSGLSTEVADMQISEPGFVDTTHDMLKSRSVEIPNENGVLNGDKAQDLALDCLESAETESTNSLSNYKEGDNDTDQRLDKECNFIPRAECSDYDFFGLGTLWMAVKKLEVWEIVSQGSLQGDVCVADPDQF

SEQ ID NO: 121747 - protein, 585 aa, Glycine max
  Coding DNA Sequence Number=SeqID_30062
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=P12628; Match level="QueryCoverage=100%, HitCoverage=100%, E-value=0.0, Identity=88%"; Hit description=NADP -dependent malic enzyme
  Pfam annotation: Domain name=Malic_M; Domain location=301-554; Score =471.2; E_value=1.4e-138; Accession=PF03949.6; Description=Malic enzyme, NAD binding domain
  Pfam annotation: Domain name=malic; Domain location=110-299; Score =416.6; E_value=3.7e-122; Accession=PF00390.10; Description=Malic enzyme, N-terminal domain
  Pfam module annotation: Pfam domain module=Malic_M::malic; Domain location=301-554::110-299
MSSTSLKEMRNGGEDYSNGHGGGVRDLYGEDCATEDQLITPWTFSVASLLRDPRYNKGLAFTEGERDAHYLRGLLPPAVFNQELQEKRLMHNLRQYEVPLHRYMAMMDLQERNERLFYKLLIDNVEELLPVVYTPTVGEACQKYGSIFRRPQGLYISLKEKGKILEVLKNWPEKSIQVIVVTDGERILGLGDLGCQGMGIPVGKLSLYTALGGVRPSSCLPITIDVGTNNEKLLNDEFYIGLKQKRAAGQEYAELLEEFMRAVKQNYGEKVLVQFEDFANHNAFDLLEKYSSSHLVFNDDIQGTASVVLAGLLASLKLVGGTLADHTFLFLGAGEAGTGIAELIALEISKQTKAPVEKTRKKIWLVDSKGLIVSSRLESLQHFKKPWAHEHEPVKTLLDAVKAIKPTVLIGSSGAGKTFTKEVVETMASLNEKPLILALSNPTSQSECTAEEAYTWSKGKAIFASGSPFDPVEYEGKVFVPGQANNAYIFPGFGLGLIISGAIRVRDEMLLAASEALAAQVSQENYDKGLIYPPFSNIRKISAHIAAKVATKAYDLGLASHLPRPKDLVKYAESCMYSPGYRSYR

SEQ ID NO: 121748 - protein, 538 aa, Glycine max
  Coding DNA Sequence Number=SeqID_30063
  Gene Ontology: Mol. function=6-phosphofructokinase activity; Cellular component=6-phosphofructokinase complex; Biological process=glycolysis
  Homolog annotation: Hit_ID=A7P4F6; Match level="QueryCoverage=94%, HitCoverage=98%, E-value=0.0, Identity=72%"; Hit description =Chromosome chr4 scaffold_6, whole genome shotgun sequence
  Pfam annotation: Domain name=PFK; Domain location=115-434; Score= -17.1; E_value=6.4e-12; Accession=PF00365.11; Description =Phosphofructokinase
MPSNDSDSPMKIVHGDAGYILEDVPHFTDYIPNLPTYPNPLRSNPAYSVVKQYFVHMDDTVPQKVLSVSTYASDLNSALTRCIGVYTFVWPFNRLLFTRIVQEVYFKSDEVHACIVTCGGLCPGLNTVIREIVCGLSYMYGVNKVLGIDDLGKKADIALMCFSIPDFFGGYRGFYSKNTITLTPKVVNDIHKRGGTILGTSRGGHDTGKIVDSIQDRGINQVYIIGGDGTQRGATVIYEEVRRRGLKVAIAGIPKTIDNDIPVIDKSFGFDTAVEEAQRAINAAHVEAESIENGIGVVKLMGRYSGFIAMYATLASRDVDCCLIPESPFYLEGKGGLFEFIQKRLKENGHMVIVIAEGAGQDLLTESMQAMDQKDASGNKLLQDVGLWISHKIKALLLLYLPDPTYMIRAIQSNASDNVYCTLLAQSAVHGAMAGYTGFTVGLVNGRHTYIPFNRINERQNKVVITDRMWARLLSSTNQPSFLSPKDLEEAKKAEQPPTELLEGNNCNDVGDAGKEEQPPKDEQESGNHADNGIKTEN

SEQ ID NO: 121749 - protein, 710 aa, Glycine max
  Coding DNA Sequence Number=SeqID_30064
  Gene Ontology: Mol. function=protein serine/threonine kinase activity; Cellular component=vacuolar membrane; Biological process =protein amino acid phosphorylation
  Homolog annotation: Hit_ID=A7P4B5; Match level="QueryCoverage=100%, HitCoverage=100%, E-value=0.0, Identity=81%"; Hit description =Chromosome chr4 scaffold_6, whole genome shotgun sequence
  Pfam annotation: Domain name=Pkinase; Domain location=142-419; Score =30.2; E_value=1.9e-10; Accession=PF00069.16; Description=Protein kinase domain
  Pfam annotation: Domain name=Pkinase_Tyr; Domain location=142-401; Score=-162.2; E_value=0.018; Accession=PF07714.8; Description =Protein tyrosine kinase
  Pfam module annotation: Pfam domain module=Pkinase::Pkinase_Tyr; Domain location=142-419::142-401
  Subcellular localization annotation: CTP_CleavageSite=40; ConfidenceScore=5.25e-01
MPELRSRPHISRLVDSANANPTTQPASPPAAGACRRKPAVAAAPTGRNRRLNNAIAVAADQILNAEDEGGAVRGTRARKLKQDQGVKENIKNKKVSVRVLEVEGMDEYDSGSRSADKAPGAEDEGTTPPIPEKVQVGGSPLYRVERKLGKGGFGQVYVGRLLGAANSSERTGAGAVEVALKFEHRSSKGCNYGPPYEWQVYNALGGSHGVPQAHYKGQQGDYYIMVMDILGPSLWDVWNNNNPHMMSTEMVACIAIEAISILEKMHSRGYVHGDVKPENFLLGLPGTLDEKKLFLVDLGLATRWRDSSTGLHVDYDQRPDVFRGTVRYASVHAHLGRTGSRRDDLESLAYTLVFLLRGRLPWQGYQGENKGFLVCKKKMATSPETLCCFCPQPFRQFVEYVVNLKFDEEPNYAKYISLFDGIVGPNPDIRPINTEGAQKLICQVGHKRGRLTIEEDDDEQPNKKVRMGMPATQWISVYNARRPMKQRYHYNVADVRLAQHIDKGNEDGLFISSVASCSNLWALIMDAGTGFTAQVYELSPHFLHKEWIMEQWEKNYYISAIAGVNNGSSLVVMSKGTQYLQQSYKVSDSFPFKWINKKWREGFYVTAMATAGSRWAIVMSRGAGFSDQVVELDFLYPSEGIHRRWDSGYRITSTAATWDQAAFVLSVPRRKPADETQETLRTSAFPGTHVKEKWAKNLYIASICYGRTVS

SEQ ID NO: 121750 - protein, 155 aa, Glycine max
  Coding DNA Sequence Number=SeqID_30065
  Homolog annotation: Hit_ID=A7P751; Match level="QueryCoverage=81%, HitCoverage=66%, E-value=7e-35, Identity=58%"; Hit description =Chromosome chr9 scaffold_7, whole genome shotgun sequence
  Pfam annotation: Domain name=DUF1677; Domain location=45-153; Score =140.4; E_value=5.1e-39; Accession=PF07911.4; Description=Protein of unknown function (DUF1677)
MAPNQHFTNGFQSTTVSDITLIERNKEVAIEETHDEYILPTVSEVENAKCECCGMFEECTREYIRRVREMFLGRLICGLCGEAVNVEMEKNGGKREKALKEHMSDCVRFNRLGRSYPALYQAEDVKEILKKTQKKAMSNTPDDSKGSPSKSGAQG

SEQ ID NO: 121751 - protein, 219 aa, Glycine max
  Coding DNA Sequence Number=SeqID_30066
MTNAFRVWHHCATDAIWHMRNKLVFQQESSLAPCMTMKSSFIIKWIMPSEEVLKLNCDGDVTDGRRAYCGGVLKDHFGSFLLAYACNIVSCSVIQPELWAETCSRNSDYNYRISQRMLDNALEHRPSGNKLRGNLPVTESTEDFGPDINPVTCKAIQSESSILFVKEKAVKIGSNFEKHQHQIHESGSIPGPTARTVFDPATLFPSSQKIPINAKVGSG

SEQ ID NO: 121752 - protein, 130 aa, Glycine max
  Coding DNA Sequence Number=SeqID_30067
MADMDSGEPDETAGSKRARFRQGEGGAWWSRAGVWRARRWRVTARDGAWGSSWPSDILHQSYPEMFNALGMAQQHNGWIYGDFKKRISKGNYYMRTRSKRTNLRQRTTQKLTIIAYLMSTLRCNLSGFHL

SEQ ID NO: 121753 - protein, 189 aa, Glycine max
  Coding DNA Sequence Number=SeqID_30068
  Gene Ontology: Mol. function=zinc ion binding
  Homolog annotation: Hit_ID=A7P566; Match level="QueryCoverage=85%, HitCoverage=87%, E-value=2e-41, Identity=46%"; Hit description =Chromosome chr4 scaffold_6, whole genome shotgun sequence
  Pfam annotation: Domain name=PHD; Domain location=111-159; Score=4.3; E_value=0.0041; Accession=PF00628.20; Description=PHD-finger
  Pfam annotation: Domain name=zf-C3HC4; Domain location=112-156; Score= 10.8; E_value=0.0053; Accession=PF00097.16; Description=Zinc finger, C3HC4 type (RING finger)
  Pfam module annotation: Pfam domain module=PHD::zf-C3HC4; Domain location=111-159::112-156
MESRASNSNSPYHYHHHPRFKPSQPISDRIVRALRHRLRLLHRSGSTFFILGATGNVYTEEDPSSLPAPTPPRNTHIAGGGGGGTLRQRFHQLFFSGGSTETKIEMEEGATCPVCLEEMGKEQNLVACGTCRNPIHEECLMKWKRTKGRSASCVICRARWRDRVEQDEYLNLSAYVGEDDVEQPDVCTC

SEQ ID NO: 121754 - protein, 132 aa, Glycine max
  Coding DNA Sequence Number=SeqID_30069
  Gene Ontology: Mol. function=oxidoreductase activity, acting on single donors with incorporation of molecular oxygen, incorporation of two atoms of oxygen
  Homolog annotation: Hit_ID=A7P585; Match level="QueryCoverage=54%, HitCoverage=12%, E-value=2e-18, Identity=61%"; Hit description =Chromosome chr4 scaffold_6, whole genome shotgun sequence
MATSYKTFLVNCSIQKRPSYVSDNSGHYNLPLFLAFKPLKKVLLEVPLQIDEVHKTMANTAAILLDAFVDSFFEFLDQPLLPSQSNFAPVVELGEAIVVTSIQGQIPDDFPEGVYIINGGIPLKFLLTQHHF

SEQ ID NO: 121755 - protein, 113 aa, Glycine max
  Coding DNA Sequence Number=SeqID_30070
MKNYVPTLFGGVVASEECNKYLLQIECRLAINGRLRDSNLDLCNVQRKDKKEEAEKPYSDEEEEVGYMDISNILMARSTEEPFYDSPVEEEPLISTSSSSKPNAGPWFTLDDT

SEQ ID NO: 121756 - protein, 125 aa, Glycine max
  Coding DNA Sequence Number=SeqID_30071
MVMPVDNSRKLRNIIILHSKRHWRPSKTVKVITSTHSFPLIFMVKPLAETAKTIRVFPPGPLDPDLPSSSQRPKDCYPTDRIILQNVKDSQIRIEIYVPDPKFQKVEDLVDDNSALEQDLEDYNA

SEQ ID NO: 121757 - protein, 505 aa, Glycine max
  Coding DNA Sequence Number=SeqID_30072
  Homolog annotation: Hit_ID=A7P593; Match level="QueryCoverage=89%, HitCoverage=99%, E-value=5e-60, Identity=51%"; Hit description =Chromosome chr4 scaffold_6, whole genome shotgun sequence
  Pfam annotation: Domain name=DUF828; Domain location=44-294; Score =142.7; E_value=1.1e-39; Accession=PF05703.2; Description=Plant protein of unknown function (DUF828)
  Pfam annotation: Domain name=PH_2; Domain location=399-504; Score =102.0; E_value=1.9e-27; Accession=PF08458.1; Description=Plant pleckstrin homology-like region
  Pfam module annotation: Pfam domain module=DUF828::PH_2; Domain location=44-294::399-504
MKESNSFSISVSPSASNSICSVHQLENIDENAPADWPASSCPPPDTPTESMEFLARSWSLSAMELSKALHSTNVTISTGIEMPLSCPSGHQFDTKSSTASKALSNGCFPPFLPKDSNEKKDLLLLHQALNPEFLSSQNLLRNGLYRSLLRGRTMGRWLKDQKERKKQEIRTHNAHLHAAVSVAGVAAAIAAVAASTASPEMPYANQKNPPPASSAIASAAALVASHCIEIAEDMGAEHDQILTVVNSAINAKTNGDIMTLTAGAATALRGAATLKARLQKGPGATSIPLVEEKCDERKEANILTALDYVFRGGELLKRTRKGMFTNMFVIVASLKWKRIKEECQMFKATYIPNASNHAILIVNTRSSSLEASVFQYKFKFADGCPSSLSAQLVRLNYLILPRFHNGGSLVRIEKWNYGNNVVVKMKSKHMAGTFTKKKKYIVTGVCNDIPAWPGREKEDISEKRAYFGIKTTDRTIEFECGSKGDKQFWLEGIQYMLNCRVKVTL

SEQ ID NO: 121758 - protein, 76 aa, Glycine max
  Coding DNA Sequence Number=SeqID_30073
MDISTKNLAILYDVMEIRLSSVMLSCPSDQACTSCKHSDSTTNEVKVLPVGGGCCGDWFVVGGTPGTRVGVVGFPE

SEQ ID NO: 121759 - protein, 597 aa, Glycine max
  Coding DNA Sequence Number=SeqID_30074
  Gene Ontology: Mol. function=transporter activity; Cellular component= membrane; Biological process=oligopeptide transport
  Homolog annotation: Hit_ID=A7P784; Match level="QueryCoverage=86%, HitCoverage=83%, E-value=1e-166, Identity=55%"; Hit description =Chromosome chr9 scaffold_7, whole genome shotgun sequence
  Pfam annotation: Domain name=MFS_1; Domain location=69-543; Score =5.6; E_value=0.012; Accession=PF07690.7; Description=Major Facilitator Superfamily
  Pfam annotation: Domain name=PTR2; Domain location=131-535; Score =175.2; E_value=1.7e-49; Accession=PF00854.12; Description=POT family
  Pfam module annotation: Pfam domain module=MFS_1::PTR2; Domain location=69-543::131-535
MCRTCRESCLILQIWYTLLCALQFTPAQPPPVVSLAMEGLSEMESVIEEPLLSKQNSNAKGGFRTLPFIIANEAFERLASLGLMPNMILYLTREYGMQTAGATNFLLLWSAASNFTPFVGAVLSDSYVGRYSMIAFGSIASLLGMVLLWLTTLIPLSKPLCNQFTNSCNNSPTTIHLLILHSSFALMSIGAGGIRSSSLAFGVDQLSKRDKNAGIKESYFSWYYAIVAMSSLIGLTVVVYIQDNMGWAVGFGIPVILMFVATASFFLASPFYVMVEVKRNMLSGLAQVLVASYKNRLLQLPQETENGIYHLEKDSDLLMPTEKLRFLNKACLIRNSLQDLTPEGRALNPWNLCTVDQVEELKALIKIVPIWSTGIMMGVNISQGSLLVLEASSMDRHITSNFEIPSGSFVTFMIVSLVLWVIIYDRILVPVASKIKGSPACIGAKQKMGIGLLTGCIAIASLAVVEDIRRKIAIEKGYEDQPQAVVNMSALWLLPRQILNGLAEALGVVGQNEFFLTELPQSMSSLASTLNGLGSSVANLVASFILSVVDNVTGGGGHESWLSSNINKVNLMVLVRIEESRTLDLMILMDTDDVSST

SEQ ID NO: 121760 - protein, 53 aa, Glycine max
  Coding DNA Sequence Number=SeqID_30075
MVDGMHGKSLSFGCCELWYIRIEVKGLFDGSIVVDSADCRMDTVIVYSVLVYE

SEQ ID NO: 121761 - protein, 210 aa, Glycine max
  Coding DNA Sequence Number=SeqID_30076
MQSQGLALPPEPKVGPSAARVSIKESCVDPSGNDPDPGDSDKCGLHVKENPPHLVALGRLYEGSTTVHNIHLLHDQVKVGVEEVRDANAPILIPTEEGAVGSVKLADRADHDVDDHLYLITLTIPQLFLKSLQAYDRERSMRVGNANVYGFLEPQSIQRSGLVLFFNTFALALVGNINILIVQYATMFVFNSALKGLDDTPQSKSKVVAR

SEQ ID NO: 121762 - protein, 101 aa, Glycine max
  Coding DNA Sequence Number=SeqID_30077
  Homolog annotation: Hit_ID=A5C9E2; Match level="QueryCoverage=82%, HitCoverage=11%, E-value=1e-15, Identity=51%"; Hit description =Putative uncharacterized protein
MDIGRYKESKWTAESTTDYAQVMRELEYLKKELFNLKFLVASFMDHKSSVEKEIEASNSKMLSCLTTEQDLRREIEEPNEEQVLASVAKIEALKEMTDIEA

SEQ ID NO: 121763 - protein, 142 aa, Glycine max
  Coding DNA Sequence Number=SeqID_30078
  Subcellular localization annotation: CTP_CleavageSite=50; ConfidenceScore=5.26e-01
NKANNNALGQTPTSLHKSAESILGFYKGISFGNSNHANVTGVQCRGNVKHAMLVPKSEKMQRQAETNKKQGSSRCGVSMENNDGLLWLMEAVGDGEIAWDTKFREDPMVNEDWVAFLLRQLHVASSRSFIKRLPQEASSWLL

SEQ ID NO: 121764 - protein, 223 aa, Glycine max
  Coding DNA Sequence Number=SeqID_30079
  Homolog annotation: Hit_ID=Q67XL6; Match level="QueryCoverage=62%, HitCoverage=41%, E-value=1e-21, Identity=58%"; Hit description=MRNA, complete cds, clone: RAFL25-35-C17
  Pfam annotation: Domain name=DUF246; Domain location=1-177; Score= -119.0; E_value=1.1e-07; Accession=PF03138.5; Description=Plant protein family
GASKRQSLDLEAISTLVTDVDMEKETKPSFYLKHILPIILKNQVIHFVGFGNRLAFDPIAFELQNTSSLCFVGPLDPYLVGPFAKSMKGVCSRLVALTNLYPKLVSKENLLSSAELQSFANYSSQLAALDFIGCTASDAFAMTDSRRRKQLGKLNMYRQGRRQEVFTGILAMTRAYIQSSSNLLRFTFLVKILYKQRATKDVPSLMFTITTKKLPTSYTEFSD

SEQ ID NO: 121765 - protein, 86 aa, Glycine max
  Coding DNA Sequence Number=SeqID_30080
  Homolog annotation: Hit_ID=Q2HW78; Match level="QueryCoverage=80%, HitCoverage=11%, E-value=2e-07, Identity=42%"; Hit description=RNA -directed DNA polymerase
MTARNERERLLTEALNNLAQVMANQGGGGGATMYHGLDRFQRNNPPTFEGGYDPEGVEAWLREIEKIFRRDGVSGPSEGVVCYSHD

SEQ ID NO: 121766 - protein, 90 aa, Glycine max
  Coding DNA Sequence Number=SeqID_30081
MLATWKYYNIDFTTPKIPLNEIVAIKVLDVEAKLHGESKVIQRCFDDNNDDDKGDDKKLKDQSKNNSSESRTIQEFKIKIKNNSRLKKKV

SEQ ID NO: 121767 - protein, 133 aa, Glycine max
  Coding DNA Sequence Number=SeqID_30082
  Gene Ontology: Biological process=response to stress
  Homolog annotation: Hit_ID=A7PSC6; Match level="QueryCoverage=46%, HitCoverage=37%, E-value=1e-20, Identity=79%"; Hit description =Chromosome chr14 scaffold_27, whole genome shotgun sequence
MTVWEFSCEVGTNGKVLISGVTTTGENIVSQYSQVFEMQTHNLCPSGQFSISFQLPGPVDPHQFSGGLYAPNTCTILSSAIIVVYLPIHVKESFYFSFVRVRSLPIQFYIFISNDPLRWVINDHPAILVKHFG

SEQ ID NO: 121768 - protein, 72 aa, Glycine max
  Coding DNA Sequence Number=SeqID_30083
MTCYKKDKELMGVEKGNKLEGLLEAQIFKALEDLCRHVLPPTSHVPCIKLSISFDYMTKTLNVITEDAIVLT

SEQ ID NO: 121769 - protein, 78 aa, Glycine max
  Coding DNA Sequence Number=SeqID_30084
VPEPPTTLTHARSDVDQTRHAVDACHAIAERLERLLNLRIVTVGTETHEVMEQCIKIARGVIEDHIVYVRSRRRRRTD

SEQ ID NO: 121770 - protein, 32 aa, Glycine max
  Coding DNA Sequence Number=SeqID_30085
MSRSGQSQDLNNLEQMPHWQCLLQSEKLVLLS

SEQ ID NO: 121771 - protein, 65 aa, Glycine max
  Coding DNA Sequence Number=SeqID_30086
MEYSWEYNNRRLISEESGVGVAGGVEQLASDAAIDASADKNRELGRRVLWHGAAEVAVQVTGEKR

SEQ ID NO: 121772 - protein, 76 aa, Glycine max
  Coding DNA Sequence Number=SeqID_30087
  Homolog annotation: Hit_ID=A7Q5S8; Match level="QueryCoverage=84%, HitCoverage=9%, E-value=8e-10, Identity=53%"; Hit description =Chromosome chr14 scaffold_54, whole genome shotgun sequence
MASVSIENKLPPAKKIEQLSYNITALLPCLPELADIIPRDTLLWKLKLLKSVVAYANSHIIRVKHVFTSVLTSPPM

SEQ ID NO: 121773 - protein, 335 aa, Glycine max
  Coding DNA Sequence Number=SeqID_30088
  Gene Ontology: Mol. function=intramolecular transferase activity, phosphotransferases; Cellular component=cytosol; Biological process =metabolic process
  Homolog annotation: Hit_ID=A2X9P1; Match level="QueryCoverage=80%, HitCoverage=30%, E-value=1e-107, Identity=69%"; Hit description =Putative uncharacterized protein
  Pfam annotation: Domain name=PGAM; Domain location=94-268; Score =133.9; E_value=4.6e-37; Accession=PF00300.13; Description =Phosphoglycerate mutase family
  Subcellular localization annotation: CTP_CleavageSite=80; ConfidenceScore=5.33e-01
MAAEVYYQAIGTLQSHSYLNNLNHHQKHQNNLVTLVSRDFISSNGLSTRRSNCTGQRNCSVIRSLASQTSVVDPVLSPSRSNAGDTYKKSNEAALILIRHGESLWNEKNLFTGCVDVPLSKKGIDEAIEAGKRISSIPVDVIFTSALIRAQMTAMLAMTQHRRGKYTSKMLFPKSSTSQQVPIMMHNESEQARYGELQGLNKQETADRYGKEQVHEWRRSYDIPPPNGESLEMCAERAVAYFRDQIEPQLLSGKNVMISAHGNSLRSIIMYLDKLTSQEVISLELSTGIPMLYIFKEGRFIRRGSPIGPSEAGVYAYTRILFVWKAAMALAVLYQ

SEQ ID NO: 121774 - protein, 84 aa, Glycine max
  Coding DNA Sequence Number=SeqID_30089
MASSGTSAIFIVLQISMEPMKEIALNQLEEKMWIRDIGSLNFGPGYACEILGCRGTRVVIQGDPPWPVFFHDVFFKVGMWKRRR

SEQ ID NO: 121775 - protein, 41 aa, Glycine max
  Coding DNA Sequence Number=SeqID_30090
MDKSLKIGEDEWRDKKRSTKFYVSNELTNLRSGPRFSNKCA

SEQ ID NO: 121776 - protein, 204 aa, Glycine max
  Coding DNA Sequence Number=SeqID_30091
  Homolog annotation: Hit_ID=A7QPK8; Match level="QueryCoverage=96%, HitCoverage=28%, E-value=4e-48, Identity=50%"; Hit description =Chromosome chr18 scaffold_137, whole genome shotgun sequence
MEIVDNDSNLEAVENKINKIVSGFKEMQSSIDVKYKKLQFVLARVQLETETLALKKEQINKFLILEEKMGARLREFARISTEEAEGYREIVKLRRCLMPSILKSKEDKLTLAKNEEKLSGDVKLFQRDVSAARASLQELSSRKSFSELETEKKVSTAARNFKKAARIATEAKSLCVEKESIQIDMGTTIFNLELLREKFGLVNH

SEQ ID NO: 121777 - protein, 78 aa, Glycine max
  Coding DNA Sequence Number=SeqID_30092
PDIPQVPVAFDPPRHAVDDYEGYEVITERLECVLNLRTVIVGIELHDIMQDCLRIARGVPVQMEVLGLDKDDAQSIDD

SEQ ID NO: 121778 - protein, 83 aa, Glycine max
  Coding DNA Sequence Number=SeqID_30093
MRKTLCFLLRPRSRLKGFIEDVVDVKVDGNYGYRSIDALLGMGEESWSMVRNELIKELGKWLHDYINLFGGTQRFEQLRCRYM

SEQ ID NO: 121779 - protein, 208 aa, Glycine max
  Coding DNA Sequence Number=SeqID_30094
QKLLAEKTKKKLEEVAQSRSIDGVIDPPSPDSFEEQATQGSFVPHGRQDVLTAAIGRPEHPGRVRAAGVGVTIKQYFGSAPQLFPLPPEELQQLTQQIRDQLEETITEKSQKQSQGLALPPEPLVGPSGPQVSTKRSCVDPSGNDPKTGDSDRCDLYIEADPARLVALGRVYEGSTVVHNTPLLPGQVKVGVEEVTDADAPVPVPTNE

SEQ ID NO: 121780 - protein, 285 aa, Glycine max
  Coding DNA Sequence Number=SeqID_30095
LFYEGLVNGRPDELRGCNWHPIELAEICDQGQKSQCSVGLFQGKIRIMIARKNVAEEQRHPNLCQGGHASAHDLHPSSYHTACKVLSRNAQQLAYGLLVKSRSLAPLFTKLATLSLFQDQWMPQELINGIFIKGDPLASHSRALIPDSFLCGPCISIEFHDYFWVIFSHGPCELSPLPLGNFLLELSVFSLSQSDPSLLEERPTLDCFKATLVFLTSESMSVKFYVRLWSSTGSFSRGVLPCPLRENLLWSHCMQRHIHKKNGEQYDMPIYNRIKDRPRAIHCSP

SEQ ID NO: 121781 - protein, 127 aa, Glycine max
  Coding DNA Sequence Number=SeqID_30096
  Pfam annotation: Domain name=G-patch; Domain location=23-67; Score =6.5; E_value=0.031; Accession=PF01585.14; Description=G-patch domain
MALDSFGWGGPVNTAPEPRSSGAALMVAQVMLGHVYEPRMGLGRNENDIASLVEFTENHRRFGLGYEPTRTEKSFVSAGWMCEGRVVMLKKETPQDQPVWVRPCPPEFELGNWQVVKQPGISMANSM

SEQ ID NO: 121782 - protein, 126 aa, Glycine max
  Coding DNA Sequence Number=SeqID_30097
  Homolog annotation: Hit_ID=Q2HW90; Match level="QueryCoverage=69%, HitCoverage=17%, E-value=4e-11, Identity=37%"; Hit description =Putative uncharacterized protein
MGLNQVPSFKKRFYHVKVKSLELASLRELGQRMDQVRRQAFRKAYGKIWDLAMIEVSVEAIASLAQYYDQLLRCFTFRDFQLAPTIEEFEGILGCPLGGKKPYLFFPDSTLPWQEYQKWLRSWHKS

SEQ ID NO: 121783 - protein, 97 aa, Glycine max
  Coding DNA Sequence Number=SeqID_30098
  Subcellular localization annotation: CTP_CleavageSite=55; ConfidenceScore=5.04e-01
MRLFLNYFQEGAVFYVKSMHAGPKSPEPVASLVSLNKSPVLMAIPVTKSPLEMATCAAFGNRQSNWRVPWIKLHELEPDLVGYESGIFNDTCQVGKQ

SEQ ID NO: 121784 - protein, 72 aa, Glycine max
  Coding DNA Sequence Number=SeqID_30099
MGCLRTGFIEGTFPTDESDNQSYESEYDLVGEYGDWSDKNQSDCVSDFEETRDVIRNPHFDDDMILMLREEF

SEQ ID NO: 121785 - protein, 56 aa, Glycine max
  Coding DNA Sequence Number=SeqID_30100
MLLKDSLSEPDWLSETYLPSEAALENVELESSPLSAYPFTLAQRDMLVEHAFENYK

SEQ ID NO: 121786 - protein, 372 aa, Glycine max
  Coding DNA Sequence Number=SeqID_30101
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=A7NV04; Match level="QueryCoverage=94%, HitCoverage=99%, E-value=1e-129, Identity=67%"; Hit description =Chromosome chr18 scaffold_1, whole genome shotgun sequence
  Pfam annotation: Domain name=CHB_HEX_C; Domain location=222-274; Score=-7.2; E_value=0.087; Accession=PF03174.4; Description =Chitobiasebeta-hexosaminidase C-terminal domain
  Pfam annotation: Domain name=Trehalose_PPase; Domain location=112 -347; Score=339.5; E_value=6e-99; Accession=PF02358.7; Description =Trehalose-phosphatase
  Pfam module annotation: Pfam domain module=CHB_HEX_C::Trehalose _PPase; Domain location=222-274::112-347
MTNQNVVTHEVINTLIAVAASISNSTALPSATVPESMAVLGGFWGLPHNKNLVKRLEGAKVSAWIDSMRASSPTRAKSESQEKRSWILYHPSALNTFEQIVCSAKGKQVVVFLDYDGTLSPIVADPDKAFMTRKMRATLKGIARHFPTAIVTGRCRDKVYNFVKLAELYYAGSHGMDIKGPTKSQSPKQGNNNKAVLFQPASQFLPMIDEVYKILLEKTKTVPGANVENNKFCLSVHFRCVDEKSWAALAEKVRLVLNDYPQLRLTQGRKVLEIRPTIKWDKGKALEFLLESLGYENSNDVFPIYIGDDRTDEDAFKVLRSRGQGIGILVSRVAKETDASYTLQDPSEASAIYSIQLSNSCGVWWSGKDRVL

SEQ ID NO: 121787 - protein, 189 aa, Glycine max
  Coding DNA Sequence Number=SeqID_30102
GEIVETMHFMVSPLGKMVCTFDGLLPCIKKITLLSDEEDRILEAHEAAPPSQPKFEHQQFNILQRSVETQGLARRRETVDAAPYSFPSMPEQHHGMYYTPQAFTQEPSQLPPIGELSTPNALLGALWNVPGNIPDMNDLLGVYLRHDFSAEADQVDERTNRRRRNLDRATRNWDRSCRTLSRHHRHSDD

SEQ ID NO: 121788 - protein, 293 aa, Glycine max
  Coding DNA Sequence Number=SeqID_30103
  Homolog annotation: Hit_ID=A7NV02; Match level="QueryCoverage=99%, HitCoverage=99%, E-value=7e-89, Identity=56%"; Hit description =Chromosome chr18 scaffold_1, whole genome shotgun sequence
MMKLREGKALAPSADLLVCFPSRAHLTLMPKPICSPARPAEPNKRHHRKKSFSRGGGGPASPLLWAKTKSMGSEITEPTSPKVTCAGQIKVRPKTTSCRSWQSVMEEIEKIHTDKKQRKRLGWAETLGFKKEIMQFLTCLRSIRFDLRCFGSFSETDIVTEEEEEEEEDVGVESDDNEASRTVFSKWFMVLQQENESKNRREETEERDYGNEEESVSVPPPNALLLMRCSSAPAKSWVREREKEKGEKKGQSLKSLMEKENVVVMRYDSDFYDISSEVGGTSDLMFRSRSWKT

SEQ ID NO: 121789 - protein, 654 aa, Glycine max
  Coding DNA Sequence Number=SeqID_30104
  Gene Ontology: Mol. function=binding; Cellular component=cytosol; Biological process=protein folding
  Homolog annotation: Hit_ID=A7NV01; Match level="QueryCoverage=99%, HitCoverage=99%, E-value=1e-177, Identity=49%"; Hit description =Chromosome chr18 scaffold_1, whole genome shotgun sequence
  Pfam annotation: Domain name=TPR_1; Domain location=189-222; Score =34.0; E_value=5.5e-07; Accession=PF00515.19; Description =Tetratricopeptide repeat
  Pfam annotation: Domain name=TPR_1; Domain location=223-256; Score =20.4; E_value=0.0066; Accession=PF00515.19; Description =Tetratricopeptide repeat
  Pfam annotation: Domain name=TPR_1; Domain location=257-290; Score =4.2; E_value=1.7; Accession=PF00515.19; Description=Tetratricopeptide repeat
  Pfam annotation: Domain name=TPR_1; Domain location=375-409; Score =3.3; E_value=2.2; Accession=PF00515.19; Description=Tetratricopeptide repeat
  Pfam annotation: Domain name=TPR_1; Domain location=422-455; Score =13.2; E_value=0.14; Accession=PF00515.19; Description=Tetratricopepti de repeat
  Pfam annotation: Domain name=TPR_1; Domain location=456-489; Score =31.4; E_value=3.4e-06; Accession=PF00515.19; Description =Tetratricopeptide repeat
  Pfam annotation: Domain name=TPR_1; Domain location=490-523; Score =21.0; E_value=0.0043; Accession=PF00515.19; Description =Tetratricopeptide repeat
  Pfam annotation: Domain name=TPR_2; Domain location=189-222; Score =30.4; E_value=6.4e-06; Accession=PF07719.8; Description =Tetratricopeptide repeat
  Pfam annotation: Domain name=TPR_2; Domain location=223-256; Score =23.4; E_value=0.00084; Accession=PF07719.8; Description =Tetratricopeptide repeat
  Pfam annotation: Domain name=TPR_2; Domain location=375-409; Score =5.2; E_value=6.7; Accession=PF07719.8; Description=Tetratricopeptide repeat
  Pfam annotation: Domain name=TPR_2; Domain location=422-455; Score =13.8; E_value=0.57; Accession=PF07719.8; Description=Tetratricopeptid e repeat
  Pfam annotation: Domain name=TPR_2; Domain location=456-489; Score =19.8; E_value=0.01; Accession=PF07719.8; Description=Tetratricopeptid e repeat
  Pfam annotation: Domain name=TPR_2; Domain location=490-523; Score =19.9; E_value=0.0093; Accession=PF07719.8; Description =Tetratricopeptide repeat
  Pfam annotation: Domain name=TPR_4; Domain location=189-214; Score =10.4; E_value=2.2; Accession=PF07721.5; Description=Tetratricopeptide repeat
  Pfam annotation: Domain name=TPR_4; Domain location=257-282; Score =7.5; E_value=5; Accession=PF07721.5; Description=Tetratricopeptide repeat
  Pfam annotation: Domain name=TPR_4; Domain location=332-357; Score =0.7; E_value=32; Accession=PF07721.5; Description=Tetratricopeptide repeat
  Pfam annotation: Domain name=Thioredoxin; Domain location=574-652; Score=3.7; E_value=0.0001; Accession=PF00085.11; Description =Thioredoxin
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_4::TPR_4::TPR_4::Thioredoxin; Domain location=189-222::223 -256::257-290::375-409::...
  Pfam module annotation: Domain location=422-455::456-489::490 -523::189-222::223-256::375-409::422-455::456-489::490-523::189 -214::257-282::332-357::574-652
MAGKTKNKVEVQLGCGLVGRIFHLKTNNRPRKSSVHSLPLKPCNTAQQRDQGKNESKAPPNHEPKDSSIETIPTLKGEQNPARKSRQQQKDHPVVNSLELARISTSTSHHQNYGTKSPAKEFVLPITGNLLVNSSPRTSVTKSKELNSLSGSCSYNSNSTNKGMMGNIMRKNSDELGQFRSLRNSRVDPEVLKSMGNEAYKQGRFEEALALYDRAIAVDSKKATYHCNKSAALISLGRFLQAIVECEEAIRLEPSYGRAHTRLATIYFRLGEAEKALNCNETSPCVDSVLAFQAQALQNHLSKCTEARKVKDWKVILKESQAAISLGADSAPLVYCLHTEALLKLLRHQEAHATYEKMPKFDLDYSNKLFGPVRSAYLLMIGTHIYLATGRFEDAVIASQQASKLDPSSFEVNAVVRRARAVASARMSGNLLFKASKFTEAYAVYNEGLEHDPFNSVLLCNRAACRSKLGQFEKAIEDCNVALIVQPSYSKARLRRADCNAKLERWEAAIQDYEMLLREKPGDEEVARALFETQLQLKTLRGEDIKDLKFGSNLFFISSNDRFRHYVTSPGMSVVLFCNKATHKQVLLVLEQTCKRFPSVNFLKVEIEDHPYLAKSEGVNCIPAFKIYKNGSRVKEIPGSNHDLLEKLVKLYSN

SEQ ID NO: 121790 - protein, 125 aa, Glycine max
  Coding DNA Sequence Number=SeqID_30105
MLLMADGGKSKIRHKNMADGVAENDGCHGGQKKGMSNSKNSMPPFVTGAFLSELVAAVRAGASLPELVAAACACGLQVSQLHARANCGCRGCGWVRRGAGGTRLGSGEGRGWVQGRLAVGFSLRW

SEQ ID NO: 121791 - protein, 65 aa, Glycine max
  Coding DNA Sequence Number=SeqID_30106
MEEDQWTYDYTMSQEVHMDYDNEEECGVNEPHADCSNAFNTCQWARTIAHENEFVAVIMRSDTDT

SEQ ID NO: 121792 - protein, 359 aa, Glycine max
  Coding DNA Sequence Number=SeqID_30107
VRAERHGGRRVMVDDMHGAKLEACAAMALRLVPHTVVGPKLEARAAKLAFFPSSLMSCKVVKQEATTLLLMESFPHCKNLDHVEVLQFLNRCSTCMCVALLARAHGRREVGQKGWVGEEEKRRGLEGVSGERGEGQSEEGGWGKKKGFNGCYKQATALKKSGYTENDVMEQCKEVPSKRTKLNENWNYSLSSNMETPIDVSESDIPTPLARPMGQKATKRKVKVIGASSSTLLVNLFSIEKEMKERNVVQKQITKVVELDNVVKMYDILTKEKSNMIEDQHKHHKMARNSGFDRVWQQIVDEALEDNIVEEIMRYLCQLQQQANSSSRPKRTRRNINQNREDGHSLLMNDYFSENCIYA

SEQ ID NO: 121793 - protein, 164 aa, Glycine max
  Coding DNA Sequence Number=SeqID_30108
  Homolog annotation: Hit_ID=A7UQU7; Match level="QueryCoverage=71%, HitCoverage=20%, E-value=3e-10, Identity=34%"; Hit description=IMP dehydrogenase/GMP reductase, putative
MVMILTVLPNVEGRPHRHADLPAVPEAEAAVAGDEPMVDAATQDTSAEIDAQDTGAQDIGDEPEGFPSGPRDPSVLTEYVDHVAASVWSGQECPELKLSSHGRKVHNLGRPVPTIEDMVAGTGLSTLIACSIDTGDRRLISSFVERWHRETSSFHFLWGRFRSR

SEQ ID NO: 121794 - protein, 194 aa, Glycine max
  Coding DNA Sequence Number=SeqID_30109
  Homolog annotation: Hit_ID=A7NV00; Match level="QueryCoverage=71%, HitCoverage=35%, E-value=2e-21, Identity=43%"; Hit description =Chromosome chr18 scaffold_1, whole genome shotgun sequence
  Pfam annotation: Domain name=VQ; Domain location=139-169; Score=51.6; E_value=2.7e-12; Accession=PF05678.5; Description=VQ motif
MDSGNSGSISSSDDEYDSSSHAHPSFLNHFGSISDPQQPSLVPSHPSMFDLSSNYLHSLSQSHPNPHNSFLNLDSQGQRSEPNCTLHESLPSSSAIPTTTNQYLLGHDNLNNNARQQLPSSPQTNNLIRNSKKRSRASRRAPTTVLTTDTNNFRSMVQEFTGIPAPPFSPSFSRRIPLRPNPLLSTTSSRDFVT

SEQ ID NO: 121795 - protein, 389 aa, Glycine max
  Coding DNA Sequence Number=SeqID_30110
  Homolog annotation: Hit_ID=A9P8J2; Match level="QueryCoverage=71%, HitCoverage=99%, E-value=1e-102, Identity=69%"; Hit description =Putative uncharacterized protein
MERSNPVRKPHTSTADLLTWPETPISDSPAPPSSAVRSHQPSDGIRKVVFGGQVTDEEVESLNKRKPCSDYKMKEITGSGIFVANGEDDASEAGSDNPNKTGVRMYQQAISGISHISFGEEESVSPKKPTTLPEVAKQRELSGTLESEDSILKKQLSDAKCKELSGHDIFAPPPEIKPRPITPRILELKGSIDIADGDQGDTNSAGKTAKKIYDKKFAELSGNDIFKGDAPPSSAEKSLSGAKLREMSGSNIFADGKVEARDYLGGVRKPPGGESSIALCNNKDYNPDTLHVPLIKLPRALCHERLGRNRVRKPLDQGLMLSMSQNKLLGPDAGGGEAIVVGWSRGGAIDQIGIIMYKGEFQQGLQKSEAKIEGVSGILGGVILDTDSE

SEQ ID NO: 121796 - protein, 401 aa, Glycine max
  Coding DNA Sequence Number=SeqID_30111
  Gene Ontology: Mol. function=sugar:hydrogen symporter activity; Cellular component=integral to membrane; Biological process =carbohydrate transport
  Homolog annotation: Hit_ID=Q84N02; Match level="QueryCoverage=91%, HitCoverage=79%, E-value=1e-134, Identity=63%"; Hit description =Putative monosaccharide-H+ symporter
  Pfam annotation: Domain name=MFS_1; Domain location=8-371; Score =40.7; E_value=5.4e-09; Accession=PF07690.7; Description=Major Facilitator Superfamily
  Pfam annotation: Domain name=Sugar_tr; Domain location=28-394; Score =260.8; E_value=2.9e-75; Accession=PF00083.15; Description=Sugar (and other) transporter
  Pfam module annotation: Pfam domain module=MFS_1::Sugar_tr; Domain location=8-371::28-394
MAGGVVPVDSSPFSNGFAGKITLSVIITCIVAASSGLLFGYDIGISASRVTAALGRRNTIILGGVIFVVGGALNGGAENIAMLILGRILLGFGAAPLYLSEIAPPKWRGAFNTGFQFFLSLGVLVAGCINFGTAKKTWGWRVSLGLAVVPAAVMTIGAFLITDTPNSLVERGKIEQARKALRKARGSSIDVEPELEELIKWSQIAKSVEQEPFKTIFERQYRPHLAMAIAIPFFQQMTGINIVAFYSPNLFQSVGLGHDAALLSAVILGAVNLVSLLVSTAIVDRFGRRFLFITGGICIGDWCSWYKGRVEGQCNCGVGVTLFLLGRTTGQSIAVGVQFIIVFILSQTFLSMLCHFKFGAFLFYGGWIVIMTIFVIFFVPETKGIPLESMDTIWGKHWFWR

SEQ ID NO: 121797 - protein, 457 aa, Glycine max
  Coding DNA Sequence Number=SeqID_30112
  Gene Ontology: Mol. function=sugar:hydrogen symporter activity; Cellular component=integral to membrane; Biological process =carbohydrate transport
  Homolog annotation: Hit_ID=Q84N02; Match level="QueryCoverage=100%, HitCoverage=89%, E-value=0.0, Identity=76%"; Hit description =Putative monosaccharide-H+ symporter
  Pfam annotation: Domain name=DUF895; Domain location=16-147; Score= -80.6; E_value=0.079; Accession=PF05978.7; Description=Eukaryotic protein of unknown function (DUF895)
  Pfam annotation: Domain name=MFS_1; Domain location=2-390; Score =90.6; E_value=4.9e-24; Accession=PF07690.7; Description=Major Facilitator Superfamily
  Pfam annotation: Domain name=Sugar_tr; Domain location=7-438; Score =397.1; E_value=2.8e-116; Accession=PF00083.15; Description=Sugar (and other) transporter
  Pfam module annotation: Pfam domain module=DUF895::MFS_1::Sugar_tr; Domain location=16-147::2-390::7-438
MVPFLEKFFPDILRKVAGTEVNMYCVYDSQVLTLFTSSLYLAGLVSSLAASRVTAAWGRRNTILIGGVTFLIGGALNGGAENIGMLILGRVLLGFGVGFTNQAAPLYLSEIAPPKWRGAFNTGFQFFLGVGALIAGCINFATAKHTWGWRVSLGLAVVPASVMTIGALLITDTPSSLVERGKIEQARKALRKARGSSIDVEPELEELIKWSQIAKSMKQEPFKTIFERQYRPHLVMAIAIPFFQQMTGINIVAFYAPNIFQSVGLGHDAALLSAIILGAVNLVSLLVSTAIVDRFGRRFLFVTGGICMLVCQIAVSILLAVVTGVHGTKDMSNGSAIVVLVLLCCYTAGFGWSWGPLTWLIPSEIFPLKIRTTGQSIAVGVQFIIIFILSQTFLSMLCHFKFASFVFYAGWIIVMTIFVIFFVPETKGIPLESMYTIWGKHWFWRRYVKDVEQENLP

SEQ ID NO: 121798 - protein, 43 aa, Glycine max
  Coding DNA Sequence Number=SeqID_30113
MAPPSSTHHATAIRWRFFKNPLRNSAIAPPWPPFNNTGYPELK

SEQ ID NO: 121799 - protein, 92 aa, Glycine max
  Coding DNA Sequence Number=SeqID_30114
MGPKSTLRLIRTLGPSLASLAQSTWSFSIQCPCGVGLHQQPTHSSILQVTSCTIYGEAHETGQCFPTDDNTQEIHFMGNQQRQGYTQVLSQH

SEQ ID NO: 121800 - protein, 96 aa, Glycine max
  Coding DNA Sequence Number=SeqID_30115
MESLRCWTLKRSQENAIWCRGSSPRRVACLGLKKFHGSSEPDASLGEFRSKKIKARMLSLMKNNGEDVESYGKIKVRMLSPMKNKGEDVESYGKIK

SEQ ID NO: 121801 - protein, 185 aa, Glycine max
  Coding DNA Sequence Number=SeqID_30116
MDHAAEEVHEQPQEPITDHVDVDTKEHTELKLAFHGSKVENFGRPAAEIEGIVVATRLSSLITCSFETDYMNKFYRISHRFTSLLQLVDPPRHPPMVHDDTFIVPDPPVLPIQSATMPQPLVLVAANADMPRHAVATCQRIVESLERMIHKRMVTAETDAYTLTKHCLRLARSVTNQRNVYVQYR

SEQ ID NO: 121802 - protein, 129 aa, Glycine max
  Coding DNA Sequence Number=SeqID_30117
MCNRIYTHNCIHFCLRKCGDPVRCERCAGNPRWSWKEIPIGAGKRRRRRRLRARIVTRRRKYRGEGGERVMGRGERRRRRRQQASGEMNRPEIYGEMNEHDICGKKRNGREGLKIKMARIQRRFFAQPP

SEQ ID NO: 121803 - protein, 236 aa, Glycine max
  Coding DNA Sequence Number=SeqID_30118
MKDHLHLNISTPTLESSSSTRPNEPNFTTKPNLPNGELSPFSEDEDEVLHNQPQEKDDEEEAQSVSPITIVPPYYISPLMQNFEESYFQDFEYEHSLDCKEVQHPVGTLFKRMCFLKKQDVQNALLQYHVSKWTNYKTQLSNPKKIVPRSTEIAASYASISSWYGGEEGKHCNATTKRSTSKGFRHVPSSFLEFQTMYRWISILLYSKYKGTLLVAVAQDDNNKIFLIAFAVVESE

SEQ ID NO: 121804 - protein, 80 aa, Glycine max
  Coding DNA Sequence Number=SeqID_30119
  Gene Ontology: Mol. function=carbon-nitrogen ligase activity, with glutamine as amido-N-donor
  Homolog annotation: Hit_ID=A7PKQ4; Match level="QueryCoverage=71%, HitCoverage=9%, E-value=6e-18, Identity=77%"; Hit description =Chromosome chr7 scaffold_20, whole genome shotgun sequence
MVSSRRLCPIAFGVDRGGSVRMPAALCGVVGLKPTFERIPHEGVLPLNWNVGMVGIQAVNKDRHLKHVLDRKLWTISIST

SEQ ID NO: 121805 - protein, 572 aa, Glycine max
  Coding DNA Sequence Number=SeqID_30120
MALPFWQASGGTWTRMLAYHSASKLLGPEELASAYPESAFFGVAAHVIFTEFPKDFFQARHMSGYALRLDNYVVHIYLNPANAKPRVCVFGAHPVQINVVDAHFPFAVGLFDHDNIGEPGRKPDFSDEHVGDVPVLITGEVPTEPRALSGFRSELQLDKPFDGFRASFGSVISRIYVKSIAQACLVDGQGLDLRPFVHAYDLSAFSRCGVRHALTITISLIKVGNFIFKWAPGELALTEGGHQVHKPLDINGTVLVDKDPEHHEVCNNDGDDHEAVLVDGVDALEVPIRKEMTSSRLVVTRTVVTGVFVYLGLPLFFCLLRGSYVSPLGVLQEHGMQCYLGVKISDLDGSAPKSIHEFFEEPVVYLWQTGQGGRGHIVRPAGGVLRTKSFDEGVKAIYGPRWEFNVPGSPKSGRRPDARLDLLSHLYHSRLSGFHPKDFVKDILQDDGNLKWVAWGLDVGTGRGRTSHLSNKHEPPADHGQPLAFLVLPYGVAPSPQCGRDRVLTTDEKERVDEKPRGLYMSALRMAFVERTRGGTCKTKDSDAQARVSEKERERHMLVARVLKCVKDVYRV

SEQ ID NO: 121806 - protein, 328 aa, Glycine max
  Coding DNA Sequence Number=SeqID_30121
  Gene Ontology: Mol. function=catalytic activity; Cellular component =plasma membrane; Biological process=protein amino acid dephosphorylation
  Homolog annotation: Hit_ID=A2Q6E4; Match level="QueryCoverage=82%, HitCoverage=95%, E-value=1e-126, Identity=82%"; Hit description =Protein phosphatase 2C-like
  Pfam annotation: Domain name=PP2C; Domain location=78-320; Score =232.3; E_value=1.1e-66; Accession=PF00481.12; Description=Protein phosphatase 2C
MEGPWPLLPTFTATFANFEGKQHGLSESKYKLNPLSILIGLVVILDTESGFLFKFEFKLVAARSSSSTGKGKNHEGSIKYGFSLVKGKANHPMEDYHVAKFAQIQDNELGLFAIYDGHVGDRVPAYLQKHLFTNILREEEFWEDPTLSISKAYESTDQEILSHSSDLGRGGSTAVTAILINGRRLWIANVGDSRAVLSRKGQAVQMTTDHEPNTERGSIETRGGFVSNLPGDVPRVNGKLAVSRAFGDKSLKSHLRSDPDVQNTDVDVDTEILILASDGIWKVMTNQEAVDIARRTTRDPQKAAKQLTAEALKRDSKDDISCVVVKFR

SEQ ID NO: 121807 - protein, 108 aa, Glycine max
  Coding DNA Sequence Number=SeqID_30122
MIALSGTFDAAGDVEEAVAALGDEGVGVEGEPAEAEGGGERDVDGEQPGERREKEAEEGGELGERGGDGEAFGLWSETRAEPLEGLGVRVPGCAAHGPLSHIYLRLLF

SEQ ID NO: 121808 - protein, 707 aa, Glycine max
  Coding DNA Sequence Number=SeqID_30123
  Gene Ontology: Mol. function=metal ion binding; Cellular component =Golgi apparatus
  Homolog annotation: Hit_ID=A7NUX8; Match level="QueryCoverage=100%, HitCoverage=100%, E-value=0.0, Identity=68%"; Hit description =Chromosome chr18 scaffold_1, whole genome shotgun sequence
  Pfam annotation: Domain name=DUF248; Domain location=161-699; Score =453.8; E_value=2.3e-133; Accession=PF03141.7; Description=Putative methyltransferase
  Pfam annotation: Domain name=Methyltransf_11; Domain location=285 -380; Score=10.8; E_value=0.0081; Accession=PF08241.3; Description =Methyltransferase domain
  Pfam annotation: Domain name=Methyltransf_12; Domain location=285 -378; Score=9.7; E_value=0.053; Accession=PF08242.3; Description =Methyltransferase domain
  Pfam module annotation: Pfam domain module=DUF248::Methyltransf _11::Methyltransf_12; Domain location=161-699::285-380::285-378
MSRPLHRGVSIRIPDSNNNDLWDSQSKDKTEKEGLDRRGSFGHPSPLRSPFKLLFSDNSNSKYGIGENGFSSDPFIIGTPRSRHKLVLLFLKFSLVFIVILALAGSFWWTISISTASRGHIYHGYRRLQENLVSDLLDIGEISYAPSRLKELEFCSEEFENYVPCFNVSDNLALGFSDGNEFDRQCHHELRPNCLVLSPPNYKIPLRWPTGRDIIWIANAKITAQEVLSSGSFTKRMMMLDEEQISFRSASLMFDGVEDYSHQIAEMIGLRNESSFIQAGVRTILDIGCGYGSFGAHLFQSQLLTMCIASYEPSGSQVQLTLERGLPAMVASFTSKQLPYPSLSFDMLHCARCGIDWDRKDGILMIEADRLLRPGGYFVWTSPLTNARDKDSQKRWKFIQSFAENLCWDMLSQQDETVVWKKTSKRNCYSSRKNSSPPPLCGRGYDVESPYYRELQNCIGGTHSSRWISVQERETWPSRDHLNKKELAIFGLQSDEFAEDSESWKAAVRNYWSLLSPLIFSDHPKRPGDEDPPPPYNMLRNVLDMNAHVGGFNSAMLQAGKSIWVMNVVPLSGLNYLPLIQDRGYVGVLHDWCEAFPTYPRTYDLVHAAGLLSLEFAQQRSCTMLDMFIEIDRLLRPEIAVAELIFAVNIEILPKGWIIIRDTVPLIESARALTTRLKWDARVVEIESDSDQRLLICQKPFFKRQAN

SEQ ID NO: 121809 - protein, 36 aa, Glycine max
  Coding DNA Sequence Number=SeqID_30124
MSGKLVTPQVQIEFAKRIAMNVVLPCSILKRGRLGK

SEQ ID NO: 121810 - protein, 142 aa, Glycine max
  Coding DNA Sequence Number=SeqID_30125
  Homolog annotation: Hit_ID=A7UQU7; Match level="QueryCoverage=67%, HitCoverage=16%, E-value=1e-14, Identity=46%"; Hit description=IMP dehydrogenase/GMP reductase, putative
MKKISTLVLTQDYDEASPRACRWVATKKTVKSIRTPSYGERLDRLRIPDVCWIPYGEHREVRDFHLRLCYSGLLRWGPVAVYYRPERVVRQFGYTQTISAPPVDSWVSYDDIHDRWMHYKDHIVPASEVCVVPGACSSDYMD

SEQ ID NO: 121811 - protein, 145 aa, Glycine max
  Coding DNA Sequence Number=SeqID_30126
  Subcellular localization annotation: CTP_CleavageSite=64; ConfidenceScore=5.31e-01
MYNPQIQQPQYYQQLYGASSSTMSTPYYYGYSVQAPRNAFSSPQANRLSPGPSYLYYPTPMEVSFSGYRPPQQTPMRQTFASPNDLDLADGMKVMIETHLVSLTYMRKYIHQSQQRTSSETAAGVAITSEKIEYPGEELINIYTC

SEQ ID NO: 121812 - protein, 60 aa, Glycine max
  Coding DNA Sequence Number=SeqID_30127
LVVPWGHDVGRGIVAAVPLVIMGGEFIVVVVGGVKRRRFGVQQGSELLSVYAVAVCFMLY

SEQ ID NO: 121813 - protein, 422 aa, Glycine max
  Coding DNA Sequence Number=SeqID_30128
  Gene Ontology: Mol. function=metal ion binding; Cellular component =integral to membrane; Biological process=ubiquitin cycle
  Homolog annotation: Hit_ID=Q67YI6; Match level="QueryCoverage=83%, HitCoverage=90%, E-value=9e-55, Identity=38%"; Hit description=RING -H2 finger protein ATL3G
  Pfam annotation: Domain name=PHD; Domain location=175-220; Score= -6.7; E_value=0.081; Accession=PF00628.20; Description=PHD-finger
  Pfam annotation: Domain name=zf-C3HC4; Domain location=176-217; Score= 36.6; E_value=9e-08; Accession=PF00097.16; Description=Zinc finger, C3HC4 type (RING finger)
  Pfam module annotation: Pfam domain module=PHD::zf-C3HC4; Domain location=175-220::176-217
  Subcellular localization annotation: CTP_CleavageSite=41; ConfidenceScore=5.07e-01
MGKQPTGLNFTNDADVEQSSHHNTRKTTLKLKPYSSVFVIPTMMPPSQPPHWAPSPTPILSKSFLPPTSNSPAVDFTPPLIAMVVVVAAAFLVVTYSRLIARHLRPPVHRLLRRFRRRRFLPSSVGDLESLPYDSPFDGPHVFSPYGLDETVIKTIPFSLYTAKYDARFDESRYDCAVCLLEFEDEDYVRTLPVCSHTFHVDCIDAWLRSHANCPLCRAGVLCTDSPFTPMMAARIRPSLDDDTILHRISIDPLIDLPPQPASAVAISSVSEITPCVDENTPRRNQNHANVNSEDCFRDFLLKRSYSFGFERSLASERMVMEPATASPWRYRRGSSSFWSKRPSPFGSLGKPRVFSFRGFFPLSESSVRYGSGGSSSRRSKSIASPMFLRSSGVAAAAAFSSSRLRCGDPEALLSPERFNRR

SEQ ID NO: 121814 - protein, 648 aa, Glycine max
  Coding DNA Sequence Number=SeqID_30129
  Gene Ontology: Mol. function=metal ion binding; Cellular component =ribonucleoprotein complex; Biological process=ubiquitin-dependent protein catabolic process
  Homolog annotation: Hit_ID=A7P959; Match level="QueryCoverage=84%, HitCoverage=91%, E-value=0.0, Identity=70%"; Hit description =Chromosome chr3 scaffold_8, whole genome shotgun sequence
  Pfam annotation: Domain name=IBR; Domain location=243-305; Score =95.6; E_value=1.6e-25; Accession=PF01485.12; Description=IBR domain
MDDYASSDEDYHYDSDQEDSVEAYENDENYALLSSKGPTTKVYDTPFWGYSNFYSSSSSSYVKNPHLLNFLLAMIYVRVCLCDYKGITAGCTGFSEITTHIFLQKEDLRRVMDMLSVREQHARTLLIFHRWDVENLFEVYVDKGKSFLFAEAGVSVDEHRDSDSPVPPDFMCNICMDEVPSSKTTRMDCGHCFCNGCWIEHFIVKINEGQSKRIRCMEHKCNSICDEAVVRTLLSREHSHMAEKYERFLLESYIEDNKRVKWCPSTPHCGNAIRVEDDELCEVECSCGVQFCFSCLSEAHSPCSCLMWELWAKKCRDESETVNWITVHTKPCPKCHKPVEKNGGCNLVSCICGQAFCWLCGGATGREHTWSSIAGHSCGRYKEQEKTAERAKRDLYRYMHYHNRYKAHTDSFKIESKLKETIQGKISISEEKDSTLRDYSWVNNGLSRLFRSRRVLSYSYAFAFYMFGDELFKDEMTDAQREIKQNLFEDQQQQLEANVEKLSKILEEPFETFSDDKVVEIRMQILNLSTIIDKLCQKMYECIENDLLGSLNLGIHSIAPYKSKGIERASELSVCWNNKVNNTEILLSEKDYCIYAASVGVTEELDRPSGSGSSEDSGCSSRKRPRKEGLGGGGFFDLNLPAEFVDRN

SEQ ID NO: 121815 - protein, 369 aa, Glycine max
  Coding DNA Sequence Number=SeqID_30130
  Gene Ontology: Cellular component=chloroplast; Biological process =pigment biosynthetic process
  Homolog annotation: Hit_ID=A7P955; Match level="QueryCoverage=100%, HitCoverage=65%, E-value=1e-154, Identity=71%"; Hit description =Chromosome chr3 scaffold_8, whole genome shotgun sequence
  Pfam annotation: Domain name=ResB; Domain location=1-347; Score =231.7; E_value=1.7e-66; Accession=PF05140.5; Description=ResB-like family
MACTYTTQLPLIKVSRRPKLFHRWSFLHSAEAIRKQEFSESLPRPSIQDVSTILMGAGYEVFLKGPSLYAFQGLAGRLAPVGVHIALLLIMAGGTLSACGSFRGSVTVPQGLNFVVYDVLAPSGFLSSPTDAFNTEIHVNKFYMDYYESGESLQIAIEFCCVFTTFQPEKVSQFHTDLSLRNMDGKETDWSISALQILKDNEGPYNLAMAPLQINGDKQLFGTYLPAGDINSPDVKGISMLARDLQSIVLYDKEGKFAGVTWPNSKLPINIDGSEIVIVDAIGSSGLDLKTDPGVPVVYAGFGALMITTCISYLSHSQIWALQDGTAVFIGVKTNRAKMEFPEEMNRLLDKVPEIVESSLPKQADSISG

SEQ ID NO: 121816 - protein, 601 aa, Glycine max
  Coding DNA Sequence Number=SeqID_30131
  Gene Ontology: Mol. function=catalytic activity; Cellular component =chloroplast; Biological process=cellular metabolic process
  Homolog annotation: Hit_ID=Q8SKU2; Match level="QueryCoverage=75%, HitCoverage=96%, E-value=1e-162, Identity=62%"; Hit description =Tic62 protein precursor
  Pfam annotation: Domain name=Epimerase; Domain location=59-251; Score= -60.0; E_value=0.011; Accession=PF01370.12; Description=NAD dependent epimerasedehydratase family
  Pfam annotation: Domain name=NAD_binding_4; Domain location=61-269; Score=-103.2; E_value=0.044; Accession=PF07993.3; Description=Male sterility protein
  Pfam annotation: Domain name=NmrA; Domain location=59-288; Score= -64.9; E_value=0.00013; Accession=PF05368.4; Description=NmrA-like family
  Pfam module annotation: Pfam domain module=Epimerase::NAD_binding _4::NmrA; Domain location=59-251::61-269::59-288
  Subcellular localization annotation: CTP_CleavageSite=28; ConfidenceScore=5.39e-01
MEAFSVQSLTATTIPSSLSRRGATDKPSATSHVNLSHFMSTGSAEGISEKTDSKDDNLVFVAGATGRVGSRTVRELIKLGFRVRAGVRSAQRAGALVQSVEQLKLDGASGGGQAVEKLEIVECDLEKPETIGSALGDASTVICSIGASEKEVFDITGPFRIDYQATKNLIDAVLVWKRKAEEALLASGLPYTIVRPGGMERPTDAFKETHNITLSTEDTLFGGLVSNLQIAELLAVMAKNRDLSYCKIVEAIAETTAPLTPMEELLAKIPSQRPYISSPKKPDIAAVSVPDPPANVVTVEPKVATQQETAQPKPVAKQPLSPYIVYDDLKPPSSPSPSQPGGGKPTKISETVPKPSASDTPSSVPGVDGISQTTSSSKVEKPLSPYVAYPDLKPPTSPSPNAPTVSVSTPAAAGVPEIDTISSNGPAQLSAADEPKEEHLPEPKSRPLSPYTMNYGRFGNTFNCFGLPQSFLLGRKVLEGGAIRVVLGLFLFSPLDSTPSGTMDVLFVDSGNPWNPKPETISKVMATLKGVHGVLKAGGTFISVTFGQPHFRRPIFNAPDFSWSVEWTTFGETFHYFVYVLKKIPRLEHELHQIPIPLAAF

SEQ ID NO: 121817 - protein, 351 aa, Glycine max
  Coding DNA Sequence Number=SeqID_30132
  Gene Ontology: Mol. function=acyltransferase activity; Cellular component=integral to membrane; Biological process=metabolic process
  Homolog annotation: Hit_ID=A7P952; Match level="QueryCoverage=73%, HitCoverage=75%, E-value=1e-108, Identity=66%"; Hit description =Chromosome chr3 scaffold_8, whole genome shotgun sequence
  Pfam annotation: Domain name=Acyltransferase; Domain location=80-239; Score=50.3; E_value=6.9e-12; Accession=PF01553.12; Description =Acyltransferase
  Subcellular localization annotation: CTP_CleavageSite=52; ConfidenceScore=5.05e-01
MTLDILQGKDMISSTFSQSVIAFDIIAYGCSYTRKFLLWSKVSGSSTIENFKGSAVSTGAAFNSIYDCEFLASVTAGEQLPLSLVLDIVPSRERILLIANHRTEVDWMYLWDLALRKGCLGYIKYILKSSLMRLPVFGWAFHILEFIPVKRKWEADESIMRHMLSTFKDPQDPLWLALFPEGTDFTEQKCLRSQKYAAEHKLPVLKNVLLPRTKGFCACLQELRSSLTAVYDVTIGYKYRCPSFLDNVFGVDPSEVHIHIHRFPLDSIPVSEDEISMWLINRFQTKDQLLSNFQTQGQFPDQASERDLSAVTSILNCMTIVTVTVCAYLVPATYFNTRPQPILSFLKMRAR

SEQ ID NO: 121818 - protein, 246 aa, Glycine max
  Coding DNA Sequence Number=SeqID_30133
FNGHCKKVVDLKKNGYMKNDVLINACHLEGSNFALEYTWRLLKWLEQCIDTSSKRIKLSDIKDYSLPTTTGFQKVIHTNHPPNGTKNGEGERSCNLFTDCALVWHGRCNRGKNVVNKRTTEAKETNKVKVLYEIMMKNTSIMSEDQISLCSTSIANVSKLSECAMVPTTSVRFRCHRIWHGTQSHFCTIRSYWRRARSTGGRLLLVLLLDSEDESIGVGVFGPIKLGNSEGFQQGVIRVEVEEDVM

SEQ ID NO: 121819 - protein, 80 aa, Glycine max
  Coding DNA Sequence Number=SeqID_30134
MRVDVGVVVVGGRGGEEEEDARRKNRGELGERKEGGGDGEFAHGGVEGGAVAGRETTEEGGGGKKGIGEDNGSGVVEGGV

SEQ ID NO: 121820 - protein, 124 aa, Glycine max
  Coding DNA Sequence Number=SeqID_30135
  Pfam annotation: Domain name=bZIP_1; Domain location=24-87; Score =17.2; E_value=0.005; Accession=PF00170.12; Description=bZIP transcription factor
  Pfam annotation: Domain name=bZIP_2; Domain location=24-78; Score =13.2; E_value=0.019; Accession=PF07716.6; Description=Basic region leucine zipper
  Pfam module annotation: Pfam domain module=bZIP_1::bZIP_2; Domain location=24-87::24-78
AILDERLPPLLFYLQSVEMCTTETAEEKEQRRKQQKKIASKRSRMKIKMEREKLIDSLESLDDEKAALREELHDRTIECEKIEKENNALLAELIEEYGEETIMNLLNAQSTDSVAGGGQGSKNS

SEQ ID NO: 121821 - protein, 74 aa, Glycine max
  Coding DNA Sequence Number=SeqID_30136
MESVRKPRQDSVHHHTPNHSIQSITQGMTYALYASEPLHRMMGSDECSPDWQVQFYMSPYACTQSCSASSASIF

SEQ ID NO: 121822 - protein, 95 aa, Glycine max
  Coding DNA Sequence Number=SeqID_30137
  Gene Ontology: Mol. function=acyltransferase activity; Cellular component=integral to membrane; Biological process=metabolic process
  Homolog annotation: Hit_ID=Q7XZE7; Match level="QueryCoverage=91%, HitCoverage=20%, E-value=2e-27, Identity=60%"; Hit description=FAE1
  Pfam annotation: Domain name=FAE1_CUT1_RppA; Domain location=2-95; Score=-115.6; E_value=3.7e-08; Accession=PF08392.3; Description =FAE1Type III polyketide synthase-lik
MAAKVMFGALDDVFANTKVKPKDIKIALVNCSLFDPTPSLTAMIVNGYKMGGDVRTFNLGGMGCRAIDLAKDMLQLHGNSRAMLIPNCHDKHHDS

SEQ ID NO: 121823 - protein, 70 aa, Glycine max
  Coding DNA Sequence Number=SeqID_30138
MDQLRNNVNARSLPGSNVLYGSSTVSKEKNQIKKWGRDYCEQGVEEGCRRCKKSKRSYHSLKIGSGTGHL

SEQ ID NO: 121824 - protein, 359 aa, Glycine max
  Coding DNA Sequence Number=SeqID_30139
  Gene Ontology: Mol. function=transcription regulator activity; Cellular component=nucleus; Biological process=regulation of transcription
  Homolog annotation: Hit_ID=A7P900; Match level="QueryCoverage=81%, HitCoverage=95%, E-value=5e-75, Identity=48%"; Hit description =Chromosome chr3 scaffold_8, whole genome shotgun sequence
  Pfam annotation: Domain name=HLH; Domain location=199-249; Score =35.0; E_value=2.7e-07; Accession=PF00010.17; Description=Helix-loop -helix DNA-binding domain
  Subcellular localization annotation: CTP_CleavageSite=64; ConfidenceScore=5.04e-01
MLHCLNTSCSDITVLERQREATIKCQNHQPPYLTDFNAVFPSSSSSSSSSSSSSHSQGLLMMCSDSSLGQVLTHSVKPDPGVWPEFGFLPAISRTCSRDGDLVSPKENMASGKENAKKRKPQNSKVVAEIDNNKDKDKRVKVTGEEGESKVTEHHTRNKNAKSNANKNNRETSADTSKGSEVQNQKPDYIHVRARRGQATDSHSLAERVRREKISERMKYLQDLIPGCNKVAGKAGMLDEIINYVQSLQRQVEFLSMKLAAVNPRLDFNIDELFAKEVFPSCAQSFPNIGIPSDMSISNNPSYLQFNSAQQLQILPSSNWEGGDFQSLYNVAFDQGRTASFPPQPFTGLVEASNLKMEM

SEQ ID NO: 121825 - protein, 324 aa, Glycine max
  Coding DNA Sequence Number=SeqID_30140
  Homolog annotation: Hit_ID=A7P8L2; Match level="QueryCoverage=83%, HitCoverage=92%, E-value=6e-53, Identity=44%"; Hit description =Chromosome chr3 scaffold_8, whole genome shotgun sequence
  Pfam annotation: Domain name=DUF241; Domain location=52-276; Score =150.1; E_value=6.2e-42; Accession=PF03087.5; Description=Arabidopsis protein of unknown function
  Subcellular localization annotation: CTP_CleavageSite=38; ConfidenceScore=5.17e-01
MAASQLNTKSNFHARSNSLPSRPHPLILQCNEHLERLRSSNEASSSSSSLSHKLGGLQDLHECVENLFQLSLTQEALHHECQENWVDELLNGSLRLLDVCTAAKDSLLHTKECMRELQSIMRRRKGGEVELKAEIKKFLTSRKVVKKAISKALANLKSTTKSCNISSTNKDNQLISLLENVEVVTLSTFQALLQLISGTTQSKSSSWSLVSKLMQSKKVSCSQLADENEFSQLDEALQSYMFSQTSKFENMNKLQTQLEKVESLVQDLEEVSNDNFVTQVIQGNPTKLHNRKLGRELKNWSSALSTSTSAQREEPTWRPGLVRI

SEQ ID NO: 121826 - protein, 258 aa, Glycine max
  Coding DNA Sequence Number=SeqID_30141
  Homolog annotation: Hit_ID=A7P8K7; Match level="QueryCoverage=90%, HitCoverage=77%, E-value=1e-50, Identity=47%"; Hit description =Chromosome chr3 scaffold_8, whole genome shotgun sequence
  Pfam annotation: Domain name=DUF241; Domain location=51-256; Score =60.0; E_value=8e-15; Accession=PF03087.5; Description=Arabidopsis protein of unknown function
METSTKNSLHIRCNSLPSAPHPLVSQFDEHLQRLKDSEATITSLSSSSITQKLIGLQDLHDYADKLLQLPTTQQAFGHKCSDKWVDVLLEGSLGLLDICSTAQDCLLQSKESVHMVQSVIRRKCPDTEFAVEGGKYLASRKKMKKAIQKALGNLKGMKNELMDSSSSNDSEVLFILGILKEAEAVTMRLLESLLMFVSDTKGQSKQRRWSIISKLMQSDRMTCDSQESETNEFAKVLNTFQGNSLEQEFPYLTSSATS

SEQ ID NO: 121827 - protein, 137 aa, Glycine max
  Coding DNA Sequence Number=SeqID_30142
  Homolog annotation: Hit_ID=A5ALI1; Match level="QueryCoverage=45%, HitCoverage=4%, E-value=2e-12, Identity=49%"; Hit description =Putative uncharacterized protein
MEMSSGHNPSFTWRSIVSFKVVLKEWFWWKLGDEVSIDVWKQPWLRSTNIAYIQTPMYPDMEHLKVSDPLIIIRAIGIILSLIIHLRQMMCKLSNVFLSWIDQREIIKHTWAHSKCGTYTVRNAYRIIPQKFTNYNT

SEQ ID NO: 121828 - protein, 103 aa, Glycine max
  Coding DNA Sequence Number=SeqID_30143
MDFATNQKKNIPSLCSINLNKNNYMLCKSLLSLINQRKGGHGTDEELQEGVLVASNIKFEEARDENHRAGARPISTKKKTSREGCKGGALLESTLRVEHFQGF

SEQ ID NO: 121829 - protein, 1184 aa, Glycine max
  Coding DNA Sequence Number=SeqID_30144
  Gene Ontology: Mol. function=nucleoside-triphosphatase activity; Cellular component=nucleus; Biological process=proteolysis
  Homolog annotation: Hit_ID=Q8H6B2; Match level="QueryCoverage=98%, HitCoverage=98%, E-value=0.0, Identity=58%"; Hit description =Bromodomain protein 103
  Pfam annotation: Domain name=AAA; Domain location=424-614; Score =269.4; E_value=7.5e-78; Accession=PF00004.20; Description=ATPase family associated with various cellular activities (AAA)
  Pfam annotation: Domain name=AAA_2; Domain location=420-554; Score= -42.0; E_value=0.018; Accession=PF07724.5; Description=ATPase family associated with various c
  Pfam annotation: Domain name=AAA_5; Domain location=424-560; Score =8.4; E_value=0.00066; Accession=PF07728.5; Description=ATPase family associated with various
  Pfam annotation: Domain name=Bromodomain; Domain location=912-986; Score=1.9; E_value=0.0015; Accession=PF00439.16; Description =Bromodomain
  Pfam module annotation: Pfam domain module=AAA::AAA_2::AAA _5::Bromodomain; Domain location=424-614::420-554::424-560::912-986
MYPKRSGQDGPDSRQVRSSDRIKTRPNVYGRPYLYYNQNLRRTRKSKIKTRTAASQIAKMLRPGNRKSKDSNTNSGSANLRRSTRKRRLNVNLEDFTDSSGAEDEDLMVRYEAMFQRPPTYPSLRNRMKNSDRRDGLMSNKRKRVAETKQTPRREGLRPRRSKGAAIERLILESDDEQDLSEEKVDQDETENGNDVEENDADDGQKEIEGDAEGEDEGEDEGDEDGDDEEGEEEQDGRRRYDLRNRSDVRRFSMEEGKAQPRSPRRVLHQGMGTKVSRDVRKGGSRVHKRHRLARPEDSDDSLLVDELDQGPAIPWGRGGNRSGPPWLFGGLDMHGTTAFGLNLAASGWGHQGDAVATLTSGIQTAGPSSKGGADIQPLQVDDSVSFDDIGGLSEYIDALKEMVFFPLLYPDFFASYHITPPRGVLLCGPPGTGKTLIARALACAASKAGQKVSFYMRKGADVLSKWVGEAERQLKLLFEEAQRNQPSIIFFDEIDGLAPVRSSKQEQIHNSIVSTLLALMDGLDSRGQVVLIGATNRIDAIDGALRRPGRFDREFNFPLPGCEARAEILDIHTRKWKHPPPNELKKELAASCVGYCGADLKALCTEAAIRAFRQKYPQVYTSDDKFVIDVDSVKVEKTHFIEAMSTITPAAHRGAIVHSRPLSLVVQPCLQRHLEKAMSIISDIFPPASITSELTKLSMLSYGSAIPLVYRPRLMLCGGEGTGLDHLGPAVLHELEKFPVHSLGLPSLLSDPSAKTPEEALVHIFGEARRTTPSILYLPQFDVWWETAHEQLRAVLLTLLEELPSDLPILLLGTSSVTLAEVEEVPTSIFPHRSIYKVNMPCAKDRTLFFNLLIEAAMSILLEGINKKSQDAGCLPELPKAPKLASGPKVSELKAKVEAEQHALRRLRMCLRDVCNRILYDKRFNAFHYPVTDEDAPNYRSIIQNPMDMATILQHAYNGEDYNGARIVSRACELRDAVHGMLSQMDPALVAYCDKIASQGGPVQLSDELGDSTFPATPVVQLGQSTRMSARLRHVQPEVNMDQSYEVLKRTKKIAEVHAEEKSQQDSVPSKSSLEQQANDTNSERLEHVSIEGDLHGTFTNNLADGNSPDDVTVLDGEFLGEVESVKQLFVKRSENYSIPQLERLYTRIMKGVFETKNKGVSGDLKSSVLKFLLNFVEDDANF

SEQ ID NO: 121830 - protein, 797 aa, Glycine max
  Coding DNA Sequence Number=SeqID_30145
  Gene Ontology: Mol. function=binding; Cellular component=nucleus
  Homolog annotation: Hit_ID=A7QM62; Match level="QueryCoverage=98%, HitCoverage=98%, E-value=0.0, Identity=64%"; Hit description =Chromosome chr5 scaffold_124, whole genome shotgun sequence
MGVMSRRVVPVCGNLCCACPALRASSRQPVKRYKKLLADIFPRYQEAELNDRKIGKLCDYASKNPLRIPKIISVTLENYPSLHSNSRPANEDKLNSESLDLLVQGIPKVEDPLTDITKKDPLLLKAVTGTEIDCVLDTAKDPTYWSKVCLYNMVKLAREATTLRRVLEPLFHYFDTENQWSSEKGVAAHVLMYLESLLAESGDNSCLLLSILVKHLDHKNVAKQPILQINIINTTTKLAQNVKQQASVAILGAISDLIKHLRKCLQNSAEASSIGNDGLKLNTELQFALEMCILHFSNKVGDVGPILDLMAVVLENISSTTIIARTTISAVYQTAKLIMSIPNVSYHKKAFPDALFHQLLLAMAHPDHETRVGAHSIFSLVLMPSPFSPQLDQKTKGYQKVPSESFSIQHESFLGAEQINGKPMEGKAVVGVSGKYAVHPYHGHIFSGALTDGKHELSSFRLSSHQVSFLLSSIWVQATSVESGPANFEAMAHTYSIALLFTRSKTSSYMALVRCFQLAFSLMSLSLDQEGGLQPSRRRSLFTLASYMLIFSARAGNFPELIQKVKTSLTETTVDPFLELIDDVRLQAVSRESENIIYGSQEDDVSAMKIMSAVKLDDKQLKETVISCFLTKFSKLSEDELSSIKKQLVQGFSPDDAYPLGPPLFMETPGKSSPLAQIEFPDFDEIVAPLALMDEETWPKSSGSQSDHKSSLSSNSPDILSVNQLIQSVLETARQVASFPISSTPVSYDQMKNQCEALVTGKQQKMSILHSFKHQQETGAIVLSSENEIKVSPLPIK

SEQ ID NO: 121831 - protein, 192 aa, Glycine max
  Coding DNA Sequence Number=SeqID_30146
  Homolog annotation: Hit_ID=A5BJC0; Match level="QueryCoverage=30%, HitCoverage=6%, E-value=4e-09, Identity=46%"; Hit description =Putative uncharacterized protein
MSTNKTVPLLSPNNLQALQGSYRIDGRNYLQWAQLVRTTLKGQKKLNYIEGEPPAQTDPKFWAKKNFLLSQRCSTLYEEKKLGRSVMLEGSSSVDGSALATGKGSTKGSSSSFGKLLAKANCDDHWCSYCRKPGHTKETCFKLHGKEKVLERIGGFRGATQRCANQATSASESVENTLIPQAEKEILALSKA

SEQ ID NO: 121832 - protein, 417 aa, Glycine max
  Coding DNA Sequence Number=SeqID_30147
  Homolog annotation: Hit_ID=A5BES6; Match level="QueryCoverage=72%, HitCoverage=55%, E-value=8e-24, Identity=31%"; Hit description =Putative uncharacterized protein
MRDSTVQNCHQNNSGAVEAGAPSVEKDLASSVKAATEVPPSSFQFYVWSDVGINLHVDLNLSSSDWINRFRNEVCISENMHRNKSRSLWQDLSSLGENYMQGKSSFLWSKNSCQIEDHDGQARSSSSSKLTKDGATESGQQNKDGIPLRCDSFTPCNMTIEVKDNILENHSTVSAELNVNVVDNLMQEQSTVSAEVSCAIDTSKKIIDSDATNMPFIKSLCDSVVNSLSDPGTLELQNSKPDNECSEYCALLNGSCFVNPGVVCAGASLSSSVGLQNSEVISCHKYESVSLCDNDGSLDLSDPKSTSDMEQDRLVKTRIIFETDSNNFTSVTDEWEVDKIVDGRESSECSQFDDPLKKSSLDYNNQDSKLELCKKRKNRDSEIQCSNGEPTTTRVLRSMKNTATRVLRSMKNVKLPR

SEQ ID NO: 121833 - protein, 317 aa, Glycine max
  Coding DNA Sequence Number=SeqID_30148
  Gene Ontology: Mol. function=hydrolase activity; Cellular component =mitochondrion; Biological process=response to methylglyoxal
  Homolog annotation: Hit_ID=Q9FSZ6; Match level="QueryCoverage=78%, HitCoverage=91%, E-value=1e-120, Identity=83%"; Hit description =Putative mitochondrial glyoxalase II
  Pfam annotation: Domain name=Lactamase_B; Domain location=74-232; Score=119.0; E_value=1.4e-32; Accession=PF00753.18; Description =Metallo-beta-lactamase superfamily
MALWHGVKGFLSEIRIIYDGISIIHAGIASFGSDECARICVAYSLSLGKKWVLRVARCETTLLKERSSVPCLRDNYAYLLHDVDTGTVGVVDPSEAAPIIDALSKKDLNLTYILNTNHHPDHTGGNAELKERYGAKVIGSEIDKERIPGIDIYLSDGDNWMFAGHEVHILATPGHTEGHVSFYFPGSGAIFTGDTLFSLSCGKLLEGTPEQMLSSLKRIMSLPDDTSIYCGHEYTLNNSKFALSIEPENKELQSYATHVSNLRNKGLPTIPTTLKVEKACNPFLRTWSIEIRQKLNIAATADDAEALGVIRQAKDNF

SEQ ID NO: 121834 - protein, 1228 aa, Glycine max
  Coding DNA Sequence Number=SeqID_30149
  Gene Ontology: Mol. function=nucleoside-triphosphatase activity; Cellular component=nucleus; Biological process=ribosome biogenesis and assembly
  Homolog annotation: Hit_ID=A7QHJ9; Match level="QueryCoverage=94%, HitCoverage=94%, E-value=0.0, Identity=61%"; Hit description =Chromosome chr5 scaffold_98, whole genome shotgun sequence
  Pfam annotation: Domain name=AARP2CN; Domain location=237-323; Score =167.7; E_value=3e-47; Accession=PF08142.3; Description=AARP2CN (NUC121) domain
  Pfam annotation: Domain name=DUF663; Domain location=731-1059; Score =262.5; E_value=9e-76; Accession=PF04950.3; Description=Protein of unknown function (DUF663)
  Pfam annotation: Domain name=GTP_EFTU; Domain location=86-273; Score=- 69.6; E_value=0.0057; Accession=PF00009.18; Description=Elongation factor Tu GTP binding domain
  Pfam annotation: Domain name=MMR_HSR1; Domain location=89-193; Score=- 9.6; E_value=0.008; Accession=PF01926.14; Description=GTPase of unknown function
  Pfam annotation: Domain name=Miro; Domain location=90-193; Score= -10.7; E_value=0.099; Accession=PF08477.4; Description=Miro-like protein
  Pfam module annotation: Pfam domain module=AARP2CN::DUF663::GTP _EFTU::MMR_HSR1::Miro; Domain location=237-323::731-1059::86-273::89 -193::90-193
MAVNDADQSNKAHRTRQSGAKTNKKKTKKKQKLNPDDVGGEDPKKQNPKAFAFSSSNKAKRLQSRAVEKEQRRLHVPVIDRSYGEPAPYVVVVQGPPQVGKSLLIKSLVKHYTKHNLPDVRGPITIVSGKQRRVQFVECPNDINGMIDAAKFADLALLLIDGSYGFEMETFEFLNILQVHGFPKVMGVLTHLDKFKDAKKLRKTKQRLKHRFWTEIYDGAKLFYLSGLIHGKYVKREVHNLARFISVMKFHPLSWRTSHSYVMVDRFEDITPPEKVHANNKCDRKVTLYGYLRGCNLKMGNKVHIAGVGDYSLAGITALPDPCPLPSAAKKKGLRDKEKLFYAPMSGLGDLLYDKDAVYININDHLVQFSKVDDENSAMTGKGKGSDVGEDLVKSLQNIKYSINEKLENSFINIFGQKANVSSGALGDAHGTNKNVEQNDKTEALDKYQPGTGEDNNKTDLDVSESSDRDEDDATDSEASGSDEDKDAPNSNARNGVHLQEHIDFQDGRWRRRAIFGNDVDQNDLMDSEGDEDGATSNDDVESSEEEEEDGNDNDDTNEDDTGNVSKWKESLAERTLSRKTPSLMQLVYGESTINSTTINRENDNSGDEESDDDFFKPIEEVKKLNMRDGLNDDGMFNTEDCAKCTQFVVQRWDENDNEEIRNRFVSGNVAKAALRNALPAANTEEDNDDVYADFEDLETGEKHENHRTDAAFAATTHKGDDLEAEERRLKKLALQEDTGNENEVKFHRGQANESSYFDKLKEEIELQKQMNIAELNDLDEATRLEIEGFQTGTYLRLEIRDVPCEMVEYFDPYHPILVGGIGIGEENVGYMQLHARMVCIGVPVDAEETKHFLCFVNGNMDHLYARLKRHRWHKKVLKTRDPIIVSVGWRRYQTTPIYAIEDSNGRHRMLKYTPEHMHCLAMFWGPLAPPNTGVVAIQNLSNNQATFRITATAVVLEFNHAARIVKKIKLVGYPCKIFKKTALIKDMFTSDLEVARFEGAAIRTVSGIRGQVKKAAKEEIGNQAKRKGGQTKEGIARCTFEDKILMSDIVFLRAWTQVEVPQFYNPLTTALQPRDMTWKGMRTVAELRREHNLPIPVNKDSLYKKIERKPRKFNPLVIPKSLQASLPFASKPKDISKRNKPLLEERRGRGVVMEPRERKVHALVQHLQLINSEKVKKRKLKEENKRKALEAERTKEEQLLRKRQREERRDKYRKEDKQNKKIRRAEV

SEQ ID NO: 121835 - protein, 92 aa, Glycine max
  Coding DNA Sequence Number=SeqID_30150
  Gene Ontology: Mol. function=hydrolase activity, acting on glycosyl bonds; Cellular component=extracellular region; Biological process =polysaccharide catabolic process
  Homolog annotation: Hit_ID=P27054; Match level="QueryCoverage=92%, HitCoverage=31%, E-value=5e-31, Identity=69%"; Hit description =Endochitinase PR4 precursor
  Pfam annotation: Domain name=Glyco_hydro_19; Domain location=15-92; Score=-49.5; E_value=1.7e-05; Accession=PF00182.10; Description =Chitinase class I
MVPINVSAQNIGDDIVTQEFFNSIIDQADASCAGKNFYSRDVFLNAHNSYNEFGRLGNQDDSKREVAASFAHFTHETGHFCYIEEINGAAGD

SEQ ID NO: 121836 - protein, 248 aa, Glycine max
  Coding DNA Sequence Number=SeqID_30151
  Homolog annotation: Hit_ID=A7P9A7; Match level="QueryCoverage=85%, HitCoverage=95%, E-value=2e-74, Identity=63%"; Hit description =Chromosome chr3 scaffold_8, whole genome shotgun sequence
MGMDEFFAMSKMRKADLVKRVVVIAVMAMFVADAADTNDVYSPCLDAKVQRGDGFTFGIAFSDKQFFSQGNGPQLSPCDKRLDLANKGAQLSVFRPTVDEVSLLTINRSTSNPGNNAYMVAFAGQKYAARSLPIMFADNSHTITSFTLVLEFQEGTLQNLYWKSFGCDGCPSGSICLNQQDCAVPNKECQKNGGTACNMGIQLAFSGTDKNLDALNSWYEVQNLRQYSLYGLFSNLRDSIIGPYENLF

SEQ ID NO: 121837 - protein, 466 aa, Glycine max
  Coding DNA Sequence Number=SeqID_30152
  Gene Ontology: Mol. function=DNA binding; Biological process =regulation of transcription, DNA-dependent
  Homolog annotation: Hit_ID=A5AN67; Match level="QueryCoverage=82%, HitCoverage=65%, E-value=3e-70, Identity=39%"; Hit description =Putative uncharacterized protein
  Pfam annotation: Domain name=B3; Domain location=326-424; Score=67.9; E_value=3.4e-17; Accession=PF02362.12; Description=B3 DNA binding domain
  Pfam annotation: Domain name=B3; Domain location=36-126; Score=56.5; E_value=8.8e-14; Accession=PF02362.12; Description=B3 DNA binding domain
  Pfam module annotation: Pfam domain module=B3::B3; Domain location =326-424::36-126
MPHPSFHKLLLPSTVQPNQQLWNAPSSVCITNNYQYLESNLTCELQRLPDNFMRKYGGELLPIVTLSVPDGSVWRVGLKKADNKYWFLDGWKEFVKHYSISIGYLLVFKYEGKSSFSVHIFNLATSEINYQSATRSSNEGLHFTNRLKLFEEIEDEDSIEISDSSPSHLAPSSLQNQALTGSVDKMMPGKSYTPPALQNLFNGSKLNSINWGEGGNAHSSRIANSLDNRLTRDIGLQFNAVEFKRSTEELKLRASMEERMKKTTRKKRKSVCASADGQDPSAEHEEEVEMRLRFYESASARKRTVTAEERERAINAAKAFEPPNPFCRVVLRPSYLYRGCIMYLPSCFAEKHLNGVSGFIKLQISNGRQWPVRCLYRGGRAKLSQGWFEFSLENNLGEGDVCVFELLRMKEVVLQVTVFRVIEDVGLLSPPLQQNQNMSSAKMLNTPLQQHLTSTKMVRNQQQVHS

SEQ ID NO: 121838 - protein, 473 aa, Glycine max
  Coding DNA Sequence Number=SeqID_30153
  Homolog annotation: Hit_ID=A5C240; Match level="QueryCoverage=90%, HitCoverage=75%, E-value=4e-67, Identity=38%"; Hit description =Putative uncharacterized protein
MAYELLKMAIPKGTTIGLASIIVIIALILHQTVAQAVSPNGSVANNVSKPIKPDNTVRVDPLDHLKKYRGGFDITNKHYWSEYMDMQLGCFGFYVEWVASVLVYVGSSKFHYQARTSVNVIIKIADDASEIIHNVTRALEDIQENLVDSGISAEVSENLNSTAKKMDNAVDNIVKKTRKNKRTVNRAFKFVFIITIVIISLNLVAVPILSGMSNWYDSHNMLEFSVEQFLEYTCFGGHFTCRFVILCWLMAVICWLIFGLYFFLENFSIDTCTVLCNFEENPYNNSLTSILPCDELRSAKAILPEVGAGISFLITKVNSNLGPMFPNNVDLCNPFSAPPKYLYQPEFCPPNSIQIGDIPKVLKPYTCFGDSDENCGSDHLMNGGEYKVVEAYTSSTQNLLNMYPGMENLIGCKLVKDAFSQILFKHCKALNNFARMAWVAMVFLAVMMVFYVVLSTIKACQDHSSYHPSDDSV

SEQ ID NO: 121839 - protein, 138 aa, Glycine max
  Coding DNA Sequence Number=SeqID_30154
MYAGERFKCAKFINSLRPEVKMMVNYHGMHNFAQLTNMRRIFHEDQREKVAFYRNANASHGKKKKHVTHSCAKLYSSLLGQYEESNKVASKAKHCFKINTRLLQQTKPCFKINSRSSLASKQSVFKTSKALVIDYQAM

SEQ ID NO: 121840 - protein, 352 aa, Glycine max
  Coding DNA Sequence Number=SeqID_30155
MASKKRKALATPSQVRYDRSRFTSPKAWERYTDIVLPRKILLEQNVVIYHTEFDEFKEELERRKWDEELTNFDEGSIDVTIVKEFYANLYDPEDKSPKQGENLSAYSRFALLRPNPQELATKLCIPGRGFELNADDDPTVTFRGPRKARGKGSEAPPTSATPDASTPSSSTLPDPSALSTSTPHLPQFPIQLPASYAPALDFLFTVEMLHSMMHSLHRGHVILMQSFQSLGLPSIMPMEDFHAQGGGALAAQELDSAKPVEEHTEEQAAEEPTLAEDELIPLEPFSFAANTSMAQEEETSPNPMAEPFLAPISEDTMLSAPAMEPEQPILQDVPAVLMLDLNEHAEDYSQED

SEQ ID NO: 121841 - protein, 43 aa, Glycine max
  Coding DNA Sequence Number=SeqID_30156
DDKKPKRMTSRLSQEQFKNQEKFDFKNQESSFKFQESRIKNQE

SEQ ID NO: 121842 - protein, 232 aa, Glycine max
  Coding DNA Sequence Number=SeqID_30157
  Gene Ontology: Mol. function=motor activity; Cellular component=cell projection
  Homolog annotation: Hit_ID=UPI00016621D1; Match level="QueryCoverage =89%, HitCoverage=41%, E-value=9e-19, Identity=34%"; Hit description =UPI00016621D1 related cluster
MPSPSEDYTSSPSENYGSSPSEDYTSSASEDYRGLHVLGFRVLHAFTFRGLHVLAFRGLHVFAFRWLHALTFRGIHTLTFRGLHVLIGLHALTFRGLHVLPFKGLHALTFKGLQIAVFRGRHVLNFKGRHVLTFRGLCTFTFRGLQVVTFRGLHVLVFRGLLVLTFKGLHILTFRGLHALVFRGLHVLAFRGLHVLAFRELHVLPFRGIHVLAFRGLHVLAFRGLHTVVFKG

SEQ ID NO: 121843 - protein, 224 aa, Glycine max
  Coding DNA Sequence Number=SeqID_30158
  Subcellular localization annotation: CTP_CleavageSite=49; ConfidenceScore=5.27e-01
MAQSNYSRLRFPTLITALYDPTVIIRGARRPRARPTEAPSTSAAPHPASTSAAPSTLPPTDFQRFETMLWSIHQGQIILLQSLQLVVPPDSIPMVEQFNEWVSWPGTQPPLHREDEDLAAQVPHQSEDESSESSTPEPLNRKRRVVVTQEVAATSEKSPEATPEPPTPVADTTSPQQEADPSTPEDQTTSVQSPNASPLATPVLHLSEDEEVRTQDTLDQSQDF

SEQ ID NO: 121844 - protein, 228 aa, Glycine max
  Coding DNA Sequence Number=SeqID_30159
MTGHLDESISCFLIKVDPWVLVPITFRGLYVLAIRGLHILACRGLHALAFRGLRVLIFIPGPPLDIGERPIVRAHPDEGGYQHLLCTGSAHKIRPWALKKSNRALGFPALVTEPLSVQQGARPPNEGSRPQDTQWTRRSPTGPWGFQLWLWASVSPTGCPFPPARSCHRDIGIAPTKTPSGPGEVQQGPGVSSSGITPARHPVDPKKSNRVLELSSSNYGSLSVLQSA

SEQ ID NO: 121845 - protein, 70 aa, Glycine max
  Coding DNA Sequence Number=SeqID_30160
VEGRSPEYEEPWDLRSNPFQGGGDDAILPPKALASHLKEVSLAIRELLKEVFSKKLLKEFFSRKHLKEAT

SEQ ID NO: 121846 - protein, 258 aa, Glycine max
  Coding DNA Sequence Number=SeqID_30161
  Homolog annotation: Hit_ID=A7QC61; Match level="QueryCoverage=37%, HitCoverage=41%, E-value=5e-19, Identity=43%"; Hit description =Chromosome chr10 scaffold_76, whole genome shotgun sequence
DLGVTISLPKSLVSDVGGAEFAKKFRLLCKLNHTKSSTVLRLKAIWLKAKLPFELWLGQCCPVDPYLKGRLIWKLQQAFRPKDLVVPPTSTYKSETFEYLEDMTLLRSWTEAWLKYVRWYYATALSPDVSIEDFIQAPVVTTRSFQRVKSSTSDPFRSGQSQGDLVGCLFLIKLNFLCWKGVRTSLMLRLRLIENCCGETIAEAGLDPKPLTILGSRLGGSEKTKGDADYSIADSEEITDIVGTNLIFMTGPVIDLLL

SEQ ID NO: 121847 - protein, 179 aa, Glycine max
  Coding DNA Sequence Number=SeqID_30162
ATKALEQETKRARTEEHDQNKFRGALWGSNSELKLRREERDQSRVDSLILKDELKVCSRSKRNLSQRLCETETNMLTIISKYQEELNLATAHEHRVADEYAQVYAEKEARGRVIDSLHQEATMWMDRFALTLNRSQELPRLLAKAKAMADTYSAPEEIHGLLSYCQHMINLMAHIIRNR

SEQ ID NO: 121848 - protein, 87 aa, Glycine max
  Coding DNA Sequence Number=SeqID_30163
MEAKNESLFLDDGDLSRPMASCHGVAWVVAKIRHYMISTTTLFCHKQKWSLSLSQNIIHSKTPKTETGEALNRKTEIEHTLNKIPGY

SEQ ID NO: 121849 - protein, 42 aa, Glycine max
  Coding DNA Sequence Number=SeqID_30164
MVTPTSTACYLDKDEAGQSIDIKKYRDIKQILKNLTLVPLKE

SEQ ID NO: 121850 - protein, 124 aa, Glycine max
  Coding DNA Sequence Number=SeqID_30165
MARSVFASCPYFMGPIRRELTRLLAIIPKVVISLLMVSRVESPTVATYPSAGGRRVTRGMRVPRKEYARSRHQRLFEENVGKTGKDAIYELLSERFGSCIYARGRVFPFAPTYSSIWDEKIRPT

SEQ ID NO: 121851 - protein, 84 aa, Glycine max
  Coding DNA Sequence Number=SeqID_30166
MDFRNKANNNALGQTPMSLHESAESILGFTKGHHFEIPITPMRPGKHKTCNGGFQTQNDAKWSFNGGKRRFMGLMVAVGDGERA

SEQ ID NO: 121852 - protein, 101 aa, Glycine max
  Coding DNA Sequence Number=SeqID_30167
MVSGNRLPQGVIDYRLENEVRKLREPLRDGSLVIDYQIVMAAQLIHDRVEMECLEGAWETLEGNTRCRFRGTIRFAATSLVHPDEPARTLQRTVEWTAFLD

SEQ ID NO: 121853 - protein, 38 aa, Glycine max
  Coding DNA Sequence Number=SeqID_30168
DYMDWFFRILHPFMTPGHASDPLPDGHAPQPRVVPQAP

SEQ ID NO: 121854 - protein, 306 aa, Glycine max
  Coding DNA Sequence Number=SeqID_30169
  Homolog annotation: Hit_ID=A6FJQ2; Match level="QueryCoverage=12%, HitCoverage=84%, E-value=1e-10, Identity=92%"; Hit description=50S ribosomal protein L5
MRKEKIPHQAPFAIQAAQLLGRAIGAGLFAITPAGERGMCCKAIKLGNARVFPESLSPLLVRDLGAQSLKVIQRVHKAWRSSLRKDKELRGIRNGVIGGYHGWLRVHTRGLDWFSKFKVIDEENFEAPEEDEEVRALKLELGKARLAKEKFKSATTHIRKECTELQEENTATARALEQETKRARKEEHGRENSEEHCGVATMSSSSKERKETGHGSKRSLAQHLEATEQGMLAIIGQYKEELNQSVTHEQKLVEDFAQVYAEKEARGRVIDALHQETTMWMDRFALTLNGSQDLPRLLAKAKAMAE

SEQ ID NO: 121855 - protein, 156 aa, Glycine max
  Coding DNA Sequence Number=SeqID_30170
MIGPIDESISYKGGPLEGCTPSPSEDYTPSPSEGCMSLPSENYTSSPSEGCTSSPSEDYTSSPLEDYKSSPLEDYTSSPSKDHSSFPSEGYTPSPSDDYTFSPSEGYSPSPSEDYTSSLSDDYTSSPLHDYTTSTFRGLHIPRLQRTTRPRLQRNT

SEQ ID NO: 121856 - protein, 31 aa, Glycine max
  Coding DNA Sequence Number=SeqID_30171
GVMAGRNDRAIADALQALAQAIGNPNRGDFW

SEQ ID NO: 121857 - protein, 177 aa, Glycine max
  Coding DNA Sequence Number=SeqID_30172
  Homolog annotation: Hit_ID=A5BTR2; Match level="QueryCoverage=96%, HitCoverage=11%, E-value=2e-38, Identity=46%"; Hit description =Putative uncharacterized protein
MGIDYAIRKDESPAITDDSSPTTVALYEQWEQSNQLSVMFIKIKILVEIRGSINQHVKVRHLLKVIDDRFITSYKALASILIMKFSSFRLTSVKGVYEYIMQMQDISAQLKKLEEEERLVMEMGESALLTTACWKNKTTKSQSNHKGNGKMPPQANIKKVTKCFFCKREGTHEEELP

SEQ ID NO: 121858 - protein, 63 aa, Glycine max
  Coding DNA Sequence Number=SeqID_30173
MESRMTKVEEDMMTKAMNKKLKDQRTTQVNQEQSRVQESRRIQDLKNQDQDSRMKKRLNQDKY

SEQ ID NO: 121859 - protein, 83 aa, Glycine max
  Coding DNA Sequence Number=SeqID_30174
  Gene Ontology: Mol. function=aspartic-type endopeptidase activity; Biological process=DNA integration
  Homolog annotation: Hit_ID=A5BPN8; Match level="QueryCoverage=100%, HitCoverage=11%, E-value=8e-18, Identity=49%"; Hit description =Putative uncharacterized protein
KGKRKRTEEPKNEAAKGLAQKKQNQGDNCFFCTSVSRNTWLLDSGATTNIGVSMQGCLSYWKPIDSERWIYVGDGKSMEVEAI

SEQ ID NO: 121860 - protein, 239 aa, Glycine max
  Coding DNA Sequence Number=SeqID_30175
  Homolog annotation: Hit_ID=A6FJQ2; Match level="QueryCoverage=15%, HitCoverage=84%, E-value=7e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPAAEPVQPARSGTEQRPDQPGQDPRAGQQGPLHAQARGNAGRGPEETARQRAPAPERRRQHGSETTEILRGAAQHPGLCGFEPDAGAAVVPAGRDRRPAPAALPVHHRAAGLHGPAQQSAHRRAAVAGAGAGLRAHVRPARGDGLA

SEQ ID NO: 121861 - protein, 84 aa, Glycine max
  Coding DNA Sequence Number=SeqID_30176
  Subcellular localization annotation: CTP_CleavageSite=62; ConfidenceScore=5.28e-01
MTCGGTLWLSTPFVNQRKASPLTRGDLCHLPRRLPLSSTNPDSRSNDMRGYLMVICTFCQPEASEPVDTRRFTSSSAQTTSVKH

SEQ ID NO: 121862 - protein, 138 aa, Glycine max
  Coding DNA Sequence Number=SeqID_30177
  Gene Ontology: Mol. function=oxidoreductase activity; Cellular component=cytoplasm; Biological process=metabolic process
  Homolog annotation: Hit_ID=A7QJ44; Match level="QueryCoverage=81%, HitCoverage=26%, E-value=6e-39, Identity=68%"; Hit description =Chromosome chr2 scaffold_105, whole genome shotgun sequence
  Pfam annotation: Domain name=ADH_N; Domain location=1-106; Score=2.6; E_value=0.00071; Accession=PF08240.3; Description=Alcohol dehydrogenase GroES-like domai
IKVIRTLIRKTLTDQLDSIVGEGVSDMKEGDLVVPIFNGECGDCKYCKCEKTNKCERFGVDPMKKVMASDGATRFSTMDGKPIFHFLNTSTFTEYTVVDSACVVKIHVDGNGELNHHIKRLTLLSCGVSSGKELGQPQ

SEQ ID NO: 121863 - protein, 267 aa, Glycine max
  Coding DNA Sequence Number=SeqID_30178
  Gene Ontology: Mol. function=transporter activity; Cellular component= integral to membrane; Biological process=transport
  Homolog annotation: Hit_ID=A7QDI4; Match level="QueryCoverage=35%, HitCoverage=20%, E-value=8e-28, Identity=63%"; Hit description =Chromosome chr10 scaffold_81, whole genome shotgun sequence
WWKTYSNCVDRMWSFFILSLQCVCLVKAAHVYVWMPPVHVEEHKNQLHLLLRAENFSPSQIDAISGVLLLMMRCNDLFEIKIPCPLEWGAPTFDAGHAFGMVVTAYKAASRLTSATPPPAHVLSRGIGWQGIGILLNSLFGTLTGSTVSVNTILYKKEIGISKYFSVGVSLFFSTGSIYIYSAESDNVQRTEKLTSINQQPHCAQTVSNIIYLDSPASVGLSYSENTSKYATGDLCHWGSPIPISLSFVILLIYGYTKVLISKWSQC

SEQ ID NO: 121864 - protein, 86 aa, Glycine max
  Coding DNA Sequence Number=SeqID_30179
MVLKEELVACSRSKKSLAQHLEATEQSMLAIIGQYKEELNQSLTHEQKLVEDFAQAYAEKEARGRVIDALHREATMWMEVKTSRDY

SEQ ID NO: 121865 - protein, 98 aa, Glycine max
  Coding DNA Sequence Number=SeqID_30180
MINRKHIMQQKRHPHAQSLIVSDSSESVNSESTQGSGSNFLTTYEDCQSPTNQPVINTEDTRAHALRLIFTIVIVILYYDIKQFQDILILVIYNMGSL

SEQ ID NO: 121866 - protein, 480 aa, Glycine max
  Coding DNA Sequence Number=SeqID_30181
  Gene Ontology: Mol. function=nucleoside-triphosphatase activity; Cellular component=chloroplast
  Homolog annotation: Hit_ID=Q2PMM5; Match level="QueryCoverage=97%, HitCoverage=20%, E-value=0.0, Identity=88%"; Hit description=Protein ycf2
MEADKNYHRNNELLLISTHLRSLNVQEFFYSILFLLLVAGYLVRTHLLFVSRVYSELQTEFEKVKSLMIPSYMIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPSKTIYSLIRKIKNVNGDWIDDKIESWVLNSNSIDDKEREFLVQFSTLTTEKRIDQILLSLTHSHHLSKNNSGYQMIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKVDPGSNSSE

SEQ ID NO: 121867 - protein, 126 aa, Glycine max
  Coding DNA Sequence Number=SeqID_30182
MSLHSSSSVNGEGSSPKDLFSHNSCKSLSEELRDYYEGRNKSHLRPHSHRRENERKPQEANINLPYFHGKDNVEAYLDWEIRIEQKLKRKPTLKSYGSHYYPKKDQGLGILGATPSKPKDDKGKTI

SEQ ID NO: 121868 - protein, 121 aa, Glycine max
  Coding DNA Sequence Number=SeqID_30183
  Subcellular localization annotation: CTP_CleavageSite=40; ConfidenceScore=5.27e-01
MGKGWGPSTAGAGYTGRSCRSTAHVPYSWLPAGQPNATCRAPSFACELRWTLEMMATIEVAVVCLRSTATIGLAPTAVPALACNELCGCNWHPIELVETYDQSWKSQCSVTFLGPLGVLKV

SEQ ID NO: 121869 - protein, 320 aa, Glycine max
  Coding DNA Sequence Number=SeqID_30184
  Homolog annotation: Hit_ID=A5C169; Match level="QueryCoverage=61%, HitCoverage=17%, E-value=1e-08, Identity=26%"; Hit description =Putative uncharacterized protein
  Subcellular localization annotation: CTP_CleavageSite=24; ConfidenceScore=5.54e-01
MAESSKKCKVSSTSVAAHRTSRPRATGASPTPIPPSLSSSTLFSSDEKCIQYSSLFQSHQILDPKYLDLEFFDGEIFDCYQVFQNIGLIPFMSLKLPYYPELVRVFYSNLKIQDGTLISEVHGIPMIIDESLFFSLTQLPNQGAPFEGTLVDNKKFDYSCHDARRMVCIDQVDMTGRLLAGSLTFDCRIMHYIIVRILMLRSSNLAQAFEEDMILMWAFLTNCPIDWAHLIRYRMHKALRSSAPLPYSQLVTLFLRLFEIPLDSEPFVQVKRSFAIGVDAVTSFGYYAIDACFEGMDTRITQLEEDVSYLRRCFDLPPPS

SEQ ID NO: 121870 - protein, 126 aa, Glycine max
  Coding DNA Sequence Number=SeqID_30185
KLLAKKTKKKLEEAAQSGSVDGVIDPPSPVRRYVKWKMARTKKTGEMTTEAAKEIADKIDSFEEQATQNRSSPMDIRMFSSLLLDVQSTLDVSVLLKSVSPSSNTLDRLHGPLTALPLCLLTNCSS

SEQ ID NO: 121871 - protein, 232 aa, Glycine max
  Coding DNA Sequence Number=SeqID_30186
  Homolog annotation: Hit_ID=Q6WAY6; Match level="QueryCoverage=49%, HitCoverage=19%, E-value=2e-12, Identity=39%"; Hit description =Putative uncharacterized protein
MEAVISLAQYYDQPLSKIAAVVGDSAKELDHMKQTRNGVVGLPRKYLEGKARDMASQEKWGPFADILALLIFGVVLFPNVDGLVDLAAIDAFLAYHRSKESPVVAILADLFDTFDRRCEKNGARIVCCLPALCAWLVSHLFQQDTRHPCPLQSYRSCAEKGRVDWDQHLAGIGGNTINWFPRWKEGKEGVLFSRARSQGYTKSSHARKDKELRGIRNGVIGGYHGWLRVHTR

SEQ ID NO: 121872 - protein, 74 aa, Glycine max
  Coding DNA Sequence Number=SeqID_30187
MASKEWKAPSIPTQVRFDRSRFTSQEAWEGYTDIVVPRKILPERNVIIHRTKFDEFTEELEHRNWHKELTNFMD

SEQ ID NO: 121873 - protein, 89 aa, Glycine max
  Coding DNA Sequence Number=SeqID_30188
MFGGDSTHFPPMEDAPVSPRVALPLKGEVIGLSAKVRAGRVLQLSLSGPKPCLVNKMIVECNSGPCLACSSRLALFQIEKELGLARAFT

SEQ ID NO: 121874 - protein, 81 aa, Glycine max
  Coding DNA Sequence Number=SeqID_30189
MDLFRSWRGSVIMPIGWTCGADIEEEEPTDLRSNPLQGGGDDAILPRKGPVTRAMSKRLQEDWARVDKEGLRVLMNLRVDF

SEQ ID NO: 121875 - protein, 113 aa, Glycine max
  Coding DNA Sequence Number=SeqID_30190
MTISLCVLLAFSSYRQQKVYTDNHSDSKKFIRITISGISARQRDSKVSMTDLVSAEDDVKSPRVNGLIGRDRRRAQKTTLVSACYQAFRLTDNKKFIRITTRIFRPSVTQKSV

SEQ ID NO: 121876 - protein, 105 aa, Glycine max
  Coding DNA Sequence Number=SeqID_30191
MRLPGKESLLMKSPITLTEILDVSISFLNDHLEETLGSTIEENHSKCINLAQGKDWHSHPGSRFMVSQDFGSKLVEWVDMIHVRIWFGSRIKGMPHIISMTQMQK

SEQ ID NO: 121877 - protein, 100 aa, Glycine max
  Coding DNA Sequence Number=SeqID_30192
  Pfam annotation: Domain name=zf-CCHC; Domain location=25-42; Score =31.2; E_value=3.8e-06; Accession=PF00098.14; Description=Zinc knuckle
MAAQEIERRQNFNNGRRSQEDSQVLRCYKCNQLGHIKANCPSNEEWLEKSDKKRYDERRTNKAYIAWDDNDSSDGSEKEINLLTKDYENYESDENISQED

SEQ ID NO: 121878 - protein, 65 aa, Glycine max
  Coding DNA Sequence Number=SeqID_30193
MMTKVMNKKIKDQKTSQVNQEQVKSSRIKKNSRLKKKAYNQDSRFKISRIKIKIQDSRFKNEENT

SEQ ID NO: 121879 - protein, 178 aa, Glycine max
  Coding DNA Sequence Number=SeqID_30194
  Homolog annotation: Hit_ID=A6FJQ2; Match level="QueryCoverage=21%, HitCoverage=84%, E-value=4e-11, Identity=92%"; Hit description=50S ribosomal protein L5
MRKEKIPHQAPFAIQAAQLLGRAIGAGLFAITPAGERGMCCKAIKLEHPSRVHAAEADVTIKQYFGPAPRTSCTSLSMAPKDLEQLTQKIRDQLEESITEKGLALPLELEVGPSAARVSTKESYIDPSRNDPDTGDSEKCGLYVEENPPCPVAIGRLYEGLTTVHNIPFHHDQVKVGV

SEQ ID NO: 121880 - protein, 163 aa, Glycine max
  Coding DNA Sequence Number=SeqID_30195
MTAGPNYLINRSKIGCISEIAIEGDKEKDLPLEVILPHSSNSNIKKKNRVNVPFGQYDLKVASEEVGQRISGPTYSATKVYVRRKEVLRSNGKAQQFKEPAVDSNSVSKTDSMPSIQQDPIELQCALLKEMGLTYGEDANKVKGLILDMENRDDMMAAERGIK

SEQ ID NO: 121881 - protein, 64 aa, Glycine max
  Coding DNA Sequence Number=SeqID_30196
MLWNFTNCALTLPFNSRHVAKLHGLPNDGCQVPRSGQAKVASHQTDGPRTKLGYDKKENHFATK

SEQ ID NO: 121882 - protein, 136 aa, Glycine max
  Coding DNA Sequence Number=SeqID_30197
  Gene Ontology: Mol. function=transporter activity; Cellular component= membrane; Biological process=transport
  Homolog annotation: Hit_ID=Q8CZH8; Match level="QueryCoverage=100%, HitCoverage=34%, E-value=2e-52, Identity=80%"; Hit description=Inner membrane permease of D-xylose ABC transporter
  Pfam annotation: Domain name=BPD_transp_2; Domain location=1-126; Score=-44.3; E_value=0.0096; Accession=PF02653.7; Description =Branched-chain amino acid transport system  permease component
MATRTAFGRRIYAIGGNIDAARLSGINVARTKLAVFAINGVMVAIAGLILSSRLGAGSPSAGNIAELDAIAACVIGGTSLAGGVGSVAGAVMGAFIMASLDNGMSMMDVPTFWQYIVKGAILLLAVWMDTATRRRV

SEQ ID NO: 121883 - protein, 134 aa, Glycine max
  Coding DNA Sequence Number=SeqID_30198
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPSRLEGGGHMNSARK

SEQ ID NO: 121884 - protein, 153 aa, Glycine max
  Coding DNA Sequence Number=SeqID_30199
MPISPCGSISWSVPSRHRGRAHKTPSGPGEDQQGPGVSNFGYGPLSVLQGARTPRQGIAPAGHPVDPKKSNRVLGFPALITDLYQFYGVPVTPNKVIRPPTNRAFIKRYCASQSGARQNTTTAWGWPTTGNKCTVATFRVHLSSSTKRLECCL

SEQ ID NO: 121885 - protein, 121 aa, Glycine max
  Coding DNA Sequence Number=SeqID_30200
MKKEKRSSHNSCKSLSEELRDYYEGRHRSHLRPHSNRREHERKPQEANINLPYFHGKDNVEAYLDWEIRVEQKLKRKSTLKSYGSHSYPKKDQGLGILGAAPSKPKDDKGKTIEKQPPKAT

SEQ ID NO: 121886 - protein, 100 aa, Glycine max
  Coding DNA Sequence Number=SeqID_30201
  Gene Ontology: Cellular component=mitochondrion
  Homolog annotation: Hit_ID=A6H5B3; Match level="QueryCoverage=70%, HitCoverage=94%, E-value=8e-26, Identity=78%"; Hit description =Putative ribosomal protein S3
MDVDKILPSSSTLGWHSLKVKGEVQTKKGLWWIPRHPETRKGVRSSRECCTLDGESPVAESITSLRSDPSSMGHVESRVNQQGPPCKAKYSWVTDSEVVP

SEQ ID NO: 121887 - protein, 30 aa, Glycine max
  Coding DNA Sequence Number=SeqID_30202
MGILVYDYLVDTAASVQTRESINEFLTSVK

SEQ ID NO: 121888 - protein, 159 aa, Glycine max
  Coding DNA Sequence Number=SeqID_30203
MWAFHKGLQIDWAHLVRYRMHKALRLNAPLPYPHLVTLFLQHFNIPFDSEPYVPIKRSFLIGASVIASFGYQKEHDDSWVKKGAHVDEEGHGGEDSSLLQKILDRFDGLQTFVGERFDTLELQKDMCFNEMESRITKVEEDVSYIRSSFDLPPPLPPSS

SEQ ID NO: 121889 - protein, 120 aa, Glycine max
  Coding DNA Sequence Number=SeqID_30204
  Homolog annotation: Hit_ID=P03851; Match level="QueryCoverage=70%, HitCoverage=100%, E-value=4e-44, Identity=98%"; Hit description =Uncharacterized 9.4 kDa protein
  Subcellular localization annotation: CTP_CleavageSite=30; ConfidenceScore=5.21e-01
VDSRGSPLAALGRSAAASGISSLKGGNTVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 121890 - protein, 84 aa, Glycine max
  Coding DNA Sequence Number=SeqID_30205
MVPNAWLTKKRCFFGHLNFIMTFAMHSLRKSTLYDTLTEALKEKMATMMEAMMSIKEIMEVNAAAIAATSTIAEVDLTPPYGLN

SEQ ID NO: 121891 - protein, 128 aa, Glycine max
  Coding DNA Sequence Number=SeqID_30206
  Homolog annotation: Hit_ID=B0HC01; Match level="QueryCoverage=25%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPAQMTVRASLARFEVEGIL

SEQ ID NO: 121892 - protein, 176 aa, Glycine max
  Coding DNA Sequence Number=SeqID_30207
  Gene Ontology: Cellular component=mitochondrion
  Homolog annotation: Hit_ID=Q5M9X8; Match level="QueryCoverage=34%, HitCoverage=36%, E-value=6e-24, Identity=90%"; Hit description =Putative uncharacterized protein orf166a
MGLTLYLGMKRGKIACHKSEARFVTLLREGRLASRASRDEAFWRSQVNFGPPNPATDEKAYGVPRGRAIRRKRRPGSGFPTGRGTGDGHLEAHHDLQARPARPGKATRLGVRGSIVPAAPRTSSSSFLKAGGRDLLSATEKNGAYLTRHNLTMHPIPMRLPHGPCESAPTLPRELF

SEQ ID NO: 121893 - protein, 392 aa, Glycine max
  Coding DNA Sequence Number=SeqID_30208
  Gene Ontology: Mol. function=2-methylcitrate dehydratase activity; Cellular component=mitochondrial outer membrane; Biological process =propionate catabolic process, 2-methylcitrate cycle
  Homolog annotation: Hit_ID=UPI0000E88024; Match level="QueryCoverage =99%, HitCoverage=79%, E-value=1e-171, Identity=74%"; Hit description= 2-methylcitrate dehydratase
  Pfam annotation: Domain name=MmgE_PrpD; Domain location=1-384; Score =487.0; E_value=2.3e-143; Accession=PF03972.5; Description=MmgEPrpD family
MIRWLDFNDTWLAAEWGHPSDNLGGILASADYMSRKNVAEGKAPLTMKDVLTAMIKAHEIQGVLALENSFNRVGLDHVILVKIASTAVVTKLLGGNKQDIINAVSNAFVDGQSLRTYRHSPNTGSRKSWAAGDATSRAVRLAWMTLQGEMGYPSALTAKTWGFYDVLFKGNAFKFQRPYGSYVMEQVLFKISFPAEFHAQTAVECAFQLNKEVGNRLQSMDDIANIDKIIITTHESAIRIIDKSGPMNNPADRDHCIQYMAAVGLLKGNLTALDYEDEAAADPRIDALREKMTCVEKAEYTRDYMDPEKRSIANAIQIFFKDGTQSSNIAVEYPIGHRRRRGEGIPELVKKFKVNLARRFDTAKQADILDLCQNQARLEATSVNQFVDMLMV

SEQ ID NO: 121894 - protein, 95 aa, Glycine max
  Coding DNA Sequence Number=SeqID_30209
MASNIINSRDNGGTTLEISSIKIKMITKDDDKGDDKKLKGQLKNEFKIFKIESRTLQDSRGKLISRIKIQEIKISRIKIQEIKIQDSRFKNQEKA

SEQ ID NO: 121895 - protein, 167 aa, Glycine max
  Coding DNA Sequence Number=SeqID_30210
STLEDPPSKLRYDFEISNGENVQNLVVNMILKFHDDPTVNEFEIVVFLRQMLQNAATARTLEQETKRARKEEYGREKFRGALWGSNNELKLRREERDRSRVHDMILKEELVAYARSKRSLAQHLEATEQSMLAIIGQYKEELNQSVAHEQKLVEDFAQVYAEKKQEG

SEQ ID NO: 121896 - protein, 99 aa, Glycine max
  Coding DNA Sequence Number=SeqID_30211
VDSRGSPDPAQSVKDITDLCVQYFRAGCPGHFMQVRSATFIIRVIKHSGICSGDSKILQVASRFQDVKTSHDVKTSHVTSAFCSPCLHALAAASSISYS

SEQ ID NO: 121897 - protein, 148 aa, Glycine max
  Coding DNA Sequence Number=SeqID_30212
MALKKLSTKRSRRDATGEGSSAAPEFDSHCFWSAEHQHRFEAIRGWSFHRERRVQLREDEYTDFQEEIARRRWTLLVTPMAKFDPEIWIPFDADALSQFLGDPLVLEEGQQCEFSQRRNRADGFDEEAIAQLLCILGQDFARTAVERR

SEQ ID NO: 121898 - protein, 119 aa, Glycine max
  Coding DNA Sequence Number=SeqID_30213
MKAQVEKDEGPEAETLSRQLIVAEGQTNLKAQTYQGNPCGVYPDLSSFTGSGVYPDLSSFTGSGVYPDLSSFTGSGVIQTFVACIKRSAPTQSKSARKHDRPRSKKEASQDDADRTFPN

SEQ ID NO: 121899 - protein, 166 aa, Glycine max
  Coding DNA Sequence Number=SeqID_30214
  Subcellular localization annotation: CTP_CleavageSite=36; ConfidenceScore=5.11e-01
MSISPCGSISWSVSSRHRDRGHKTPSGPGGAQQGPRVSSSGYGPLDHARKTLSGPGEVQQGPGVSSSDYGPLSSGPYQPSFHQEVLCPQVGAGRDTTAARGWPTAGNRRIAATSRAPQLIYKGWSVAYDPLPTSGRPSPKPKISKSTRSVTDKSSRVQLMTLKKRS

SEQ ID NO: 121900 - protein, 152 aa, Glycine max
  Coding DNA Sequence Number=SeqID_30215
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q2PMN8; Match level="QueryCoverage=94%, HitCoverage=36%, E-value=3e-74, Identity=93%"; Hit description =NAD(P)H-quinone oxidoreductase chain H, chloroplast (EC 1.6.5.-) (NAD(P)H dehydrogenase, chain H)
MGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATELLNIKTYYAKSDFLDG

SEQ ID NO: 121901 - protein, 157 aa, Glycine max
  Coding DNA Sequence Number=SeqID_30216
  Homolog annotation: Hit_ID=A2Q4S5; Match level="QueryCoverage=52%, HitCoverage=12%, E-value=2e-07, Identity=35%"; Hit description=IMP dehydrogenase/GMP reductase, putative
MTLLQIYEHFPSVHQCVTDDTYQETSLRASRWLTSKAHMKGITGAPYRARCDALTVTDVSWLPYTEHRGVRAFELISSFQGQLRWGTMVVISIRSLSVTITIGRRLFLKNRPRNRSKAHTILLTRLASRYANPAENVIAVGVTPTKSSSESLYLFVL

SEQ ID NO: 121902 - protein, 82 aa, Glycine max
  Coding DNA Sequence Number=SeqID_30217
  Gene Ontology: Biological process=transposition, DNA-mediated
  Homolog annotation: Hit_ID=Q1J7G7; Match level="QueryCoverage=36%, HitCoverage=42%, E-value=2e-10, Identity=100%"; Hit description =Transposase
DLLRADQRLIFAKSGPGLPVSQGHQDLFILRSDLPSQWLLFLSAVPPVQLLTGWCVTAKAPPDISAGKCSGHAARNHHTRRA

SEQ ID NO: 121903 - protein, 244 aa, Glycine max
  Coding DNA Sequence Number=SeqID_30218
  Gene Ontology: Mol. function=motor activity; Cellular component=cell projection
  Homolog annotation: Hit_ID=UPI00016621D1; Match level="QueryCoverage =80%, HitCoverage=41%, E-value=1e-13, Identity=29%"; Hit description =UPI00016621D1 related cluster
MSRSLASHKGGPWVLVPIAFRGMHALAFRKLHALTFKGLCILAIKGLHPFAFRGLHALAFRGLHVLASRGLHILAFRGLDVIAFTKLHVIAFRGLHAFAFRGPHVLAPRGLHVLAFRGLHALAFIGLHVLTFRGLHALASRGLHVLAFRGLHVLTFRGLHTLAFRGPHVLASRGLHILASKGLHVLAFKGLHVLAFRGLHVLAFRGLHVLAFRGLHVLALRRLHVLAFRGLHALAFTVATRPRF

SEQ ID NO: 121904 - protein, 31 aa, Glycine max
  Coding DNA Sequence Number=SeqID_30219
MKHGSKLEGGGHMNSASSKLEGGGHMNSARQ

SEQ ID NO: 121905 - protein, 108 aa, Glycine max
  Coding DNA Sequence Number=SeqID_30220
  Gene Ontology: Mol. function=peptidyl-prolyl cis-trans isomerase activity; Cellular component=intracellular; Biological process =response to stress
  Homolog annotation: Hit_ID=A7NUA8; Match level="QueryCoverage=100%, HitCoverage=15%, E-value=1e-27, Identity=58%"; Hit description =Chromosome chr18 scaffold_1, whole genome shotgun sequence
EKAPWELNSKEKIEVAGRMKEEGNVLFKVGNYQRAGKKYEKIPLVHDFCQIHDTLFSRGAADFVDEGGSFGFDEQKQAQTLKVSCWLNSAACSLKLNDFPGAIKLCSQ

SEQ ID NO: 121906 - protein, 109 aa, Glycine max
  Coding DNA Sequence Number=SeqID_30221
MARDKLQSSAVCDLKLKLISDRQLDGRLYNLPNTAEVAALIIGDEHTVDGYTMIESEKLNYVREHQQELRVYKYMNLNAYNNDPETHGNEKEKRIILSSSFVGSHRYME

SEQ ID NO: 121907 - protein, 143 aa, Glycine max
  Coding DNA Sequence Number=SeqID_30222
MAAQLIHDRVEMECLEGVWETLEGNARCRFCGTIRLTTTSLVHPEEPARTLQRTVEWILPTPNPYRLVEPVQVIEVLSSEEDPEEDLEELPPEPVVDALDFPEGDEDPLPDVDSLEDVMSASKADSTEESGPRGIVTSGDSSS

SEQ ID NO: 121908 - protein, 21 aa, Glycine max
  Coding DNA Sequence Number=SeqID_30223
HSSSPSPPSSYPWPPMVVSFF

SEQ ID NO: 121909 - protein, 123 aa, Glycine max
  Coding DNA Sequence Number=SeqID_30224
MEVKQNFAQVQKNACVWLAVESLVQNEFWMFARKLGRIDGDPVLRETKIWATWEYVSSVGGGQQGMVGLCALCGCGKTCCAPSPDRHLSGTWRYAAGVRRPWGRQVGWGCPKPSLTNPDPTRA

SEQ ID NO: 121910 - protein, 96 aa, Glycine max
  Coding DNA Sequence Number=SeqID_30225
MIRGDTLRLSAPFCHPEAAGPMTSRDQVWSFCTLVSSRGGGPDDTRKYHEVIRINTLLSIYLSLVLVRCLAPIVRQFVKIRERQVMSPATLVNREE

SEQ ID NO: 121911 - protein, 157 aa, Glycine max
  Coding DNA Sequence Number=SeqID_30226
  Gene Ontology: Mol. function=helicase activity; Biological process =viral genome replication
  Homolog annotation: Hit_ID=Q8RV60; Match level="QueryCoverage=77%, HitCoverage=13%, E-value=2e-14, Identity=33%"; Hit description =Putative uncharacterized protein At2g05640
MIFDDYDEQSFLSASFAYQNTGGAYIDIGDPVWECPHCKVMMWYDERINKDKQTQKPSMHDMLDEQIIIAIKDMLDHHNHYAQKFMMARDKLQSATLPDLKIKLISQRQTYGRLYNLPTTIEVAALIVGDEHSADKRDIIIEKQSGLLKRIHELHPA

SEQ ID NO: 121912 - protein, 72 aa, Glycine max
  Coding DNA Sequence Number=SeqID_30227
  Homolog annotation: Hit_ID=A5ATZ8; Match level="QueryCoverage=81%, HitCoverage=9%, E-value=4e-08, Identity=45%"; Hit description =Putative uncharacterized protein
MRDITPLLEMEMELGRWKTKVENQTGLKVKSLKSDNGEEYDSQEFKDSCSEHGIRTIKTYQKHPSKTVLQKG

SEQ ID NO: 121913 - protein, 46 aa, Glycine max
  Coding DNA Sequence Number=SeqID_30228
MTENKRGYISYGSVLVEGTSTRLFKENKGGHIPCGSLLAQVVAEPV

SEQ ID NO: 121914 - protein, 83 aa, Glycine max
  Coding DNA Sequence Number=SeqID_30229
  Homolog annotation: Hit_ID=A6FJQ2; Match level="QueryCoverage=45%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARGVMARWNDRAIADALQALAQAIGNPNRVPSSNS

SEQ ID NO: 121915 - protein, 144 aa, Glycine max
  Coding DNA Sequence Number=SeqID_30230
MMIWKQHAKLVMATARWALKHPIYGIVILRLGVYTNRPNHFVSKRPYRGNTGSNKDRRKSLKVYQSHTVRGEKVAQDFVGNQRERTTLGRGQGLTFSPWVKVYDKLGFWLKACRMGGHDICQGLASGSRIKGMSYIISMIHMQQ

SEQ ID NO: 121916 - protein, 74 aa, Glycine max
  Coding DNA Sequence Number=SeqID_30231
MAERDGVGLNKPQFTTGMSMSFGSIPVLAGCINESANARGEAVCVLGALPLPRSLTRCARSFGCGERYQLTQRR

SEQ ID NO: 121917 - protein, 65 aa, Glycine max
  Coding DNA Sequence Number=SeqID_30232
PGLRAQWIPFDADAIGQLVGYPLVLEEGFCPDCCQETGADHAHQHDHPDSDLDDFAAQQHLAQRP

SEQ ID NO: 121918 - protein, 113 aa, Glycine max
  Coding DNA Sequence Number=SeqID_30233
MSKSCGFGMTSPLDESISCFLIRVDPWVLVPIAFRGLHVLAFRGLHVLTLRGLHVLANRGLHDLTFRGLHVLALRGLHVLTIRGLHALTSRGLHVLALRGLHALTLGTSYPHL

SEQ ID NO: 121919 - protein, 185 aa, Glycine max
  Coding DNA Sequence Number=SeqID_30234
  Gene Ontology: Mol. function=calcium ion binding
  Homolog annotation: Hit_ID=UPI00006A2D9E; Match level="QueryCoverage =98%, HitCoverage=80%, E-value=5e-11, Identity=14%"; Hit description =UPI00006A2D9E related cluster
GLHALAFRGLDVLSFRGLHALALRGQLILAFSGLHTLAFRGLLVLAFRVLHALAFGGLHVLTFIGLHVLAFRGLHVLAFRGLHAIAFKGLHVLAFKGLHVLAFRGLHVLAFRGLHALAFRGLDVLSFRGLHALDFRGLDVLAFRGLHKPRCFRNASVSDSVEILHHSSSFFIVLHSFFVVLHSST

SEQ ID NO: 121920 - protein, 290 aa, Glycine max
  Coding DNA Sequence Number=SeqID_30235
  Gene Ontology: Cellular component=plasma membrane
  Homolog annotation: Hit_ID=A8XZZ5; Match level="QueryCoverage=63%, HitCoverage=61%, E-value=7e-21, Identity=27%"; Hit description =Putative uncharacterized protein
MPPPLEDYTSSPAEDYTSLPLEGCVPSPSEDYIGLNALAFRGIHAHTFKGLHALVFRGLHALSVRGLHVLTFRGLHILAFRGLRIPTVRGLHVLALIGLHVSPSEGHTPSTLEDYPSSPSEDYMTTHPHLKRAARPRHQRTTRPRLHRATRPRHQRTTCSRLQRATRPRINRTTHPHSQGTKRPHLQREARPRLKWATCPRLQRTTRPHLQRSKRPCLLRVAYPHLQKTTRPRLQRDTRLHLQKAGHPHLHRTTCPHLQRNTHPRLQRVAYPHLQRTTRARLKRTTCPRF

SEQ ID NO: 121921 - protein, 133 aa, Glycine max
  Coding DNA Sequence Number=SeqID_30236
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=O48653; Match level="QueryCoverage=56%, HitCoverage=8%, E-value=4e-11, Identity=34%"; Hit description=DNA polymerase alpha catalytic subunit
MLENLQVPPSTTESAPVLKRYAPPNQRKSCMIFADFFKKLQDAVSDVKNEIAQHLVNLEVSNFSMAPVKVSWCKFEVTVDSPKQIIVWRRPERLTRFTIVRKLDGIIFPMGFSKEVTDRNLQAGSNILCAESR

SEQ ID NO: 121922 - protein, 240 aa, Glycine max
  Coding DNA Sequence Number=SeqID_30237
  Gene Ontology: Biological process=transposition, DNA-mediated
  Homolog annotation: Hit_ID=Q1J7G7; Match level="QueryCoverage=13%, HitCoverage=47%, E-value=2e-11, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSELRQENRLNLGGGGCSEPRSRHCNPAWATDQAYRYRRPRGGARYQLLFPLVRVNFEIGVIMVIAVSFGKPVVPAALMNRPTRGERRFAYWALAECILAYYVGTDEGVSEVLHVAGEKRLH

SEQ ID NO: 121923 - protein, 203 aa, Glycine max
  Coding DNA Sequence Number=SeqID_30238
GSRPQDTQWTRRSPTGPWGFQLWLRASVSPIGCSSPPARSCHRDVGKDRAHKTPSGPEGVQQGPGVSTSGIAPARHLVDPEKSNRVLGFPALITGLFQFYGVPVAPNKVIRPPNNRAFIKKYCAPQASAGRDTTVAWGWPAAGNRRTASTFKAPQLIYKGWSFAYDPWPTSRQPSPKPKVSKSTRSVTDKSSRVQLKTLKKRY

SEQ ID NO: 121924 - protein, 225 aa, Glycine max
  Coding DNA Sequence Number=SeqID_30239
  Gene Ontology: Mol. function=motor activity; Cellular component=cell projection
  Homolog annotation: Hit_ID=UPI00016621D1; Match level="QueryCoverage =76%, HitCoverage=41%, E-value=3e-14, Identity=35%"; Hit description =UPI00016621D1 related cluster
GYTPLPSEGYTSSPSKGLHHFAFRGLHDLAFRGLHVLAFRGLHAITFRGLHVLAFRGLHALTFQRLHVLAFRGLHVLAFRGLHVLAFRGLHVLAFRGLHVLAFRGLHVLAFRGQRALAFRGLHILTFRGLHALTFRGLHVLTFRGLPAFTFIGLHALAFRGLHVLPFRGLHVSPSEGYMPSPSEDYMSSPSEGCTLSPSEEYKTSPSEAYTSSSTEGWTPSPLEE

SEQ ID NO: 121925 - protein, 51 aa, Glycine max
  Coding DNA Sequence Number=SeqID_30240
MMKMKSAGLQPSQVSPVLPVGRDVPRDGRLLSPCRWGIRSRVVACVLWPVL

SEQ ID NO: 121926 - protein, 360 aa, Glycine max
  Coding DNA Sequence Number=SeqID_30241
MGNPVEQPNSPQEQPAVEVQQNVSVEEIPSHARTSPAPETDAVNVEEQGEGQGIGPSSPHGSSQKSSSEENFFDEEGIEEAEAGGSDIYPASSTSKLSASIGIAEDTFIQMQDKDPAAALRLLLNTSQANTSSEKNPGASSSSDAEINSSVRQDCLLLKLSMEYAREDVLKSIEENPSAAFGHLNFLKKLHNPLTSDEILGKVIQIESIIDQFASTVQKKRENGARLDAQKQAHILLLEKARAAQHEVERLTKEAKEGSFEVKACDDNISSWEATITDLLSQVDDLRQKIVTEQAKRQELQEKAANSIQKLVAEKGREGLKAFSASQAVADEARVMESADQVLSKEMATLKKLYEDLVMH

SEQ ID NO: 121927 - protein, 183 aa, Glycine max
  Coding DNA Sequence Number=SeqID_30242
  Gene Ontology: Mol. function=structural constituent of ribosome; Cellular component=mitochondrion; Biological process=translation
  Homolog annotation: Hit_ID=Q9ZZU0; Match level="QueryCoverage=84%, HitCoverage=98%, E-value=2e-74, Identity=80%"; Hit description =Ribosomal protein L5
  Pfam annotation: Domain name=Ribosomal_L5; Domain location=49-107; Score=4.9; E_value=0.0079; Accession=PF00281.10; Description =Ribosomal protein L5
MDEIACKLRRDAPYDIFGLFPMLSVGQQPSTSHFHVSRQDPLLKLNHANVMEVPGSCEIRVVPKAPYDFIIKNGKLAMEIPRDKGYVSDLARQSTLRGHGMSNFSVRISTVMSLLDSPVEIRENSIQFSMETEFCEFSPELEDHFEIFEHIRGFNVTIVTSANTQDETLPPWSGFLQKDEGET

SEQ ID NO: 121928 - protein, 55 aa, Glycine max
  Coding DNA Sequence Number=SeqID_30243
MVEPSKDGNPFKLKVRNETLEQNGMEIMEQNKVDEKVMHLAEEHKAQILYSSFYQ

SEQ ID NO: 121929 - protein, 305 aa, Glycine max
  Coding DNA Sequence Number=SeqID_30244
  Homolog annotation: Hit_ID=Q6WAY6; Match level="QueryCoverage=34%, HitCoverage=18%, E-value=3e-12, Identity=35%"; Hit description =Putative uncharacterized protein
MDWDQLLVGIGGRTISWFPRWKEGKEGVLFSCGRYPNIPLVGTRGCINYNPTLAIRQLGYPMRGAPTEESMSPFLVRDLGAQNSKTIQRIHKAWETPLRKDQELRGVRNGIIGGRQRREFEAPEEDEEVQALKSELGKAKLAKEKSSWLLHTFGRSVPGYGKRMQLPQEPLNERPRGLARKSMAGTNFVEPYGELVACSRSKRSLSQRLCETETNMLAIIAKYQEELGLAMAHEHRIADEYAQVYAEKEARGRVIDSLHQEATMWMDRFALTLNGSQELPRLLAKAKAMADTYSAPEEIHGLLGY

SEQ ID NO: 121930 - protein, 87 aa, Glycine max
  Coding DNA Sequence Number=SeqID_30245
  Homolog annotation: Hit_ID=A5BNA8; Match level="QueryCoverage=83%, HitCoverage=6%, E-value=4e-10, Identity=40%"; Hit description =Putative uncharacterized protein
MEERKIMEKLPEEEKKFGHVEKNCCNKNRHQANIAEEHDQEQCMFYATQDSIKEKGGSWYLDSGCSNHKAKDETIFKSIEESVKVKV

SEQ ID NO: 121931 - protein, 88 aa, Glycine max
  Coding DNA Sequence Number=SeqID_30246
YQAFIKKYCVSRQRRANTQQHWDGRQRATDAPPSPLEFTSAHPQKGLSIAYTTWPSNRRPSPKPKESKVSMLEVFPDARNGTRMNAQI

SEQ ID NO: 121932 - protein, 203 aa, Glycine max
  Coding DNA Sequence Number=SeqID_30247
MTGRLLPGSLTFDNRIMHYIIVRILLPRSSNLAQASEEDLILMWAFLTGRQIDWAHLVRYRMHKALRANAPLPYPHLITLFLRHFQILLDDEPFVQVKRSFAIGAGVVTSFGYRKDRNGQWLKKDALPPQDERTPSPPPQREDSALLNEVLTELRCLRSYVGERFDSLDTRFAGMDIRLTQVEEDVSFIRTCFDPPTPTPSSS

SEQ ID NO: 121933 - protein, 96 aa, Glycine max
  Coding DNA Sequence Number=SeqID_30248
MERKEKNENKEKNRRKERRIPDQGSERSEKGKKSNSRSMKDRGQKFFKPDCHSKSFSTGNIPPHMNKEEKTETPNFLSKNTTLEKILLVRDRTFDL

SEQ ID NO: 121934 - protein, 119 aa, Glycine max
  Coding DNA Sequence Number=SeqID_30249
DAGSRQARQGASAGVGGCRGWLNYAASEQIVLRVHHMRAIGAGLFAITPAGERGMCCKAIKLGNARVFPVTTLNIPSTTLLTEIFYLLNQGTNINMPCMPKGPSDSLSMLVQTPRALTF

SEQ ID NO: 121935 - protein, 104 aa, Glycine max
  Coding DNA Sequence Number=SeqID_30250
MDTFVIFVPHPLVNYIFALWKHSFMMNLRLIQRCFDDNKGDDKKLKMFKIESRTLQGSRGNLISRIKIQGSSFQESRSRFKTQDSRIKRRLNQDKYEKVFAKTE

SEQ ID NO: 121936 - protein, 76 aa, Glycine max
  Coding DNA Sequence Number=SeqID_30251
MVELMNLDVVSLMMNNSHMKSIIWGTSLETILMQVDFSDFSMDNNTTNNKDNEGTILGINSIETRGVIHKAATTRA

SEQ ID NO: 121937 - protein, 134 aa, Glycine max
  Coding DNA Sequence Number=SeqID_30252
  Gene Ontology: Mol. function=helicase activity; Biological process =viral genome replication
  Homolog annotation: Hit_ID=Q2A9I1; Match level="QueryCoverage=93%, HitCoverage=8%, E-value=4e-20, Identity=42%"; Hit description =Putative uncharacterized protein
MGFLQDDKEFIEAIKEAKDWGSTHYIRKLFVLLLLTATMNKPEQVWAQTRHWMADDIVYNYKKSSTSPALQLDDMTLQNLVLLEIEQLLQANQRSLTDYPSMSYPEDVNFPTYLDNSLILAELNYNNQELRSES

SEQ ID NO: 121938 - protein, 126 aa, Glycine max
  Coding DNA Sequence Number=SeqID_30253
  Gene Ontology: Cellular component=integral to membrane
  Homolog annotation: Hit_ID=O80668; Match level="QueryCoverage=88%, HitCoverage=20%, E-value=3e-48, Identity=79%"; Hit description =Expressed protein
MTMITNSSSVPLTSLFPGTSLDLGGFKLDSMHMFGVLTALIILPTVWLKDLRIISYLSGGGVVATILIMICVFCVGTIDSVGFHHTGQLVKWNGIPFAIGVYGFCFAGHSVFPNIYQSMADKKGIL

SEQ ID NO: 121939 - protein, 148 aa, Glycine max
  Coding DNA Sequence Number=SeqID_30254
MGEAEEVQEKMKADMEAMKEQMATMMETMMSMKKIMEANAVIVAATSAVAKVNPMLPSGLKQMNHPTSNMVGKDLGSTNDPMMCKFKTSTLSHHMACLPTIHHPMWHTLSMKISITPLPYSLRANNPKLIMHMSLKPWKRHMNFHTTI

SEQ ID NO: 121940 - protein, 442 aa, Glycine max
  Coding DNA Sequence Number=SeqID_30255
  Gene Ontology: Mol. function=S-adenosylmethionine-dependent methyltransferase activity; Cellular component=nucleus; Biological process=rRNA processing
  Homolog annotation: Hit_ID=A4WBJ4; Match level="QueryCoverage=99%, HitCoverage=96%, E-value=0.0, Identity=81%"; Hit description =Ribosomal RNA small subunit methyltransferase F (EC 2.1.1.-) (rRNA (cytosine-C(5)-)-methyltransferase rsmF)
  Pfam annotation: Domain name=Nol1_Nop2_Fmu; Domain location=176-439; Score=198.4; E_value=1.7e-56; Accession=PF01189.8; Description =NOL1NOP2sun family
MREALPSHLSLDDFIAACQRPLRRSIRVNTLKISVNDFLTLVAPYRWQLTPVPWCAEGFWIERDDEDDVPLGSTAEHLSGLFYIQEASSMLPVAALFAEGNAPERVMDVAAAPGSKTTQIAARMGNQGAILANEFSASRVKVLHANISRCGIHNVALTHFDGRVFGAALPEAFDAILLDAPCSGEGVVRKDPDALKNWSVESNLEIAATQRELIDSAFHALRPGGTLVYSTCTLNRDENEDVSGEAVTPEGFLHVFPQIYDCEGFFVARLRKTQAVAPLPAPKFKVGTFPFAPLKGRDAAQLIAAASQVGLVWDESLHLWQRDKEVWLFPANIEPLIGKVRFSRIGIRLAEVHNKGYRWQHEAIIALAGGENTFALTHQEAEEWYRGRDVYPASTPAGDEAIVTYQGYPLGLAKKVGSRLKNSYPRELVRDGRLFTGNDRTD

SEQ ID NO: 121941 - protein, 142 aa, Glycine max
  Coding DNA Sequence Number=SeqID_30256
  Homolog annotation: Hit_ID=A6FJQ2; Match level="QueryCoverage=26%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLLQDVQFVVELMNLEVVSLMKSKLNMKLIIWGICQRQFQYKWISRISEQPTVSTAETVANHPGNQFNRDQGGSSTRPQLQMPSLYD

SEQ ID NO: 121942 - protein, 312 aa, Glycine max
  Coding DNA Sequence Number=SeqID_30257
  Homolog annotation: Hit_ID=A5BSR3; Match level="QueryCoverage=33%, HitCoverage=33%, E-value=7e-08, Identity=37%"; Hit description =Putative uncharacterized protein
MARTKKTREMTTEAAKEIAEKNDSFEEQATQGSFVPHGRQDVLAAAIGRPEHPRRVRGIGAGVTIKQYFGSAPRTSHSASSLPPNELHQLTQQIRDQLEESITEKVTRQVMASFSHLQSQMQSQGLAVPPEPLVGPGPFGPRVSTKGSCVDPSGNDPETGDSDRVSVEEVRDADAPIPVPTDEVSLVGQALHTFLAWPTHLVKSLSQQVVVSPPKPPPKPDPEVDDPLYLMTLTIPELFLRPYQVRWDATMFGVVNPDFPLYIKHEDLSEIAHGGQCLSISVLQLWILHLTETCMRAGNSDIYGFLEPQSIQ

SEQ ID NO: 121943 - protein, 50 aa, Glycine max
  Coding DNA Sequence Number=SeqID_30258
MTGDSSKFTHISPMKSGHVTYGDNSKGRILGVGKIAKMMIHGYGINVLLT

SEQ ID NO: 121944 - protein, 66 aa, Glycine max
  Coding DNA Sequence Number=SeqID_30259
ATHTPVSPSSIKHERKLGSEGKLLGSHIINETSKRVGLRLQKETTPENVAFHRFKQKTQMKLKAET

SEQ ID NO: 121945 - protein, 53 aa, Glycine max
  Coding DNA Sequence Number=SeqID_30260
MGPKSTLSLMRTLGPSLASLVQSTWSLLFNALAGSENPFLGHLPMKEHGSSPT

SEQ ID NO: 121946 - protein, 72 aa, Glycine max
  Coding DNA Sequence Number=SeqID_30261
  Subcellular localization annotation: CTP_CleavageSite=64; ConfidenceScore=5.42e-01
MEKRLCRGPLTSLLSIFLASSRKSPPRSKPVYTPLAPNTQTASPPRVGRFINAAGTTGFPTGKRAVSATQLM

SEQ ID NO: 121947 - protein, 86 aa, Glycine max
  Coding DNA Sequence Number=SeqID_30262
MAAQLIHDRVVMECLEGVWENLEGNERRPRGVPPELDMDALDLPEDDEDPLPDVDSPEDIMSASEADSTEESGPGGTVNSDDSSSS

SEQ ID NO: 121948 - protein, 207 aa, Glycine max
  Coding DNA Sequence Number=SeqID_30263
  Homolog annotation: Hit_ID=Q8LI60; Match level="QueryCoverage=59%, HitCoverage=19%, E-value=3e-08, Identity=28%"; Hit description =Putative uncharacterized protein OJ1634_H04.130
  Subcellular localization annotation: CTP_CleavageSite=55; ConfidenceScore=5.71e-01
MATPPASPPPPVPLPPPPADASVSLFTLKRTRKATQLRSLATRPPGAKRPMVNVDSATGKVDGPHKKKLRTYLVIVARDKVDVTYDTWKEVPTGQKDLIWKDIQAEFEIPEASDTDKDGVDDIVCEKYGISKEKWAQFCQTHRDPSWEDVRKKAQVIQKQNTAPHVLSRGGYKYLEQKLMAEKTKKRLEEAAQSGSTESIIDPPSPI

SEQ ID NO: 121949 - protein, 143 aa, Glycine max
  Coding DNA Sequence Number=SeqID_30264
  Homolog annotation: Hit_ID=Q51617; Match level="QueryCoverage=26%, HitCoverage=55%, E-value=1e-12, Identity=92%"; Hit description =Putative uncharacterized protein
MTVKTSDTCSSRRRSQLVCKRMPGADKPVRARQRVLSGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLVD

SEQ ID NO: 121950 - protein, 439 aa, Glycine max
  Coding DNA Sequence Number=SeqID_30265
  Gene Ontology: Mol. function=hydrolase activity
  Homolog annotation: Hit_ID=A9IJN9; Match level="QueryCoverage=18%, HitCoverage=25%, E-value=2e-34, Identity=81%"; Hit description =Putative uncharacterized protein
  Pfam annotation: Domain name=DUF258; Domain location=1-91; Score= -135.8; E_value=0.0001; Accession=PF03193.7; Description=Protein of unknown function, DUF258
MGKHTTTSTRLYHLPAPGGDLIDSPGFQAFGLQHMSREDIIRGFPEFTKPIESCRFYNCTHRHDPGCGVVGALDAGAIVPARLSTRLEAVAQQVIKVAQHAGRGAPDEVPAIRHAVIVTHPAVLQPRLVQTVIGRIHQERQRHFEHLGDFERVRRQLEAGRNQRHDRDDGESSGGQVRGHAAQHLDVVGRQSGFLLRLAQRRGDRRRIAGLDTAARKTDLAGMVVQVRGALGQHDVHAIVARHQRNQHGRGHRGAFAAGIAQVIVARQLERPGGRLAERAAQQVGRQQAGRHRRQGIVGDHPGLRRRVEPGTRQRPARPRRRRGIRHSAFQKEKGTLAGAFLTRKPVPNENAGWRVRPTLVGPCADKRSSRRGLLADQLFLDTRRLARAVAQVVQLGAAHVAAALDFDAGDLRRVQLERTFHGFTRRNLAHGERGVQAA

SEQ ID NO: 121951 - protein, 208 aa, Glycine max
  Coding DNA Sequence Number=SeqID_30266
PEEDEEVQALKSELGKAKLAKEKFKLAATHIRKECARLREENATTARALEQEAKRAHKEEYGRNKFRGALWCSNNELKLRREERDQSRAHSMVLKEELVACSRSKRNLSQRLCETETNMLAIIAKYQEELGLATAHEHRVAEEYAQVYAEKEAKGRVIDSLHQEATMWMDRSALTLIGSQELPRLLAKAKAMADTYSAPEEIHGLLGY

SEQ ID NO: 121952 - protein, 73 aa, Glycine max
  Coding DNA Sequence Number=SeqID_30267
  Gene Ontology: Mol. function=transcription regulator activity; Cellular component=nucleus; Biological process=regulation of transcription
  Homolog annotation: Hit_ID=A7R6Q5; Match level="QueryCoverage=98%, HitCoverage=18%, E-value=7e-19, Identity=68%"; Hit description =Chromosome undetermined scaffold_1376, whole genome shotgun sequence
MYNRRYSISSLHDIHNISEVRDSGGVVKKSGSEAAPKRPRNETPSPLPAFKVRKEKMGDRITALQQLVSPFGK

SEQ ID NO: 121953 - protein, 35 aa, Glycine max
  Coding DNA Sequence Number=SeqID_30268
MAKDNDCASKPCTGAMKAPCHDERYNWYFKVLHWA

SEQ ID NO: 121954 - protein, 82 aa, Glycine max
  Coding DNA Sequence Number=SeqID_30269
MRGTVHEPQVNIGADQKFSPIEDGPLGTSTLVSRGLYVLTFIGLHALTLGTSYPHHQRAARPHLQRTTCPRLERATRPHLGY

SEQ ID NO: 121955 - protein, 105 aa, Glycine max
  Coding DNA Sequence Number=SeqID_30270
  Homolog annotation: Hit_ID=Q2HTA0; Match level="QueryCoverage=94%, HitCoverage=15%, E-value=6e-10, Identity=40%"; Hit description=IMP dehydrogenase/GMP reductase, related
MPYGEHRPVQEFDLISCFSDQLRWGPVAVRHQPERVMRQFGYVQSIPVEDADSWVSFEEIDDRWMHYLDHLAPTGEICLVPGQCVPEYMDWFFVISHPCMTAAQQ

SEQ ID NO: 121956 - protein, 83 aa, Glycine max
  Coding DNA Sequence Number=SeqID_30271
MSQHISVIVVDSPQSIQRSGQSQFEAECYIKGWMQSSKCDVYLGAYLNGLDNYLKGIINSALKGLDDAPHPKSKAPTRWIVVK

SEQ ID NO: 121957 - protein, 149 aa, Glycine max
  Coding DNA Sequence Number=SeqID_30272
MSFLGETSSQTIVNSRLAFIFPNGSITHNQTGVYFQSPTLTLMQVPDDCSFDTLKLQLTNDQLVDEIYYRQPFIDASQQYFFQSLQLKNDDDVYRMLICNEQYSCVGPIELLCITIRTPDAILNLLQSTITPTHDAIMYYNEKWNIPRQ

SEQ ID NO: 121958 - protein, 203 aa, Glycine max
  Coding DNA Sequence Number=SeqID_30273
  Gene Ontology: Mol. function=RNA-directed DNA polymerase activity; Biological process=RNA-dependent DNA replication
  Homolog annotation: Hit_ID=Q5NRP4; Match level="QueryCoverage=48%, HitCoverage=6%, E-value=8e-09, Identity=32%"; Hit description =Putative gag-pol polyprotein, identical
  Pfam annotation: Domain name=zf-CCHC; Domain location=121-138; Score =21.5; E_value=0.00084; Accession=PF00098.14; Description=Zinc knuckle
HNSCKSLSEELRDYYEGRHRSHLRPHSHRREKGRKPQEVNIELPYFHGKDNVEANLDWEIRVEQQLKRKSTSKSYGSHSYPKKDQGQGILGVRPSKPKDDKGKTIEKQPLKASMQEKTSSMKCFKCLGRGHITSQCPTKKTMIMRGQDIYSSQDEATTSPSSNLPPRRGQPLMVKEECKETLVSIATSLRLEFIPQVKELLDE

SEQ ID NO: 121959 - protein, 104 aa, Glycine max
  Coding DNA Sequence Number=SeqID_30274
VNGDPEVDHDLLCQTQICGSNVFQGYFDDAKESRVKKIPKIQESSFKNQVSRIKIQDQDSRLKIQESREDSIKISTKKFFKTLSSTRSFHKIITKEFFSLVIDY

SEQ ID NO: 121960 - protein, 138 aa, Glycine max
  Coding DNA Sequence Number=SeqID_30275
  Gene Ontology: Mol. function=binding
  Homolog annotation: Hit_ID=Q9FKW5; Match level="QueryCoverage=92%, HitCoverage=19%, E-value=1e-44, Identity=77%"; Hit description =Genomic DNA, chromosome 5, TAC clone:K2A18
MAKSIQLADQVAKAVAEEASSFFKQECLELKSKTEKLAGLLWQVARVSSDLYEWPTRRIIADTELVLDKALSLILKCRANDLMKRVFNMIPAAAFRKMSSQLENSIVDVSWLLRVSAPADDRADIEYVTTTATASDPY

SEQ ID NO: 121961 - protein, 103 aa, Glycine max
  Coding DNA Sequence Number=SeqID_30276
MGSSKYEVEKFTGQNDFGLCLGDKVLRQVSKETTAAGVALNSKELNERKKKKSSTSGEGLTARGKTFRKDSKFDKKKQKPENQKNDEGNIFKSDAITVKRRVI

SEQ ID NO: 121962 - protein, 175 aa, Glycine max
  Coding DNA Sequence Number=SeqID_30277
  Gene Ontology: Mol. function=siderophore-iron transmembrane transporter activity; Cellular component=cell outer membrane; Biological process=siderophore transport
  Homolog annotation: Hit_ID=A1FS06; Match level="QueryCoverage=85%, HitCoverage=20%, E-value=6e-65, Identity=85%"; Hit description=TonB -dependent siderophore receptor precursor
  Pfam annotation: Domain name=Plug; Domain location=63-158; Score =74.2; E_value=4.2e-19; Accession=PF07715.6; Description=TonB -dependent Receptor Plug Domain
MPLPTPLQRALYLALTLPLAPLAHAAESSTAAPKDLDKVEVRGRAQALYRVDDAAVGTRTDTPLELVPQSIQVIPRELIDDQAARQVTDLYRSISGISYFSYAGVTLRGFRQENVLYDGLRGDPYAGFSVPQLFNIERVEVLKGPAGALYGGGDAGGVINYVTRKPKAAAERRIE

SEQ ID NO: 121963 - protein, 319 aa, Glycine max
  Coding DNA Sequence Number=SeqID_30278
  Homolog annotation: Hit_ID=A3LL40; Match level="QueryCoverage=75%, HitCoverage=77%, E-value=1e-28, Identity=36%"; Hit description =Putative uncharacterized protein
AGSIGGALPRRCERDAAGSCAPPAVGLDRAFRRAEILFGTHAGVMEGYGAGGACVDELLHQRIGIGLDFLGRALGGDTAVAQDDHMVGHMEGFLHVMGHQDGGQAHGVVEFSDQLGSGAQGNGVQPGEGLVVHDQFGVQCNGPRQRHAAGHAARYLAGHEVARTAQTHGMQLHEHDVAHQFVGKVGVLAQREGHVVEHAHVGEQGAELEQHAHAPARSVQARGVHGGDVLAIEQHLPLLGMLLAADQAQHGGLAPARCAHQGRDFAARHLQRQVAQDHTLAIAEGKPAIVQTGAAACSPPPEINIHPCMFLKKSWQKPP

SEQ ID NO: 121964 - protein, 65 aa, Glycine max
  Coding DNA Sequence Number=SeqID_30279
MAAQLIHDRVEMECLEGDWETLEGNARGTSTHALAHCGMNITYAYSISSSGANPSDRGDVIRGRP

SEQ ID NO: 121965 - protein, 71 aa, Glycine max
  Coding DNA Sequence Number=SeqID_30280
MGLADLLTKPDVSSIGACRPRRRHFKEKMSLEEAHYHRRPWIRAWRKKEMNEGRGREEHEILCSKRALKSE

SEQ ID NO: 121966 - protein, 166 aa, Glycine max
  Coding DNA Sequence Number=SeqID_30281
MNVLQCWVYLKPATLTQASVACPGELTHTSNFLFRDYASETPSGPREVQQGPGFPTLIIGLCQFNGVAVIPTKLIRPPINRAFIRKYYMPEEDQQQPIADAPPPPLGESQDPNPLPWPTPEQFEATVAWPGDETDFETRAGPAGAPGDDEGAQEDDDMADVLDFFT

SEQ ID NO: 121967 - protein, 69 aa, Glycine max
  Coding DNA Sequence Number=SeqID_30282
MPYKEMAPKKLSAKRSRRDAAAEGTSAAPEFDSHHFKSAEHQQRFEAIKGWSFHRERRVQLKDDEYTDF

SEQ ID NO: 121968 - protein, 101 aa, Glycine max
  Coding DNA Sequence Number=SeqID_30283
MGEDSWPLVRNELIKELGRWSHEYMNLFGGTERFEQLKLSLPVDGFSKCRQVDGYNGDGICDCITTIVPYRLQRCCGQAIVILKQSSGQLHILVECNNTQA

SEQ ID NO: 121969 - protein, 110 aa, Glycine max
  Coding DNA Sequence Number=SeqID_30284
MTRGNPSDLQPFDPEIDRTFHRLVRHHFIPFDHSEHSITGESMHSVIGDFEHPDLEHYNFEHSDSEHSDFAHSENMAQPPPRERTLREMAAPDFTYESLCIQYPDEDVPY

SEQ ID NO: 121970 - protein, 150 aa, Glycine max
  Coding DNA Sequence Number=SeqID_30285
  Homolog annotation: Hit_ID=A5AJ42; Match level="QueryCoverage=29%, HitCoverage=4%, E-value=5e-10, Identity=70%"; Hit description =Putative uncharacterized protein
MGRRPSQKVTEACKGFLGPDGDWPSSAKAEGSLTARPTRRAGTKVGLSDPTADLPQELTSTGKVWHLDVGFFATWGCSMFQGLGLFAHKAYERTGKDALWCASYRAHGKRWVAKASGSTAETAMGSLPQRGWSERSFENSREGHGETSRF

SEQ ID NO: 121971 - protein, 51 aa, Glycine max
  Coding DNA Sequence Number=SeqID_30286
MQSYSPRALHRRLKEDCAKDAREDPKVLMSLKVGYPRNVGFFSPCILGHLD

SEQ ID NO: 121972 - protein, 127 aa, Glycine max
  Coding DNA Sequence Number=SeqID_30287
  Homolog annotation: Hit_ID=UPI00006A2D9E; Match level="QueryCoverage =92%, HitCoverage=85%, E-value=5e-12, Identity=18%"; Hit description =UPI00006A2D9E related cluster
GGPLGTSTLAFRGLHALAFRGQHVLTYRGLHVLAIRGLHALTFRGLHVLAIRGLHALTFRELHVHTFRGLHALAFVGLHALTFRGLHALAFKGLHVLTFKGLHVLAIRGLHALTFRGLHVLAFRGLQ

SEQ ID NO: 121973 - protein, 201 aa, Glycine max
  Coding DNA Sequence Number=SeqID_30288
  Homolog annotation: Hit_ID=A6FJQ2; Match level="QueryCoverage=18%, HitCoverage=84%, E-value=5e-11, Identity=92%"; Hit description=50S ribosomal protein L5
MRKEKIPHQAPFAIQAAQLLGRAIGAGLFAITPAGERGMCCKAIKLDVPAAAADDPPLPAGSTPHGPLRLLPSLVLEAPHRRLHPLPLPASLPQNPRHVPHKHNNVEILEKQQSQQHPPPSAPPQLRVPAVALGVAEAAAPFRVVRLVGREAGHQERAQPLARALPGGTELEFVIMVIAVSCVKLLSAHNSTQHTSRKHKV

SEQ ID NO: 121974 - protein, 31 aa, Glycine max
  Coding DNA Sequence Number=SeqID_30289
PSNGSWSAVTDRDCWIKQIAMNKLNAKLKAM

SEQ ID NO: 121975 - protein, 68 aa, Glycine max
  Coding DNA Sequence Number=SeqID_30290
MVEVSTEAIASLAQYYDKPVEVLHLWWTSELSPMRSNAFLAYHDHKESPVVAMLANLYDTFDRSVTEE

SEQ ID NO: 121976 - protein, 126 aa, Glycine max
  Coding DNA Sequence Number=SeqID_30291
  Homolog annotation: Hit_ID=B0HC01; Match level="QueryCoverage=26%, HitCoverage=72%, E-value=1e-11, Identity=100%"; Hit description =Putative uncharacterized protein
GGGAYGKTPATRPFYGSWPFAGLLLTCSFLRYPLILWITVLPPLSELIPLAAAERPSAASHWHDRFPDWKAGSERNAINETAMTMITNSSSVPEFDTRFLPFYTTCAIQCTCQNRTLGAERLRLVA

SEQ ID NO: 121977 - protein, 24 aa, Glycine max
  Coding DNA Sequence Number=SeqID_30292
LSFTTANWRCLRKRFDYIFEASKS

SEQ ID NO: 121978 - protein, 85 aa, Glycine max
  Coding DNA Sequence Number=SeqID_30293
MDILSRTHLCLFNFHQNESFDLIHQLKDPSTISRPWKILFARINYFFHSSSLRGRENKTTIGTSKPYTRATKGTMQKLQANLGAD

SEQ ID NO: 121979 - protein, 26 aa, Glycine max
  Coding DNA Sequence Number=SeqID_30294
MATPMSTACYLDKDEISQSIDVKQYR

SEQ ID NO: 121980 - protein, 42 aa, Glycine max
  Coding DNA Sequence Number=SeqID_30295
MDKSLKIGEDEWRDRKRRGYKIYASNEPTNPRISPRFPTKCA

SEQ ID NO: 121981 - protein, 162 aa, Glycine max
  Coding DNA Sequence Number=SeqID_30296
MALVIDYQSCVTRVWALIAMEAQLIHDRVVMECLQGVWETLEGNERCRFRGTIRLTATSLVHPEEPERTLQQPVEWILPTPTPYRLVEPVQVIEVSSSEEDPEEDPEELPPEPVVDDLDLPEDDEDPLPDVDSPEDIMSASEADSIEESVPGGTANSEDSSS

SEQ ID NO: 121982 - protein, 92 aa, Glycine max
  Coding DNA Sequence Number=SeqID_30297
MDHAAPPTFEGQPPQPTGDARKDSRERAQRDIDSFPLLTTKGPAPNALPQPNIAVVSQPRPTQPLLFSVQRDDLPQESFEDVLPENGGILKA

SEQ ID NO: 121983 - protein, 86 aa, Glycine max
  Coding DNA Sequence Number=SeqID_30298
MNCVFIHASSTHEFGAMHSDCLVQFSILNPFSEPHELFSFMRPPTHEFGAMRSDCLEQFSILNPFSEHHELRFRSCLLHPRVWSHA

SEQ ID NO: 121984 - protein, 126 aa, Glycine max
  Coding DNA Sequence Number=SeqID_30299
  Gene Ontology: Mol. function=peptidase activity
  Homolog annotation: Hit_ID=Q8H6W2; Match level="QueryCoverage=56%, HitCoverage=76%, E-value=3e-11, Identity=43%"; Hit description=Gag -protease polyprotein-like protein
MLCGTSRGYIYLGLTENKRGYISCGLVLVEGTSTRFKENKGGYIPCGSLLVKGFLQGNSIHKPPIFNGEGYHYWKTRMQIFIEAIDLNIWEAIKLGPHIPTIVDVSTSTTTQKPRDQWIEEDRRKI

SEQ ID NO: 121985 - protein, 111 aa, Glycine max
  Coding DNA Sequence Number=SeqID_30300
MHRSPTGNLVPLDLEIEATLRRNWDESRRKLLQDRTVTSILEEETHFSDSLSPDSPSSRESATQFPEATIMADEQHQRITLEDYSSSSVPYKTQSILILIGRRGKEVASLV

SEQ ID NO: 121986 - protein, 31 aa, Glycine max
  Coding DNA Sequence Number=SeqID_30301
MLMMLKMHYVDVMLWEIDVRQVASDILRRGG

SEQ ID NO: 121987 - protein, 115 aa, Glycine max
  Coding DNA Sequence Number=SeqID_30302
  Gene Ontology: Mol. function=nucleic acid binding
  Homolog annotation: Hit_ID=Q2AA09; Match level="QueryCoverage=47%, HitCoverage=20%, E-value=9e-09, Identity=49%"; Hit description =Retrotransposon gag protein
MAEDHPQRMTLEDYSSFATPQYFTSIARLDVQAANLSYPHSLIQLIQGNIFHGVPEDAIHLNLFSFSMASEVKRWLHSFKGNSLWTWEEMVEKFLKKYFPKSKTAEGKVESHLIM

SEQ ID NO: 121988 - protein, 52 aa, Glycine max
  Coding DNA Sequence Number=SeqID_30303
MVHDIFVKVKLEVTRTSTVLNVFGSRRSSDKWVYDPNMVGSWYLKHATKNVV

SEQ ID NO: 121989 - protein, 124 aa, Glycine max
  Coding DNA Sequence Number=SeqID_30304
MAAQLIHYRVEMECLEGAWETLEGNARCRFRGMIRFTTTSLVHPDEPARTLQRTVEWILPTPTPYRLVEPVQVIEEDPEEDPEELPPEPAVDALDFLEGINEALGLNLALGLNLELGLDLKRAD

SEQ ID NO: 121990 - protein, 183 aa, Glycine max
  Coding DNA Sequence Number=SeqID_30305
MILKDELKACLRSKRNLSRQLSKTEGNMWAIIDEYKEKLNLAATHEQRLEDEYTKISAEREARERVINSLHRGAMVWMDRFAFTLNGSQELPRLLAKAKAMADVYSAPEEIHGLLNYCQHMIDLVAHIIRSRSNTITKHTPRHPYRTRSESRAMCDVEEVQEQMKANMLTLKDQMASMMEAML

SEQ ID NO: 121991 - protein, 133 aa, Glycine max
  Coding DNA Sequence Number=SeqID_30306
  Pfam annotation: Domain name=zf-CCHC; Domain location=61-78; Score =24.7; E_value=0.00028; Accession=PF00098.14; Description=Zinc knuckle
TDKRKRSIALKASSSIQEEEEDEEDFSLFVKKFHKFVKKRRIERRQNFNHGKRFQEDSPTIRCYKCNQLGHIKANFPSNEQWPKKNEKKSHEERRSKKAYIAWDDNDSSDGSEKEINLLSKDYESDENISQED

SEQ ID NO: 121992 - protein, 47 aa, Glycine max
  Coding DNA Sequence Number=SeqID_30307
MPTYDKFMKELLKKKNTYIEQDTIQLEPGCNVKHCRIGEQALVLYHS

SEQ ID NO: 121993 - protein, 68 aa, Glycine max
  Coding DNA Sequence Number=SeqID_30308
RIPQKCRNMPFCGRAKARLTGALSKGGKMRGVATNEGISTSHVDKSGAFAPTYPPSKRKSDLRSSFFK

SEQ ID NO: 121994 - protein, 141 aa, Glycine max
  Coding DNA Sequence Number=SeqID_30309
MGSDQGSSFKKRFYHVKVKNLEVASLRKLGQQMGQVQRQAFSKDFQLAPTIEEFEGILGCPKGGRKPYLFLGTILLCGNTKEVLGEDENSGKPRGVAIDAFLAYHHSKESSVIAILADAHDTFNLRCEKSSARIVCCMPAL

SEQ ID NO: 121995 - protein, 44 aa, Glycine max
  Coding DNA Sequence Number=SeqID_30310
WCDTEEEEPTNLRSNPLQGGRDDAILPRKGLITRAMSKRLRGLG

SEQ ID NO: 121996 - protein, 64 aa, Glycine max
  Coding DNA Sequence Number=SeqID_30311
  Homolog annotation: Hit_ID=UPI0000ECBAF8; Match level="QueryCoverage =64%, HitCoverage=48%, E-value=1e-16, Identity=100%"; Hit description= UPI0000ECBAF8 related cluster
MEPGRFQVSIPGMQAWHWPSFYNVVTGKTLALPNLIALQHIPLSPAGVIAKRPAPIALPNSCAA

SEQ ID NO: 121997 - protein, 93 aa, Glycine max
  Coding DNA Sequence Number=SeqID_30312
  Homolog annotation: Hit_ID=A7P1R4; Match level="QueryCoverage=38%, HitCoverage=9%, E-value=2e-14, Identity=91%"; Hit description =Chromosome chr19 scaffold_4, whole genome shotgun sequence
MRKEKIPHQAPFAIQAAQLLGRAIGAGLFAITPAGERGMCCKAIKLGNARVFPVTTLLMGKVASDKCHKWVFKEPTECEPNISNYWQSSFDAV

SEQ ID NO: 121998 - protein, 260 aa, Glycine max
  Coding DNA Sequence Number=SeqID_30313
MTTLAQTWSVLSFSNLIPTSHTSDVTLDRAKLIYGIIMKMDMNVGYLISHQISLTTQHDTSRLGFPALIIALCKARGVQSNSRSLESLSPAINLVYIKKNCWNLDDPIVTFRAPRKARGKRSEAPSTSTSEEATPSSSTLPPSSTTELPVIPPAPTQIPLPAPLSVGQTEFIFTPQMLHSMLQSIHKGQSIIMQSLQGLGFPSIMSMEEFDTHMVWPGDQPSSSGGGGASTAQETVSEEPLAPAPSPAATEEETTPAQTP

SEQ ID NO: 121999 - protein, 45 aa, Glycine max
  Coding DNA Sequence Number=SeqID_30314
MEEEAEKNTKTPLTQTARIFIPWVKSVENINVPTDEIPSLIYVGK

SEQ ID NO: 122000 - protein, 69 aa, Glycine max
  Coding DNA Sequence Number=SeqID_30315
MTETRQKRVRKVNENENKSTQNKWGPPQGYGKFTEALRVSRNPQYPNFLTKRGRWLSPSSPRRARLLPP

SEQ ID NO: 122001 - protein, 45 aa, Glycine max
  Coding DNA Sequence Number=SeqID_30316
MGAKVPRSGQTRVASQQMDGPRTILGEKGAGSNGSPHAIELAASG

SEQ ID NO: 122002 - protein, 246 aa, Glycine max
  Coding DNA Sequence Number=SeqID_30317
  Homolog annotation: Hit_ID=Q2HTA0; Match level="QueryCoverage=55%, HitCoverage=21%, E-value=5e-15, Identity=37%"; Hit description=IMP dehydrogenase/GMP reductase, related
  Pfam annotation: Domain name=DUF1723; Domain location=147-196; Score =52.3; E_value=1.7e-12; Accession=PF08330.1; Description=Protein of unknown function (DUF1723)
IMVRTRGLDRALGHVTSRGDHDDSDDAPLRRRPTTSAQRQRVPVTAAHDEPVLPAPNVEADVFSDDPMAPANVEDIGPDIPDDTGAQAAEDEDEGFLGGPSDPSERPKLKLSSHGRKVHSLGRPVPAIEGLVAGTGLSPLITCSVDTGDRGLLSSFVERWHRETSSFHLPVGEVTITLDDFLSLLHLSVVGDLHAFQPLHVDDAVQMLVDLLMVSAEAARAETGQCCGPYVRLQWVRDIYERRCQA

SEQ ID NO: 122003 - protein, 80 aa, Glycine max
  Coding DNA Sequence Number=SeqID_30318
MSIKGGVGGAGGGDSISTSGRSRWGLLLEVVTQLVQGFVLVGIGLGRNNPQGAQPKGCWAFRPGHLVQNLFHGYYWPVVS

SEQ ID NO: 122004 - protein, 65 aa, Glycine max
  Coding DNA Sequence Number=SeqID_30319
MQDKVNCNKINEIREEIIANSIYTGSATSRAYVQPSTEWRRRKGDWRRHFKEKISQEQAHHHRKS

SEQ ID NO: 122005 - protein, 243 aa, Glycine max
  Coding DNA Sequence Number=SeqID_30320
  Gene Ontology: Mol. function=2,5-didehydrogluconate reductase activity; Cellular component=cytoplasm; Biological process=L -ascorbic acid biosynthetic process
  Homolog annotation: Hit_ID=A1JQS1; Match level="QueryCoverage=100%, HitCoverage=87%, E-value=1e-107, Identity=74%"; Hit description =Putative aldo/keto reductase family protein
  Pfam annotation: Domain name=Aldo_ket_red; Domain location=9-243; Score=347.8; E_value=1.9e-101; Accession=PF00248.12; Description =Aldoketo reductase family
MAEQPRIKLHDGNMMPQLGLGVWQASIDEARNAVLEALKVGYRSIDTAAAYKNEEAIGQALQETDVARDEIFITTKLWNDDQQNVEQAMETSLKKLQLEQVDLYLMHWPCPQKDHYVDAWKKMVELQQQGLAKSIGVCNFHEAHLKRLIDETGVSPVVNQIELHPMLQQRTLHAWNALHQIQTESWSPLAQGGEGVFDQEIIRELAKKYSKTPAQIVIRWHLDSGLVVIPKSVTPARIQENFQ

SEQ ID NO: 122006 - protein, 144 aa, Glycine max
  Coding DNA Sequence Number=SeqID_30321
  Subcellular localization annotation: CTP_CleavageSite=36; ConfidenceScore=5.06e-01
MTMSGTRHRSAKSENGLLPRPSTTLSLSSSEPIFPLSFAKGTDSFTGAGEDGTWRTMFGWGNSWGAGFLRGSRGPRWASPSSSSLQGIVGIRRELPLEGRGLAQIIRSGTGSEVRSQTIRLGLRDYTSDLTPSCFCLGPVYCGL

SEQ ID NO: 122007 - protein, 153 aa, Glycine max
  Coding DNA Sequence Number=SeqID_30322
MPISPCKSISWSVSSQHGDRTRETPSGPGKVQQGPGVSSFGYGLYQSYRVLVPPRQGHIIIGIAPARHPVDPKKSNRVLELSSSNYGSLSVLQSTYNPQQVHQAPINQAFIKKYCVYRQAQGETPQQPGDGRQRATDAPPSPLEFTSAHPQKG

SEQ ID NO: 122008 - protein, 146 aa, Glycine max
  Coding DNA Sequence Number=SeqID_30323
MARTRGLGRAIGRVVGRDRAADEDAGDVPERRRPTASAPYEAPEMLADAQGADRADGSGGDDAAEGFPGGPRDLSVLTSFVEHVAHAVWSGQERPDLKLVSHGRKVTLIGRPVPEIEGLVAATGLSPLIDCSVITGDPGLISAFVE

SEQ ID NO: 122009 - protein, 183 aa, Glycine max
  Coding DNA Sequence Number=SeqID_30324
  Pfam annotation: Domain name=G-patch; Domain location=20-59; Score =24.8; E_value=0.00019; Accession=PF01585.14; Description=G-patch domain
FLRGLPLWAACLSDAAVMMARVMLGNGYEPGMGLGKNNGGITSLINTQGNRGKYGLGYKPTQADMKRSIAGRKNNGQSSRWRQEGEGSPPCHISRSFISAGSGDKAGKLAEWRNRPGIYATSIISDDESPEGTNTWDPSIDFEQEMNQTEDEGNEDVGLPPELERMVAHEDQEMGPHQEETEL

SEQ ID NO: 122010 - protein, 32 aa, Glycine max
  Coding DNA Sequence Number=SeqID_30325
MAVMCLILEAQAEARLLCFSYELLSPAIGDPI

SEQ ID NO: 122011 - protein, 160 aa, Glycine max
  Coding DNA Sequence Number=SeqID_30326
MWAFLTGRQIDWAHLVRYRMHKALRANAPFPYPHLITLFLRHFQIPLDDEPFVQVKCSFAISAGAMTSFGYRKDRNGQWLKKDALPPQDERTPSPPPQRDDSALMNEVLTKLRGLRSYVGDRFDSLDTRFAGMDIRLTQLEEDVGYIRQSFDLPPPPPPS

SEQ ID NO: 122012 - protein, 184 aa, Glycine max
  Coding DNA Sequence Number=SeqID_30327
MEVKDKVELLPYRDRDDLVQLCIKVEQQLKWKPHSYPKKDQGQGILGVAPSKPKDNKGKNIKGKEEQPLMVKEECKELSVSSKRLAKKESHFEIKTNIKETSLLRQPLHLLLCKRALLSTAIPLELDIIPQVKELLDESLFCIIRQQIPMIGGMMNVLSGATLFCKITHASNIFMIHIHRDSLG

SEQ ID NO: 122013 - protein, 99 aa, Glycine max
  Coding DNA Sequence Number=SeqID_30328
MEPNVVIVAATGAVAKHTEIPHHNLADFEPWLGYATEGQAVGGIPFENTLEGPQFRPQPQPLHFAVGRAPPAMAEKGKADHLKERLRPLKEVKIMPLLT

SEQ ID NO: 122014 - protein, 59 aa, Glycine max
  Coding DNA Sequence Number=SeqID_30329
MTGDVSKFTTISPKKSGQVTYGDNNKGKIIGVSKIEDIKYLLILKNVLSSMSMTRTLSI

SEQ ID NO: 122015 - protein, 113 aa, Glycine max
  Coding DNA Sequence Number=SeqID_30330
MSLHSSSSVNGEGSTLKDPFSHDSCKSLSEELSDYYRGCHSSHTEHHSQRREKERKPQEANINLPYFHGKDNVEANLDWEIRVEQQLKRKSTSKSYGSHSYPKKDQGQGILER

SEQ ID NO: 122016 - protein, 70 aa, Glycine max
  Coding DNA Sequence Number=SeqID_30331
MKLLRWLTPCFLTKFFKGWHQSSFPIFYMPTHKQGNKETSNNQRPKNEMKAKPIEFEQDKFSSIIQQLKQ

SEQ ID NO: 122017 - protein, 94 aa, Glycine max
  Coding DNA Sequence Number=SeqID_30332
MARKDKLWSFCSLLSSRGGGLDDMRRQIMVIPHPFAIQTQSCPMARRDKLWSFCTLLSSRGGGPDDMRRHYGIPHPFTQIVSYAETNYGHSAPF

SEQ ID NO: 122018 - protein, 114 aa, Glycine max
  Coding DNA Sequence Number=SeqID_30333
  Homolog annotation: Hit_ID=P10978; Match level="QueryCoverage=97%, HitCoverage=8%, E-value=3e-08, Identity=31%"; Hit description =Retrovirus-related Pol polyprotein from transposon TNT 1-94 [Includes: Protease (EC ...
  Homolog annotation: Hit description=3.4.23.-); Reverse transcriptase (EC 2.7.7.49); Endonuclease]
MEMGGDLHDYINKFNQLVSQLLNVDDKLSYEEQVLLLLASLPRSFKALVQTLFVGISTLNLDEVTATLRENQRIMRTGNVDDEHHAIAMVESERWRNHSRRYDGPRGTSKSGIL

SEQ ID NO: 122019 - protein, 53 aa, Glycine max
  Coding DNA Sequence Number=SeqID_30334
MARSVFAPCPYLKDLQGRELTRGIILFEEHIAAVGTTSNNKFSKRKALDEGSL

SEQ ID NO: 122020 - protein, 132 aa, Glycine max
  Coding DNA Sequence Number=SeqID_30335
MARKLEFIYQNRVGWIPNVRSSIDIILGTTGDLGAQSLKVIQRVHKAWRSRLRKDKELRGIQNGVIGGYRGWLRVHTRGLDWLSKLKVINEENFEAPEEDEEVQALKLELGKARLAKEKFKSAATHIRKEYT

SEQ ID NO: 122021 - protein, 360 aa, Glycine max
  Coding DNA Sequence Number=SeqID_30336
MSILTLESKKRKEGKFPIKEKAKRKERKIPNQRVGESEKKRKEIPNQRMGEIGSFISSLKHVRILAKKNIEVISSLTSYPEQRRSEFLIGGYVGARASLLSTTPPFVAMTQELVTRGDTLQLSAPRHSVTPSVIDEQRPMWSSAPFPEMSASSGGDFFKSHKHSRVRWHAETNYGHSAPFCHPEAAGPMTCGDKIWSFRTPLPFRHSRVRWHAETNYGHFAPFCHPEAAGPMTCGDKIWSFCTPLTFRHSRVRWHAETNYGHSAPFCHPEAAGPMTCGDKIWSFRTPLPFRHSRVRWHAETNYGHSAPFCHPEAAGPMTCGDKILSFRTPLSFRHSCVRWHAETNYGHSAPFVNRGRQAR

SEQ ID NO: 122022 - protein, 64 aa, Glycine max
  Coding DNA Sequence Number=SeqID_30337
MDLEGKGRGIYFGTIINFGTSICELWKLFATPQGFDDAKTKATQVLFQVQIKTKKTKIKKKAKS

SEQ ID NO: 122023 - protein, 91 aa, Glycine max
  Coding DNA Sequence Number=SeqID_30338
MSGFTHDSPQISASPHQLDLAPYASKPYNAQWNTPGLLRDMHTLRSSRILGEMEVDEPWLGLWLPLNYQVVFVIGSAVDRLCGRFRDGLCG

SEQ ID NO: 122024 - protein, 160 aa, Glycine max
  Coding DNA Sequence Number=SeqID_30339
  Gene Ontology: Mol. function=catalytic activity
  Homolog annotation: Hit_ID=A7R4K8; Match level="QueryCoverage=60%, HitCoverage=29%, E-value=1e-15, Identity=46%"; Hit description =Chromosome undetermined scaffold_728, whole genome shotgun sequence
MWQEYEGDQWGLDPRRKRTTKGRLVSTCIPTEMGEEENERENIKKCRICLTTCFATSLATFIYKDFTLALSLVRPLPLFISDAKLLRKQTALTKYKNGRVSKVFIIAEKDNIQTEDFQRWIIEGTGPYADVKVIKDSDHMVMFSRPKKLSFELLKIAYEY

SEQ ID NO: 122025 - protein, 236 aa, Glycine max
  Coding DNA Sequence Number=SeqID_30340
MARTKKTGEMTTETAKEIAKKIVSHGQLTITIMFQYFENAMYHCHIGIVRPPWTSGCSRRCYWTSRPEHPGRVRAAGAGVTIKQYFGSAPRTSRNASSLPPNELQQLTQQIRDRLEESITEKVTRQVMASFSQLQSQMQSQGLAVPPEPLVGPSGPQVSTKGSCADPSGNDPETGDSDRCGLYIEADPAGLVAMGRVYEGFTVVHNTPLLPGQVKVSVEEVTDADAPVPVPIDEVS

SEQ ID NO: 122026 - protein, 133 aa, Glycine max
  Coding DNA Sequence Number=SeqID_30341
  Homolog annotation: Hit_ID=A6T9B8; Match level="QueryCoverage=85%, HitCoverage=70%, E-value=4e-22, Identity=52%"; Hit description =Putative cell envelope integrity inner membrane protein TolA
MAYTAKDNAEQIKDAAADKARAIKQEADKQIDDIKTQANNEADSLKTQASSIKSEADKKADAIAQDAKNKADAVKQDAQQKSDAIMKEAGKIKDNAIVEANQLSADAANKTKEIKESIAPEQAPAQQAPAGQQ

SEQ ID NO: 122027 - protein, 84 aa, Glycine max
  Coding DNA Sequence Number=SeqID_30342
  Subcellular localization annotation: CTP_CleavageSite=49; ConfidenceScore=5.57e-01
MGVQIAPRPIWALQKIPPKFSSGASKFSSPVESPTVVTYPSAGGRRETRGMRVPRKEYARSRHQRLFEENVGKTGKDAIYELLS

SEQ ID NO: 122028 - protein, 90 aa, Glycine max
  Coding DNA Sequence Number=SeqID_30343
  Homolog annotation: Hit_ID=A5BP71; Match level="QueryCoverage=48%, HitCoverage=11%, E-value=2e-07, Identity=59%"; Hit description =Putative uncharacterized protein
MKDKYIVLRLLKNLNKIKNKLVRTSFACMISTRQAIPPSNDAWTLIPDPTTIRAKGRPKSTRIRNEMDWVEPSEHRQKFSRCEAEGHNKR

SEQ ID NO: 122029 - protein, 135 aa, Glycine max
  Coding DNA Sequence Number=SeqID_30344
IVPARHLVDPKKANRVLELPALNTGLCQFYGVPVTSSKGIRPPTNRAFIKKYCAPRQAQGRNTTAALGWPVAGNRHTATTSKVHLSSSAKRLERCLRHMADQQGDQVQSQRTHLVAHDPGDLNKTSASSEGREIP

SEQ ID NO: 122030 - protein, 107 aa, Glycine max
  Coding DNA Sequence Number=SeqID_30345
MAYHANSKANQNSMKNHEIHFERGSNLDKLLMQFMETTKSTQQALQSVEIQVGELAEVVNQFMSRPEKSFVEAEAQEKSPVKEHESREKDEEKDVGSSGLKIIKKGG

SEQ ID NO: 122031 - protein, 60 aa, Glycine max
  Coding DNA Sequence Number=SeqID_30346
NFKRLQFKSDIAETRIKKQIAELADTEPKKAESPDEGAKTEESRPKRTITKPSYLRDFVE

SEQ ID NO: 122032 - protein, 74 aa, Glycine max
  Coding DNA Sequence Number=SeqID_30347
MTSRDQVWSFCTHDTRRYLMVIRTLCHPEAAGPMNDKSWSPATLDQPRGAKLVSYTDFRGPLLDDMRPFFVILV

SEQ ID NO: 122033 - protein, 362 aa, Glycine max
  Coding DNA Sequence Number=SeqID_30348
  Gene Ontology: Mol. function=transferase activity; Cellular component= cytoplasm; Biological process=selenocysteine incorporation
  Homolog annotation: Hit_ID=A6TFJ2; Match level="QueryCoverage=48%, HitCoverage=85%, E-value=7e-64, Identity=73%"; Hit description =Putative S-transferase
  Pfam annotation: Domain name=GST_C; Domain location=88-186; Score =16.8; E_value=0.0018; Accession=PF00043.16; Description=Glutathione S-transferase, C-terminal domain
  Pfam annotation: Domain name=SelA; Domain location=274-362; Score= -187.9; E_value=9.1e-06; Accession=PF03841.4; Description=L-seryl -tRNA selenium transferase
  Pfam module annotation: Pfam domain module=GST_C::SelA; Domain location=88-186::274-362
PFVRKISVILLEKAIPFEFVNELPYNDVNGVAQYNPLGKVPALLTDDGACWFDSPIIAQYLELLLNVAPAMLPAEPLAALKIRQLEALSDGIMEAAIALVREKARPAAQQSETELLRQREKIARGLDMLEGYAADGTLRNGELNLATITAACAIAYLNFRRVAPGWRYNRHSLLTPSPVGRGENNLSSGSLMSTDTRALYTRLPAIDRLLRDPAFALLLDRHGHSQIVALLRQMLDEAREHIRQAQALPEWCDDWPQETASRLNLNQQSALRPVFNLTGTVLHTNLGRAIQAEAAVQAVAQAMRAPVTLEYDLDDAGRGHRDRALADLLCRITGAEDACIVNNNAAAVLLMLAATASGTEVV

SEQ ID NO: 122034 - protein, 81 aa, Glycine max
  Coding DNA Sequence Number=SeqID_30349
MSKCPRCGVSRYKVKDDEECSSDENSKKGPPAKVWWYLQLFQGLSVFSLMETMLKTLHGMQMGETVMEWSIIRLIASSGRR

SEQ ID NO: 122035 - protein, 137 aa, Glycine max
  Coding DNA Sequence Number=SeqID_30350
  Gene Ontology: Mol. function=hydrolase activity; Cellular component =membrane; Biological process=metabolic process
  Homolog annotation: Hit_ID=A6T644; Match level="QueryCoverage=100%, HitCoverage=100%, E-value=1e-65, Identity=89%"; Hit description =Putative uncharacterized protein ybdB
  Pfam annotation: Domain name=4HBT; Domain location=50-127; Score =88.3; E_value=2.4e-23; Accession=PF03061.13; Description =Thioesterase superfamily
MAWKRELTLAALNASSENTMVAHLGIIYTRLEEALLEAEMPVDARTHQPFGLLHGGASAALAETLGSMAGWLMTEDGQCVVGTELNATHHRPVSSGKVRGECRPLHLGRQSQSWEIVVYDEKGRRCCTCRLGTAVLG

SEQ ID NO: 122036 - protein, 166 aa, Glycine max
  Coding DNA Sequence Number=SeqID_30351
MGVALSGRSLSQQIGLARSARKNPEEDELSSLLSAPLQVIKHTIQVIKRTASSHPLSETSALSQNPLMRAKRSRFALSARAQTRRFPDYGKLNPLLDHPYRTKLLCYHEESGYKNLVVYVCLNMVLVEFSLTRGICGRGLIRTRLGYHEESGSSSPGDNIGMHEHC

SEQ ID NO: 122037 - protein, 36 aa, Glycine max
  Coding DNA Sequence Number=SeqID_30352
MAFSEELAKLACCAKRVHSLRINTHPLAELPMAKRG

SEQ ID NO: 122038 - protein, 265 aa, Glycine max
  Coding DNA Sequence Number=SeqID_30353
MWLKGMKTPMFLFGNRDEHAKHTVVLILLSAPVAKPKGHFGEAELSAPCCAKPKLSASLPSNFDVAIVKEFYGNLYDPEDKSPKQVKMDMNVGYLISHEISIIPQHDSSRLGFPTLITALCKARGVTSDSRSLESLSPAINLAFIKKNCWNLDDPTVTFRGPRKSSGLPSIMSTNEFLTHVAWLGVQPSPSGGGGTSTAQEPEVVEEQIPVEEDGPTPPEPFEFVSDLVVAQEEVPSPEPSPGPVPEDTMLAEDTQPSAPILEHE

SEQ ID NO: 122039 - protein, 134 aa, Glycine max
  Coding DNA Sequence Number=SeqID_30354
MTKVMNKKLKDQRTTQVNQEQVKSSRIKKNSRLKKKVYNQEPRFKIQDLKNQDQDSRMKKRLNQDNLRSLSQHIGGYILCGTSRGYIYLGLTENKRGYISCGSVLVEGTSTRFKENKGGYIPCGSLLVKGFLQG

SEQ ID NO: 122040 - protein, 86 aa, Glycine max
  Coding DNA Sequence Number=SeqID_30355
  Subcellular localization annotation: CTP_CleavageSite=38; ConfidenceScore=5.07e-01
MPEYARALAIKLADQAVIVPSNLIKLTISGLSAHPTLSAATARRESGTTPISRPCAKREINVLSAAIVISQAQRMTDAKLKSTFSH

SEQ ID NO: 122041 - protein, 200 aa, Glycine max
  Coding DNA Sequence Number=SeqID_30356
MAEYSGYPQQALQDVVLKVLHKADISITEVVNFGRVQCLNEIPLLGSRHMRRVGRAGSLGIHAGNCCRQSELGCLLKWLSSSGGTIRAIIALGVVQHIQKMEYEHTRTTSIEGLQFLLHVDPSIENLDVLIGNRGFLVYISGGMNGYGVGAGVKDLRHALVFLFFGKRRGDHSLVCLLLDNNDLPLTPSDWSSLWISPLG

SEQ ID NO: 122042 - protein, 316 aa, Glycine max
  Coding DNA Sequence Number=SeqID_30357
  Gene Ontology: Mol. function=heme oxygenase (decyclizing) activity; Biological process=heme oxidation
  Homolog annotation: Hit_ID=Q94FX1; Match level="QueryCoverage=89%, HitCoverage=99%, E-value=1e-124, Identity=82%"; Hit description=Heme oxygenase 1
  Pfam annotation: Domain name=Heme_oxygenase; Domain location=139-313; Score=-54.2; E_value=0.0038; Accession=PF01126.11; Description=Heme oxygenase
  Subcellular localization annotation: CTP_CleavageSite=58; ConfidenceScore=5.81e-01
MASSLTTTLSQSQSLYIKPRLAPRPPHPQFRSLFLTSPAVAGGVRAAVMPRRTAVIVSAATAETPKKKGESKGFVEEMRFVAMRLHTRDQAREGEKEVKQPEEKAVTKWNPSVEGYLKFLVDSKLVYDTLEKIVHEAPHPFCEFLPSHDIFSNKLLFLCVCFSWVIDHASSLQPTDAEFRNTGLERSASLVEDLDWFKEQGYTIPEPSSPGLTYAQYLKELSVKDPQAFICHFYNIYFAHSAGGRMIGKKVAEKLLNNKALEFYKWDGDLPQLLQNVRDKLNKVAEPWTREEKDHCLEETEKSFKLSGEILRLILS

SEQ ID NO: 122043 - protein, 54 aa, Glycine max
  Coding DNA Sequence Number=SeqID_30358
MTKVHNDHNLSLRAIGLDRLWMAKRDCGATDKSEALAPTYPQFVMRNSDLRSSG

SEQ ID NO: 122044 - protein, 154 aa, Glycine max
  Coding DNA Sequence Number=SeqID_30359
  Subcellular localization annotation: CTP_CleavageSite=59; ConfidenceScore=5.09e-01
MHFQTNSLSVPTALSEFIFWGRTFIFLRRYMWLSGANLLTQVAWPGAQLSIVRTSGRFVAQTPRQEGSDETAAPPKLTPAHVEPMPADPHSLVADPSSPKLEVAPPSSPIIIISEDSTESASGEAVALSDSPVFHLIDEEDAQTQDTQDLSQGF

SEQ ID NO: 122045 - protein, 161 aa, Glycine max
  Coding DNA Sequence Number=SeqID_30360
ACDAITERLERHLSLEIVTPGTSTHVVIKECLMITRSVTRDRIVYVRSRPFAKRATQWLSARKNSEEDELSVIDTCAKRTSTNKATYLSLKSNLQREFGVFLEEASTCTRVWPWLEAFACLGSSRERKVQVPKSSERFCCVKICRDASSKQKPFREHEMSL

SEQ ID NO: 122046 - protein, 109 aa, Glycine max
  Coding DNA Sequence Number=SeqID_30361
MAVEPTAQFLCPKFIKFMTSEVHEIGTSITDASSIGACRPRIFFINGFLCFLEDKWQRNGEGSERRCHFKEKMSLEEAHHHRRPWIRAWRKKEMNEGRGREENEILCSK

SEQ ID NO: 122047 - protein, 62 aa, Glycine max
  Coding DNA Sequence Number=SeqID_30362
MDEDQWMYDSVMSEEVYMNDQNEDEGGVNEEHVDCSNAFNTSYVFATCDDDLHWARFVAYET

SEQ ID NO: 122048 - protein, 210 aa, Glycine max
  Coding DNA Sequence Number=SeqID_30363
  Homolog annotation: Hit_ID=Q2HTA0; Match level="QueryCoverage=42%, HitCoverage=13%, E-value=3e-10, Identity=38%"; Hit description=IMP dehydrogenase/GMP reductase, related
  Pfam annotation: Domain name=DUF1723; Domain location=1-50; Score =50.3; E_value=6.6e-12; Accession=PF08330.1; Description=Protein of unknown function (DUF1723)
MSNRGLMSAFMEKWYKETSSFHLLVGEVTITLDDVALLFHLPIIGTFYTFEPLHVDDAMFLLVELLEVSAEDGRAKTIQSHGAYVQLSWLGSYAWGATALVHMYENLNDTSKSTTRQLARYITLLQAYQMGSIYCHTSTENGSATVWCSPNYMEWFYTISHPFMSSAQPEDPPRHPPMQHHDTFVELDVAQHPVAAVVVDEEPEDAHMLM

SEQ ID NO: 122049 - protein, 59 aa, Glycine max
  Coding DNA Sequence Number=SeqID_30364
MGVAVTMMDIPDGGNRVGKYLYLGACHSIWNSLKTQADHHGGGGGELPVHDKVISTVAT

SEQ ID NO: 122050 - protein, 67 aa, Glycine max
  Coding DNA Sequence Number=SeqID_30365
SIRHSSLSIVAFLVFSRTPPPVALLGFQNIREKEKGLKPPFHDPTCDASFSVHRKFFINPNGEGVRN

SEQ ID NO: 122051 - protein, 50 aa, Glycine max
  Coding DNA Sequence Number=SeqID_30366
MEEIHGEEDEEQGNKALDLLHQWSPLLLEDQWQQNGEGGKVIGDATSRRR

SEQ ID NO: 122052 - protein, 161 aa, Glycine max
  Coding DNA Sequence Number=SeqID_30367
MDKRSWVQGQLIPYDEDAINQFPGHPLVLEEGQHCEYNKRRSQVLGFGLCQFYGVPVTPTKLIWPPINRSFIEKYCMSRQAQQPGQDQQQQLAANAPPPPLQQPPSLNPYPWPTPELFKATVAWLGDRPNFQAGAGPTEAPGDEDGVEEDDDMADVMDFFL

SEQ ID NO: 122053 - protein, 152 aa, Glycine max
  Coding DNA Sequence Number=SeqID_30368
  Gene Ontology: Mol. function=aspartic-type endopeptidase activity; Biological process=RNA-dependent DNA replication
  Homolog annotation: Hit_ID=Q6WAY3; Match level="QueryCoverage=53%, HitCoverage=3%, E-value=1e-08, Identity=35%"; Hit description =Gag/pol polyprotein
MARQAWWSSLRIVEGLGRVTSLHRWTRRGSPLKGRREAWPIYKGKDYKWKGSPFVTSAKALLVQDGCARIRSDVESCKSNDTEDSDVDFECPISQAKGEENEDWGLPPDLRGMVEQEEKEVKPHREETKIVNLGANRERKEVKVDTCMSINV

SEQ ID NO: 122054 - protein, 353 aa, Glycine max
  Coding DNA Sequence Number=SeqID_30369
MFLSVKNMIFHCVFRLSAYGIKEEKDTCHTFPEAWELYTDIVVPRKILPESNVVICHTEFNDFKEELKRRNWHEEFTIFEEGSIDVAIVKEFYANLYDPEDKSPKQEEPDYHCFDLERAFFLKLGPYLTHFRYHSGQGQVDLWNNSEDGHEYGYLISHQISMIAQHDSSRLGFPTLITTLCKVRGVTSDSRILESLSPVINLAYVKKNCWNLDDLTVTFRGPRKAKGKKYEILPSSEVPPTTSAPSTLAPTSSTPTTFAPSPAQLPVLAPSSSGPSDFSFTPEMLHAMMQSLHRGHEEVPSPKPILEPSPTPIPEDTLPSAPALELEQPIVQNPPAAPVLDLTEHAEDHPQED

SEQ ID NO: 122055 - protein, 259 aa, Glycine max
  Coding DNA Sequence Number=SeqID_30370
  Gene Ontology: Mol. function=aspartic-type endopeptidase activity; Biological process=RNA-dependent DNA replication
  Homolog annotation: Hit_ID=A5AZG1; Match level="QueryCoverage=20%, HitCoverage=15%, E-value=1e-09, Identity=53%"; Hit description =Putative uncharacterized protein
MEGGIGHILNITPKEEKRIEGLKMLTLASHISMEKDNVEAYLDWEMKVEQLFACHHISEERKVPLATLSIQGYALYWWTSLVRERRIYGCQTQISSGDYHSWIFGFSLAELSCSTPVTVQDERSFDVLVKGAKDTKRDGQKGLFRDFSRPQLAQASLWLTWAPPNGLGLKSPTRPGKPSHFRVKHQLNTHLSRVRAEVPNALTTSFVLWRSICGHAGSPTRLITVKPHLEFFSFDDTLSLVVPTTTMFDIKEDDISRNL

SEQ ID NO: 122056 - protein, 166 aa, Glycine max
  Coding DNA Sequence Number=SeqID_30371
MIMRGQDIYSNQDEATTSPSSSESEEAKGEESSEEIYPQEEGQPLMVKEERKEVSVSSKRLAKKESHFTININIKETSPLRQPPHFLLCKKTLVSIATPLGLEFIPQVKELLGVPINPKRIKVIPEWPTPPSVEGRSLEFQEPLDLRSNPLQGGGNDSILPPKGIG

SEQ ID NO: 122057 - protein, 85 aa, Glycine max
  Coding DNA Sequence Number=SeqID_30372
MSSSLSTGYRDKKEEPGGSGSIVEVNPYLSKVEELKHKVIAIEQKLALHEERICLLKKMLGNEEAQSWAYANGVKNYINKWQSNR

SEQ ID NO: 122058 - protein, 503 aa, Glycine max
  Coding DNA Sequence Number=SeqID_30373
  Gene Ontology: Mol. function=voltage-gated potassium channel activity; Cellular component=integral to membrane; Biological process=potassium ion transport
  Homolog annotation: Hit_ID=A7QJQ9; Match level="QueryCoverage=70%, HitCoverage=50%, E-value=1e-169, Identity=82%"; Hit description =Chromosome undetermined scaffold_107, whole genome shotgun sequence
  Pfam annotation: Domain name=cNMP_binding; Domain location=286-386; Score=23.9; E_value=0.00059; Accession=PF00027.20; Description =Cyclic nucleotide-binding domain
MAKIHEQCVHSAVQVRRALSTYFFIVEGYPMCPFCSSAEESAVHLFFHCRRIIPLWWESLSWVKLVGAFPNHPRQHFLQHIYGVTEGMRASRWKWWWLALTWSIWKQRNNMIFSNGTFNANRILDEAIFLTWTWLTQLEKDFSIHYNHCSYGQNLETSTFIGETSFAIVIAILGLVLFSHLIGNMQTYLQSITIRLEEWRLKQRDTEEWMRHRQLPEDLRSRVRRFVQYKWLATRGVDEEIILRALPADLRRDIQCHLCLNLVRRVPFFSQMDDQLLDAICERLVSSLSTQGTYIVREGDPVTEMLFIIRGRLDSSTTNGGRSGFFNSIILRPGDFCGEELLSWALLPKSTINLPSSTRTVKALSEVEAFALRAEDLKFVANQFRRLHSKKLQHTFRFYSHHWRTWAACFIQAAWRRYKKRITMKDLSLRESIPLDETVASEREHEDYAAGSNSTRAKLNLGATILASRFAANTRRGALKIKDDMPQLQKPEEPDFSTEADDD

SEQ ID NO: 122059 - protein, 143 aa, Glycine max
  Coding DNA Sequence Number=SeqID_30374
  Homolog annotation: Hit_ID=UPI0000ECBAF8; Match level="QueryCoverage =28%, HitCoverage=48%, E-value=1e-16, Identity=100%"; Hit description= UPI0000ECBAF8 related cluster
MTGPCPRLVSIVPIKESSNLLCLISLRHIKTVTSIPMSTKVIHVLANFFEADLFTKEIVFGVTSWVWLSCSVSRLRHFGSDEDGELSRPAGMQAWHWPSFYNVVTGKTLALPNLIALQHIPLSPAGVIAKRPAPIALPNSCAA

SEQ ID NO: 122060 - protein, 306 aa, Glycine max
  Coding DNA Sequence Number=SeqID_30375
  Gene Ontology: Mol. function=RNA-directed DNA polymerase activity; Biological process=regulation of transcription, DNA-dependent
  Homolog annotation: Hit_ID=A7P7S9; Match level="QueryCoverage=96%, HitCoverage=41%, E-value=5e-28, Identity=26%"; Hit description =Chromosome chr9 scaffold_7, whole genome shotgun sequence
MLIETLEEKVSSEENLNQIQQDDQVSSLEDDEIQEVNTLTKEQDILFEAINSIHDPQENKVFLNKLKKSLEAKPKQKEFITNTKFNVSNMLKRLENTLVKPTTIQDLQTKIKNLKQEVKELRKQQDIHQIILSQFEEHSNSDNEIKGEEDECQDDEIFMGLINKVKIQKFYKNEVILGTPFIKALFPLQISKEGITTWHLGKKITFDFSTKPITKNINLIKKKINQINFLKDEVSFNNIQTQLEKPQMKEKIHSLLKHIQSTMCSNLPYAFWNRKKHIVNLLYEKDFRGKHIPTKARTIQMNEELF

SEQ ID NO: 122061 - protein, 567 aa, Glycine max
  Coding DNA Sequence Number=SeqID_30376
  Gene Ontology: Mol. function=nucleic acid binding; Cellular component= intracellular
  Homolog annotation: Hit_ID=A7PFK7; Match level="QueryCoverage=93%, HitCoverage=99%, E-value=1e-170, Identity=63%"; Hit description =Chromosome chr11 scaffold_14, whole genome shotgun sequence
MASFKNKEPERFPESANTFLGFSFSFLDFNSFLLMVQLMKNSRKPETSSCGDPVKLEIVEDPLEEEHGPHNKRCKPSPSPSPQPQQWSASDDGSVSSPSHLNILDEPSPLGLRLRKSPSLLDLIQMKLSQGSAQPSEDLSSGAKRESRAAAVSGAGGADKLKASNFPASLLRIGSWEYKSRYEGDLVAKCYFAKHKLVWEVLEGGLKSKIEIQWSDIMALKAHCPDDGPSTLTVVLARQPLYFRETNPQPRKHTLWQATADFTDGQSSKHRLHFLQCPQGLLAKHFEKLIQCDMRLNFLSQQPEIILDSPHFDTQPSAFEDPDNPKDRDLLQVSGKGSSTSCFQDSGSPQASLLSSFKTEHNDPPGMMLDSLPRDAPSPSSVMECTSIEGSTSSETDSKGPRNGDQIKLPGLRPSMSVSDFIGQIELCLTEQITSGNPPFSDGGSEYKEILEDIAQHLLNDNQVAATSDEKSLMSRVNSLCCLLQKDPVTVQNSHFTEDSSTVEGPHDGKDVKPGAEEPKDTSGGKQALGMSRKDSFSDLLLHLPRITSLPKFLFNISEEDDDSHAK

SEQ ID NO: 122062 - protein, 163 aa, Glycine max
  Coding DNA Sequence Number=SeqID_30377
MRQFGYTQTIPAPPVDSWVSYDDIHDRWMHYSDHKVPAGEVCVVPGQCASDYIDWFFCISHSFMTPGQHQILCQMAPETDIPHVPELGAPSTSVRPAMEEPRHAVEVCYGIAERLERHLSLGVVTPGSSTHEVIEECLRMVRSVTQDQLVYVRSRRRRCTDQT

SEQ ID NO: 122063 - protein, 119 aa, Glycine max
  Coding DNA Sequence Number=SeqID_30378
MVVAAAAEYGEARSCQGLLDRRIQSLTRESLSGKWVFLSLCGDCEGGWDCNGGCGKRFLFFFVEELAIIVAVIGGCRGALRRILRRATPPSIAEGALPPSTVEVSVATMSFPPLLPAIG

SEQ ID NO: 122064 - protein, 142 aa, Glycine max
  Coding DNA Sequence Number=SeqID_30379
MEEMRESGLEDWVEIEDSCDSSKFDGGKVSFHGIEMLGCHPSAHTRKGRLSMKSTNDMSSIKGLEVEVSDDIIAEQILAIQQRKKNGIVPYWLFLDASLEDKAIAEGDSNVRPPKLSSPVQLNYWPWVWKTYNMKRVIGSEC

SEQ ID NO: 122065 - protein, 268 aa, Glycine max
  Coding DNA Sequence Number=SeqID_30380
  Homolog annotation: Hit_ID=A5AZ86; Match level="QueryCoverage=70%, HitCoverage=27%, E-value=2e-07, Identity=24%"; Hit description =Putative uncharacterized protein
MASTCLDPSVTGTPLICTEKLSEKVSLHGLQSYVYGTKVFGESQSIQDLFLLEEAQAVVEKLKMFLEGDSMEEVRRKNNNLYMVMIPRGANQVFNHIHVQVLIAHDVPSVEDLVTQLLHVPTQKNKVSSLEVHELSAMVSSRGRGRGGYQRKGGQGRGRKGKNNNLWRNHFKTSSHTQDLCYDLNGFLEKTIHVSKFGKSEQTNDIFEEKYQEYLLLKTNNQAHSSSTPSVSTACISQFVEGQGPWVIDLGVFYHIADNDSLFPFMSS

SEQ ID NO: 122066 - protein, 140 aa, Glycine max
  Coding DNA Sequence Number=SeqID_30381
MTVKEWDLQSSNPSRRNIKGSNHNKIGFSVEHSQRFEKHAYGYVEFVVLGVPMYIIVAYAFLFPSFTPETHQNPDNIFTGGEGNEGEGRMWSWGAVVVPGRRWRKCNGKRREEEKEKTTSEWGEEQTPVGKEEERTRGAL

SEQ ID NO: 122067 - protein, 49 aa, Glycine max
  Coding DNA Sequence Number=SeqID_30382
MAFSGLIRARKVLMMLKSKGQKGKSKNNMKNLEHKQVKQLDDSKLRLNC

SEQ ID NO: 122068 - protein, 149 aa, Glycine max
  Coding DNA Sequence Number=SeqID_30383
MKSITWGTSPETILMQEDFPDSSSINRRDSGKITLVSMANQKSTKSAIKNLDVQVGQIAKQLADRPSSSFSANTEKNPKEECKAVMTRSRMATHVDERKAEKKMEEHKQQLAGELALKPVDDLVELEEIVKEVEGDEEGETPIKDCKRK

SEQ ID NO: 122069 - protein, 145 aa, Glycine max
  Coding DNA Sequence Number=SeqID_30384
MVARVVRANDNVILLGAGEDGSHVRMTTICWLLQLEKIAWIRSFSWIRDLKRCCQLLSTLGLCCTCLELELYFCDGMKNRVGRGSWLGRVCGRKMKGWVITRKIVIIDIIFSMECIPSEMSALLEIGGATTWNNLRLKLEAQGKF

SEQ ID NO: 122070 - protein, 184 aa, Glycine max
  Coding DNA Sequence Number=SeqID_30385
  Homolog annotation: Hit_ID=A5BE52; Match level="QueryCoverage=50%, HitCoverage=5%, E-value=2e-09, Identity=41%"; Hit description =Putative uncharacterized protein
MSDSASETLTEENFDRPRGRDLQYRCQSRVNECAREGIVVRERSRENENEEQLQRAQVAIKGIQDSRMNAKIKLWESCFWFFRYFTAIKNTQEIMSNTIRIEKFNGKNNFNLWRIKMPSLLKKQHVWAPVASASVKKPVTSDSKEKASASKTEELTEQEEKAHSLILLSMSDEVLYEVANEETA

SEQ ID NO: 122071 - protein, 115 aa, Glycine max
  Coding DNA Sequence Number=SeqID_30386
  Homolog annotation: Hit_ID=A5C5K2; Match level="QueryCoverage=95%, HitCoverage=7%, E-value=2e-07, Identity=27%"; Hit description =Putative uncharacterized protein
MDQLEDVIAELTSSHLSMSTKIGDLIHRTAQLETNQHTQHSWASSATTPHTSPPSDTQHRLKLEVPCFDGSDPTGWIFKITQFFEYHSILDQERLTISSFYMDTLAWFQWMSRNA

SEQ ID NO: 122072 - protein, 176 aa, Glycine max
  Coding DNA Sequence Number=SeqID_30387
MASSQTYVEEQISLGKKMLVEESGGNKGITYSIFELLESKPSLFPALVRLPSQIPDDQGVAIWSHINRRCVGYKGNGMVGWARWWEEYFWVNVFMVDICCGEVEGLRVLATAYQVSHQRHTGKEHEIQQGRNDPVSAPQCHYRDGDILVRHHFQLLCATSLCFSCGGPKLKPNGAE

SEQ ID NO: 122073 - protein, 132 aa, Glycine max
  Coding DNA Sequence Number=SeqID_30388
  Subcellular localization annotation: CTP_CleavageSite=30; ConfidenceScore=5.76e-01
MGSPPASAPPPPPSTSDASASPSAVKRTHKASRLRSLSTRPPGAKRPVVHVDPATGKANGPHRKKLRTYLGIVARDKVDITYENWKEVPTAQKDLIWKDIQAEFDIPKASNRCAHEGKGHPEAEYWPPQAPG

SEQ ID NO: 122074 - protein, 476 aa, Glycine max
  Coding DNA Sequence Number=SeqID_30389
MRLKHHFGPTTQVANNIVSKYTIYPSLPYFFTVVVENDEEVVRDTSSAATLNDVVAAIKHLAQQMQNIENENKKRLDAIDKTKTSMLKAICTLAKQDYKDSTKDGDEDVAMSGTHDNTFVYRQPLHCQNANKRVSNPTMKCTTNQAYEKSDATLNNIETIFIPGDDDDDEFLRPSNRGMKAKFVHDENTTTYSSLKTIKLSGPVRTKENVDESETFTNKINPRSQAETVKDSSIPPRKLSFPNDKSVSGSSKKQKIDNQDQPTWNASRYQYSKGTSLGNINNNKATWMFHRPRPNSRNNLGTQAHFQSLCPNKPIREEPITALGVFGVCPQHLRYAIHYVLDVIDGTLVETVMLHYGKDWMPSFANLKMANVLLSVLESVFETQDLIFGFVGMDNWDIVEPKGIPNCGSSEKSALWILEWMQMEDSFFSLLYGVLDEKAVRMKVTMILLLGTHNQYKAELITNAKRTWHDSIHGKH

SEQ ID NO: 122075 - protein, 356 aa, Glycine max
  Coding DNA Sequence Number=SeqID_30390
MSMTLFVKNTAFARTNEPNFVRATETRHGTMCGKRHRPSISKTGPPHVLSRGGYELLEQKLMADKTNKKQEEVAQSGSTKALFDPPSPISRHDSLEEQASQGSFVPHGRQDVLIAAIGRPEHGGHVRAVGAGVTIKHFFGPAKKTYHNSSSIDPKELEQLTQQIRDQLEESITEKVTRQVGPSVALVNTKESCVEHSGNHPQTGDSDKCGLYIEGKPSRLVAIGRLYEESTTVHNMALLHGQVKVVVEEIIHADAPVPVPIDQFVVFNSALKGVDGTPQPKSKAAGPTWIVVKCNKQKGSTECGYYVMHWMSTIILASFTNNWEMYFNDVRPLESYTLKALRIQWANYYLIVRNET

SEQ ID NO: 122076 - protein, 64 aa, Glycine max
  Coding DNA Sequence Number=SeqID_30391
MAVALGPAVLGREQDLRGPLLDIHYMACYNLCLYIGYIDNKIFFYIHQEVSTYYNISIGVELSR

SEQ ID NO: 122077 - protein, 89 aa, Glycine max
  Coding DNA Sequence Number=SeqID_30392
  Gene Ontology: Mol. function=serine carboxypeptidase activity; Cellular component=extracellular region; Biological process =proteolysis
  Homolog annotation: Hit_ID=A5C816; Match level="QueryCoverage=55%, HitCoverage=18%, E-value=5e-14, Identity=48%"; Hit description =Putative uncharacterized protein
MILDCMIPALSVVFLISGVHSSEAHMFWWLYRNPYRVDNPSKPRPIILWLQGGPDNPVGTGYSFVEDYEWLPNFCYKCSSLVSNFNFGR

SEQ ID NO: 122078 - protein, 182 aa, Glycine max
  Coding DNA Sequence Number=SeqID_30393
MAQAIKKQNIVPHVLSRGEHPGRFRVAGDSVTIKQYFGSASRSSRKSTSMAPEDLEQLTQKIRDQLEESIIEKVTQQLMLFFGQMQSQELALPPEPKIGPSAACVSIKGSYVDTSGQESDMGDSKKYELYVDDNPSRLVSLVRVYEGSTTIHNTRLGNDQVKVDVQEVRHTDACIPVPTQEV

SEQ ID NO: 122079 - protein, 53 aa, Glycine max
  Coding DNA Sequence Number=SeqID_30394
MVKSELLKHQDRDEKLLAARCVYEITQITAPEKLPKPMKFSRPPYRYLLVDCR

SEQ ID NO: 122080 - protein, 96 aa, Glycine max
  Coding DNA Sequence Number=SeqID_30395
MGDDGKGSSVGWVGKGLTLMVGFLGLGARFESDSEPFLFLGSNRGWVLCFLVKDRGWGSEDEGWIFELQRCLLMVIFHHGDAAKDKGEEVRGGAIH

SEQ ID NO: 122081 - protein, 106 aa, Glycine max
  Coding DNA Sequence Number=SeqID_30396
MVAFVRQYQYNFDMVPDRMQLQNICKKGDGSFKEHAQKVEGSGGPGGTPNDGKGDDDRDSRHVTDLVFASKRIDVGPKRGKFDHPTRTTEKTGANEEGEKREKPML

SEQ ID NO: 122082 - protein, 65 aa, Glycine max
  Coding DNA Sequence Number=SeqID_30397
MLSKVRMRWTTITDPHKSLRREMRSSCSTCSWNVNAKMIFAWHCMLTCNNFLAWRRDLIGMEVQR

SEQ ID NO: 122083 - protein, 126 aa, Glycine max
  Coding DNA Sequence Number=SeqID_30398
SHEGKYLYLGACHSVWNFLETQADHQGGRGVTCARHGDLDTCCLVFLSESVGWTCLDYFLMNGTTLQLRVEVRYDVLIIANRTTVFGTSYSARPRGRAGFDGCLSVPETKTIRKQKNGHFLEFFGP

SEQ ID NO: 122084 - protein, 277 aa, Glycine max
  Coding DNA Sequence Number=SeqID_30399
MGSDGCRETRGTGTREATCKPRQDFNIQKEKERGSLFKIKSHVLSLFTHSEKFRSSRHLLTLLFFFPSHPPSLPIKAPNFAHHFYSKSQKEVIFGVVKRTSTLWDFKFQLGGVDGDPVLRGTRIRATWGYASSVDGGQLGMSGTWRYVVGVRRPWGRQGVLLPKTKLDQSRPNPGIASSWQSTNKKTKTTKQGGLCGGWPAMDFERYLEYGLWLRNEDRMLRWPLAIDYQCCVIDYTEQQGTGFHVLKLCNSSLAFGNRLPTGVIDYQRRKPLRHTF

SEQ ID NO: 122085 - protein, 74 aa, Glycine max
  Coding DNA Sequence Number=SeqID_30400
MAIEGFTMRRGVKERKGVNETPRRGAPLELVGLGSSSSMDSFASWKMNGSGMEKEEREETLLQGEDESRRSSSP

SEQ ID NO: 122086 - protein, 65 aa, Glycine max
  Coding DNA Sequence Number=SeqID_30401
MAVVVEVEKVGVRIEEVVVSEPRLVVEDQGMQRAFAKRITHGLNARKTLEEDELYRFAKCTASSH

SEQ ID NO: 122087 - protein, 118 aa, Glycine max
  Coding DNA Sequence Number=SeqID_30402
MNRLPHLVIDCPSQFQKKEDSQPDPTPSSISDASSIGACRPRIFFINGFLCFFEDEWQRNGERERERRRHFKEKMSLEEAHHHRRPWIRAWRKKEMNEGRGREEHEILCSKWALKSEV

SEQ ID NO: 122088 - protein, 148 aa, Glycine max
  Coding DNA Sequence Number=SeqID_30403
  Homolog annotation: Hit_ID=Q2A9Z5; Match level="QueryCoverage=43%, HitCoverage=17%, E-value=3e-08, Identity=37%"; Hit description=Gag -pol polyprotein, putative
TLVSIATPLGLEFIPQVKNLLDEGLVRKSLNPGALSVPKIGFIRHQIPKIGGMMNVLSGATLFCKITRAPNIFMIYVHRDSLGSDQGVPMNPKRIKVIPEWLTPPSIRKIWGFHDLTIFYKRFVPYFSILVAPLIELVRNHVPSWEDA

SEQ ID NO: 122089 - protein, 157 aa, Glycine max
  Coding DNA Sequence Number=SeqID_30404
  Homolog annotation: Hit_ID=A5AHJ1; Match level="QueryCoverage=57%, HitCoverage=33%, E-value=4e-12, Identity=44%"; Hit description =Putative uncharacterized protein
FTYIVNYLLGLGKTLEDEEMNIKILNCLKGTWEPKITTIKESKNLFTMTMEALFDKLLAYEHELTQQSYAEETEKKRKGITLKVNSSREEYQDSSNSDKIKHGDEKKGKKDRKEKKTYIACEDSASTTSNSSSDEEIANTCLMEKSINDPSTSEEIE

SEQ ID NO: 122090 - protein, 59 aa, Glycine max
  Coding DNA Sequence Number=SeqID_30405
MSKLDESFANVRLVEDIGPLIEPSKGTDTSNQRNDVWKLVELPQGKKAVGVQKQAGRGR

SEQ ID NO: 122091 - protein, 149 aa, Glycine max
  Coding DNA Sequence Number=SeqID_30406
  Gene Ontology: Mol. function=L-glutamine transmembrane transporter activity; Cellular component=integral to membrane; Biological process=amino acid transport
  Homolog annotation: Hit_ID=A7PAH1; Match level="QueryCoverage=95%, HitCoverage=30%, E-value=2e-56, Identity=72%"; Hit description =Chromosome chr14 scaffold_9, whole genome shotgun sequence
MQPVIRASLVLCSSIYILTALFGFLLFGESTLDDVLANFDTDLGIPYSSLLNDIVRISYALHLMLVFPVIFFSLRFNLDDLIFPSARPLDLDKCRFVLITTGLIALIYVAANFVPSIWDAFQFTGATATVCLGFIFPAAIALRWVFLLI

SEQ ID NO: 122092 - protein, 64 aa, Glycine max
  Coding DNA Sequence Number=SeqID_30407
MGDGQPCRMAEFIVGILIGGGILGRYISTMTSRLYIKIWLGRQQNDLISTMGSFYQNNWNWDLK

SEQ ID NO: 122093 - protein, 106 aa, Glycine max
  Coding DNA Sequence Number=SeqID_30408
MDKSLEEEGDERMGSYLAHGPEICPKAHENHRAFACISGPIYLESSIQCPCGVGLHHIGTKVVEGNDGNPMTPETLGGRLAIFIVPNCIGEGPKASMPVTGPMTIS

SEQ ID NO: 122094 - protein, 73 aa, Glycine max
  Coding DNA Sequence Number=SeqID_30409
MKRLKESDIVRDSAIVAKDVEHVDHPAHEERTDLNLASHARKVEKFGRLAPEIEGIVVIGNLYLLCGEVVEGN

SEQ ID NO: 122095 - protein, 105 aa, Glycine max
  Coding DNA Sequence Number=SeqID_30410
  Subcellular localization annotation: CTP_CleavageSite=12; ConfidenceScore=5.19e-01
MTPLMKNIQSLQAPHGGTSLRKVRFGLLPLRLLRKCSRLKIQRIILSSYSLMNIRERNLNYFFLHFFLYVLLHTLWEFISNPHLYEGSPSAEWLQMMAPSKKPPL

SEQ ID NO: 122096 - protein, 175 aa, Glycine max
  Coding DNA Sequence Number=SeqID_30411
MLKVASNALLDYAILRARFSGLELDEKPLPNREHHEVGRHYETLNHTFFIAETPFNRVCPWKRDFAIESDCNFSFMVQLPHSRFAFTHLVQPIIEEVNYNAEVDANLNTLAVKVYDPPPSGEYVRCVEEAFLITREALGSLDFHAPINLSSGDEFGDEFLRKFDEEVAKQKGEKM

SEQ ID NO: 122097 - protein, 503 aa, Glycine max
  Coding DNA Sequence Number=SeqID_30412
  Homolog annotation: Hit_ID=A7PF31; Match level="QueryCoverage=98%, HitCoverage=29%, E-value=6e-96, Identity=70%"; Hit description =Chromosome chr11 scaffold_13, whole genome shotgun sequence
MVSPKQLLGTIESALLGTSPPMAAHRVELLHALRTSRTSLQSLLSYPPPKPSDRSQVQSKSVRLPDSPPISLDDQDVHIALKLSDDLHLNEVDCVRLLVSANKEWGLMGREPLEILRLAAGLWYTERRDLITSLHLLLRAVVLDQGLQDDILVDIQKYLEDLISSGLRQRLISLIKELNREEPSGLGGPQCESYVLDSRGSLVERQAVVSRERLILGHCLVLSILDSASEVSESNATVKHQDSMIFQPNRVQNRLWYCFAASLSYSQSLLLASSLALCHDMMGSASSHLRLTLLKLLLSSSAIGGALGTVPDKASVLSSNTSFRHEFHELVMTTGNDPHVEGFVGGIRLAWVVHLMLIQDGVPARETISSGSSNELGYLSQCLEAIFSNNVFQFLLDKVLRTASFQTEDEDMIYMYNAYLHKLITCFLSNPLARDKIKESKERIMSVLSPYRVVGSHDFAQDSNSSSLHGTEMGPLPFNSILDFVSEIYQEPETGYNTECNFY

SEQ ID NO: 122098 - protein, 317 aa, Glycine max
  Coding DNA Sequence Number=SeqID_30413
  Pfam annotation: Domain name=zf-CCHC; Domain location=176-193; Score =7.9; E_value=0.097; Accession=PF00098.14; Description=Zinc knuckle
  Subcellular localization annotation: CTP_CleavageSite=15; ConfidenceScore=5.38e-01
MASTSSLPPPPPLSPAVTPSPITLFGIMKFSWSSKVMVYWIFWLLRSLRRDLILSLITLWEKLHAHFYSIARTKKRQLCMDLRNVSLENYRIIDYLLHIQTLVDSLTSIGDSVSQNSVQSELVFLHTPTSNNGGYINSGNYNNFGRGGGGWNNFYHGGHEGGCGRGAHGGGKFVDVQCQVCHKYGHEATYCHQSLTYGLYQLIFSSTLNLKPKHPLNLHNGFLPLLNLSILPFSPLPAPIHDTLLLSPTSSSALPLHLLKTYTPGCTILPFTDENPETSQIQAKGPSGEGQSPRVEKDEGPKAKTLSRLLIVAEGPD

SEQ ID NO: 122099 - protein, 72 aa, Glycine max
  Coding DNA Sequence Number=SeqID_30414
MKLELRINNLPYRIILTLATMVETTWLRHLPRRWTVMKLPRQWTVALLFTETSSMHLATSSRQAPLHNNNGG

SEQ ID NO: 122100 - protein, 147 aa, Glycine max
  Coding DNA Sequence Number=SeqID_30415
  Gene Ontology: Mol. function=RNA-directed DNA polymerase activity; Biological process=RNA-dependent DNA replication
  Homolog annotation: Hit_ID=Q2R4A2; Match level="QueryCoverage=51%, HitCoverage=27%, E-value=1e-08, Identity=41%"; Hit description =Retrotransposon protein, putative, unclassified
MFLSPKLMDLELDHENIEKRVTTDPKRIKFIPEWPTLPSIREIWGFLDLTYFYKRFVPYFSILVAPLIELVRNHVPSWEDAQEKGVKGRSLEFQESLDLRSNAFQGGWDDAILPPRALDRRLQEDWARDAGEGPKVLMSLRVDFGMG

SEQ ID NO: 122101 - protein, 38 aa, Glycine max
  Coding DNA Sequence Number=SeqID_30416
MTVKKRLSFEVQKVAVGAKRASTAKRRFSTLSAKENLA

SEQ ID NO: 122102 - protein, 82 aa, Glycine max
  Coding DNA Sequence Number=SeqID_30417
  Subcellular localization annotation: CTP_CleavageSite=59; ConfidenceScore=5.25e-01
MLKTPLAMHFGYFGVKTRFREEKSSRSTSVTLPEAILWKFFIVLRRSSPFFIRSSVILRSSTVFFSSVFNVLLTIYLSRFLV

SEQ ID NO: 122103 - protein, 491 aa, Glycine max
  Coding DNA Sequence Number=SeqID_30418
  Gene Ontology: Mol. function=sequence-specific DNA binding; Cellular component=intracellular; Biological process=response to DNA damage stimulus
  Homolog annotation: Hit_ID=Q82TW6; Match level="QueryCoverage=99%, HitCoverage=71%, E-value=1e-170, Identity=62%"; Hit description=DNA ligase
  Pfam annotation: Domain name=DNA_ligase_OB; Domain location=321-402; Score=164.7; E_value=2.4e-46; Accession=PF03120.7; Description=NAD -dependent DNA ligase OB-fold domain
  Pfam annotation: Domain name=DNA_ligase_ZBD; Domain location=407-435; Score=57.8; E_value=3.8e-14; Accession=PF03119.7; Description=NAD -dependent DNA ligase C4 zinc finger domain
  Pfam annotation: Domain name=DNA_ligase_aden; Domain location=4-319; Score=577.8; E_value=1.1e-170; Accession=PF01653.9; Description=NAD -dependent DNA ligase adenylation
  Pfam module annotation: Pfam domain module=DNA_ligase_OB::DNA_ligase _ZBD::DNA_ligase_aden; Domain location=321-402::407-435::4-319
MSAQEVALTLQQLKQRLAEYDYHYYVLDAPLVTDNEYDGLYRQLVEIEQQFPELVTPDSPSQRVGGQALSAFASVQHRQAMLSLNNAFSDDELEAFDRRVREGAGVSIVEYAVEPKFDGLAITLTYEQGLFVQGATRGDGYTGENVTHNLKTIRAIPSRLNMTNPPALLEVRGEVLMLKKDFEKLNQQQAAVGGKLFANPRNAAAGSLRQLDSNITAKRPLHFFAYGLGASDGVPELHSHAEAMQYLADLRFPVSVLRGVKTGVQGLRDYYAEIGEKRKDLPFDIDGVVYKVNDFDMQETLGFVSRAPRWAVAHKFPAEEATTVVEDITVQVGRTGAITPVARLKPVFVGGVTVTNATLHNEDELRRKNILIGDTVVVRRAGDVIPEVVLVKPELRPDNARTFVMPTVCPECGSHVVRLEDEAVARCTGGLICPAQRKQAITHFASRRAMDIEGLGEKLVDQLVARELIHHLDDIYHLDLPVLAGLDRMGR

SEQ ID NO: 122104 - protein, 167 aa, Glycine max
  Coding DNA Sequence Number=SeqID_30419
  Homolog annotation: Hit_ID=UPI00006A2939; Match level="QueryCoverage =85%, HitCoverage=75%, E-value=5e-10, Identity=30%"; Hit description =UPI00006A2939 related cluster
VDPWVLVPITLRGLHVLAIRGLHVLNLRGLHVLAIRGPHVLALRGLHALTIRGLHVLALRGLHALTLGLHVLTIRGLHALTIRGLHVLALRGLHALTLGLHVLALRGLHVLTIRGLHALTIRGLHVLALRGLHALTLGLHVLALRGLHILTIRGLHALTSRGLHVLA

SEQ ID NO: 122105 - protein, 86 aa, Glycine max
  Coding DNA Sequence Number=SeqID_30420
MDISCCAHFKISALSHHPAFQLAIVPEIAISPSSSLELVLGPKGNGVTKSSLLLQLDHCSTRWVTSSGLPGKLLFFFQELVGGMDT

SEQ ID NO: 122106 - protein, 144 aa, Glycine max
  Coding DNA Sequence Number=SeqID_30421
  Homolog annotation: Hit_ID=A0R741; Match level="QueryCoverage=81%, HitCoverage=65%, E-value=4e-25, Identity=49%"; Hit description =Putative uncharacterized protein
MAEYTLSVYLEKSEFNRGPHLDGAEGAEAIAAFISRPEHEEALASGLAHFTGLPLIDLREDSAVVTSYLQLIYLDDKGESRMLANHGSSPGYRIHRVVVNRWELKRIAGQWKIHRRTLIPVDGSGLSRALLSQGLKDVFSRQSR

SEQ ID NO: 122107 - protein, 190 aa, Glycine max
  Coding DNA Sequence Number=SeqID_30422
MSHHSSSVNGEGTSHKETLSKILDELSSLKLWKEKLEIKEKGKERVNINQDERKQIREEQRRKILKELRKEKQASYSSHNSCKSLSEELCDYYEGRHRSHLRPHSHRRENERKPQEANISLPYFHGKDNVEAYLDWEIRVEQKLKRKSTLKSYDSHLYPKKDQGLGISGAAPSKPKDDKGKTIEKQPPEA

SEQ ID NO: 122108 - protein, 161 aa, Glycine max
  Coding DNA Sequence Number=SeqID_30423
MWAFHTGRQIDWAHLVWYRMHKALRLNVPLPYPHLVTLFLQHFNIPLDSEPYVPIKRSFLISDVVVASFGYRKEHDGSWVKKGAQPNDDEGHVPVEGDFSLLQSILDRFDGLQTYVGERFDALERQMDMRFDAMDSRITKVEEDVTIIRDCLDLPLPPSSV

SEQ ID NO: 122109 - protein, 198 aa, Glycine max
  Coding DNA Sequence Number=SeqID_30424
  Gene Ontology: Mol. function=heat shock protein binding; Biological process=response to stress
  Homolog annotation: Hit_ID=Q8H2B1; Match level="QueryCoverage=22%, HitCoverage=27%, E-value=3e-16, Identity=88%"; Hit description=DnaJ -like protein
  Pfam annotation: Domain name=DnaJ; Domain location=133-186; Score =21.7; E_value=3.1e-05; Accession=PF00226.22; Description=DnaJ domain
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDIRTAYRKLAMRWHPDKWALNPATAGEAKRRFQQIQEAYSGYLANCIITVPSSNS

SEQ ID NO: 122110 - protein, 316 aa, Glycine max
  Coding DNA Sequence Number=SeqID_30425
  Homolog annotation: Hit_ID=A5AWV0; Match level="QueryCoverage=97%, HitCoverage=21%, E-value=4e-12, Identity=22%"; Hit description =Putative uncharacterized protein
  Pfam annotation: Domain name=Transposase_23; Domain location=37-107; Score=-0.3; E_value=0.0013; Accession=PF03017.5; Description =TNP1ENSPM transposase
MQSQGIALPPEPSLGPSDPQVSTKESCVDLSGNDPKTGDSNRCGLYIEANPARMVTLGRVYEGSTAVHNTPLLPGQVKVGVEEVKAPNAPVHVPTNEVSLVGQAIHTFLTWPTHLVKSLSQQTAVSLAKPPQKLDPKVNDLLYLMTLIIPELFLRPYQVTWDATVFGVFNPDFPLYIKHEDLSKIAHGGQCLSISVLQLWILHLTDTSMRAGNSDIYGFLDPQSIQRSGQSQFETESYIKNWMQSSKHDVYLGAYLNGGHWQMVVIVPKEHLVVWFCSLHNRPDNYLKGIINSALKGLDDAPQPKSKVLARWIVVK

SEQ ID NO: 122111 - protein, 228 aa, Glycine max
  Coding DNA Sequence Number=SeqID_30426
MWQPLGGLSLRPYKREVVIPHSGRKEDSCLLHSGELHDMETCLGVEELLQRMIDQGQLEVGNEGREEQHICMQSTDGSTVAKPKPLVTYFTKGTASQKPGHPLAAKPVPFPYQNSHAVPWRYTPPRGKEEEATDVSLLSAKVTNITGLSGVTRSGCVFAPPDLPVQPANVKGKAKVVEEQDDEIPLASNKDIPAKGLLEKKDGKKEVSLEAASEFLRIIQQSEFKVIE

SEQ ID NO: 122112 - protein, 108 aa, Glycine max
  Coding DNA Sequence Number=SeqID_30427
FCTIVGNDLPKESVPTNQLPLDETDRCTPRDIGVGSRFDPFGEIIYCHENEAMTVRSLGFDGPYDVYPPHGKRLRGGHDVQRMWRSIDIVRERLTFMAFPYMVSMVSQ

SEQ ID NO: 122113 - protein, 182 aa, Glycine max
  Coding DNA Sequence Number=SeqID_30428
KCLEERAKALENQAEWLSCMDILALLIFGVVLCPNMEGLVDLAVIDAFLAFHHGKKSPVVAILAMYDMFDRGCPSIRYKVTARASKKERRIGTNSWLAWREECHQTKASRLSSHGVSVTTTRGYSKEFARHGMRHEERTESLGEAVMGSSAAIIKSDEVQALKAELERARVVEEKFKSIAIK

SEQ ID NO: 122114 - protein, 209 aa, Glycine max
  Coding DNA Sequence Number=SeqID_30429
MIGRLLAGSLALESRILHYLIVRILLPRSSNLAQVSEEDLIVMWAFDTDRQIDWAHLVRYRMHKALRFNAPLPYPHLFTLFLQHFNIPFDSEPYVPIKRSFLIGAVVVASFGYRKEHDGTWVKKGAQPNDDEGQLPVQEDSSLLQSILDRFDGLQTYVGERFDSLEHEVDTRFEEMNSRIAKVEEDVPSFATALIYLHHHHHFRHYYYY

SEQ ID NO: 122115 - protein, 98 aa, Glycine max
  Coding DNA Sequence Number=SeqID_30430
MTLLSLYGFLTVENRRTHSQSQVRIHFHQPDLPLNKNGSNKAPPNQGAVGDSSYQGGSPQPTLNLGSTTRLRNESEGSARHSIFKRKGREGIKSRKKV

SEQ ID NO: 122116 - protein, 127 aa, Glycine max
  Coding DNA Sequence Number=SeqID_30431
LFWNPSFYVFFKPPTRKNHNLGTNISHHSPQFHRREKERKPQEANINLPYFHGKDNVEAYLDWKIRVEQQLKRKSTSKSYGSYSYPKKDQGQGILGVTPSKPKDDKGKTIEKQPFKASMQEKTSSIM

SEQ ID NO: 122117 - protein, 117 aa, Glycine max
  Coding DNA Sequence Number=SeqID_30432
MRERNVLIAKLATLREKELEKEYYDILMKDTSTISTLQLSYPIFIWGLSFVDLLILASRLMVLNTSYSESKEPFSILIRNAKDTRKKGQKRHFIEFLGSWLTHASLWLAWASQLLQE

SEQ ID NO: 122118 - protein, 238 aa, Glycine max
  Coding DNA Sequence Number=SeqID_30433
  Gene Ontology: Mol. function=nucleotide binding; Cellular component =intracellular
  Homolog annotation: Hit_ID=P0A3B2; Match level="QueryCoverage=94%, HitCoverage=42%, E-value=4e-15, Identity=33%"; Hit description=GTP -binding protein typA/bipA
MVKLPWLISCYSNPNVEALPDFGGDEHRIYVPWLTLVCGKEGKFVTFARSADALVKKAGAQRCADALKKPKTPMRSHKVSAPGRAPVRIENMVVTGFEMANSWTSRSRVYASALNGSGSDQKHGRHDASRCTRRLLTVYRRRDVDLDFRSGCRCISQLDYNNYVGVIGIGRQRARKTRSGKVGSTDSLVSSVRERRSEAVPAHGAEVYEGQIIGIHSRSNDLTVNCLTGKKLTNMRAS

SEQ ID NO: 122119 - protein, 192 aa, Glycine max
  Coding DNA Sequence Number=SeqID_30434
  Homolog annotation: Hit_ID=Q51617; Match level="QueryCoverage=21%, HitCoverage=59%, E-value=2e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSDPVPESLSSHSQSPSLPHLQISSSITARCLIRLQPPDLHSTLPPPPKIVATCAIDCASLWMQQCAN

SEQ ID NO: 122120 - protein, 172 aa, Glycine max
  Coding DNA Sequence Number=SeqID_30435
  Homolog annotation: Hit_ID=B0HC01; Match level="QueryCoverage=19%, HitCoverage=70%, E-value=4e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPSAVRYRQKCRHRSAVNRLPRTAGQSSDDTGGGCPGSSQTHFVDRGEGSWPHPMQALESNTIT

SEQ ID NO: 122121 - protein, 76 aa, Glycine max
  Coding DNA Sequence Number=SeqID_30436
GSRLQDTQWTRRSPTGVPVAPRKIIRPPTNRAFIKKYCVPRQAQGETPQQPGDGRQRATDAPPSPLEFISTHPQKG

SEQ ID NO: 122122 - protein, 201 aa, Glycine max
  Coding DNA Sequence Number=SeqID_30437
  Subcellular localization annotation: CTP_CleavageSite=32; ConfidenceScore=5.07e-01
MYYPGHHQHQSYAEPNVPPVHVPRFMSQHHPSQAQYQSTSFSGHASQGCQQSFQPLGFSSYIPQYSFQVPSISNVFDGSSQMFVTTFNTPPSAYNLAPSSFCYRPSLPTQIRDMSHEDEDKDEDNNNNNDDDDDGDGVDDDDNGGHHVPQQQWTITRQHPRTRGDRGCRPREQQTQTNSIQQDEIPRRISRRTSCGTSSHY

SEQ ID NO: 122123 - protein, 106 aa, Glycine max
  Coding DNA Sequence Number=SeqID_30438
MGCKESLIIAILADAMTHLTEDAKRAVQESSVAHLLFMDDWSLTSFIMKVDPSVPCKVTTHAPRKGRPIGSNSWLVWWGHPLIGSPDGRKEEPEFRPHARGSQTSP

SEQ ID NO: 122124 - protein, 55 aa, Glycine max
  Coding DNA Sequence Number=SeqID_30439
MPISPYGSISWGHSHKTPSGLGEVQQGLGDSSSGYEPLSVLQGARTPRQGHAIAT

SEQ ID NO: 122125 - protein, 132 aa, Glycine max
  Coding DNA Sequence Number=SeqID_30440
MVPRKLASKRSRKDKVAEGTSSAPDYDSHRFRSAEHQQGFEAIKGWSFLRERRVQLRDDEYTDFQEEIVRQRWASLVTPMAKFDPDIVLEFYANAWPTEEGVQDMRSWVRGQWIPFDADAISQLLGYPFSME

SEQ ID NO: 122126 - protein, 91 aa, Glycine max
  Coding DNA Sequence Number=SeqID_30441
  Gene Ontology: Mol. function=nucleoside-triphosphatase activity; Cellular component=chloroplast
  Homolog annotation: Hit_ID=Q2PMM5; Match level="QueryCoverage=79%, HitCoverage=3%, E-value=1e-33, Identity=97%"; Hit description =Protein ycf2
MANSSDSIVSSTMESDNELQTEFEKVKSLMIPSYMIELRKLLDRYPTSELNSFWLKNLFLVALEQLGDSLEEIRSFALGGNMLWGGGPHLW

SEQ ID NO: 122127 - protein, 62 aa, Glycine max
  Coding DNA Sequence Number=SeqID_30442
MFIQPYSSLTTPPPHVEHAIYDWADLEINSGAQHKSKNHNESLEISNNNLLSQPTLRQEGDA

SEQ ID NO: 122128 - protein, 167 aa, Glycine max
  Coding DNA Sequence Number=SeqID_30443
MAPTRHPMDPDKSNRALGFPALITGLCQSFGVPVAPTKVIRPPITQAFIEKYCTQRQAQGDAPQAAGAPPPPHQAGPAGSFDMEQYLQHLVRQQAANHRAHVQTHDWLRFFFMPYSRPVHGRGRMARGLARGPSRRGTPRGSRRWRGGHEDEEMADLLDFLGGSGAT

SEQ ID NO: 122129 - protein, 178 aa, Glycine max
  Coding DNA Sequence Number=SeqID_30444
MGSDHRLPSTKEGGRQMGYIQTVPPPPVHDSLTGTDKDDRWVQFADHVAPTGELCVVPGQVAPNYMEWFFQISHLFVTPTEDSAEPRPVPSLPTHDDDFVEPPVAQVSVTSDPPAHSVVDCTACVRMGRIAEHLEHVINLRMVTAGTDLYDIMDLCLRIARDDDPDDSLRPRQRPRIY

SEQ ID NO: 122130 - protein, 48 aa, Glycine max
  Coding DNA Sequence Number=SeqID_30445
MEDIASLDSSNERPLASSLSLEEGEVVCLILATINVLAPHNLDFVVGH

SEQ ID NO: 122131 - protein, 239 aa, Glycine max
  Coding DNA Sequence Number=SeqID_30446
  Homolog annotation: Hit_ID=A7QUI1; Match level="QueryCoverage=100%, HitCoverage=55%, E-value=1e-54, Identity=49%"; Hit description =Chromosome chr10 scaffold_179, whole genome shotgun sequence
LQTQIQTEIAIGNPSEGDVRDAIEKVLALDKAYPLPLLGGAMLEKFPAKFEAARWWPKSRLSSNDKDKIMDIKNNNNNGWNVELEEEMREVIKVFKRKDMEDYERLGNIALKINKGFVVSAPLLTGIAALGSVFSGDGLVLALAGALATVVNAFEHGGQVGMVFEMYRTCGGFFQLLEETIEAAIEEKDLDKRENGELIEMKMALQLGRSVSQLRELATKSASCRIEGREIHEFASKLF

SEQ ID NO: 122132 - protein, 124 aa, Glycine max
  Coding DNA Sequence Number=SeqID_30447
MKVAQDTRKKRKGNTQASKREVTQAKSIGMKFKIGIILEAAHIFGKVLQTKHKQIKGERIPLSKTPLPFEVAINGSIDCHTKGSGRNTFHDPSTKLSREANGLKHPIQEFPGNGIITNYSKIWV

SEQ ID NO: 122133 - protein, 104 aa, Glycine max
  Coding DNA Sequence Number=SeqID_30448
MEDGYAVSSEVGQVHLRMRKMLPVEVLDTAFLTSMIRPSKVGMIPPPRIVPIAGEVIIVLLWLILLLRLRRSIVEVYSISFRLFNCFKLLHIRAKVCVVVCRGA

SEQ ID NO: 122134 - protein, 195 aa, Glycine max
  Coding DNA Sequence Number=SeqID_30449
MAKFDPKIVLEFYANAWPTEEGVRDMRSWVRGQWIPFDTDALSQFLGDPLVLEEGQQCEFSQRKNKANGFDEEAIAQLLCILGQDFTRTTVGKRVRIMRTSMTTLTQTWMTLLLSNVLPSYHNSDLPLPKCQLVYAILTWMSVHVAQVIADAIYLFASMAPSRHPLDPDKSNRALGFRADHGLCQSYEVPITPSM

SEQ ID NO: 122135 - protein, 88 aa, Glycine max
  Coding DNA Sequence Number=SeqID_30450
MSLHVLYLYAFSGFPPGISRLLYLSLQSFKEMNGQDHLELPSGVGTKHGKQKPIKVLRKGCKWDGVTTDWSLPFLCAKQTENVAARQP

SEQ ID NO: 122136 - protein, 41 aa, Glycine max
  Coding DNA Sequence Number=SeqID_30451
MEKNEETTMEEKLQWGPLMVIFHHGDAAEDKGKEVRGGAIH

SEQ ID NO: 122137 - protein, 65 aa, Glycine max
  Coding DNA Sequence Number=SeqID_30452
MRIKIHEAQCGPPWQNRGDACRPARPGELSSPRRARLLPSRSNSLLEEYSGGPKWAWVLFAPPFY

SEQ ID NO: 122138 - protein, 46 aa, Glycine max
  Coding DNA Sequence Number=SeqID_30453
MMQSYPPRALDRRLQEDWAKDARKGPKVGYPRNVGFFSPCILGYID

SEQ ID NO: 122139 - protein, 71 aa, Glycine max
  Coding DNA Sequence Number=SeqID_30454
  Gene Ontology: Mol. function=ATPase activity, coupled to transmembrane movement of ions, phosphorylative mechanism; Cellular component=membrane; Biological process=metabolic process
  Homolog annotation: Hit_ID=A7P4F0; Match level="QueryCoverage=98%, HitCoverage=12%, E-value=7e-17, Identity=58%"; Hit description =Chromosome chr4 scaffold_6, whole genome shotgun sequence
MKKEGSLRFYKPKLGYIFCDMDGTLLNSKSQISSTTANALREATSMGVKIVIATENCDKIIMVILTKLQIL

SEQ ID NO: 122140 - protein, 46 aa, Glycine max
  Coding DNA Sequence Number=SeqID_30455
DKGVPMNPKRINVILEWPTPPSVEEKSLEFQKPRDLRSNPFQGGRE

SEQ ID NO: 122141 - protein, 107 aa, Glycine max
  Coding DNA Sequence Number=SeqID_30456
  Homolog annotation: Hit_ID=A6FJQ2; Match level="QueryCoverage=35%, HitCoverage=84%, E-value=3e-11, Identity=92%"; Hit description=50S ribosomal protein L5
  Subcellular localization annotation: CTP_CleavageSite=48; ConfidenceScore=5.56e-01
MKIGVSRGPFVSRVSVMTVKTSDTGSSRRRSQLVCKRMTGADKPVRARQRMRKEKIPHQAPFAIQAAQLLGRAIGAGLFAITPAGERGMCCKAIKLGNARVFPVTTL

SEQ ID NO: 122142 - protein, 140 aa, Glycine max
  Coding DNA Sequence Number=SeqID_30457
TLVSIATPLGLEFIPQVKELLDEDLVRKSLNPCALLVPKIGIIRHHIPKIGGMMNVLSGATLFCKITRAPNIFMICVHRESFGSDKGVPMNPKRIKVILEWPTPPSVEEKSPEFQEPRDLRSNPFKGGGNDAILLLKGIR

SEQ ID NO: 122143 - protein, 110 aa, Glycine max
  Coding DNA Sequence Number=SeqID_30458
  Subcellular localization annotation: CTP_CleavageSite=52; ConfidenceScore=5.17e-01
ISPTKTPSGPGEVQQGPGGSRLQDTQWTRRSPTGSWSCQALITGLCQFYGVPVTSSKGIRPPTNRAFIKKYCVSRQAQGETPQQPGDGRQRATDAPPSPLEFTSAHPQKG

SEQ ID NO: 122144 - protein, 148 aa, Glycine max
  Coding DNA Sequence Number=SeqID_30459
PGRTDSGPQPELETQGPCWTSPGPLGGDRSCGGVHDPYSSPCSGWVKSSPSMHSSCTIASLSGYACTVGRPPISGGGPGTDKRKLLAPHPGAQALIKHQGRRTLSSLKAQMWSPMKARACNPMKVRACSPQKARTCSPLKARACSPLK

SEQ ID NO: 122145 - protein, 96 aa, Glycine max
  Coding DNA Sequence Number=SeqID_30460
  Homolog annotation: Hit_ID=A5BSR3; Match level="QueryCoverage=66%, HitCoverage=20%, E-value=5e-07, Identity=45%"; Hit description =Putative uncharacterized protein
MTRTKKIGQMTFEAAKEIAEKIDSLEEQASQGLFVPHGHQDLLIAVIGRPKHPGRVRAAGAGVTIKKYFGSAPRTSHSLSSMAPEELEQLIQQIRN

SEQ ID NO: 122146 - protein, 80 aa, Glycine max
  Coding DNA Sequence Number=SeqID_30461
MSFFLFPRRYQRIRNRFKCWLRCCRNLPFLQASEARLTGASSKGGKCTESPPTFIERKTLEKPKEIGHEEYSRFGSCIYV

SEQ ID NO: 122147 - protein, 138 aa, Glycine max
  Coding DNA Sequence Number=SeqID_30462
  Gene Ontology: Mol. function=heat shock protein binding; Biological process=protein folding
  Homolog annotation: Hit_ID=O82368; Match level="QueryCoverage=82%, HitCoverage=37%, E-value=1e-25, Identity=50%"; Hit description =Uncharacterized protein At2g29880
MGDSQENNKGKSRDKDNYVSWTMEDTNELLHLLVDAMNRGLRDANGSLSKQNVERIILPQLNAKTKFPKTYSHYLSRMKWFRNQYNMMSTLMRNNSGFGWDPIGKTFTAHEDVWKDYLKDCIGAIDGTHIPASVNGRA

SEQ ID NO: 122148 - protein, 138 aa, Glycine max
  Coding DNA Sequence Number=SeqID_30463
  Homolog annotation: Hit_ID=A0ST23; Match level="QueryCoverage=23%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPKSAIHMTTQQTIEAINPEKVGKPVVPAALMNRPTRGERRFAYWALFRFLAH

SEQ ID NO: 122149 - protein, 107 aa, Glycine max
  Coding DNA Sequence Number=SeqID_30464
ETRGTGTRETARKPRQDFSISKPHIFRSSLSLSLTLLFFLPHSPLKLHTKLQPLAIISAPNRERRAFSGVVKCVAMSGTSKFQDLIWARLDEGKCGFRNMLFVQILL

SEQ ID NO: 122150 - protein, 181 aa, Glycine max
  Coding DNA Sequence Number=SeqID_30465
MERNIILYVTEYDEFRRELDRRSWHKALTMQLDGHIDVALVKEFYANIYDPEDKSPRQVRVRGKLIKFDAESLNSFLETPVILEPGEHYTTYSRFCHSCPNPQEFAARLCILGCGFVLNTEGAPWKLLRKDLTTLAKTWTVLSYSNLAPTSHTSDLNMDRARLVYGLVMKMDMDLGSLISG

SEQ ID NO: 122151 - protein, 154 aa, Glycine max
  Coding DNA Sequence Number=SeqID_30466
  Homolog annotation: Hit_ID=A0ST23; Match level="QueryCoverage=31%, HitCoverage=97%, E-value=9e-12, Identity=70%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPNWHPAPQFLITFKSKGTELEFVIMVIAVSFGKPVVPAALMNRPTRGERRFAYWALFRFLAH

SEQ ID NO: 122152 - protein, 60 aa, Glycine max
  Coding DNA Sequence Number=SeqID_30467
MGCQWPKAKTVSWKGIYQDTGHCSFDRQVSPFAKRLLLAKCIITYALSHEFKRLVHQPGT

SEQ ID NO: 122153 - protein, 98 aa, Glycine max
  Coding DNA Sequence Number=SeqID_30468
MSVASSFLSLGDTYLHGTAWLFRYRKGTGLATEGYQSFWEAVSLVKYITKGLGLPKLLSSADCIHICCSSLPSSPTSSRLDLSSAATIPPLLNMFPCM

SEQ ID NO: 122154 - protein, 72 aa, Glycine max
  Coding DNA Sequence Number=SeqID_30469
MKQSALITCLSQTEWRRKRERRCHFKEKMSLEEAHHHRRPWIKAWWKKKMNEGRGRQEHEILCSERALKSEV

SEQ ID NO: 122155 - protein, 49 aa, Glycine max
  Coding DNA Sequence Number=SeqID_30470
MDTDSTGDFLEASVPPLMKKLAANLLNVLLSLSAISGGYSLLSTYRLMS

SEQ ID NO: 122156 - protein, 217 aa, Glycine max
  Coding DNA Sequence Number=SeqID_30471
  Homolog annotation: Hit_ID=A5C062; Match level="QueryCoverage=99%, HitCoverage=13%, E-value=2e-07, Identity=23%"; Hit description =Putative uncharacterized protein
MKTLMHIWQHSLKSVYTEKPRSGSIHFKGNSLKTWEEVVEKFLKKYFPGLLRKTPSHGLSEPTQLNIFIDGLRPQSKQLLDAFAGGKIKLKTLEEATKLIENMSASDHAILRDRGHQPTKKSLLELSTQVVPYVVVLMNPVFAFLLKSKRKRLATWGINKGRDTIKGPYNQQGQWRSHPDNQFNKDQGGPSNRPPQQGPNIFQRTTKLEETLTQFMQ

SEQ ID NO: 122157 - protein, 111 aa, Glycine max
  Coding DNA Sequence Number=SeqID_30472
  Subcellular localization annotation: CTP_CleavageSite=50; ConfidenceScore=5.15e-01
MSSAFASKTIKSVGQQRQSKSSTSFLKTSMSFDQDYHSLLGLQDYQVYSPAETIKAITVFFASETIKFVEATTSKIILMMPKNQELSKFQRMRSQNASRIKFQRIKIQEQS

SEQ ID NO: 122158 - protein, 15 aa, Glycine max
  Coding DNA Sequence Number=SeqID_30473
GECCEISPDARNGLG

SEQ ID NO: 122159 - protein, 105 aa, Glycine max
  Coding DNA Sequence Number=SeqID_30474
MKRNVDHHGNIGEKLAAQLAQASKVASSRSNSLLEGPSGPAFEEVTETHGLPKDTSFRLLPHYGISRIAQTYFLLISETSRDFIYCATKDAKYLKAANQRLHVIK

SEQ ID NO: 122160 - protein, 135 aa, Glycine max
  Coding DNA Sequence Number=SeqID_30475
  Homolog annotation: Hit_ID=A0ST23; Match level="QueryCoverage=35%, HitCoverage=97%, E-value=7e-12, Identity=70%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPSQGTELEFVIMVIAVSFGKPVVPAALMNRPTRGERRFAYWALFRFLAH

SEQ ID NO: 122161 - protein, 241 aa, Glycine max
  Coding DNA Sequence Number=SeqID_30476
MTTEAAKEIAEKIGTQGSFIPHVRQDVLTAAIGRPEHLGRVCAAGAGVTIKQYFGSAPRTSRSSSFLPPEELQQLTQQIRDQLEESITEKVTRQLMALFSQMQSQMQSQGLALPPEPLVGPSGPRVSTKGSCIDLSGNDPKTGDSDRCGLYIEANPVRLVALGSVYEGSIVVHNTPLLPGQVKVGMEEVKDADAPVPVPIVEVSLVGQTIHTFLARPTHLVKSLSQQLCLRKNHLKSLIRW

SEQ ID NO: 122162 - protein, 126 aa, Glycine max
  Coding DNA Sequence Number=SeqID_30477
MKWKIGRTKKTDRMTSEAAKEIAEKIERFIGGAGLTWFLCRPWTLGCTDCCHWATRTRWSCACCWSRCHHQAILWTDSKDLLHVFLHGSRRPGVANATNQGPAGGVDHIKSDSTANIILQPDAIPV

SEQ ID NO: 122163 - protein, 50 aa, Glycine max
  Coding DNA Sequence Number=SeqID_30478
MEAGSLSFNEVLQWQRRRGEGRHHPQGNKPRKKELHHQELTWIKSLKRML

SEQ ID NO: 122164 - protein, 109 aa, Glycine max
  Coding DNA Sequence Number=SeqID_30479
MTRGNPGDLQPFDPEIDRTFHRLVRHSVHPDHSVHFEHCEHFEHFEYSVAGESEYSDFEHSTTNFHIENMAQPPPHERTLREMAAPDFTYEACAFNILMRVFHMFSRLD

SEQ ID NO: 122165 - protein, 87 aa, Glycine max
  Coding DNA Sequence Number=SeqID_30480
MPEIKRKYCYAIRPLGPSRMFLQKEVASGGSNLARLGELGGKLLPDFPINKGRSEGERGSALLVLRNHLKLVRKIVSVKKIQAEVLP

SEQ ID NO: 122166 - protein, 140 aa, Glycine max
  Coding DNA Sequence Number=SeqID_30481
  Subcellular localization annotation: CTP_CleavageSite=38; ConfidenceScore=5.34e-01
MEKITKGSSSTTTAAGHRCQGTSRDPPTPVPPSISTPRSSTLFSSDDQHQRYYAQFCNRVILDPKYLDLEFFDEETFDCYQIWDDVLYSEVHSIPIVVDQSLFYSLTKLPSQGVPFKGTLVDDWKFDYSSHDAHRMVCND

SEQ ID NO: 122167 - protein, 248 aa, Glycine max
  Coding DNA Sequence Number=SeqID_30482
  Gene Ontology: Mol. function=dihydrolipoyl dehydrogenase activity; Cellular component=cytoplasm; Biological process=cell redox homeostasis
  Homolog annotation: Hit_ID=A3I207; Match level="QueryCoverage=97%, HitCoverage=52%, E-value=1e-66, Identity=51%"; Hit description =Dihydrolipoyl dehydrogenase
  Pfam annotation: Domain name=GIDA; Domain location=5-244; Score= -221.8; E_value=0.0022; Accession=PF01134.13; Description=Glucose inhibited division protein A
  Pfam annotation: Domain name=HI0933_like; Domain location=4-240; Score=-275.3; E_value=0.079; Accession=PF03486.5; Description=HI0933- like protein
  Pfam annotation: Domain name=Pyr_redox; Domain location=175-244; Score=47.4; E_value=5.1e-11; Accession=PF00070.18; Description =Pyridine nucleotide-disulphide oxidor
  Pfam annotation: Domain name=Pyr_redox_2; Domain location=5-233; Score=122.4; E_value=1.4e-33; Accession=PF07992.5; Description =Pyridine nucleotide-disulphide oxidore
  Pfam module annotation: Pfam domain module=GIDA::HI0933_like::Pyr _redox::Pyr_redox_2; Domain location=5-244::4-240::175-244::5-233
MENYDVAVIGSGPGGYVAAIRSAQLGYKTVIIEKYTTLGGTCTNVGCIPTKALLDSTHHYAEAQHGFGSHGIMLNEINLDFSQMYKRKSEVVTKNTSGLEFLMNKNKITHIQGMARFINDSTIQISGKEGEQTVVAKHYIIATGSKPSTISGIEIDKKRIITSTEALSLQEKPKTMIIIGGGVIGVEMASIFSRIGTKVTILEYADHLISTMDHGLGRSLQKILKKEGIEIHLNQSVYKAENLGASAK

SEQ ID NO: 122168 - protein, 66 aa, Glycine max
  Coding DNA Sequence Number=SeqID_30483
  Homolog annotation: Hit_ID=A7PWG3; Match level="QueryCoverage=60%, HitCoverage=8%, E-value=1e-12, Identity=82%"; Hit description =Chromosome chr8 scaffold_34, whole genome shotgun sequence
LVYGAELGQLPSISHVDFRICVQIALGQGYSLHVDIQYLDARWEVLVVLPLRDCFAQEINMLCRLD

SEQ ID NO: 122169 - protein, 250 aa, Glycine max
  Coding DNA Sequence Number=SeqID_30484
  Homolog annotation: Hit_ID=Q2HW90; Match level="QueryCoverage=68%, HitCoverage=31%, E-value=4e-21, Identity=36%"; Hit description =Putative uncharacterized protein
MSFWGKETVSFLRVSSLLEQDCSCGQGFGKRVGSCKANSKRRSGPTTEVLRRQGKGYGESRGVVPFMDVLALLIFVGVLFPNMDGLVDLAAIDAFLAYHHNKESPAVAILADLFDTFDRRCEKSSAQIIFCLPALCVWLVSHLLQQDIRHPCPLRSHRSCVKKRRVDWDQHLAGIGGRTINWFPRWKEGKEGVIFSCGDYPNIPLIGTRGCINYNPALAIRQLGYPMRGAPTEESLSPFLVRDFGAQSFK

SEQ ID NO: 122170 - protein, 83 aa, Glycine max
  Coding DNA Sequence Number=SeqID_30485
MATARWALKHPVYGIVILRLGIYTNRPNVSKTTFLNEKLYTVPKFQQTLLTTTNISFLNDHLEETLGPTKIGENHSKCINLTQ

SEQ ID NO: 122171 - protein, 124 aa, Glycine max
  Coding DNA Sequence Number=SeqID_30486
  Subcellular localization annotation: CTP_CleavageSite=68; ConfidenceScore=5.55e-01
MLVRMIRTRLFAAARVKSCLSMHSSSVIASLSSCARTVGPPPISGGGPGTVWMSSTLKMRTRSPLKVRACSPLKARRCSPLEMRACSPLLARTCSPFKVRACNPLMVRTCSPLKGRTCSPLNGE

SEQ ID NO: 122172 - protein, 145 aa, Glycine max
  Coding DNA Sequence Number=SeqID_30487
MGGTKRLLVIIPKVIISLLMVSRGIIPLEKHIVAVGTTNNNMSSKRKTLDEGSLLSSKSETQHVREIIILHKIRRPNSLKTVPNGVANCRNLPFDGRARGCVFHEREMCVVATNVYSRKTSEKSEMCGLRTLSVTGSGVVFTHGE

SEQ ID NO: 122173 - protein, 191 aa, Glycine max
  Coding DNA Sequence Number=SeqID_30488
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
  Subcellular localization annotation: CTP_CleavageSite=32; ConfidenceScore=5.23e-01
KRKSAQYANRLSPRVGRFINAAGTTGFPTGKRAVSATQLIGRQRRRGERRHQSLGNKPWKKEHHHQECALDKKLGEDASMEEKKEKEKERGEHEIKGGFYGGWIFELQWDPSMVIFHHGGVAQDKGEEVRGGANHWGISMQAWHWPSFYNVVTGKTLALPNLIALQHIPLSPAGVIAKRPAPIALPNSCAA

SEQ ID NO: 122174 - protein, 132 aa, Glycine max
  Coding DNA Sequence Number=SeqID_30489
GDKLEACQKSKRSLSEQLGKTEENMWAIIDQYKEKLSLAETHEQRLEDEYAKVLVLQAEREARERVIDSLHIEAMMWMNRFAFTLNGSQELPRLLAKAKAMVDVYSALEEVHGLLDYCQHMINLMAHVVRNR

SEQ ID NO: 122175 - protein, 109 aa, Glycine max
  Coding DNA Sequence Number=SeqID_30490
  Homolog annotation: Hit_ID=Q2HW90; Match level="QueryCoverage=79%, HitCoverage=17%, E-value=2e-10, Identity=37%"; Hit description =Putative uncharacterized protein
MGTNQNGKRFYQVKVKGLDVTSLKELGRLMGPLQRQAFRKVYGKILDLTTAEVFTEAVVSLAQYYDQPLRCFTFGDFQMVPTVEKFEEILGFPLGGRKPYLLSGFLPSL

SEQ ID NO: 122176 - protein, 100 aa, Glycine max
  Coding DNA Sequence Number=SeqID_30491
MTVKPRTHAAPGDGHSLSVTGCREQTSPSGRVTGCCRCPGLAELCGIRADCTESAPYAAAQLLGRAIGAGLFAITPAGERGMCCKAIKLGNARVFPVTTL

SEQ ID NO: 122177 - protein, 82 aa, Glycine max
  Coding DNA Sequence Number=SeqID_30492
  Subcellular localization annotation: CTP_CleavageSite=77; ConfidenceScore=5.64e-01
ISKLIWSTKFRALLSLSLHSSPSSSKLLSMASYGVASPLSLPSPFHFHSSSKKQRNPLMKKILGLQAPMELASCGIRASSSR

SEQ ID NO: 122178 - protein, 73 aa, Glycine max
  Coding DNA Sequence Number=SeqID_30493
  Gene Ontology: Mol. function=hydrolase activity, acting on acid anhydrides, in phosphorus-containing anhydrides
  Homolog annotation: Hit_ID=A3NNL7; Match level="QueryCoverage=100%, HitCoverage=36%, E-value=3e-20, Identity=61%"; Hit description=NTP pyrophosphohydrolases including oxidative damage repair enzymes
MSPGSVTEKLYFYVAEYQPKDRTGTGGGIKAEGEDIDVLEMPLEEALRGIETGKIVDGKTIMLLYHVALKGIL

SEQ ID NO: 122179 - protein, 119 aa, Glycine max
  Coding DNA Sequence Number=SeqID_30494
MAPTRHPLDPEKSNRALGFPALITGLCQSYEVPVTPSKGDAHQDAGTPPPPRQADSAWPLGVERYLQHLVRQQAANHHGHVQIHECLYQFSLSQQGQGSAPFVCPTLEQFGAEVAWPGD

SEQ ID NO: 122180 - protein, 90 aa, Glycine max
  Coding DNA Sequence Number=SeqID_30495
  Subcellular localization annotation: CTP_CleavageSite=29; ConfidenceScore=5.21e-01
MWRKSKRDVFAQSQLGPLGPSRFFLQKAVASGGSNLARLGELGGKLLPYFAINRGRSEGRRGSAFLALLILSKLLRKITSVKKIQAEVLP

SEQ ID NO: 122181 - protein, 96 aa, Glycine max
  Coding DNA Sequence Number=SeqID_30496
  Homolog annotation: Hit_ID=A6FJQ2; Match level="QueryCoverage=39%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARIFQKKIDLLQHQAVAAQKRKLLYNHGGCTSSVPSPGLKSYFVSFGT

SEQ ID NO: 122182 - protein, 239 aa, Glycine max
  Coding DNA Sequence Number=SeqID_30497
  Gene Ontology: Mol. function=zinc ion binding
  Homolog annotation: Hit_ID=A7UQU7; Match level="QueryCoverage=84%, HitCoverage=42%, E-value=9e-17, Identity=29%"; Hit description=IMP dehydrogenase/GMP reductase, putative
  Pfam annotation: Domain name=DUF1723; Domain location=43-92; Score =45.2; E_value=2.3e-10; Accession=PF08330.1; Description=Protein of unknown function (DUF1723)
ERPKLKLSSHERKVHSLGRPVPAIEGLVAGTGLSPLIACSIYTGDRGLLSSFIERSHQETSSFHLPVGEVTITLDDVAYLLHFPVVGDFHAFQPVHVDDAVQMLVELLIVPAEAARVETAQCRGPDARQDIGQLRLAFRDFSQAGRYAWGVVVLVHMYDHLNDASISTSRQLGGYITLLQCWIYEHFPSVAKSITDPDYDEDSPRAWSAWTDSGFWMSVGSHMGSTDRSGTSIGFHAIP

SEQ ID NO: 122183 - protein, 171 aa, Glycine max
  Coding DNA Sequence Number=SeqID_30498
  Gene Ontology: Mol. function=transferase activity; Cellular component= cytoplasm; Biological process=biosynthetic process
  Homolog annotation: Hit_ID=A8GFV0; Match level="QueryCoverage=66%, HitCoverage=32%, E-value=6e-39, Identity=68%"; Hit description =Glycosyl transferase group 1
  Pfam annotation: Domain name=Glycos_transf_1; Domain location=1-153; Score=82.0; E_value=1.9e-21; Accession=PF00534.11; Description =Glycosyl transferases group 1
MSGDRERFAVPRTGADAGAAAKGGAGGGAFEQSEGLRSPDRAVARGGGADAGLARQVSLLPATADVADYYRQASLYVMTSRYEGLPMVLIEAMSFGMPLVAYDCKTGPAELIDDGVNGYLVPDDDAAAFSEGVIKLMLDPGLRERFSVAALEKSRRFSPERIYPQWQQLTE

SEQ ID NO: 122184 - protein, 33 aa, Glycine max
  Coding DNA Sequence Number=SeqID_30499
MEMQRTDTRRQIVRGGTIHKGNKPWNEKLHHQE

SEQ ID NO: 122185 - protein, 103 aa, Glycine max
  Coding DNA Sequence Number=SeqID_30500
MLMCNHQFSCVGPIELLCTIGRTPDGILNLLQATMTPTHDALLYYNERWNMPCQHDFVGYSFTGKNPKKFDIPFGCTIDELKDLIKQVAPQGIPLMIFMNHKR

SEQ ID NO: 122186 - protein, 86 aa, Glycine max
  Coding DNA Sequence Number=SeqID_30501
MDNKKRRPIICRTKPNLNKTFKEDTKAIEVVQVQVSLMVGDHTIMHILVQITLLLQVLLTTRMEVLQIRVHNNKLSQIECPKWKIL

SEQ ID NO: 122187 - protein, 347 aa, Glycine max
  Coding DNA Sequence Number=SeqID_30502
  Homolog annotation: Hit_ID=Q6WAY6; Match level="QueryCoverage=35%, HitCoverage=21%, E-value=4e-13, Identity=33%"; Hit description =Putative uncharacterized protein
MDWDQLLAGIGSRTISWFPRWKEGKEGVLFSCGRYPNIPLVGTRGCINYNPTLAIRQLGYPMRGASTEESMSPFLVRDLGAQNSKTIQRIHKAWETPLRKDQELRGIRNGIIGGYHEWLKVRIRGLDWLAKLKVVSEENFEAPEEDEEVQALKSELGKAKLAKEKFKLAATHVRKECAGLREENTITARALERETKRARKEEYGRNKFHGALWGSNNELKLRREDRDQSRAHSMRLCETETNMLAIITKYQEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 122188 - protein, 54 aa, Glycine max
  Coding DNA Sequence Number=SeqID_30503
MVPLTSIRGRILPKKEGMIKDYLRRKSLAWVGSTWIDQSLEQGVRDFNKSLARD

SEQ ID NO: 122189 - protein, 179 aa, Glycine max
  Coding DNA Sequence Number=SeqID_30504
AFFVRQAFEQLFQLPPNLLSQHNMLKNREPPRDCRRELAYKKKIGRLPEGLSDPINCVSRSALARVLFLYERDSIQICHSLGDALFSMNTPPLNDELCQSSPPTRPGENTESSQALTRQNGIHISFVWASVLAYEFPAFELSSRALIEEVAQPFFIYAKRNYFLFYSTGNGASRSIPKA

SEQ ID NO: 122190 - protein, 61 aa, Glycine max
  Coding DNA Sequence Number=SeqID_30505
MTGHNGSHIIWLILAGSSGQTLTHKEGGNMVNVPLKTKMCARLARLGELSSPGRATRAFKI

SEQ ID NO: 122191 - protein, 125 aa, Glycine max
  Coding DNA Sequence Number=SeqID_30506
SFRVPVTLSKAPDAPPPPPQADPAGSFDTEQYLRHLVRQQAANHRAHLQTHDCLYQLSLSLQSQGFASFPCPTPDQFRAEVAWPGDWPEDQAGEAPAEAPDDAYEARMDEEMTDLLDFLGGSEAT

SEQ ID NO: 122192 - protein, 95 aa, Glycine max
  Coding DNA Sequence Number=SeqID_30507
  Subcellular localization annotation: CTP_CleavageSite=50; ConfidenceScore=5.04e-01
MQNYQYAKRCDSVKAKTNRKRVMQQKRHGHAESSSQPTVNCTSEYNMIVSDSSESENSESTQGSGSNFMTPFEDCQSPTNQPVINTEGNDYNSDF

SEQ ID NO: 122193 - protein, 88 aa, Glycine max
  Coding DNA Sequence Number=SeqID_30508
MGSQIYPKVYENPKAFFINSSPILLEPLAHGSGNWSFPKEDCIRLGPPNHPRPLCRFEFALRDPILYAKALNRTAILLKEGRNPEKKY

SEQ ID NO: 122194 - protein, 145 aa, Glycine max
  Coding DNA Sequence Number=SeqID_30509
MAPTRHPLDPDKSNRALRFPALITGLCQSFGVPVAPSKRQAQGDAPQAADAPPPHQAGPAGSFDTEQYLWHLLSLSLQSQGFTSFPCPTPDQFRAEVAWPGDWPEARAGEAPTEAPAEAPDEADEAREDEEMTDLLDFLGGSGAT

SEQ ID NO: 122195 - protein, 257 aa, Glycine max
  Coding DNA Sequence Number=SeqID_30510
  Gene Ontology: Mol. function=RNA-directed DNA polymerase activity; Biological process=regulation of transcription, DNA-dependent
  Homolog annotation: Hit_ID=A7QL19; Match level="QueryCoverage=72%, HitCoverage=33%, E-value=5e-40, Identity=43%"; Hit description =Chromosome undetermined scaffold_116, whole genome shotgun sequence
  Pfam annotation: Domain name=DUF755; Domain location=103-210; Score= -25.8; E_value=0.0045; Accession=PF05501.2; Description=Domain of unknown function (DUF755)
MDLNRKVITNDNNKEIPYVVNTLIFTIAQHFIGDPSLWKDRSAELLSNLKCRTLADFRWYRDTFLTRVYTREDNQQPFWKDKFLPGLPRSLGDKVRDKIRSQSANGDIPYESLSYGQLISYVQKVALKICQDEKIQIQLAKEKAQTKRDLGSFCEQFGLLACPKQKRKQTPRKEIHENKPVHKKRFPRRKYSDKPSTKEETETSSSMLSEKNLSKIQQHDQLSSMDDDRQINTLTREPDLLFQAINSIPDPQEKKVF

SEQ ID NO: 122196 - protein, 106 aa, Glycine max
  Coding DNA Sequence Number=SeqID_30511
MGEYAKDEELLIHSFQESLTGYQYNFDMVPDMMQLQNMCKKGDGSFKEHAQKLEGSGGPDLVFASERINVGPKRGKFDHPTRTTEKTGANKEGEDEGETHAVTAIP

SEQ ID NO: 122197 - protein, 68 aa, Glycine max
  Coding DNA Sequence Number=SeqID_30512
MQVPYTRCPICPQFKRCLWNCLTRNPIQQIHGSFQGIHLQRYGKFLTHPLPKKSRAVSRHNRNVNNHQ

SEQ ID NO: 122198 - protein, 41 aa, Glycine max
  Coding DNA Sequence Number=SeqID_30513
MRFQKQGKTNRHKRGSRSIKNKVIMELRKKRRTTNKSFGTN

SEQ ID NO: 122199 - protein, 125 aa, Glycine max
  Coding DNA Sequence Number=SeqID_30514
VCFTVDVEADASEVGGGRGGEGEEGGGGEGGGGVEAGGEPMIFYTITYKIGLMNRGSVISFFWKAKKRKRGTSNNLKVVHSGTKEFKIASNKRDLFLGFSEHQERLRKKLAVEEGRIFAANEQLS

SEQ ID NO: 122200 - protein, 57 aa, Glycine max
  Coding DNA Sequence Number=SeqID_30515
MKEAKEHHLDEDALISHDIAPCGALEWRWKNDEWRCHFKEKMSQEEAHHHRKPWIRA

SEQ ID NO: 122201 - protein, 51 aa, Glycine max
  Coding DNA Sequence Number=SeqID_30516
METFYGCNLNMFQNMFGMGNQTENRTSDELSRFIKLGVRPQEGELQGSVVQ

SEQ ID NO: 122202 - protein, 285 aa, Glycine max
  Coding DNA Sequence Number=SeqID_30517
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=92%, HitCoverage=51%, E-value=2e-47, Identity=42%"; Hit description=CTV.20
  Pfam annotation: Domain name=DUF755; Domain location=75-153; Score= -43.7; E_value=0.1; Accession=PF05501.2; Description=Domain of unknown function (DUF755)
QHFIGDPSLWKDRSAELLSNLKCRTLADFRWYSDTFLTRVYTREDSQQPFWKEKFLAGLPRSLGDKVRDKIHSQSANGDIPYESLSYGQLISYVQKVALKICQDDKIQRQLAKEKAQTKRDLGSFCEQFGLPACPKQKTSEEETETSSSVLSDENLNLIQQDDQLSSTDDDDGQINTLTREQDLLFEAINSIPDPQEKKVFLEKLKKTLEVKPRQKDFITNNKFDVSNILKRLENSSTKPTTIQDLQTEINNLKREVKELRQQQEIHQIILSQLEEDSDSESTNN

SEQ ID NO: 122203 - protein, 41 aa, Glycine max
  Coding DNA Sequence Number=SeqID_30518
MAFSGGALVLTNMDGEELPLPGQNQLVVVRCQDEVGGRNPS

SEQ ID NO: 122204 - protein, 134 aa, Glycine max
  Coding DNA Sequence Number=SeqID_30519
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=86%, HitCoverage=68%, E-value=5e-25, Identity=57%"; Hit description=LacZ -alpha
  Subcellular localization annotation: CTP_CleavageSite=34; ConfidenceScore=5.18e-01
MTMITNSSSVPVGMEAHLRQMISRKLFRKARKSKANATWGSSRVDLHACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 122205 - protein, 112 aa, Glycine max
  Coding DNA Sequence Number=SeqID_30520
MAGTNSERLCGAVIASLSSEERKGTNHKSKRSLSQRLCETETNMLAIISKYQEELNLAMAHEHKVADEYARVYAEKEARGRVIDSLHQEATMWMDRFALTLNRSQELPRLMA

SEQ ID NO: 122206 - protein, 52 aa, Glycine max
  Coding DNA Sequence Number=SeqID_30521
MEEGASTSIDEPWIRSLERMLQCLIYLESSTQCPCGVGLHQATTQHHNSTSS

SEQ ID NO: 122207 - protein, 53 aa, Glycine max
  Coding DNA Sequence Number=SeqID_30522
QCELSQDIEAFNVASPCLGTSLRGGFLYGLTLSSLGVEGVAPKIPWAWSLPVK

SEQ ID NO: 122208 - protein, 133 aa, Glycine max
  Coding DNA Sequence Number=SeqID_30523
  Homolog annotation: Hit_ID=A3I0I0; Match level="QueryCoverage=85%, HitCoverage=16%, E-value=8e-18, Identity=45%"; Hit description =Putative uncharacterized protein
MKRIFLLWLLALTCRAQVQPAEDPTALLARLWPDQAESLTEEHAENLYQLYQQPLDLNAAGEEQLASLFLLTPAQIRSFLRYRREAGPLVSLYELQAVPDLNIPLIRKLLPFVRVKKYTPQKADTRFCCGMTG

SEQ ID NO: 122209 - protein, 326 aa, Glycine max
  Coding DNA Sequence Number=SeqID_30524
MAMFDLEIVLEFYANAWHTEEGVRDMRSWVRGQWIPFDADAIGQLLGYPLVLEEGQECEYGQRRNRSDGFDEEAIAQLLCIPGQDFARTVAGRRVRIMHTNMTTLTHICMTLLLSNILPTDHNSDLPMPKCQLVYVILTRMSIHVAQLIADAIYIFAGMAPTRNPLDPDKSNRALGFPSLITGLCQSFGVPVAPTKAQGDAPQAAGAPPPPHQAGQAGAFDMEQYLRHLVRQQAANHRAHVQTHDCLYQMSLSMQSQGFASFSCPTLDQFRAEVACPGDWPEAQAGEAPPEAPGGGEEAHEDEEMVDLLDFLGGSGDTSLGDPQIH

SEQ ID NO: 122210 - protein, 91 aa, Glycine max
  Coding DNA Sequence Number=SeqID_30525
MEERSLLSEIAVTLGCHSALKHPKNLLIKSSLGKIFPREARVLDSSPIFFCPLISRFLGCSACAYIYYSGKQGIEEAMNLEVVRLSTRNLL

SEQ ID NO: 122211 - protein, 184 aa, Glycine max
  Coding DNA Sequence Number=SeqID_30526
  Homolog annotation: Hit_ID=A7UQU7; Match level="QueryCoverage=63%, HitCoverage=19%, E-value=7e-14, Identity=40%"; Hit description=IMP dehydrogenase/GMP reductase, putative
MDDAIQMLVDLLMVSPESARAETVQCRGPATNVHVVYLEAFRDLSMTERYAWGVVALVQFADSTADQEYDEDSPHARRWIATKKTVKSICTPAYMEHLDRLRILDVCWIPYGEYRSVRDFHVRSCYSGLLRWGPIAVYYQPERVMRQFGYTQTIPAPPIDSWVSYDDIHDRWMHYSDHIVPVGE

SEQ ID NO: 122212 - protein, 49 aa, Glycine max
  Coding DNA Sequence Number=SeqID_30527
MVRSRDKVKRQKSTKGRMQMEDRVTTDRSSSLPGAGQVENVAAKQPSIL

SEQ ID NO: 122213 - protein, 247 aa, Glycine max
  Coding DNA Sequence Number=SeqID_30528
  Gene Ontology: Mol. function=methyltransferase activity
  Homolog annotation: Hit_ID=A9CEU1; Match level="QueryCoverage=100%, HitCoverage=100%, E-value=1e-128, Identity=90%"; Hit description =Putative uncharacterized protein
  Pfam annotation: Domain name=Methyltransf_11; Domain location=64-161; Score=36.1; E_value=1.3e-07; Accession=PF08241.3; Description =Methyltransferase domain
  Pfam annotation: Domain name=Methyltransf_12; Domain location=64-159; Score=35.7; E_value=1.7e-07; Accession=PF08242.3; Description =Methyltransferase domain
  Pfam module annotation: Pfam domain module=Methyltransf _11::Methyltransf_12; Domain location=64-161::64-159
MSDTQWLEWGRKNPYYGVYSEDRFHTSNIEATKGEFFATGEANVSWMLGRAEQYCGPLGKGRVLEFGAGVARMSIPLASRFETVIGVELSPDMRAEAVKNCQLYNVKNVEMVPSDDDLSHASGEFDLVLSYIVLQHVDARRGVMLIDKLLSKVGPSGVAILQASVKRPERRLSDRLRYHLRHNVPVLAATYRFLRGKGWNTLSMRMSEYDPIAILAVFSRNGMKDVLLSEHYQGDVLTFHFTARKGG

SEQ ID NO: 122214 - protein, 73 aa, Glycine max
  Coding DNA Sequence Number=SeqID_30529
  Subcellular localization annotation: CTP_CleavageSite=37; ConfidenceScore=5.12e-01
MTKFCLRMSSGPPPLDDKGCMSHDLRVSADNRKVSPRATSSWVMVTKSGAVDKSEALAPTYPPMRNSDLRSSG

SEQ ID NO: 122215 - protein, 39 aa, Glycine max
  Coding DNA Sequence Number=SeqID_30530
MEALEKFKWLKAQVEKDEGPSGEGLSPRVEKDEGPSGDG

SEQ ID NO: 122216 - protein, 203 aa, Glycine max
  Coding DNA Sequence Number=SeqID_30531
  Homolog annotation: Hit_ID=A5AWV0; Match level="QueryCoverage=58%, HitCoverage=8%, E-value=5e-11, Identity=32%"; Hit description =Putative uncharacterized protein
VAVSPAKPPPKPDPEVDDPLYLMTLTIPELFLRPYQVRWDATVFGVFNPNFPLYIKHEDLSEIAHGGQCLSISLKHPQSIQRFGQSQFEFESYIKTWMQSSKRDVYLGAYLNGGHWQMVVILPKEHLVVWFCSLHNRPDNYLKGIINSALKGLDDAPQPKSKAPAKWIVVQCNIQKGSTECGYYVMHWMSNIILGTFRNNWEA

SEQ ID NO: 122217 - protein, 201 aa, Glycine max
  Coding DNA Sequence Number=SeqID_30532
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
  Subcellular localization annotation: CTP_CleavageSite=26; ConfidenceScore=5.02e-01
GETPGIFIVLSAFATSDLSVDFCDARQGAGAYGKTPATRPFYADTARRSRTTERSESVSEEAEERPIRKPPLPAPDNNFTQETAMTMITNSSSVPCLTQTNFKEPDELSNVTFLPTAIYKDKIQRFSSPRRLPPYTIQRYSSKVADRNGMQAWHWPSFYNVVTGKTLALPNLIALQHIPLSPAGVIAKRPAPIALPNSCAA

SEQ ID NO: 122218 - protein, 150 aa, Glycine max
  Coding DNA Sequence Number=SeqID_30533
  Gene Ontology: Mol. function=chlorophyll binding; Cellular component =integral to membrane; Biological process=photosynthetic electron transport
  Homolog annotation: Hit_ID=Q2MI75; Match level="QueryCoverage=73%, HitCoverage=31%, E-value=1e-38, Identity=53%"; Hit description =Photosystem II P680 chlorophyll A apoprotein
  Pfam annotation: Domain name=PSII; Domain location=1-150; Score= -176.0; E_value=0.0026; Accession=PF00421.10; Description=Photosystem II protein
MALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGLFVADYGMVQQQPLLNYSVLLVINGIRDTFSKKYIEELVLD

SEQ ID NO: 122219 - protein, 192 aa, Glycine max
  Coding DNA Sequence Number=SeqID_30534
  Homolog annotation: Hit_ID=A8ARU6; Match level="QueryCoverage=24%, HitCoverage=60%, E-value=6e-19, Identity=89%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTRLDTTYRHWQQPLVTGLAER

SEQ ID NO: 122220 - protein, 122 aa, Glycine max
  Coding DNA Sequence Number=SeqID_30535
  Homolog annotation: Hit_ID=UPI00006A2D9E; Match level="QueryCoverage =88%, HitCoverage=72%, E-value=2e-08, Identity=17%"; Hit description =UPI00006A2D9E related cluster
MSNLSEFGMIDPLDESISCILIRVDPWVHALTFRGLHALTFRGLHALAFRGLHVLTFRGLHTLTFRGLHALAFGGLHTLAFRGLHVLTFRELHALTFRGLHVLAFRGLRIITFRGLHVASLN

SEQ ID NO: 122221 - protein, 108 aa, Glycine max
  Coding DNA Sequence Number=SeqID_30536
MKTGAKMVSGNRLPGNIVMAAQLIRDRVEMECLKGAWETLEGNTRCRFRGTIRFTATSLVHPDEPARTLQRTVEWTTPWISFVYFLGWAYLGLTVRFTLLFCMGRPDV

SEQ ID NO: 122222 - protein, 93 aa, Glycine max
  Coding DNA Sequence Number=SeqID_30537
MQWRFQSQKRCKDKLKLTRNKHRTMVASKENERLKCLNKKCSRERKLRTDSKHFLKDPNGQIVEKCLVKLQTEFRKDPTVNEGWEGFLPRQLM

SEQ ID NO: 122223 - protein, 73 aa, Glycine max
  Coding DNA Sequence Number=SeqID_30538
  Pfam annotation: Domain name=zf-CCHC; Domain location=23-40; Score =28.6; E_value=2.3e-05; Accession=PF00098.14; Description=Zinc knuckle
RRRIERRRNFNNGRRSQEDSQVLRCYKCNQLGHIKANCPLNEERPEKSDKKRYYERRTKNAYIAWDDNDSSDG

SEQ ID NO: 122224 - protein, 178 aa, Glycine max
  Coding DNA Sequence Number=SeqID_30539
MAKFDPDIVLEFYANAWPTEEGVRDMRSWVRGQWIPFDADAISQFLGYPFSAGRGPGVRVWPEEEPDFARTAAGRRVRIMRTNMTTLTHIWMTLLLSNILPNDHNSDLPLPKCHLVYAILTRMSIHVAQLITDAIYLFAGMAPTRHPLDPDKSNRALGFPALITGLCQSFGVPVAPTK

SEQ ID NO: 122225 - protein, 48 aa, Glycine max
  Coding DNA Sequence Number=SeqID_30540
MMLSYNLRQGPVLVQMMDPEKEAGPTLVQMAQAQAKEMALVLQHPPEQ

SEQ ID NO: 122226 - protein, 131 aa, Glycine max
  Coding DNA Sequence Number=SeqID_30541
MNKKSAPVARVCGLCSSADHHTNLYPSLQQSGVNEQPEAYAANIYNRPPQQQNQQQQNNYDLLRNIYNLGWRNHPNLRWASPPKQQQPVPPFQNATGPSKPYVPPPMQQQQQQSQQRQQLTEAPPQPSLEE

SEQ ID NO: 122227 - protein, 103 aa, Glycine max
  Coding DNA Sequence Number=SeqID_30542
MRGYLMITRTFRQPGANEPVDAQRLTSSSAPFAIQGQRVRWQAEIPYGHLHLSSTEGNEFDGIRMMLVVRLATREILLYWVGTIECNGEGKCHGCPTLSLSWH

SEQ ID NO: 122228 - protein, 82 aa, Glycine max
  Coding DNA Sequence Number=SeqID_30543
MSGHRIRHLGSCSFNASLDFYLALYSTSSILEQDVRTLNNQHKNTEKGVEGKSLEYEEPRDLRSNPFQGGGDDAILPPKGIG

SEQ ID NO: 122229 - protein, 228 aa, Glycine max
  Coding DNA Sequence Number=SeqID_30544
TGEARLIALCARTPKGNRVKILNRDVAADGNVRESGDVGGGPGKSYLFCLTACPPWKRLSRRTECLPRPVVLITASGLQGWARGPIPNPSAVGGLLELLPRRERVVACRSGDRIGNGPFGASSPGVEQSTQNWGERNQPSAGGFPPEFRLRIAGARGRVLSGRCGCSVEPRHGIESSKWAIFGKQNWRCGMNRKLGYGAQLRANLDPTKGVGRLRQQDGGHGSRNPLR

SEQ ID NO: 122230 - protein, 275 aa, Glycine max
  Coding DNA Sequence Number=SeqID_30545
  Subcellular localization annotation: CTP_CleavageSite=22; ConfidenceScore=5.18e-01
PVESSSPSAALPGARSKEMRPPAWAGAGEPRGARPPTSMVTVMSFNMLRVILISIRQHLADDRTSHFATEPDWNCPGALHGDNLRACLGLVAINLLCAAEAPAIDNHIEHRLIAGSLRIERYRAQQLRTSGCGIKVAALIDHRMSAASRFFDVKAVGPAGSDIGSGKGLQLRHARLRRCPDLADVSSRRLPCGRYGRNGTGGKQCQRKDRRQAALMTDAVGHGWAGLHEGGDIVVAALAHIGAASAAHLDTGRDVAVAVLREDGGVIGQNWPGRP

SEQ ID NO: 122231 - protein, 76 aa, Glycine max
  Coding DNA Sequence Number=SeqID_30546
  Subcellular localization annotation: CTP_CleavageSite=53; ConfidenceScore=5.09e-01
MARSCPPRSRIVSGHGQKSRQVNGRNQPRYIGTDASGARVTTDRSLPLPGAKQAENVAVRQPSILCVYSFFYYCLF

SEQ ID NO: 122232 - protein, 114 aa, Glycine max
  Coding DNA Sequence Number=SeqID_30547
  Homolog annotation: Hit_ID=A6FJQ2; Match level="QueryCoverage=33%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARTEETYPKVPITLVDTWVLASSVSLASPKSAGTELEFVIMVIAVSCVKLLSAHNSTQHTSRKHKV

SEQ ID NO: 122233 - protein, 103 aa, Glycine max
  Coding DNA Sequence Number=SeqID_30548
MTGLSHSRLDHLTSCSDSSLLDEVRVTYLGAEVGLDILAQKHYWHRWKMFGICSGTEADVLCMAGIFHPMNFVDKFVCILCFVERNMDLPESDHWSSRKFLLV

SEQ ID NO: 122234 - protein, 80 aa, Glycine max
  Coding DNA Sequence Number=SeqID_30549
VDSRGSPDQDDVEDTVCDKYDISKEKWAQFCQTRRDPSWEDVRIKAQAIQKQNTAPHVLSRGGYDYLEQKLLAEKTKKKL

SEQ ID NO: 122235 - protein, 202 aa, Glycine max
  Coding DNA Sequence Number=SeqID_30550
MDPWVLVTLTVRGLHVLALRGLHVLTIRGLHALTSRGLHVLTMRGLHALTLGTSYPHHQRAARPHLQRTACPRLERATRPHLGGLHALTSRGLHVLALRGLHALTLGTSYPHRQRTARPRLERTTHPHHQRAARGASRGLHVLALRGLHALTLGTSYPHRQRTTRPRLERTTRPHHQRAARPHLQRTTCPRHERATRPQLGY

SEQ ID NO: 122236 - protein, 190 aa, Glycine max
  Coding DNA Sequence Number=SeqID_30551
MLFRSLALGACCCLLPTGEGRAAVWLHADHSDPPVDSWVSYDDIHYRWMHYKNHIVPTGEVCVVPGACSSDYMNWFFRISHPFMTLGHALDPLPHGHAPQPRVVPQAPQTDIPRVPEPGASSTSAEEPRHAVEVCDDIVERLERHLSLGVVTPGSSTHEVIKECLRLARSVTQDHLVYVRSRRRRRTDQA

SEQ ID NO: 122237 - protein, 159 aa, Glycine max
  Coding DNA Sequence Number=SeqID_30552
  Subcellular localization annotation: CTP_CleavageSite=59; ConfidenceScore=5.66e-01
SLDQNLCYSSSFASLLAKNRRTNHLNSFVSLFSLPREFKRTNRLRILFPNTLEGTSFVVQVEGTSFMNKRGYISCGSVQVEGTSTWLFKENKGGYIPCGSLACKGFYKVERNLKNWLVAWGLDVGTDCGRTSINLVFVFFFPTLFNFRRVLLIPTFTFG

SEQ ID NO: 122238 - protein, 46 aa, Glycine max
  Coding DNA Sequence Number=SeqID_30553
MVGYTPSCFADLVFVGERIKAGLEREDENEGETFAMTAIPTRSNFP

SEQ ID NO: 122239 - protein, 99 aa, Glycine max
  Coding DNA Sequence Number=SeqID_30554
MERNEETPMEEKVKLKISGGLRSTYLKLLCSDTTCWKLAYEASMEARSLSFNKILQWRSFTTKRVTWIRSLKRKLQWRKRIPEREGEEGGGRGVGIEGD

SEQ ID NO: 122240 - protein, 104 aa, Glycine max
  Coding DNA Sequence Number=SeqID_30555
FTRDSPQISASPHQLDLAPYASEPYNAQWNAPGLLCDKHMLRSSRILGEMEVDEPWLGVMATIELSNFVADLGIAFVDNWAVGKEKVCYWLSNNIVGLVGNLAV

SEQ ID NO: 122241 - protein, 52 aa, Glycine max
  Coding DNA Sequence Number=SeqID_30556
MVTQNNESRNFLLWDHECAKLIGETADDVNRVKIEEWYRFVSNSFKALKTID

SEQ ID NO: 122242 - protein, 136 aa, Glycine max
  Coding DNA Sequence Number=SeqID_30557
MQVKVNEPRHHQSKEELGQLMGQLPAASFSQRLTPSIMIAIEVLPFVGLPTVTVGGRLKRPKEKSSRGKKEVHTSSQIGSTPSISSEFLKRSNLGTGLDRQKQVENGVVGMRENVLPPGLGKRQESWQVKANGPCS

SEQ ID NO: 122243 - protein, 118 aa, Glycine max
  Coding DNA Sequence Number=SeqID_30558
MVDEREITMMVDTLPGSTMRSEVTWPPALTELCSEMKQLIEKNAATAAAVSSAAEADPTLLATAHHPPSNIVGRGRDTLGHDGSPHLGYNRAAYPYGLPPNYSPPVLQKMRPHCFSCP

SEQ ID NO: 122244 - protein, 315 aa, Glycine max
  Coding DNA Sequence Number=SeqID_30559
MAPRKLASKRSRKDKAAKGTSSAPEYDSHRFRSVEHQQCFEAIKGWSFLRERRVQLRDDEYTDFQEEIVHRRWASLVTPMAKFDPDIVLEFYANAWPTEEGVRDMRSWVRGQLIPFDADAIGQLLGYPLVLEEGQECEYGQRRNRSDGFDEEAIAQLLCIPGQDFARTAAGRRVRIMRTNMTTLTQIWMTLLLSNIQPSDHNSDLPLPKCQLVYAILTRMSIHVAQLIADAIYIFAGMAPTKHPLDPDKSNRTLGFPALITGLCQSFGFPVAPSKVIRPPITRAFIEKYCTQRQAQGDAPQAAEVPPPHQAGPAG

SEQ ID NO: 122245 - protein, 41 aa, Glycine max
  Coding DNA Sequence Number=SeqID_30560
LQQVWEWKIFQILGQSETTSKQDGVSASNSKNLNSVAAELI

SEQ ID NO: 122246 - protein, 142 aa, Glycine max
  Coding DNA Sequence Number=SeqID_30561
  Homolog annotation: Hit_ID=UPI0000ECBAF8; Match level="QueryCoverage =28%, HitCoverage=48%, E-value=1e-16, Identity=100%"; Hit description= UPI0000ECBAF8 related cluster
TLEGNERCQFRGTIRLTTTSLVHLEEPARTIQQPVEWILPTPTPYRLVEPVQLIEDDEDSLPDVDSPEDIMAASEADSIEESGPGGTANSMQAWHWPSFYNVVTGKTLALPNLIALQHIPLSPAGVIAKRPAPIALPNSCAA

SEQ ID NO: 122247 - protein, 73 aa, Glycine max
  Coding DNA Sequence Number=SeqID_30562
MLLSSNVIYICVRVVMLVSMIHTRLFATARVKSCPGMHSSCVIASLSGCARIVGPPPGSGGGPKVDKRKLLAP

SEQ ID NO: 122248 - protein, 109 aa, Glycine max
  Coding DNA Sequence Number=SeqID_30563
MAAQLIQDRVVMECLEGVWETLEGNERCRFHGTIQLTATSLVSSSEEDPEEDLEELPPEPVVDDLDLPEDDEDPLPDVDSPEDIMSASEVDSTEESGPGGTTSSEDSSS

SEQ ID NO: 122249 - protein, 188 aa, Glycine max
  Coding DNA Sequence Number=SeqID_30564
  Homolog annotation: Hit_ID=UPI0000ECBAF8; Match level="QueryCoverage =21%, HitCoverage=48%, E-value=6e-16, Identity=97%"; Hit description =UPI0000ECBAF8 related cluster
  Pfam annotation: Domain name=Transposase_23; Domain location=46-116; Score=3.9; E_value=0.00045; Accession=PF03017.5; Description =TNP1ENSPM transposase
MTSFSQLQSQMQYQGPPEPLVGPGPFGPRVSTKGSCVDPSGNDPETGDSDRYGLYIEADPARLVTVGRVYEGSTLVHNTPLLPGQVKVSVDKVKDADAAVPVPTVEVSLVGQALHTFLAWPTHQIKSLSNQSRPAGMQAWHWPSFYNVVTGKTLALPNLIALQHIPLSPAGVIAKRPGPIALPNSCAA

SEQ ID NO: 122250 - protein, 72 aa, Glycine max
  Coding DNA Sequence Number=SeqID_30565
MMMTKVMTKSSKINQRTTQVIKIESKNNSRLKRKVKESRIKIQGSRSQELRIKIQGSRSQESRSRFKNQEKA

SEQ ID NO: 122251 - protein, 153 aa, Glycine max
  Coding DNA Sequence Number=SeqID_30566
  Gene Ontology: Mol. function=aspartic-type endopeptidase activity; Biological process=proteolysis
  Homolog annotation: Hit_ID=A7R230; Match level="QueryCoverage=67%, HitCoverage=5%, E-value=1e-09, Identity=37%"; Hit description =Chromosome undetermined scaffold_395, whole genome shotgun sequence
  Subcellular localization annotation: CTP_CleavageSite=63; ConfidenceScore=5.04e-01
MTMQNMQFQQETRASIQSLTNQMGQLATQLNQQQSQNSDKLPSQAVQNPKNKQHIPPLPFPPRAVSNKKMEEAEKEILETFRKVEQIPRYAKFLKELCTNKRKLKGSERISMGRNVSALIGKSVPQIPEKCKDPGPLQSTDVMDFLKDQFPSF

SEQ ID NO: 122252 - protein, 74 aa, Glycine max
  Coding DNA Sequence Number=SeqID_30567
MYGLLGPAAFWKEGAGCCHNCSAVVDFAAEVKEVYCKYLQHKLQAAQLLQVAAWEGKGLYGGQQRSTNHKLLRQ

SEQ ID NO: 122253 - protein, 173 aa, Glycine max
  Coding DNA Sequence Number=SeqID_30568
  Homolog annotation: Hit_ID=Q0KIL1; Match level="QueryCoverage=50%, HitCoverage=9%, E-value=7e-07, Identity=32%"; Hit description =Gag/pol polyprotein, 3'-partial, putative
  Pfam annotation: Domain name=G-patch; Domain location=43-82; Score =25.4; E_value=0.00016; Accession=PF01585.14; Description=G-patch domain
MPYVESSEESLETAFQSFELVSISSVDSISGQACLSDAAVMMARVMLGNGYEPGMGLGKDNGGITSLINAKGNRGKYGLGYKPTQADIKRSIAGRKSGSQSSRLRQEGEGSPPCHISRSFISAVLGDEGQLVAIYEDDVPTGKLASGRMPRHLRNEHNVNLYGFKSSIVVPRL

SEQ ID NO: 122254 - protein, 103 aa, Glycine max
  Coding DNA Sequence Number=SeqID_30569
MGAKYLEVVKRGSHPDNGWSPDEIRIKGVATYPSAGGRRVTRGMRVPRKEYARSRHQRLFEENVGKTGKDAIYELFSEKVRELYLRTGKVLAPHTSVPRDGSL

SEQ ID NO: 122255 - protein, 252 aa, Glycine max
  Coding DNA Sequence Number=SeqID_30570
MASSSGVRLLKGTMDEFVRAGVGNKGGVDDGVSNGHCLTHGGWLHNLNLSANRRCSCLPWFAAAVYIAVQWDPRMWLMRIANGEHEEMPGKTIIDHSEPLNLGTSSFIRCDAVCDPDAENEVASAFDLVPSAIRLSLCSMKAPMIPSFRGLGNLRDTRDLWKLEGTRKERENASSERETRRRKGLERKEEKLLDFSIFLQGDGPEKASREEVQEGHHQRGCRNLPFGGRATRDSRVRVPWKGIRAESPPTFI

SEQ ID NO: 122256 - protein, 100 aa, Glycine max
  Coding DNA Sequence Number=SeqID_30571
  Subcellular localization annotation: CTP_CleavageSite=92; ConfidenceScore=5.61e-01
MPPKVSSSSGRGGRSSTKGKDVMLALPEPITKKATTSSSGSPTQTGSSTARNRKLRKIWKSRKQQTISTIAETCLCKVVVTIRYLKGCSRTSQELVSEQP

SEQ ID NO: 122257 - protein, 76 aa, Glycine max
  Coding DNA Sequence Number=SeqID_30572
MVFGASVASVMLPKNFRKTLEKIESKCLCNASVSDSVEILHRSSSFVTVLRSFFIVLRSSTSKFPKSNLSIHFMHP

SEQ ID NO: 122258 - protein, 72 aa, Glycine max
  Coding DNA Sequence Number=SeqID_30573
MIMKGQDIYSSQDEVTTSPSSSESEEAKGEESSEEIDSQEERDLLMVRRLLGGQSCDLNFQKLLNDSKVIFN

SEQ ID NO: 122259 - protein, 81 aa, Glycine max
  Coding DNA Sequence Number=SeqID_30574
MFRTRGLGRALGRVIGRALGREDYHDSDDVPQRRRPTASARKQREVAPVVEDALDMAEDERPELKLSSHGRKVHKFGRLAP

SEQ ID NO: 122260 - protein, 138 aa, Glycine max
  Coding DNA Sequence Number=SeqID_30575
MTEKEMITMIVDTLPVFYFEKMVGYTPSSFADLVFAGERIEVVQQCQYSANISPSHYPPPNHPQGSSLNQPQSLPVVRPVPNTSLNINQDTNQGGNFPAKKPVEFTPIPVSYANFLPYLLYNSMVVITPAKVSQPPFL

SEQ ID NO: 122261 - protein, 65 aa, Glycine max
  Coding DNA Sequence Number=SeqID_30576
GVDTEEEEPIDLRSNPLQGGGVDAILTRAMSKRLQEDWARAAEEDPRVLMNLRVCRVPYKLRVQV

SEQ ID NO: 122262 - protein, 74 aa, Glycine max
  Coding DNA Sequence Number=SeqID_30577
VDSRGSHLGMTKQRCLGSSLAGPSILHGWAPSLGPSERLSSPTPGDVPHPHLSYPNFVRGPLLDDMRPFFGPCE

SEQ ID NO: 122263 - protein, 57 aa, Glycine max
  Coding DNA Sequence Number=SeqID_30578
MADEPRRVTLEDYSSSSVPQFFTSIARPEVQAQNITYPHSLIQLIQNNLFHGLPNED

SEQ ID NO: 122264 - protein, 120 aa, Glycine max
  Coding DNA Sequence Number=SeqID_30579
SKASQMSHQKLNIRPLQGAGTTSHGLMGPMQVESLGGKRKDGSQEWNGNIPEDTLNKVLLVKGLTANLISISHGIEDSMAADQRTTVTYGHLKNPVTPPHVYSPKKMKSKYGIKDLDICT

SEQ ID NO: 122265 - protein, 59 aa, Glycine max
  Coding DNA Sequence Number=SeqID_30580
MTIATTKQTLVPQIWGSHGHVAPHDTGLLGHGNKKWGGRQKQGFCSYVSSICDEELRPT

SEQ ID NO: 122266 - protein, 96 aa, Glycine max
  Coding DNA Sequence Number=SeqID_30581
MALMHRYGRNLRQPAKPLIGRKKMQEIQKNNDCPHLLSCGGYDLLEKKLLDERMKKRKHDALLTENLALIEDLPISHSKTCQVEDGLHESIWEDDI

SEQ ID NO: 122267 - protein, 174 aa, Glycine max
  Coding DNA Sequence Number=SeqID_30582
MRGYLMVIRTYCQPEARETVDTRRFTSSSTQTTSVKHKPVWLGGRRKYPSETASPMTCGGTLWLSAPFVNQRQASPLTCGDLRHLPCRLPLSSTNLIQILTSSSTPFCQPEASEPIDTQKLTLSSAPLSSRDGEFDDMRGYLIVIRTFCQPEANEHVDTWRFTSSSTQTTSVKH

SEQ ID NO: 122268 - protein, 149 aa, Glycine max
  Coding DNA Sequence Number=SeqID_30583
  Homolog annotation: Hit_ID=B0HC01; Match level="QueryCoverage=22%, HitCoverage=72%, E-value=1e-11, Identity=100%"; Hit description =Putative uncharacterized protein
GGGAYGKTPATRPFYGSWPFAGLLLTCSFLRYPLILWITVLPPLSELIPLAAAERPSAASHWHDRFPDWKAGSERNAINETAMTMITNSSSVPCSKLFTMSGLGGMFSVLVSASGVLAGSLSSGLGALMVGGSSFGMGTGSSFRIGGIL

SEQ ID NO: 122269 - protein, 164 aa, Glycine max
  Coding DNA Sequence Number=SeqID_30584
  Homolog annotation: Hit_ID=Q2HW90; Match level="QueryCoverage=49%, HitCoverage=16%, E-value=7e-10, Identity=38%"; Hit description =Putative uncharacterized protein
MGTNQTGKRFYQVKVKSLDTTSIKELGRLMEPLQMQAFRKTYGKILELTIAEVSIEAIASLTQYYDQPLRCFTFADFQLVPTIEEFEEILGCPLGGRKPYLSSGYLPSLSRIATVVKDSAEIYSTHLTEGAKRVAHGSSVAYPPSVFGWFHTCSNKTQDIHVRS

SEQ ID NO: 122270 - protein, 260 aa, Glycine max
  Coding DNA Sequence Number=SeqID_30585
ENVRAAPPVLIVVRQHAGPQINPNGVVAADVRLDGIRLPAGADPPHHPVRRETVRRGAQPQPLIDLAHRAPRAVQRRKTRQQLRRQVAGIQPPAIVRHEPDFARQQHQAQAGNVGHLLAADALQQQRPQGLIAPAFPQAAGFEQVVGDPQIGVRRRVGVQHLPLFVIALAPQPGGQTGAEIARRQIVLRPGQQQIEGRPVVGHQGEEQAVALPLGGGDFPGHSQAAAALKAHSSSMPSDRRCSMAFTAVNPDLQAPDDAG

SEQ ID NO: 122271 - protein, 69 aa, Glycine max
  Coding DNA Sequence Number=SeqID_30586
MEEKKIENERDENTYRLKNEERTKNGEERRKIFTDLLSEALRKHFDSIFLHENGKREVLAAQRLLEEDF

SEQ ID NO: 122272 - protein, 157 aa, Glycine max
  Coding DNA Sequence Number=SeqID_30587
MAKFDPEIVLEFYANVWPTEEGVRDMRSWVRVSVDSLYADALSQFLGDPLVLEEGQQCEFSQRRNRADGFNEEAIAQLLCISGQDFTRTVAGRRVRIMHISMTTLTQTWMTLLLSNVLPSDHNSNLPLPKCQLVYAILTWMSVHVAQVIADAIYLFA

SEQ ID NO: 122273 - protein, 203 aa, Glycine max
  Coding DNA Sequence Number=SeqID_30588
  Gene Ontology: Mol. function=binding; Cellular component=ubiquitin ligase complex; Biological process=protein ubiquitination
  Homolog annotation: Hit_ID=A7NU90; Match level="QueryCoverage=48%, HitCoverage=28%, E-value=5e-27, Identity=67%"; Hit description =Chromosome chr18 scaffold_1, whole genome shotgun sequence
  Pfam annotation: Domain name=Arm; Domain location=15-55; Score=12.5; E_value=0.28; Accession=PF00514.14; Description=Armadillobeta -catenin-like repeat
  Pfam annotation: Domain name=Arm; Domain location=56-96; Score=5.7; E_ value=2.1; Accession=PF00514.14; Description=Armadillobeta-catenin -like repeat
  Pfam module annotation: Pfam domain module=Arm::Arm; Domain location =15-55::56-96
MKENTTCALLRLSQVEESKAMIRRFDAIPLLVSLLESGGLRAKRDASTMLYSLYMVKENKIKAVKAGIMKVLVELMADFESNMVDKLTYVVSVLVEIIEVCEDFDGEEHCCEDAVDFDADVHVEVVCDGGVLVAKFLLQRNFQVGEGFSSENPSHVSAVDGENAYLAALVLDYGDAVHGGGATTRGGLLGATTSAALPGTSFQ

SEQ ID NO: 122274 - protein, 95 aa, Glycine max
  Coding DNA Sequence Number=SeqID_30589
  Homolog annotation: Hit_ID=Q2HV50; Match level="QueryCoverage=73%, HitCoverage=42%, E-value=1e-07, Identity=36%"; Hit description=H+ -transporting two-sector ATPase, alpha/beta subunit, central region, related
MEFTDLWKLKVPSKVSLFAWRLVRDRLPTKVNLRRRNMELNDLCKTMPLWWEALYWLNIVGVFPEMPREHFLQHSHGHLNGIRLQQWQTWWISLT

SEQ ID NO: 122275 - protein, 72 aa, Glycine max
  Coding DNA Sequence Number=SeqID_30590
MVRKEQVDMLCLQETKKAVIDKALCQVLWGDAEVRRKMQPTINRKGHGLPKEFYGIKSGNSELQAVGVSSAF

SEQ ID NO: 122276 - protein, 193 aa, Glycine max
  Coding DNA Sequence Number=SeqID_30591
  Gene Ontology: Mol. function=sequence-specific DNA binding; Cellular component=nucleus; Biological process=regulation of transcription, DNA-dependent
  Homolog annotation: Hit_ID=A7QXM2; Match level="QueryCoverage=53%, HitCoverage=14%, E-value=2e-15, Identity=48%"; Hit description =Chromosome undetermined scaffold_226, whole genome shotgun sequence
  Subcellular localization annotation: CTP_CleavageSite=53; ConfidenceScore=5.50e-01
MRDVNNLNNKGSGKSSYSQEQTKSKLVSSKFKTSSTKRQEKKHKVRSKSHKHRAGTSKSKKTVTHSSVEAPLEDSSNKKVIIRKYRHKTDGKSSQMLSSTKLEGGKNSHSSGIEGNDVDGEAKIKKRKRRKKKRQRNNIDVDDASRLRRRTRYLLIKMKLEQNLIDAYSGEGWKGQRKNMFTTSHLGISEIFT

SEQ ID NO: 122277 - protein, 168 aa, Glycine max
  Coding DNA Sequence Number=SeqID_30592
MEHCRKYNNVSDIHWVVDKEVDLEEGLRVCETDFDIRDMVITARHDGDEVELYYDHKVDEQPILFEADVPEDGLGNLNPIPEVEEEGDKDDGDGDEDIASEEHDDIDGDEDVDVEVRVGCEWWTDIPEYNNEVQEDEVEPVGYESEKLDSPRSNGQALTLLTCGNGQT

SEQ ID NO: 122278 - protein, 117 aa, Glycine max
  Coding DNA Sequence Number=SeqID_30593
  Homolog annotation: Hit_ID=A5BSR3; Match level="QueryCoverage=93%, HitCoverage=34%, E-value=9e-09, Identity=32%"; Hit description =Putative uncharacterized protein
MARTKKTGQMTSEATKEIADRIDYMDEQASQGSFVPPGRQNILTAVIGRPEHPGRVRVVGAGVTIKQYFGLALRTSCSSSSMPLEDLEQLTQQIRDQLEESITEKMTQKMMTSFSQM

SEQ ID NO: 122279 - protein, 400 aa, Glycine max
  Coding DNA Sequence Number=SeqID_30594
  Gene Ontology: Mol. function=phosphatidylinositol binding; Cellular component=Golgi apparatus; Biological process=clathrin cage assembly
  Homolog annotation: Hit_ID=Q8VYT2; Match level="QueryCoverage=78%, HitCoverage=87%, E-value=1e-53, Identity=44%"; Hit description =Putative clathrin assembly protein At4g25940
MGTFQSFRKAYGALKDSTKVGLAKVNSEYKELDIAIVKATNHVEYPPKERHPEGCAYSNHLVQYALALAENLADFYEYCKGLDLTRNFQFPTLRQPPPSFLATMEEYIKEAPQTGYVNKKVEYQENEESSKEESESNESAEPQANEEQVEEVNEEESVEEEEEQPKEEEVEPPPLISTDDGTNDLLGLNEINPKAMELEESNAMALAIVPPGGNNPNNLALSNFDGTTGWELSLVTTPSNHSSQAPDRRLAGGFDKLLLDSLYEDENARRQLQLQNAGYGHSGTMDIQNNNPFDHYNQQDPFAMSNNIAPPPSVQMALMSQQQQQQQMMFQQQQMMYQQAQQQHNNMMMVPYHQQQPYNQYPQQMYNSSSHNPFGDPLPVMKRRKSSDEDNSSGSGGDED

SEQ ID NO: 122280 - protein, 189 aa, Glycine max
  Coding DNA Sequence Number=SeqID_30595
  Gene Ontology: Mol. function=aspartic-type endopeptidase activity; Cellular component=chromatin; Biological process=chromatin assembly or disassembly
  Homolog annotation: Hit_ID=A5ANN9; Match level="QueryCoverage=50%, HitCoverage=11%, E-value=7e-12, Identity=37%"; Hit description =Putative uncharacterized protein
  Pfam annotation: Domain name=Retrotrans_gag; Domain location=71-161; Score=45.4; E_value=2e-10; Accession=PF03732.8; Description =Retrotransposon gag protein
MDIMMQEVLEQLKELQKGNLEPQMGSPERGEGGASHFSGNKTEKTEWRWRNLELPMFNGGDVAGSIGGGVEVALVALEGKVLTWFQWWETRAEDQSWWDFKNALSRRFQPALAQNLFEVLLGLKQEGTVSEYRDTFEEISCPLKIGNTNYFKGNFMNGLKEESRVELRLHPLKTLEELIDLALLIEPTT

SEQ ID NO: 122281 - protein, 206 aa, Glycine max
  Coding DNA Sequence Number=SeqID_30596
  Homolog annotation: Hit_ID=A7QXM8; Match level="QueryCoverage=71%, HitCoverage=69%, E-value=2e-47, Identity=64%"; Hit description =Chromosome undetermined scaffold_226, whole genome shotgun sequence
  Subcellular localization annotation: CTP_CleavageSite=36; ConfidenceScore=5.03e-01
MLTSCFCNCMITFSSRPSSEATVASENQGQAGQQPQQQQPAPQRQVVVRRFQIAFQIDLLLMLKLAAVIFLFNQDGSRQRLIVLVFFAALVYLYQTGALTPIIRWLSRGMQRAAAPPHPPRPAARAENVPAPRPEGDNAAPAEGQPEAENGNQPANDADQAVENENVAEHGNVNGGNQWWGIVKEIQMIVFGFITSLLPGFHNHMD

SEQ ID NO: 122282 - protein, 387 aa, Glycine max
  Coding DNA Sequence Number=SeqID_30597
  Homolog annotation: Hit_ID=A2Q4S5; Match level="QueryCoverage=60%, HitCoverage=42%, E-value=1e-28, Identity=32%"; Hit description=IMP dehydrogenase/GMP reductase, putative
MGELTITLDDVSSLLHLPVIGDLHAFQPLHVDDAVQMLVDLLMVSTESARAETAQCRGPYVRLQWVRDIYERRCQTCHWKTAARAYLLYFLGCTLFANKSATNVHVVYLEALRDLSMTERYAWGVATLIYEHFPSVAESTADQDYDEASPRACRWIATKKTVKSIRTPSYKERLDRLRIPDVCWIPYGEHREVRDFHVRSCYSVLLHWGPVAVYYRSERVVRQFGYTQTIPTPPVDSWVSYDDIHDRWMHYEDYIVPAGEVCVVLGACFSDYMDWFFRIFMTPGHALDPLPHGPAPQPRVVPQAPQTDIPHVPEPGASSTSAEEPRHAVEVCDDIVERLERHLSLGVVTPDSSTHEVIEECLRLARSVTQDHLIYIRCRRRRRTDQA

SEQ ID NO: 122283 - protein, 116 aa, Glycine max
  Coding DNA Sequence Number=SeqID_30598
MRDEGGCCFGVGVGRFQRGETRVSSVDSLSEEDEVGFSLLPVKEIVHSFSPNLGLAFVARALIHLRMGQLGWQSFAFEELSAQIPHPLHQFHLGLFNLCGIIFSSVGHSSPPEELA

SEQ ID NO: 122284 - protein, 81 aa, Glycine max
  Coding DNA Sequence Number=SeqID_30599
MEEAGSLLREMLQYKNAAELINIINNEVDTESISDFLATLCCLLIIKDSTNNRRFMNERFWFKIKKSSTFLLQKWFEIWTL

SEQ ID NO: 122285 - protein, 113 aa, Glycine max
  Coding DNA Sequence Number=SeqID_30600
  Subcellular localization annotation: CTP_CleavageSite=43; ConfidenceScore=5.39e-01
MDVGSWSSSPSKMKFRFSFQDRLICRKNSQENRTNSSLWSTPSDMMVADLSLGPQSFMAWWCHTPSTATKKPRLYESTSKRKKMWSANLLNFHRLFFVAPFIDLTWILRFVYF

SEQ ID NO: 122286 - protein, 133 aa, Glycine max
  Coding DNA Sequence Number=SeqID_30601
MYHENMMIHEKYACSKWFFRPSKVDIVIEIKISAAKNYHKMWHSGLEVADLSCFRRIWVTKLDGGHAHSVVVWMVLGIVGVYGLWWLSAKVRIERFEVGPESVRKAHLLVVHLRPDVKKLNLRVGVLMWLKWD

SEQ ID NO: 122287 - protein, 810 aa, Glycine max
  Coding DNA Sequence Number=SeqID_30602
  Homolog annotation: Hit_ID=A5B6D5; Match level="QueryCoverage=98%, HitCoverage=98%, E-value=0.0, Identity=55%"; Hit description =Putative uncharacterized protein
  Pfam annotation: Domain name=DUF630; Domain location=1-60; Score =117.8; E_value=3.1e-32; Accession=PF04783.3; Description=Protein of unknown function (DUF630)
  Pfam annotation: Domain name=DUF632; Domain location=331-719; Score =445.5; E_value=7.3e-131; Accession=PF04782.3; Description=Protein of unknown function (DUF632)
  Pfam module annotation: Pfam domain module=DUF630::DUF632; Domain location=1-60::331-719
MGCSHSRLDDEEAVRLCKDRKKFIKQAVEQRTRFATGHIAYIESLKRVSAALRDYIEGDEPREFSLDTVITPPFTPVKKKTGPGFIPISAKPFATTGSIEFGIGPNSTLKVNYLRPGGNPAISVEERPQSPERVRVETYYSPMQHYGINGFFNMQSSPVNPSIFAYSPNNRPVIPPPSPQASQWDFFWNPFSSLDSYGYPSRSSIEQTAMDDEYRGLRQVREEEGIPDLEEDETEHEDCVGKRNVAEERTTHDINASKEEVIVEDVDDDDDEEEEEEEEEEEEETDIEDETKTEHEAKDSQAHGSASFEVAKAQAAGHIESRHREMTIGKQEAVEETPGFTVYVNRRPTSMAEVINDLETQFTVVCNAANDVAALLEAKKSQYLLTSNELSASKLLNPVALLRSASSRSSSSRFLMNCSSTSTEGCEGTKDLSAEHCMLSGSHHSTLDRLNTWEKKLYEEVRPLCICKGKAAYNIPPPYLRIAKSLWAMGYFGHFLLQQSGERVRIAYEKKYKQLRNLDVKGEDPSCADKIRATIRELDTQITVSIHSVEAISRRIETLRDEELHPQLLELVHGLERMWKVMAECHQTQKRTLDEAKILLAGTSSKSRARKQSSMSMTDPNRLARSASNLEFELRNWRNAFESWITSQRSYIHALTGWLLRCMRSEPDVSKLPCSPRRSSGTHPLFGLCVQWSRRLDAIQEKAVLDGLDFFAAGMGSLYAHQLREDSSRISFGSKQSNGNMEMVEVGEVEEVMAPEKLAEVAIKVLCAGMSVAISSLAEFALDSAEGYNEVVKQWDNGKCQNTTSSETRT

SEQ ID NO: 122288 - protein, 89 aa, Glycine max
  Coding DNA Sequence Number=SeqID_30603
MEVANDGKMKKRCHVVQGDGNLPYGKMETTSLLVPPLHKRGYISPRLPVSTEQAIKGLSPVPATSPSMAGTSVPNFYTFLPWEDNFNSG

SEQ ID NO: 122289 - protein, 1080 aa, Glycine max
  Coding DNA Sequence Number=SeqID_30604
  Gene Ontology: Mol. function=RNA binding; Cellular component =cytoplasm; Biological process=regulation of translation
  Homolog annotation: Hit_ID=Q9M6S0; Match level="QueryCoverage=98%, HitCoverage=99%, E-value=1e-177, Identity=38%"; Hit description =Pumilio domain-containing protein PPD1
  Pfam annotation: Domain name=PUF; Domain location=654-688; Score =35.1; E_value=2.5e-07; Accession=PF00806.10; Description=Pumilio -family RNA binding repeat
  Pfam annotation: Domain name=PUF; Domain location=690-721; Score =19.5; E_value=0.013; Accession=PF00806.10; Description=Pumilio -family RNA binding repeat
  Pfam annotation: Domain name=PUF; Domain location=723-759; Score =13.6; E_value=0.29; Accession=PF00806.10; Description=Pumilio-family RNA binding repeat
  Pfam annotation: Domain name=PUF; Domain location=781-815; Score =32.4; E_value=1.7e-06; Accession=PF00806.10; Description=Pumilio -family RNA binding repeat
  Pfam annotation: Domain name=PUF; Domain location=817-852; Score =33.9; E_value=5.8e-07; Accession=PF00806.10; Description=Pumilio -family RNA binding repeat
  Pfam annotation: Domain name=PUF; Domain location=952-986; Score =42.2; E_value=1.8e-09; Accession=PF00806.10; Description=Pumilio -family RNA binding repeat
  Pfam annotation: Domain name=PUF; Domain location=997-1028; Score =31.1; E_value=3.9e-06; Accession=PF00806.10; Description=Pumilio -family RNA binding repeat
  Pfam module annotation: Pfam domain module=PUF::PUF::PUF::PUF::PUF::PU F::PUF; Domain location=654-688::690-721::723-759::781-815::817 -852::952-986::997-1028
MATESPIRISEAGGKWPSHKEAAAFGSLSRNMATEDLGILLKGHRYQGGGKDVAPNRSGSAPPSIEGSFLAIENLLPQHNTTQNASFANLSSAMQNCESEEQLRADPAYLAYYNSNVNLNPRLPPPLTSWENRHLGRHIISFRNNWRMSTTDDSGKSSLHLPQRTLSTHKEESEDDSPQQPYDHELVKASGIWRSPDAASLASQHKNMVDLIQEDFPRTMSPVYNKSLSVSHGLVDKPIDLEAGSSSSHGPPVTTIKAGKPTIGADDIRVSSSVDTHAPVASSSSLESTGSIGVSDIATVESQLKALGVSNVPNSESLSYEEKWKASYQNNLMRHPGFQQQNNPYDVPSANSQNLNSVYVGREQFPFNSSKFSNVQPLLQSSGFTPPLYATAAAYMSSANPFYTNMEASGIYTPQYVGGYTVNPTAFPPYTAYPPHGVLPLVVDGATSSNYTPLTPGVSIGGNISHGAEMVQTNKYLGQFGFPPQPSFGDPMYMQYHQQPFVEGYGISGHFDPLAPRASGVSQISPYDSQKRSSTGAYLDDKKLTDQRTSANMNSRRGGVSIPSYFGHMPNMGFVMQYPSSPLPSPVLSGYPEGSPGLPGVRNEIKLSPASGRNGGVISGWQGHRSFDSAHDPKMVNFLEDLKSGKGRRFELSDIIGHIVEFSSDQHGSRFIQQKLESCSGEEKALVFKEVLPHASKLMTDVFGNYVIQKYGSSEQRRELADRLVGQILPLSLQMYGCRVIQKATAIEICVDVLIMDFCHCGFVSALEVIELEQKAQLVHELDGNVMRCVRDQNGNHVIQKCIESIQTKKISFILSAFRGQVATLSMHPYGCRVIQRVLEHCMDESQCQFIVDEILESVCALAQDQYGETSNKGRQSLISEEQRLSENKGRWSPENKEKGAQVLLALRAQCSAVAAVAHAFDYIALNNSKAREVDHVLERGKPQERSQILSKLSGHIVQLSQHKFASNVVEKCLEYGDATERELLVAEIFGHDDQCDNLLTMMKDQFANYVVQKVIDICSENQRAMLLSHVRIHAHALKKYTYGKHIVARLEHQFGGVYSSTLVDKIEILVLFGILVTYN

SEQ ID NO: 122290 - protein, 180 aa, Glycine max
  Coding DNA Sequence Number=SeqID_30605
  Homolog annotation: Hit_ID=A7P2S6; Match level="QueryCoverage=59%, HitCoverage=46%, E-value=4e-08, Identity=32%"; Hit description =Chromosome chr1 scaffold_5, whole genome shotgun sequence
MKTPQSASKLKSCLSVICARCDFEPRKGKKVKVREKKKGGNKEEKRKVVDVLESHSMLENDHDEGEGFDNESPRSKVVESLWQDPDVNDSGLTEGSETEEDVGFHSDEEDIGINGQPISEDSLHLSSFDLHLQHNLSKEEIDSQRNRKFSWETPAIGMSNCKWIGVEANDFDVLMMIMMI

SEQ ID NO: 122291 - protein, 59 aa, Glycine max
  Coding DNA Sequence Number=SeqID_30606
MALNEKLGLGKSNKTEDDFEMSGNVEEQLTGDSVGPILRRTAWELRLGFRGGEGGSLNF

SEQ ID NO: 122292 - protein, 678 aa, Glycine max
  Coding DNA Sequence Number=SeqID_30607
  Gene Ontology: Mol. function=oxidoreductase activity; Cellular component=extracellular region; Biological process=response to oxidative stress
  Homolog annotation: Hit_ID=A7Q6C3; Match level="QueryCoverage=36%, HitCoverage=90%, E-value=1e-103, Identity=67%"; Hit description =Chromosome chr11 scaffold_56, whole genome shotgun sequence
  Pfam annotation: Domain name=peroxidase; Domain location=43-247; Score=315.2; E_value=1.2e-91; Accession=PF00141.14; Description =Peroxidase
  Subcellular localization annotation: CTP_CleavageSite=44; ConfidenceScore=5.33e-01
MGDPCFFVVLSSLLLLIVSTQTSSAQLTRGFYLNTCPNVEQLVRSAVEQKFQQTFVTAPATLRLFFHDCFVRGCDASILLASPNNKAEKDHPDDISLAGDGFDTVAKAKAAVDSDPQCRNKVSCADILALATRDVINLAGGPFYKVELGRRDGRISTIASVQRQLPHPDFNLDKLNSMFSFHGLTQTDMIALSVDSRIAINMDPVTPQKFDNQYFKNLQQGMGLFTSDQVLATDERSRGTINLFASNEQAFYNAFIEAITKMGRIGVKTGRQGCGMIESEWNCEKKVRVVVTRGTRSGGELEVGDDYSRMIRRGHNRPAIFLASYLVTWHLTQLAINCATSSRSPSQMKFSMILAKVLVTPGLNHLVQQLLKAVMICNNGEMVPGKGLLKKAMGCPYCKRTTPMPMLDASVSMVNGSLKSGLYGGSLDHGCNNGGITMDKATIEPSEAHKASKSFNGTRSGPLLNHNNFGSNWFNPFMQDQVAEMVEMILRNAAIDENVVEKDDDEVSEPCNRSSMEKQRAPSSSSKSSSIVGIGNRSLTVRAFKARNHGDVEARGIARFTAQASKVRLSHHPHSSILISSQFDQATLVKELYDVEVYREGGYLEVDRDRLTKPTTLQLLVVTHHNRKRSSGAKRESELGDEVLLDEIVGAPTVHQEEHHLARNLTHHSDGLECQMAR

SEQ ID NO: 122293 - protein, 283 aa, Glycine max
  Coding DNA Sequence Number=SeqID_30608
  Homolog annotation: Hit_ID=A2Q3A0; Match level="QueryCoverage=79%, HitCoverage=98%, E-value=9e-47, Identity=45%"; Hit description =Putative uncharacterized protein
MGRGWGYPIPDGYGDETINLNSSGIAYGYENMLESQGEDHDPRRKRTTKDRPVDVEFASMGTKIEYSINLLASSVDSNNFIVGGVDVWEHYQNKGETNKHCSIGVNKLQDPMDRMLDRNNIESIKKTMQMHEEIFKYQERSGSCSGETIKRQRGFDLERPAERDIFGGGCDEHEAGLSSYTALERCKISSNNDDGYDEDMEVDLTLSIGGGSQVNDKKNSSSKKPYLLPLGCSDSPNGKTRELNSSVSFQSDRVGDFSDPTTPMSSSSVTFDQERKGPHWLSQ

SEQ ID NO: 122294 - protein, 51 aa, Glycine max
  Coding DNA Sequence Number=SeqID_30609
MERDKRSERSTARDVVEARKELAIVPQIAQIKKARISKRINKIQTELALLW

SEQ ID NO: 122295 - protein, 308 aa, Glycine max
  Coding DNA Sequence Number=SeqID_30610
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=A2Q3A6; Match level="QueryCoverage=99%, HitCoverage=29%, E-value=1e-121, Identity=73%"; Hit description =Plasma-membrane proton-efflux P-type ATPase
  Pfam annotation: Domain name=Cation_ATPase_N; Domain location=42-118; Score=104.2; E_value=3.9e-28; Accession=PF00690.17; Description =Cation transporterATPase, N-terminus
  Pfam annotation: Domain name=E1-E2_ATPase; Domain location=130-308; Score=174.1; E_value=3.7e-49; Accession=PF00122.11; Description=E1 -E2 ATPase
  Pfam module annotation: Pfam domain module=Cation_ATPase_N::E1-E2 _ATPase; Domain location=42-118::130-308
MAGDKGTITLEEIKNETVDLEVGSYSEHCVLVEACAVFGYNWAYSRERIPIEEVFEQLKCTREGLSSTEGENRLQIFGPNKLEEKKESKFLKFLGFMWNPLSWVMEAAAIMAIALANGEGKPPDWQDFVGIVCLLLINSTISFIEENNAGNAAAALMAGLAPKTKVLRDGKWSEQEAAILVPGDIISIKLGDIIPADARLLEGDPLMVDQAALTGESLPVTKHPGQEVFSGSTCKQGEIEAVVIATGVHTFFGKAAHLVDSTNQVGHFQKVLTAIGNFCICSIAVGMLAEIIVMYPIQHRKYRDGIDN

SEQ ID NO: 122296 - protein, 568 aa, Glycine max
  Coding DNA Sequence Number=SeqID_30611
  Gene Ontology: Mol. function=scavenger receptor activity; Cellular component=membrane; Biological process=regulation of transcription, DNA-dependent
  Homolog annotation: Hit_ID=A2Q1M2; Match level="QueryCoverage=93%, HitCoverage=95%, E-value=0.0, Identity=68%"; Hit description =Speract/scavenger receptor; Cyclin-like F-box; Galactose oxidase, central
  Pfam annotation: Domain name=F-box; Domain location=154-202; Score =30.9; E_value=4.7e-06; Accession=PF00646.24; Description=F-box domain
  Pfam annotation: Domain name=Kelch_1; Domain location=251-301; Score =23.2; E_value=0.00097; Accession=PF01344.16; Description=Kelch motif
  Pfam annotation: Domain name=Kelch_1; Domain location=304-351; Score =15.7; E_value=0.04; Accession=PF01344.16; Description=Kelch motif
  Pfam annotation: Domain name=Kelch_1; Domain location=356-404; Score =5.1; E_value=0.76; Accession=PF01344.16; Description=Kelch motif
  Pfam annotation: Domain name=Kelch_1; Domain location=409-460; Score =3.1; E_value=1.3; Accession=PF01344.16; Description=Kelch motif
  Pfam annotation: Domain name=Kelch_1; Domain location=475-523; Score =10.1; E_value=0.19; Accession=PF01344.16; Description=Kelch motif
  Pfam annotation: Domain name=Kelch_2; Domain location=251-299; Score =14.4; E_value=0.42; Accession=PF07646.6; Description=Kelch motif
  Pfam annotation: Domain name=Kelch_2; Domain location=304-351; Score =27.8; E_value=4e-05; Accession=PF07646.6; Description=Kelch motif
  Pfam annotation: Domain name=Kelch_2; Domain location=355-401; Score =12.7; E_value=1.3; Accession=PF07646.6; Description=Kelch motif
  Pfam annotation: Domain name=Kelch_2; Domain location=409-460; Score =38.2; E_value=2.9e-08; Accession=PF07646.6; Description=Kelch motif
  Pfam annotation: Domain name=Kelch_2; Domain location=475-523; Score =33.4; E_value=8.4e-07; Accession=PF07646.6; Description=Kelch motif
  Pfam module annotation: Pfam domain module=F-box::Kelch_1::Kelch _1::Kelch_1::Kelch_1::Kelch_1::Kelch_2::Kelch_2::Kelch_2::Kelch _2::Kelch_2; Domain location=154-202::251-301::304-351::356-404::409 -460::475-523::251-299::...
  Pfam module annotation: Domain location=304-351::355-401::409 -460::475-523
MALVSQLSMSSAYIDTGFGPKPNHSAEQGSLIRAADVACRGPFAKRRHPLVDSTVVSEIRRCLDEGVEFQGELLNFRKDGSPLMNRLRLTPIYGDGEITHVIGIQFFTEANIDLGPLPGSTIKESTKSSDRFHSVLSSLNPLPVGDRNVTRGVCGILQLSDEVLSLKILARLTPRDIASVASVCRRLYELTENEDLWRMVCQNAWGSETTRVLETVPGARRLGWGRLARELTTLEAAAWRKLTVGGAVEPSRCNFSACAVGNRVVLFGGEGVNMQPMNDTFVLDLNSSNPEWQHVQVSSPPPGRWGHTLSCVNGSRLVVFGGCGTQGLLNDVFVLDLDAKPPTWREISGLAPPLPRSWHSSCTLDGTKLIVSGGCADSGVLLSDTFLLDLSMEKPVWREIPVAWTPPSRLGHTLSVYGGRKILMFGGLAKSGPLRFRSSDVFTMDLSEEEPCWRCVTGSGMPGAGNPGGIAPPPRLDHVAVSLPGGRILIFGGSVAGLHSASQLYILDPTDEKPTWRILNVPGCPPRFAWGHSTCVVGGTRAIVLGGQTGEEWMLSELHELSLASSVI

SEQ ID NO: 122297 - protein, 139 aa, Glycine max
  Coding DNA Sequence Number=SeqID_30612
MRKGVEERKGVNETPRRGGSMVVCPVPWTGGAQAALVPALAERDAREGEGGTGGGGVIVMDRAGGDGSGGEGEADGGKGREDEANLRGEQGAEMACGGANWEVNLPAEEVPPEHPEPVLGINFARDGMQEKDFRLAIFS

SEQ ID NO: 122298 - protein, 475 aa, Glycine max
  Coding DNA Sequence Number=SeqID_30613
  Subcellular localization annotation: CTP_CleavageSite=45; ConfidenceScore=5.31e-01
MKHSHCGSLGLGAKSYAGGRVKATHLSSLHLSLVLTSFLLLPLLSLSYNGSVLRSASLALDFLALLARYAPWMGLPFKVGSLWPGRDDYVVESGKGAKKINSYPTRFQTRESIEELKRKINIMALDDIELLIVEPCSTKEHVFMRASKDETNFVYMAMITRICMKEPSKSDPTKKSVKVMEEGVKGGNVKVEIVHLDGQNVADKGAEENNADKGSAGVMDKEKELEEEVVQRDNPSTRGSSMNKAILCYHEGNECDKMDYVGPVESAWTPSRSSLVDKKTKAMVARVKAMKVQVSKTKQLVVELAKSRGLVRKLEEDSRLACWETLEEDRSNMCSPSAPQARSASRLSLLALSVPSSQVKDIGTRVEGNLETTEDKVADLKKRIEKLRSKLQKKEEAKCAVTVELDETQRQVKVLLLSFGPGQLDVNFDVVDGEIIRELQLCSESEGEEEKEAKVRIRPVVFLKKLRFGFDLSLA

SEQ ID NO: 122299 - protein, 120 aa, Glycine max
  Coding DNA Sequence Number=SeqID_30614
MLDHGCYDIAQVGRGILISWITTPLRGFQTFVILSLGKEKGGDVVAEGGNVWGEVKEKACDEDSTSVMNEEVGEFYVIYLLPKTSALVQLPTVVSGDCIGKEEEKEADDGAADAAGHSRG

SEQ ID NO: 122300 - protein, 294 aa, Glycine max
  Coding DNA Sequence Number=SeqID_30615
  Homolog annotation: Hit_ID=A7Q1C5; Match level="QueryCoverage=41%, HitCoverage=30%, E-value=6e-41, Identity=67%"; Hit description =Chromosome chr10 scaffold_43, whole genome shotgun sequence
MVWYLYWVTNHEVLKTEDYFSLLIAAISTDLYGIRVKLATDYRCQSNISQSQVPSTFQDNLLVSELCQAVKYLGEKIFNLIYDIEAHKDLITSYRDNNNHNILHLAGKLAPSDQLHVVSGAALQMQRELLWFKEVEKIIQPLFKEIKDSEGRTPQMLFTEEHKGLAKGEKWLKNTASSCMLVATLLSFSLFPTPQPFSLPLSHLSIASHPLLFSLVSLRPPNLLRIFFLHKGIIIRRRIMVFPPNQSQKNDDLEPVHRWIIVKFDYHVRNTIPSILTVGNFDIMSELREKSFAL

SEQ ID NO: 122301 - protein, 518 aa, Glycine max
  Coding DNA Sequence Number=SeqID_30616
  Homolog annotation: Hit_ID=A7Q9H7; Match level="QueryCoverage=75%, HitCoverage=86%, E-value=7e-63, Identity=37%"; Hit description =Chromosome chr19 scaffold_66, whole genome shotgun sequence
  Pfam annotation: Domain name=DUF247; Domain location=52-445; Score =320.6; E_value=2.9e-93; Accession=PF03140.6; Description=Plant protein of unknown function
MAWPKLIKFAYHRFTTRKFHGTANRMSSNWRHLMKKELQSGNSAKQEESHPHHPHPVCIYRVPSNMRQVEPKAYRPNNISIGPCHHGAPHLENMVDLKKRFYRRLFDPTNDENGAKLDEAFKFLEEQESEVRGCYMEDIKLSSDEFLQMMLVDSSFVVQLLRDLSAFKFGHIPHLSSTWMLPIIRREMIMLENQLPMFLLSKLFELTSTDDPPSSLKELALRFFYPLLQVDSNNFPECEKVEELRGLHFLDLLRSSIRPKLGENLRKPQHHMIRSVTELMEAGVKIKADESKQLLDISFGKKYGFLMRELTIPPLYINDHRGTVFRNIVAFENCHKDCNPDVTTYLFFFNGLINSSDDVSLLHYKGVLNHSLGNDNTVSELINNITKEIVRDKNESYLYKVVNKANSYFGSFYARKRASLVHHYLTSWVVGVSTIGALLALYFTFIQTVCGFADALKALENKNFGSLFVDAFCIPVRGTPTTNSESENSTSEDATTKSESNGWKFIQWFFWVENVLHR

SEQ ID NO: 122302 - protein, 190 aa, Glycine max
  Coding DNA Sequence Number=SeqID_30617
  Homolog annotation: Hit_ID=Q1RU80; Match level="QueryCoverage=54%, HitCoverage=84%, E-value=8e-11, Identity=35%"; Hit description =Putative uncharacterized protein
MGEVSITLDDVASLLHLPIVGAFHTFEPLHVDEVMLMLVELLEVSGEAPRAETAQYALRDLSQSGSYAWAVVVLVHMYDHLNDACRSSSQQLAGYITLLQCWIYKHFPSVAECMVDSDYDELRWGPIAVRNRPERIMRQFGYVQSIPIEAVNSWVSFEEIDDRWVHYSYHLAPAGEICLMPGQCAPEYMD

SEQ ID NO: 122303 - protein, 251 aa, Glycine max
  Coding DNA Sequence Number=SeqID_30618
  Gene Ontology: Mol. function=microtubule motor activity; Cellular component=microtubule associated complex; Biological process =microtubule-based movement
  Homolog annotation: Hit_ID=A7P9D5; Match level="QueryCoverage=91%, HitCoverage=8%, E-value=9e-66, Identity=56%"; Hit description =Chromosome chr3 scaffold_8, whole genome shotgun sequence
MAENFKSVACDLECLKSQCLYSTKLIQPWLEKIWSEIVFKDCAMFVLHLCHMGILLETITGMHVENGLLSHGLCESNSIISDLKEHNYRTKQELHMCKILKGKLLVDIKNNFDRINKKEVEAREITIKLNNFAKNISDLQLQEEMMLQRSNEMGSQLAKLMRELDVSNIDIVTSLLDQEKLLKQKVVAIECEAEFFMANWVNLLKLTERMEITESLEDEILEMNIVFSQMNDSFTKLSSDLDDVTNKRDQL

SEQ ID NO: 122304 - protein, 301 aa, Glycine max
  Coding DNA Sequence Number=SeqID_30619
MTRSMRQIRSASSIHLARHTARLADWETLEEDKLEMCSPSAQPACLTRMLSLLVLSASCLAKPKFTYFRLASLRKLKGPRAFKTLKLAEIRRRGVIAQINHAIGAVGVVSKECKVVVAQYGKTILDKLINEVLSVSAVRDNILEAVKVLIDGAYVSTVLESLLFSKTVCFYPSLKVNTFNDVSFYDGRRPSLYVAIASFTPHLPPILEEPTMTAGVDGLTSAPIRPNIAKTLQAENVSYSASLITLIKANQVHGLSHEDPYTQLANAVEICNTMKIAQANNLRTWEEVVFKFLKKYFPQPI

SEQ ID NO: 122305 - protein, 473 aa, Glycine max
  Coding DNA Sequence Number=SeqID_30620
  Homolog annotation: Hit_ID=A5BCG5; Match level="QueryCoverage=96%, HitCoverage=81%, E-value=6e-96, Identity=43%"; Hit description =Putative uncharacterized protein
  Pfam annotation: Domain name=Ank; Domain location=142-174; Score =22.3; E_value=0.0018; Accession=PF00023.21; Description=Ankyrin repeat
  Pfam annotation: Domain name=Ank; Domain location=291-323; Score=7.7; E_value=2.5; Accession=PF00023.21; Description=Ankyrin repeat
  Pfam annotation: Domain name=Ank; Domain location=73-107; Score=6.9; E_value=3.3; Accession=PF00023.21; Description=Ankyrin repeat
  Pfam module annotation: Pfam domain module=Ank::Ank::Ank; Domain location=142-174::291-323::73-107
LLHLSKPGISTGVVPTAAAAAASLMSDGGEEARHRYLTQCVPLHKAALKGDWKEAKKILDQDPTLLKSAITKGWATVLHIAVGANHECFVEELVKLLSREDLELLDDKGNTAFCFAAAVGNVHIAEIMRIKNESLPTIRGGEGVTPLHLAVLQGRSEMTRYLFDKTREILYDDDWITLFLICVNSGLYELALEMLNQRESLAFARGDNYETALHVLARKPLNCGKNMKDPPVLKLTRRIWDIFLTLDDSEMMDAIREPSQVTFIAAEEGNFEFLSVIMSTYPDLIWELNTMGRSIIHVAALHRHASIFNLIHEIGPSKDFVLTFLDDEGSTLLHSVAVIAPTDRLNVVSGAAFQMMLELTWFEEVKKIMLPSFVEMPNYEGIIPRELFTNQHEDLLKKGESWMKRTASSCMVVSTLIATGVFSAAFSVPGGIDDKLGSPNYLKKPLFTVTAIQIDIWTSVTIFLNNQHDGSIQ

SEQ ID NO: 122306 - protein, 175 aa, Glycine max
  Coding DNA Sequence Number=SeqID_30621
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=27%, HitCoverage=25%, E-value=9e-15, Identity=81%"; Hit description =Chromosome chr4 scaffold_32, whole genome shotgun sequence
  Subcellular localization annotation: CTP_CleavageSite=42; ConfidenceScore=5.10e-01
MNTIGDDMGYSGDSEDKRGSLSSQDNVKQSPSTLAGAMSCAKSSKYKKGSKFSGNGTQTHEHDVSVRGKLSIEENPTLLLELCGSKKPYIALGTVVGAQSSKLSTLPVNKFLISAVALSEVDCAFSGFQACESYTPSKVSIRAVDGFHNLKEIKTVELVKAIGWVYLSLSGADPR

SEQ ID NO: 122307 - protein, 115 aa, Glycine max
  Coding DNA Sequence Number=SeqID_30622
  Subcellular localization annotation: CTP_CleavageSite=54; ConfidenceScore=5.61e-01
MPSNPFSPFFPSPSSSYPTENNSPHATNRKQLTSWKLGENCKKVTWFRESLSIRSSSTWFRDLVAWTKITHEVGEEWLDDAVVAVDGGGGAAWSTVVARWWWFPNKPKIWYCSSL

SEQ ID NO: 122308 - protein, 230 aa, Glycine max
  Coding DNA Sequence Number=SeqID_30623
MVYGGGMVVVVSGEEGEEGDGVTASSGSGDPPPNGGHAQPIQPPSTNTNFNHIISEKLDVVNSLLEIADSIQANLVQQNQNQPQNPNQNQYLNYSQNDQNQYQQSNFNGGRGGRFGGRRGRGGRSSIQCSICFQYGHDAGNCRHIPSFSFYGTTYPSMTQPMQPMVQPMQVSFGTQQQYAQALVQYVPMLNNFSAQPVFPQQLQQQAYLGTAQSIFPHHKATWESLHKLQ

SEQ ID NO: 122309 - protein, 93 aa, Glycine max
  Coding DNA Sequence Number=SeqID_30624
  Gene Ontology: Mol. function=RNA binding; Biological process =gynoecium development
  Homolog annotation: Hit_ID=A7QUD9; Match level="QueryCoverage=90%, HitCoverage=16%, E-value=3e-16, Identity=60%"; Hit description =Chromosome chr11 scaffold_177, whole genome shotgun sequence
MANHFHEDEVQSYATVDERIVEIQGEALKVLKALEAVVGHLRKFLVDHSVLPLFEKTNGVPEVLIIQERTIQMVPQSDIHILKGNQSMDIGFI

SEQ ID NO: 122310 - protein, 167 aa, Glycine max
  Coding DNA Sequence Number=SeqID_30625
  Subcellular localization annotation: CTP_CleavageSite=64; ConfidenceScore=5.00e-01
MKKIQGLQAPHGATSNILPSDHNFDLPLPKCQLVHAILTQVSTSFMECLSPPAFGPLSPGPSSRSTTPPDRLRARHHNSLEMPSRRKLMHRCLLRVHLSSLAESQDPNTYAWPTHEQFDPTVAWPGDWPDAQTGAGHAGTSGDGYGTEEDDDMANVMDFFLGGGGDV

SEQ ID NO: 122311 - protein, 133 aa, Glycine max
  Coding DNA Sequence Number=SeqID_30626
MASMMEAMLGMKRLIESNATTATVVSTTAEVDPVFPSTTNLAHQLSLDMVGRERDTLGNTNSPHFGYNRSAYPNGLPPNFTPPAMHENTNHAIPFTFEGQLPQPVGGTREEPWERAQGDIDSYPPFPHLGTGT

SEQ ID NO: 122312 - protein, 94 aa, Glycine max
  Coding DNA Sequence Number=SeqID_30627
MTLGNGYLGSCIDEERSEMRYLVVYADLPRAPASWLVEIWVHGRLRRDKMVDEPRSRPITCEPVSSGPIDDPLRARTLPTRPQSGGYPLSLSIS

SEQ ID NO: 122313 - protein, 204 aa, Glycine max
  Coding DNA Sequence Number=SeqID_30628
MTGRLLAGSLTFDNRIMHYIIVRILLPRSSNLAQASKEDLILMWAFLTSRQIDWAHLVRYRMHKALRANAPLPYPQLITLFLRHFQIPLDDEPYVQVKRSFAIGAGAVTSFGYRKDRNGQWLKKDAFPPQDERTPSPPPQRDDSTLMNEVLTELRGLRFYVGERFDSLDTRFAGMDIRLTQLEEDVGYIRQSFDLPPPPPPSRI

SEQ ID NO: 122314 - protein, 78 aa, Glycine max
  Coding DNA Sequence Number=SeqID_30629
  Homolog annotation: Hit_ID=A6FJQ2; Match level="QueryCoverage=48%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGCQAMWGSGVGRPHYKKVLDYQWTTIKALSWW

SEQ ID NO: 122315 - protein, 128 aa, Glycine max
  Coding DNA Sequence Number=SeqID_30630
MKTGENEEDENEGETLAMTAIPTRSNFPSVQQCHYSANISPSHYPPPSHPQRPSLNQPQSLPAAHPAMVAITPAKVPQPPFFRGYDSDATCVYHGGVPGHSIEHCMTLKLKVQSLIDVGWLKFEEHRL

SEQ ID NO: 122316 - protein, 116 aa, Glycine max
  Coding DNA Sequence Number=SeqID_30631
MVIHTFCQPEASEPVDTQRLTSSSAPLSSRDCKSDGMRRYFMVIRTFCQPEASEPVDTHRLTWSSAPLSSRDGESDEMRRYLMVIHTFCQLEASDPVDMQRLNIVICTFFIQRRQV

SEQ ID NO: 122317 - protein, 105 aa, Glycine max
  Coding DNA Sequence Number=SeqID_30632
MKKQSGSQDNGDRGNNELQENGKPQEIIPSTTLLVIYQKGYTWTLFITHKNDAFQAFRKLAKIIQNKKNLKIISIRSDQWGIRHRVEHNFSAPRTPQQNGYVEEE

SEQ ID NO: 122318 - protein, 274 aa, Glycine max
  Coding DNA Sequence Number=SeqID_30633
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=29%, HitCoverage=73%, E-value=1e-36, Identity=95%"; Hit description =Chromosome undetermined scaffold_79, whole genome shotgun sequence
  Pfam annotation: Domain name=Complex1_49kDa; Domain location=57-274; Score=-65.8; E_value=3.3e-08; Accession=PF00346.10; Description =Respiratory-chain NADH dehydrogenase,
TGLRALFRLVGWEVPLMIILCVLSGLESGYTLHMMDPAGGQPAANPAAEQPSNVPSGASTSGWRSFEEGVLLESSNESSEASVNQQPVIPELEPPLLDDNTPASRARCSIEGELVGGSLITSESSTPSSGVNLQSKGHIEAALVADGYSPQVVFERRHMIRGFLFYPEGHALSENAYAGYLTKIANFAGKMTTGSSVYSTSIHHFELYTEGFSVPAPSTYTAVEAPKGEFGVFLVSNGSNRPHRRKIRAPSSAHSQGLDSMSKHHMPADVVTII

SEQ ID NO: 122319 - protein, 164 aa, Glycine max
  Coding DNA Sequence Number=SeqID_30634
  Pfam annotation: Domain name=Transposase_23; Domain location=80-150; Score=-8.0; E_value=0.0088; Accession=PF03017.5; Description =TNP1ENSPM transposase
MAPEDLEQLTQKIRDQLEEPITEKVTRQLMLSFSQMQSHFQSQMQSQGLTLPPEPEVSPSYARVSTKESCVDPLGNDPDKGDSEKYGLYVEENPPRLVALGRLYEGSTTVHNIPLLHDHVKVGVEEVKDADTLIHVPTEEVKLVGQTLNTFLTWSTHLVKRLSK

SEQ ID NO: 122320 - protein, 123 aa, Glycine max
  Coding DNA Sequence Number=SeqID_30635
MSNQKSTESAIKNLEVQVGQLAKQLADRSSSSFTANTEKNPKEECKAVMTRSRMAIQRDDSEAGKKMKEHKQQLAPKPALEPLSDFVELEEINEETEDDKEEETPIKEKEKERRKRKTKKVEK

SEQ ID NO: 122321 - protein, 149 aa, Glycine max
  Coding DNA Sequence Number=SeqID_30636
FACNVVSWQFSLHQYPKFVNINQCTLRVRLIASEPNLRSCLMDEGLTGTLSMEFGDITVHFNILDAMKYPSEDLSVFRAEIIDHVVDEYMTDLYSNLHASHFSCIESEIVLDHMTEFDVESDIDCMPGGGVLPLEIDFIESDRTNHVSG

SEQ ID NO: 122322 - protein, 127 aa, Glycine max
  Coding DNA Sequence Number=SeqID_30637
WNCSLHYFLEIRTIIIVIKRKECALRCPYPTCAKARVMSEIEEVQEQMKADMEAMKDQMAAMMEAMLSMKKIMEDNVVAVATMSAATEVDPTHPPGLNQVNPPISDMVGQGGEVMQSYTPRALDRRL

SEQ ID NO: 122323 - protein, 53 aa, Glycine max
  Coding DNA Sequence Number=SeqID_30638
MEVEEPWLGLWLPLNYRVDMGSSSAYDNGIWGEPYRLFAVVFVIGSAVDKLCG

SEQ ID NO: 122324 - protein, 185 aa, Glycine max
  Coding DNA Sequence Number=SeqID_30639
  Homolog annotation: Hit_ID=Q6WAY6; Match level="QueryCoverage=49%, HitCoverage=16%, E-value=6e-12, Identity=38%"; Hit description =Putative uncharacterized protein
RQGRSLFSCGDYPNVPLIGTRGCINYNPALAIRQLGYPMRGTPTEESLSPFLVRGLGAQSLKPIQRVHKAWRSPLKKDKELRGIRNVVIGGYHGWLRIHTRGLDWLYKLKVIEEENFEAPEEDEEVQALKLELGKARLAKEKFKSVATHIRKECTELQEENAATARALEQEIKRARKEEYGREKF

SEQ ID NO: 122325 - protein, 67 aa, Glycine max
  Coding DNA Sequence Number=SeqID_30640
  Gene Ontology: Mol. function=transferase activity
  Homolog annotation: Hit_ID=A5BZ49; Match level="QueryCoverage=91%, HitCoverage=45%, E-value=3e-15, Identity=57%"; Hit description =Putative uncharacterized protein
MEAKFISYFEATFHGAIILKLYYDTSATIFMAKNNKSGSQSKHTNIKYLAIRERVKEKKVVNTLALS

SEQ ID NO: 122326 - protein, 160 aa, Glycine max
  Coding DNA Sequence Number=SeqID_30641
  Gene Ontology: Mol. function=cofactor binding; Biological process =electron transport
  Homolog annotation: Hit_ID=A6TER9; Match level="QueryCoverage=100%, HitCoverage=47%, E-value=9e-79, Identity=88%"; Hit description =Putative uncharacterized protein
  Pfam annotation: Domain name=Oxidored_molyb; Domain location=95-160; Score=-73.5; E_value=0.071; Accession=PF00174.10; Description =Oxidoreductase molybdopterin binding
MTEDAMKTRKLTEADVTAESVFNLQRRQVLKMLGIGATAMSLSTKAHADLLDWFKGHDRPPAPAGKALTFDKPAAWQSKLALTPEDKVAGYNNFYEFGLDKADPAANAGSLRTDPWTLTIGGEVAKPLTLDHDDLTRRFPLEERIYRMRCVEAWSMVVPW

SEQ ID NO: 122327 - protein, 16 aa, Glycine max
  Coding DNA Sequence Number=SeqID_30642
YFHASGIGWEGKDDFP

SEQ ID NO: 122328 - protein, 44 aa, Glycine max
  Coding DNA Sequence Number=SeqID_30643
MEKKREVVAAQLAQNVAELYGLRKNALFDFQNVAELYRLLNDGC

SEQ ID NO: 122329 - protein, 232 aa, Glycine max
  Coding DNA Sequence Number=SeqID_30644
  Homolog annotation: Hit_ID=Q6WAY6; Match level="QueryCoverage=46%, HitCoverage=21%, E-value=1e-14, Identity=37%"; Hit description =Putative uncharacterized protein
VRHTCPLESHRSCTEKGRANWDQLLASKEGTSVNWFPRWKEGRTEVLISCGGFPNVPLMGTRGCISYNPVLAIRQLGYPMKGAPLEDELTPVRKAWEVLQKKDKELRGSNNGPIGGYRKWLKTHVQGLDWLPSLRTDKREEVEAPEEDEEVQALRTELKQAQTVKERFELAALKIRKENTELRDVNVATTKALEQETERACREECGWNKFRRTLWGSNSELKLRREERDQSR

SEQ ID NO: 122330 - protein, 330 aa, Glycine max
  Coding DNA Sequence Number=SeqID_30645
  Subcellular localization annotation: CTP_CleavageSite=31; ConfidenceScore=5.19e-01
MATPPSFPPLTDATSYSPSTLKRIRKATCLRSLATRPVGVEKPLVHVDPTIKKADGPHRKKLRTYLGIVARDKSDLMSKWALAADKDSVDDTSRRDPSWEDVQKKAQAIQKQNSAPHVLFHGGYEFLENKLMKEKKKKQLEEATKFGSTNTVIDPPSPIRRHVKWKMSRTNKTGQMTSKVAKEIVDKIDVLTAAIGQPEHHGRVRAAGAGMQSQKLALPPEPEVGHLATRVSTKESCVDPSGNDLDAGRLYEGSTTIHNIPLHHDQVKVGVEEVRDANALIPVSTEEVMWDATVFGVFNDNFPLYIKHEDLSKITHGGQCLSISVIQLWI

SEQ ID NO: 122331 - protein, 65 aa, Glycine max
  Coding DNA Sequence Number=SeqID_30646
MTLGAEFNVESLTCRDWNTSAKVSQKVCVRFCARKKRTTYISMKFSRLKKLGLGFDMLMKDRDTG

SEQ ID NO: 122332 - protein, 117 aa, Glycine max
  Coding DNA Sequence Number=SeqID_30647
  Homolog annotation: Hit_ID=UPI0001652057; Match level="QueryCoverage =72%, HitCoverage=31%, E-value=2e-07, Identity=33%"; Hit description =conserved hypothetical protein
  Subcellular localization annotation: CTP_CleavageSite=58; ConfidenceScore=5.13e-01
NPCGVYPDLSSFIGSGVYPDLSSLTGSGVYPDLSSFTGSGVYPDLSSFTGSGVYPDLSSFTGSGVYPDLSSFTGSGVYPDLSSFTGGGVNQKLYRLYQAIRPVRFASSGIRASLLIQ

SEQ ID NO: 122333 - protein, 203 aa, Glycine max
  Coding DNA Sequence Number=SeqID_30648
MTTQMQRLLNRNNEELYRRIAKSSLFILKPLSPREVCDDQIRMREKREQEKENSEAPQRNRKKKSDTPEGKSDTHKRESDTHERKFNYFAEASEVRKVLPAHEPLCLQYCKDSKISTETQRKDAHAKVEYVKRLYDQVNVQIAKKNESYTKQANKKRKEVVLEPGDDLGHLRANVFQEGGNDESPETGQIQAKGPSGEGRRPK

SEQ ID NO: 122334 - protein, 34 aa, Glycine max
  Coding DNA Sequence Number=SeqID_30649
MVKAHKKGDKRGRWLPPSSPRRAGLLPPEGTAFC

SEQ ID NO: 122335 - protein, 144 aa, Glycine max
  Coding DNA Sequence Number=SeqID_30650
METLAMFRYEASSWSYMTRSRLPSGKKGRKEMAHAVSSTPAWVKPQQTHLMVPIQYACRHAPIASRLMLGTPLVQHPCSLRRPPRGKLPKFNSEHDSTGPDHPRQLKKGGSSISSRKIESRGRIWGLSVRRHDDLCLVPDVYPL

SEQ ID NO: 122336 - protein, 68 aa, Glycine max
  Coding DNA Sequence Number=SeqID_30651
  Pfam annotation: Domain name=G-patch; Domain location=2-43; Score =23.5; E_value=0.00028; Accession=PF01585.14; Description=G-patch domain
MMVTHVMLGHGYEPGMGLGKNNDGKANLVDIKENRGKFGLGYKPTRTDMRRSVLERRNRGMGPQLSHK

SEQ ID NO: 122337 - protein, 137 aa, Glycine max
  Coding DNA Sequence Number=SeqID_30652
MSHAVKDHRGKWAPNYEGPFVVKRAFSGGALGQDHLELPSGVETKYEQQKPIKVRQRYGQDWPHQVVSYLQVSSPGRATPAPNYKNDERGDVFAFKNFFPPPPFKSHTHGIDEFAALGSSFFAFFDSVLRFCSSPTS

SEQ ID NO: 122338 - protein, 105 aa, Glycine max
  Coding DNA Sequence Number=SeqID_30653
  Gene Ontology: Mol. function=RNA-directed DNA polymerase activity; Biological process=regulation of transcription, DNA-dependent
  Homolog annotation: Hit_ID=A7QZD9; Match level="QueryCoverage=85%, HitCoverage=40%, E-value=2e-20, Identity=48%"; Hit description =Chromosome chr16 scaffold_271, whole genome shotgun sequence
MTETSQKSLRIPCCVQVAIKPLIDMGIDVAVLMCLRDIRHNKFEDSLIGTIETSLRQGPIYFNCYPNKTVSLMDRNILDSLFLNTHFHGLDMKEGSIPTALIYRI

SEQ ID NO: 122339 - protein, 72 aa, Glycine max
  Coding DNA Sequence Number=SeqID_30654
MEAQLIHDRVVMECLQGVWETLEGNERCRFRGTIRLTATSLVHPGGTRTHTTATCGVDTTYTYSISTSGASS

SEQ ID NO: 122340 - protein, 64 aa, Glycine max
  Coding DNA Sequence Number=SeqID_30655
MEKTKLFQALTEAETPFVLKFQRGEDELFTFHLMARGKLKAKLWSGSLDTGYEDLDDATSSEGR

SEQ ID NO: 122341 - protein, 192 aa, Glycine max
  Coding DNA Sequence Number=SeqID_30656
  Gene Ontology: Mol. function=oxidoreductase activity, acting on paired donors, with incorporation or reduction of molecular oxygen, NADH or NADPH as one donor, and incorporation of one atom of oxygen; Biological process=...
  Gene Ontology: Biological process=ubiquinone biosynthetic process
  Homolog annotation: Hit_ID=A8GIS3; Match level="QueryCoverage=83%, HitCoverage=41%, E-value=8e-77, Identity=90%"; Hit description=2 -polyprenyl-6-methoxyphenol 4-hydroxylase precursor
MAGATLALAISSLTQGRMAVDLVEATRPDDRSHPGFDARAIALAQGTCQQLARIGVWPALRDCATPIAQVHVSDRGHAGFVNLQAQDYQVDALGQVIELHNAGQRLFALLAKAPGVTLHCPARVVDVIRTAERAEVQLDTGLSLCGQLLVAADGSRSALAQPATCSGGRRTIRSSPPSPTSPRRKICRARLR

SEQ ID NO: 122342 - protein, 48 aa, Glycine max
  Coding DNA Sequence Number=SeqID_30657
MKTLLIPHDVAPCGASEWRRRRVERRRHFKEKMSQEEAHQHRKLWIRV

SEQ ID NO: 122343 - protein, 82 aa, Glycine max
  Coding DNA Sequence Number=SeqID_30658
MTIRLCRELPLFNFERLDILCPRIGQQQQQQQQPRLIPLVFLMRIMKLAKYRLKAQVEKDEGPSGEGQSPRVEKDEGPSGEG

SEQ ID NO: 122344 - protein, 74 aa, Glycine max
  Coding DNA Sequence Number=SeqID_30659
GCTRLSDTWRSKKGIQRIYTVRKHLLWNGKLQKKLLNFVQSTLRKQNLLGFPSLSMTKEWEVRVQEGCMLSLQV

SEQ ID NO: 122345 - protein, 151 aa, Glycine max
  Coding DNA Sequence Number=SeqID_30660
MGEVEEVQEQMKTDMEVMKEKMATMMEAMMSVKKIMEVNAVAIAATTPLLRRPHDVQIQNEHAFPPYGLPPNYTPPNVAYTPDEDVNNSAPILIESRQPHHEHVSQLMGETYEIPHHNLAKFEPCLRYATKGQAVGGIPLQNTLEGPQFCP

SEQ ID NO: 122346 - protein, 173 aa, Glycine max
  Coding DNA Sequence Number=SeqID_30661
MDNEEGVQEQMKADLSALKDQMVSISEVMLKLQKTIEDKATATASSTAREAEPVLQPALNLGRDRNTAVFGRRYSPQAYPYGLPPDFAPRAAPEDLSQTPTFEGQLPPYDDYPVQDDEEGDTHLGPLLRLKDPSLHELPQPNVVRHVPSSPAPVIESVPFAEDKGKIDALERG

SEQ ID NO: 122347 - protein, 151 aa, Glycine max
  Coding DNA Sequence Number=SeqID_30662
  Homolog annotation: Hit_ID=Q2PEW8; Match level="QueryCoverage=98%, HitCoverage=37%, E-value=1e-35, Identity=44%"; Hit description =Putative uncharacterized protein
  Pfam annotation: Domain name=SURNod19; Domain location=2-151; Score= -168.2; E_value=6.9e-05; Accession=PF07712.3; Description=Stress up -regulated Nod 19
MVIDTRGAQDKKACTQCRCDQMNLPKDFYNVTRDIHNQKLTTNYKGGLFCCQDNLQCKQIEGFQGSRRMVSLRYKISWVDWNIYQIPVKVYILDSTDKVRSNGSKILHDCLAEYTIPAGGGGDSPHVQKANIPMENGGYLIYGTAHMHSGV

SEQ ID NO: 122348 - protein, 73 aa, Glycine max
  Coding DNA Sequence Number=SeqID_30663
MVLGKPWSLTTSLKKSFEMWEVSYPNFVRGPLFGDMQPSLDLLEQFESRPFQNILEVGLLKEEAIGRQAPPHF

SEQ ID NO: 122349 - protein, 57 aa, Glycine max
  Coding DNA Sequence Number=SeqID_30664
MSMGEVDVEPCLSASKFKNWEQGQPCNNRESITVIVQEVTPRETLLAAWKLMVNLLR

SEQ ID NO: 122350 - protein, 61 aa, Glycine max
  Coding DNA Sequence Number=SeqID_30665
MVRTRGLGRTLGRVIGRALGRKDRHDLDDAPQRLKAQVEKDKGPSGEGQSPRVEKDEGPSG

SEQ ID NO: 122351 - protein, 76 aa, Glycine max
  Coding DNA Sequence Number=SeqID_30666
MNCVFIHVSSTFEFGAMRSDFLEQFSILNPFSEPHELQFSFMCPPPSIHVSSTFEFGAMRSDCLDELSILNLFGAP

SEQ ID NO: 122352 - protein, 78 aa, Glycine max
  Coding DNA Sequence Number=SeqID_30667
MMFVRLWALWPDHIYSPVTWKLWHGGQNLKEGQDVATGDSSGDVWLFKDVLDWSILDINITRCMAQHSTCLRRWDAPY

SEQ ID NO: 122353 - protein, 162 aa, Glycine max
  Coding DNA Sequence Number=SeqID_30668
  Homolog annotation: Hit_ID=A1IW39; Match level="QueryCoverage=19%, HitCoverage=80%, E-value=2e-09, Identity=91%"; Hit description =Putative uncharacterized protein ophh-69
  Subcellular localization annotation: CTP_CleavageSite=26; ConfidenceScore=5.51e-01
RNSSLIERSAPKMNGAKRSAEAGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 122354 - protein, 149 aa, Glycine max
  Coding DNA Sequence Number=SeqID_30669
MSLPSVVHVFSLIKCEASGDWEARYSVVFQIGSFAKRKKKEVEMRVVIAKRAGRTKSVSYLCFPLISDERPTWAFQKVVSSVGSNLARLGELGGKHLPYFAINRGGSEEEKAEALPKRFCNVSVKNFAKGFNRSSAFFIRSSLFFDLQR

SEQ ID NO: 122355 - protein, 175 aa, Glycine max
  Coding DNA Sequence Number=SeqID_30670
MDKFDPEVVLEFYANAWPTEEGVRDMCSWVRGQWIPFDADALSQFLGDPLVLEEGQQSEFSQRRNRADGFDEKAIAQLLCTPGQDFARTAAGRRVRIMRTSMTTLPQTWMILLLSNVLPSDHNSDLPLPKCQLVIRPPITGAFIEKYCTPRQAHVMHLRPQMHRHHLIRPIPLDH

SEQ ID NO: 122356 - protein, 168 aa, Glycine max
  Coding DNA Sequence Number=SeqID_30671
  Pfam annotation: Domain name=Transposase_23; Domain location=85-155; Score=2.7; E_value=0.00059; Accession=PF03017.5; Description =TNP1ENSPM transposase
ILWTGSKDLPHVFLHGSRRPRIANSTNQGPGGGVDHRKSDSAANVMLQLDAVPVSVTDAIIGTYTASRVSTKESCVDPSRNDPDMGDLNKCRLYIEENHPRLVALGRVYEGSTTVHNIPLLHDQVKVAVEEVKDVDAPIPVPTEEVKLVGQTLNTFIAWPTHLVKRLS

SEQ ID NO: 122357 - protein, 222 aa, Glycine max
  Coding DNA Sequence Number=SeqID_30672
  Homolog annotation: Hit_ID=A2Q243; Match level="QueryCoverage=47%, HitCoverage=69%, E-value=3e-07, Identity=28%"; Hit description =Nucleic acid-binding, OB-fold
LQSWALRPGQCLNPMVKAVHSFQEIVCVTIGTITRIVMDNHSWCYIACIQCHKKIDAEMMPFTCACGKYNQEAMLRYRLDVMINHRDENTKFLLWDRECTELIGQSADAINRLKIEIKVQPKFRNSAILKCSIDSSLIDVVMDMLPDAETSSKINVPAFDSNHSTKHESKSMSVTIDHDPLLGLPLTPTKRQTFHDCDDEATSSLISPAQLSSNKLKKHDSI

SEQ ID NO: 122358 - protein, 78 aa, Glycine max
  Coding DNA Sequence Number=SeqID_30673
MKKRPSIPRTQIVTMAVRSNKMAQNLKLSSYLNQQYYNLMQSYPARALARRLQVDWARDPRKGPRVLMSLRVDFEPMG

SEQ ID NO: 122359 - protein, 159 aa, Glycine max
  Coding DNA Sequence Number=SeqID_30674
MIESFQQQQEMGVIELCVEVDIAGAFALNVKNSLLSCGNNIVGNESKVQRFVTNLDEDSDDDDYMIYNSYVEDSSDEEEDINDISDTDEEGGSEIAFWESASNYSNINWSHPDEEDIRGFDMGSTFNIGQELFVGMEFESKNAVKKCTATVCYKGAPNF

SEQ ID NO: 122360 - protein, 88 aa, Glycine max
  Coding DNA Sequence Number=SeqID_30675
MAVQLIHDRVVMECLEVEPIQVIEVSSSEEGPEELPPEPAMDALDLPEDDEDPLPDVDSPEDIMSASEADSTEESGPGGTANSDDSSS

SEQ ID NO: 122361 - protein, 226 aa, Glycine max
  Coding DNA Sequence Number=SeqID_30676
MLLVFALPIGKGCLARFSTPVMHDGHDYLWLSSESVLVGDGNIGDALLYGSRCFVGWLSFENAAVGWHGCLNVAVLIGSFARATTQGWIFTNACCRCPLECFARTHSTAQVGGGANKWVVVNTAKKNAVLLHCFWLDNDAPSRALRTAGRVSGAWCARACRIPARAATATCARLFNRRFKCALIGVGFLVRRGMDHEASVVFHIPDVTVPGLLAHGGTLDLSDAEN

SEQ ID NO: 122362 - protein, 18 aa, Glycine max
  Coding DNA Sequence Number=SeqID_30677
MDPFDDLLPVALVARMVA

SEQ ID NO: 122363 - protein, 35 aa, Glycine max
  Coding DNA Sequence Number=SeqID_30678
MEEGYAAASEVGQVHLRMRKMILVEVLDTAFPTSM

SEQ ID NO: 122364 - protein, 70 aa, Glycine max
  Coding DNA Sequence Number=SeqID_30679
MLRNLTDYVIIPFLPFGTLRNFTNCALTLPFNCRHVTELHGLCYNAFLLASGMSQNFTNFLTMDAKYLEV

SEQ ID NO: 122365 - protein, 112 aa, Glycine max
  Coding DNA Sequence Number=SeqID_30680
NEQPEAYAANIYNRPPQQQNQQQQTNYDLSSNRYNPGWRNHPNLRWASPPQQQQPIPTFQNVVGPSKPYVPPPANDHPEYAISARDKSLHSESDKSDGVDGYSVEPSSVPKF

SEQ ID NO: 122366 - protein, 37 aa, Glycine max
  Coding DNA Sequence Number=SeqID_30681
KWAPKVEALFRASMENEGGKNGNVRERGKASEKCGAE

SEQ ID NO: 122367 - protein, 139 aa, Glycine max
  Coding DNA Sequence Number=SeqID_30682
MKGDAPGPSVRSIARLDRRRVMHRRSQRRRHHAHQADPAGVIGHGAVFTALGSLAGGQPQGADQFRAEVAWPGDWHEAQAGLAPAEAPDDAEEARMDEEMTDLLGFLGWSGPRDQGIPRFLFSFMFPLLSVTYHFIFIT

SEQ ID NO: 122368 - protein, 200 aa, Glycine max
  Coding DNA Sequence Number=SeqID_30683
  Subcellular localization annotation: CTP_CleavageSite=31; ConfidenceScore=5.00e-01
MEEPSKKRKGSSSRSQRHSDTQETQIPSSISSSSLFSSEEQRIRYTNLFSSRSIIDPKFIDMDFFCNESFECIQAFENSNVIPFMSLKLPVYSKLVKAFYSNLEIQEGTLISEVYGIKMVIDQSLFYDLTQLSSEGVPFEGTLNDDWKFDFSVGVARWLVCTNQADMTGRLLVGSLTFESRVLHYLIVRILLPRSSNLAQ

SEQ ID NO: 122369 - protein, 85 aa, Glycine max
  Coding DNA Sequence Number=SeqID_30684
  Homolog annotation: Hit_ID=UPI0000ECBAF8; Match level="QueryCoverage =50%, HitCoverage=50%, E-value=1e-17, Identity=100%"; Hit description= UPI0000ECBAF8 related cluster
MQYLESDPRSPPNEQCPGDPLVTRTAVEIHPIELITIHWPSFYNVVTGKTLALPNLIALQHIPLSPAGVIAKRPAPIALPNSCAA

SEQ ID NO: 122370 - protein, 161 aa, Glycine max
  Coding DNA Sequence Number=SeqID_30685
MATPVVVVGETEGPPKCLAEVDNQLLAPQWHIQGEVRSRLDCGLGVLHVSPPWVEGPVPDHIGVVSSQGEQEWHGRHSRLAYVRHWVACGWEASRMVGRNACSKLAQNRGHPYFLTLRDVSSIGACKPRIFFINGFLCFLEDEWQWNGEGRERGDATSRRR

SEQ ID NO: 122371 - protein, 158 aa, Glycine max
  Coding DNA Sequence Number=SeqID_30686
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRLRPPDEHHKNPTLKSE

SEQ ID NO: 122372 - protein, 63 aa, Glycine max
  Coding DNA Sequence Number=SeqID_30687
MTIICLRMSSGPPPLDDKRAQNDHNLSLRSIGHNCVWNGKKGQYDKDCGAADKSEALAPTYPQ

SEQ ID NO: 122373 - protein, 51 aa, Glycine max
  Coding DNA Sequence Number=SeqID_30688
MDEDKWAYYSAMSEEVDMDFQNEEDYGVNEAHVDCSDAFNTSQVFEPEKMF

SEQ ID NO: 122374 - protein, 436 aa, Glycine max
  Coding DNA Sequence Number=SeqID_30689
SVERAALGCCKRRGSRAWARLYRGARAPLGPCPAAAQRGNALPSALFANDFDQAWAVAAQLGTTDAADPGQFVQAGRALFGDVAQGAVVEDHEGRHVLFARQFGTQAAQGVEQGQILRQHRQAGALCAALASAGAAGRVAAHADLAAAGQHVAAGIGQAQAAMALAIHFQQAGGDQLAEHAAPGACIQVAADRIGAQLVVALLLHLLVLAATQDVDQVTDAEALAAAVDAAQCLLRGNGGIPRSGRGQAVVAVAAGLRIGLAETGQQHLAAALHGFAVAQQVIELAPLQLLAFFAGLGLLDHLLEQDHVTQAVAQPCFSGFAITAGATGFLVVAFHRLGQVGMRHEAHVRLVDAHAKGDGGAHHDAILAQETALVVSAHFQRQGGMVWQGVEALAAEEFGSLLDLAPRHAVDDAGLATVAAHEIRQLLAGIVLLHH

SEQ ID NO: 122375 - protein, 236 aa, Glycine max
  Coding DNA Sequence Number=SeqID_30690
  Gene Ontology: Mol. function=carboxyl- or carbamoyltransferase activity; Cellular component=ornithine carbamoyltransferase complex; Biological process=amino acid metabolic process
  Homolog annotation: Hit_ID=A4W608; Match level="QueryCoverage=100%, HitCoverage=70%, E-value=1e-128, Identity=94%"; Hit description =Ornithine carbamoyltransferase
  Pfam annotation: Domain name=OTCace; Domain location=65-236; Score =283.4; E_value=4.6e-82; Accession=PF00185.15; Description =Aspartateornithine carbamoyltransferase, AspOrn binding domain
  Pfam annotation: Domain name=OTCace_N; Domain location=1-59; Score =8.1; E_value=4.5e-09; Accession=PF02729.12; Description =Aspartateornithine carbamoyltransferase, carbamoyl-P binding domain
  Pfam module annotation: Pfam domain module=OTCace::OTCace_N; Domain location=65-236::1-59
MKDTARVLGRMYDGIEYRGYGQAIVEELGEYAGVPVWNGLTDEFHPTQILADLMTMLEHSPGKTLPELSFAYLGDARNNMGNSLMVGAAKMGMDIRLVAPKSFWPEAGLVEQCRAIAKETGARITLTDDVEKGVQGADFLYTDVWVSMGEPKEAWAERVSLMKPYQINAHVMKATGNPNVKFMHCLPAFHNEHTKVGREIEMAYGLKGLEVTEEVFESPNSIVFDEAENRMHTIKA

SEQ ID NO: 122376 - protein, 172 aa, Glycine max
  Coding DNA Sequence Number=SeqID_30691
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTGAPYPVTIVLSPT

SEQ ID NO: 122377 - protein, 222 aa, Glycine max
  Coding DNA Sequence Number=SeqID_30692
  Homolog annotation: Hit_ID=Q6WAY6; Match level="QueryCoverage=20%, HitCoverage=8%, E-value=1e-09, Identity=60%"; Hit description =Putative uncharacterized protein
LDWLSKLKVINEENFEAPEEDEEVQALKLELGKARLAKEKFKLAATNIRKECTELREENMATARALQQLELKAPERGKETSDGSKRSLAQHLEATEQSMLAIIGQYKEELNQSVTHEQKLVEDFTFDKCTLKRKQEGGAINWFPHWKEGKEGVTFSCGDYPNVPLIGTRGCINYNPTLAIRQLGYPMRGAPTEESLSPFLVRNLGAQSLKAIQESTRRGEVR

SEQ ID NO: 122378 - protein, 81 aa, Glycine max
  Coding DNA Sequence Number=SeqID_30693
MKMKASKTRNELKVSDSNSYRLKNEKRTKKSEEWRKIFTDLLTETSRKRYGSTSTRFFFTETWGKRECPLPPRGFLTARLI

SEQ ID NO: 122379 - protein, 110 aa, Glycine max
  Coding DNA Sequence Number=SeqID_30694
RENPLRTSICIIHSKGEKSFCSSQKSSCNQETSCLLDCENLEHKGEGSQDSGKSQVGCLRTGHRHAKWLNLMQSYPARALDKRIQEDWAKDAREDPKVLMSLRVDFGHMG

SEQ ID NO: 122380 - protein, 182 aa, Glycine max
  Coding DNA Sequence Number=SeqID_30695
  Pfam annotation: Domain name=zf-CCHC; Domain location=124-141; Score =22.6; E_value=0.00058; Accession=PF00098.14; Description=Zinc knuckle
MKDISQDEKEKIREEERRKILKELRKEKHASYSSHDSCKRLSEELRDYYEGRHRSHLRPHSHRREKERKPNEANINLPYFHGKDNKYQGQGILGVTPSKPKDDKGKTIEKQPLKANMQEKTSSIKCFKCLGRGHITSQCPTKKTMIMKGQDIYISQDEATTSPSCSESEEAKREESSEEIYP

SEQ ID NO: 122381 - protein, 164 aa, Glycine max
  Coding DNA Sequence Number=SeqID_30696
MHLTETCMRAGNSDIYGFLEPQSIQRSGQSQFESESYIKSWMQSSQRDVYLGAYLNGFHCSGHWQMVVILPKEHLVVCAIKGLDDAPQPKSKAHARWIVVKCNRQKGTTECSYYVMHWMSTIILGSFRNNWEAYFNDPRPLEPERLKALRIQWAQFYLRVRDQA

SEQ ID NO: 122382 - protein, 78 aa, Glycine max
  Coding DNA Sequence Number=SeqID_30697
DFLSVVSLVTIFQRNERGFEAFSTHDHLGLPSGVKTKHEWQKPVKVLKDERKRGWGHDRPIVALLCAKQAGNVAARQP

SEQ ID NO: 122383 - protein, 153 aa, Glycine max
  Coding DNA Sequence Number=SeqID_30698
MEVDSLHMPVMESRSNFRRSPKMLYLECDPIPKVVENEDDLDDVPVAGHEEGKFKFICTWSDMMLVPESREMLVSRGMLVRKGMVVSKGILMLVSKEMVVSRGMLKLLKLKLRQMVIIQRSLISPLVVMMKMRMLKFILNIVKVVELVYSSWG

SEQ ID NO: 122384 - protein, 67 aa, Glycine max
  Coding DNA Sequence Number=SeqID_30699
MRKGPLKEGGTEAIDSVGTLRTYTKNEVTLSKKGNRNEEKEGILKQAQPNSGAKRASGAKRATKCRR

SEQ ID NO: 122385 - protein, 23 aa, Glycine max
  Coding DNA Sequence Number=SeqID_30700
EFAKISTVLRRSSFVLHRSSIFN

SEQ ID NO: 122386 - protein, 101 aa, Glycine max
  Coding DNA Sequence Number=SeqID_30701
MIRLTATSLVHPEVPARTLQQPVEWILPTPTPYRLVEPVQVIEDPEEFTPEPTVDALDLPEDDEDPLPDVDSPEDIMSASEADSIEESGPGGTANSEDSSS

SEQ ID NO: 122387 - protein, 172 aa, Glycine max
  Coding DNA Sequence Number=SeqID_30702
  Pfam annotation: Domain name=zf-CCHC; Domain location=15-32; Score =14.2; E_value=0.011; Accession=PF00098.14; Description=Zinc knuckle
MQPHKASMQEKTSSIKCFKYLGRGHITSQCPTKKTMIMRGQDIYSSQDEATTSPSSIESEEAKGEESNEENYPQEEIQPLMVKEERKVVSASSKRLAKKENHFTIKTNNTETLSLRKPPHFLLCKKTLVSIVTPLGLEFIPQVKELLDEGLVCKSLNPCAFLVPKIGIRSLK

SEQ ID NO: 122388 - protein, 76 aa, Glycine max
  Coding DNA Sequence Number=SeqID_30703
MEAEWRRKRERRRRFKEKMSLEEAHHHRRPWIKAWRKKEMNEGRGKEEHEILCSKRDLKSEPTNPRSIPRFSTKCA

SEQ ID NO: 122389 - protein, 213 aa, Glycine max
  Coding DNA Sequence Number=SeqID_30704
  Gene Ontology: Mol. function=oxidoreductase activity; Cellular component=intracellular; Biological process=aromatic compound metabolic process
  Homolog annotation: Hit_ID=A6E970; Match level="QueryCoverage=38%, HitCoverage=20%, E-value=3e-24, Identity=70%"; Hit description =Monooxygenase; possible 2-polyprenyl-6-methoxyphenol hydroxylase
MSDLVYTSSAPSASLKDFVESFWMLDNQSENKEVILLPDGRIDIILSQSSTMPFHIVLLGIGTHPEEIVIAEKSRTFAIKKIASELSLRKIDERKRKLFDLIYSANGDISVKELSEKVIWSERQINRYFNQQYAIIGGGPGGLTLANLLQINKAEVQVYERDEHKDVRVQGATLDLHEESGLEALKRAGLMDAFIAHYRPDAGKLKILDKGIL

SEQ ID NO: 122390 - protein, 110 aa, Glycine max
  Coding DNA Sequence Number=SeqID_30705
MGEVVEIQEKMKADMEAIKEKMATMMEAMMSVKKLMEANAVAIAATSVVAKVNPTSPSGINESSNLIYEMGKLDHLEERLRAIEGGEDYAFANLEELFLVPNIIIPPKFK

SEQ ID NO: 122391 - protein, 253 aa, Glycine max
  Coding DNA Sequence Number=SeqID_30706
  Subcellular localization annotation: CTP_CleavageSite=90; ConfidenceScore=5.19e-01
PYPGGSSSHPTPSGMTRVPNVSTIVELPDTALTPAARSKEGPNVKTNPLASHGKASVNAIQEGGPSRAKRLGEVATSRRFIYQSLQAACMVSRGGGERDKCLFHLGESHDMETCPAVEELLQRLMDCGQLEVSIGGREEPQICMQSEEKKVPLTPKALVICFTRKGTGSTPIYPRTMPKPTSFAYQSNKAIPWKYTPPAFSERVATEVDSLSSKVTNITGLSGITGSGRVFASLTQRSCPPRGKCPWSKSPQT

SEQ ID NO: 122392 - protein, 148 aa, Glycine max
  Coding DNA Sequence Number=SeqID_30707
MAAQLIRDRVVMKCLEGVWETLEGNERCQFCGTVRLTTTSLVHPEQPTCTLHQPVEWILPTPTPYRLVEPIQLIEVSSSEEDPEGDPEESSPEPAMDAPDLPEDDEDPLPNVDSPEDIMPAPEADSTEESGPGRMENSDDSSSQQTTP

SEQ ID NO: 122393 - protein, 116 aa, Glycine max
  Coding DNA Sequence Number=SeqID_30708
MRRYYMSADVTFFEDTPFFSPSIDHSSSLQEVLPIPYPCPLDDSDQNVSVVPSSSPTSPEVVSSPLIADQPRTTLIGFPVPEASPRDSRSSSTSPPLMDPSTSSPSDSHWPIAIRK

SEQ ID NO: 122394 - protein, 87 aa, Glycine max
  Coding DNA Sequence Number=SeqID_30709
FYKVEKKSQGSQVAWGLDVGTENQIKVYAAKGNKGRKELVLNEGNWVLERINNIAYRLDLLEKYGVSNTFNIIDLVPFAGVADSDDE

SEQ ID NO: 122395 - protein, 211 aa, Glycine max
  Coding DNA Sequence Number=SeqID_30710
  Gene Ontology: Mol. function=helicase activity; Biological process =viral genome replication
  Homolog annotation: Hit_ID=A2Q378; Match level="QueryCoverage=99%, HitCoverage=12%, E-value=7e-51, Identity=46%"; Hit description =Putative uncharacterized protein
MFEPRTILDSNGYPVYRRRNNGRTISKNGVIIDNRYIVPYNAKLLRKYQAHINIEWCNQSTSIKYLFKYINKGYDRVTVAVVYDANETVDNAITKNDQIKEYLDCRYICPCKATLGIFAFPIHARKPAVERLYFHLPGQHNILCEDDDDIDGILSKPSISDSKFLAWMNNNKFFLEGRNLTYSQFVSKFVYNQKARSWKLRKKDNTIGRLI

SEQ ID NO: 122396 - protein, 158 aa, Glycine max
  Coding DNA Sequence Number=SeqID_30711
MTLLLNNVLPSDHNSDLPLLKCQLVYAILTRMSVHVAQLITDAIYLFAGMPPTRHPLDPDKSNRALGFPALITGLCQSFGVPVTPSKVIRPPITRAFIEKYCTPRQTQGDAPQAADAPPPPHQANPAGSFGMERYLQYLVRQQAANHRGQVQIHECLY

SEQ ID NO: 122397 - protein, 236 aa, Glycine max
  Coding DNA Sequence Number=SeqID_30712
MSPFLVRDFGAQNFKAIQRIHKAWETPLRKDQELRGIRNGVIGDWLAKLKVVSEESFEAPEEDEEVQALKSELGKAKLAKEKFKLAATHIRKECAGLREENATTARALEQETKRARKEEYGRNKFRGALWGSNSELKLRREERDQLRAHSMVLKEEYAQVYAEKEARGRVIDSLHQEATMWMDRFALALNESQELPRLLAKAKAMADTYSAPEEIHGLLGYCQHMIDLMTHIIRNR

SEQ ID NO: 122398 - protein, 188 aa, Glycine max
  Coding DNA Sequence Number=SeqID_30713
MIIDQSLFFSLTHLPSQGAPFEGTIVDDWKFDYSSHDARRMVCNDEVEMTSITGQCTSPLPSIDNFFLRHFQISLDDEPFVQVKRSFAIGAGAVTSFGYRKDRNGQWLKKDALPPQDERTPSPPPQRDDSALMTEVLSELRDLRSYVGECFDSLDTCFAGMDIRLTQHEEDVGYIRQSFALPPPPLPS

SEQ ID NO: 122399 - protein, 78 aa, Glycine max
  Coding DNA Sequence Number=SeqID_30714
MSKIGRFGGLGMEERRKGEEVEQGFLKNVIFIDQDALWRQPTGNQLHEDCNRLQAICSSVIDYSIHVIDYQNKIIAFS

SEQ ID NO: 122400 - protein, 55 aa, Glycine max
  Coding DNA Sequence Number=SeqID_30715
EAKRWLHSFKGNSLKTWEEVVENVGEVSYPNFVRGSLLDDVRPFFGPREVLGTHH

SEQ ID NO: 122401 - protein, 129 aa, Glycine max
  Coding DNA Sequence Number=SeqID_30716
MAPRKLSAKRSRRDAAVEGTSAAPEFDNHRFRSAEHQQRFEAIKGWSFHQERRIQLRDNEYIDFQEEIALRRWMSLVTPMAKFDPDIVLEFYANAWPTEEGVRDMRSWVRGQWIPFDADALSQFLGDAL

SEQ ID NO: 122402 - protein, 75 aa, Glycine max
  Coding DNA Sequence Number=SeqID_30717
MHETQCGPLRVHRMNRKAWFEQNRGDACRPARPGEQGCFLQKQPPSGGTFWRAQMGLGAICTPIFTKFTPSTVFW

SEQ ID NO: 122403 - protein, 27 aa, Glycine max
  Coding DNA Sequence Number=SeqID_30718
MASRPDRHIKAHEWGGGDPISSVKISF

SEQ ID NO: 122404 - protein, 350 aa, Glycine max
  Coding DNA Sequence Number=SeqID_30719
  Gene Ontology: Mol. function=molecular_function; Cellular component =membrane; Biological process=auxin mediated signaling pathway
  Homolog annotation: Hit_ID=A9P9F1; Match level="QueryCoverage=98%, HitCoverage=98%, E-value=1e-140, Identity=68%"; Hit description =Putative uncharacterized protein
  Pfam annotation: Domain name=DUF6; Domain location=176-305; Score =58.8; E_value=1.9e-14; Accession=PF00892.11; Description=Integral membrane protein DUF6
  Pfam annotation: Domain name=TPT; Domain location=167-305; Score= -33.4; E_value=0.052; Accession=PF03151.7; Description=Triose -phosphate Transporter family
  Pfam module annotation: Pfam domain module=DUF6::TPT; Domain location= 176-305::167-305
MADLGSASSKRMWCSVPERMQLHLAMLALQFGYAGFHVVSRAALNMGVSKLVFPVYRNIIALLLLLPFAYFLEKKDRPAMTLNFVCQFFLLALVGIEQVRLNRKDGLGKVAGTVLCVVGATVITLYKGPTIYSPTTGVNINNTRVTQVFELGSVSLGDAKGKNWTLGCLYLIGHCLSWSGWLVLQAPVLKKYPARLSVTSYTCFFGLLQFLVIALLLERDAQAWLFHSGGEAFTILYAGVVASGIAFAVQIWCIDRGGPVFVAVYQPVQTFVVAIMASIALGEEFYLGGIIGAVLIVAGLYLVLWGKSEERKFAREQLAIASTEHSIIRPASHAKASLAQPLLSSSTENV

SEQ ID NO: 122405 - protein, 92 aa, Glycine max
  Coding DNA Sequence Number=SeqID_30720
  Gene Ontology: Mol. function=amino acid transmembrane transporter activity; Cellular component=integral to membrane; Biological process=response to nematode
  Homolog annotation: Hit_ID=A7QHW1; Match level="QueryCoverage=90%, HitCoverage=18%, E-value=3e-19, Identity=49%"; Hit description =Chromosome undetermined scaffold_100, whole genome shotgun sequence
MAIAGFCPFFSAFCYTEFVVDMPVAGGAFSYLRVTFGLTVYLGTTIRISSAKWRLTVSSLPKGFKEIDFVAVAVILLITLIICYKCFPQFLQ

SEQ ID NO: 122406 - protein, 73 aa, Glycine max
  Coding DNA Sequence Number=SeqID_30721
MVRITVRVSTDKDYGAALDKSKALADNRADNRKVSPRVTSSWVMATKSGAVDKSEALAPTYPPMRNSDLRSSG

SEQ ID NO: 122407 - protein, 451 aa, Glycine max
  Coding DNA Sequence Number=SeqID_30722
  Homolog annotation: Hit_ID=A0U140; Match level="QueryCoverage=50%, HitCoverage=30%, E-value=3e-18, Identity=32%"; Hit description =Putative uncharacterized protein
HGRRADEARREFAGRTGIQAVGRVVLFDLAAAQQHHLVGHAHGLGLVVRDVHHGDAQVLLQGADLAPHLLAKLRVQVGQRLVHQAHRRFGNYRAAQRHALLLAARQLQRLAVQQMAQAQQRSHALQAAVVVARGLLAHLQAEQDVLAHRQVREQRVRLEHHGNAALGRRQLGDVAVADADGAGRGRVQAGDHAQRGRFAATRWAQQHGEAARRHGEADAVDRGRAAVLLGEGIWPGVFPNHGVVRDQRAVVPPVQLVARRLHDVLQGRARPQLQRQLVRGARTGRGNGAAEAAEDGAVQVAAQHALDARIARHDAFKFRAAGQQADVVHVLDAGLEWRMMHQHQRRPVGLFGQARGQPAQAFVAQLAVAFHRHHRVQRQQAQRIGFDGILDERPLSLQIAMVREGGAQLRAVVMVAGQQEIRDFKRLQLLAQRLVFMRTAQVGQVARDQHA

SEQ ID NO: 122408 - protein, 37 aa, Glycine max
  Coding DNA Sequence Number=SeqID_30723
MFLVFNSALKGLDDTPQPKSKAGARWIVVKELMKHWA

SEQ ID NO: 122409 - protein, 107 aa, Glycine max
  Coding DNA Sequence Number=SeqID_30724
  Homolog annotation: Hit_ID=A5AFZ5; Match level="QueryCoverage=96%, HitCoverage=8%, E-value=8e-16, Identity=45%"; Hit description =Putative uncharacterized protein
MGTATFFEDIEFGGKNKVRDFVLEEESVTIPEPIHTIAFDKANLEPLQDIVIESPTQDNLVIHEKQTQDPQEPILHEPIPLQRFTRERRSAIPDDYMVFLKEHEENY

SEQ ID NO: 122410 - protein, 209 aa, Glycine max
  Coding DNA Sequence Number=SeqID_30725
  Homolog annotation: Hit_ID=A5BS60; Match level="QueryCoverage=92%, HitCoverage=40%, E-value=5e-07, Identity=23%"; Hit description =Putative uncharacterized protein
MMMIGNLIGRLLGGSLALESRILHYLIVRILIPRSSNLVQVSEEDLIVMWAFHTGRQIDWADLVQYRMHKALLLNTPLPYPHLVTFFLQHFNIPLDSEPYVPIKRSFLIGAAVVASFGYRKERDGSWVKKGAQPNDDEGHLPVEGDSSLLQSILDRFNGLQTYVGERFDSLELQVDTRFEEMNSRIAKVEKDVTIIRDCLDLPPPPPSI

SEQ ID NO: 122411 - protein, 278 aa, Glycine max
  Coding DNA Sequence Number=SeqID_30726
  Gene Ontology: Mol. function=carboxylesterase activity; Cellular component=cytoplasmic membrane-bound vesicle; Biological process =biological_process
  Homolog annotation: Hit_ID=A8AE77; Match level="QueryCoverage=99%, HitCoverage=99%, E-value=1e-137, Identity=82%"; Hit description =Putative uncharacterized protein
  Pfam annotation: Domain name=Esterase; Domain location=13-271; Score =383.4; E_value=3.6e-112; Accession=PF00756.11; Description=Putative esterase
  Pfam annotation: Domain name=Peptidase_S9; Domain location=59-278; Score=-59.6; E_value=0.004; Accession=PF00326.12; Description=Prolyl oligopeptidase family
  Pfam module annotation: Pfam domain module=Esterase::Peptidase_S9; Domain location=13-271::59-278
MELLEEHRCYEGRQQRWRHHSSTLNCAMTFSIFLPPTTETAPPPVLYWLSGLTCNDENFTTKAGAQRVAAELGIALVMPDTSPRGDDVADDAGYDLGKGAGFYLNATQAPWAAHFRMYDYLRDELPQLINRQFKVADRCAISGHSMGGHGALIMALKNPGRFTSVSAFAPIVNPCKVPWGQKAFSAYLGNDEANWQEWDSCALMQTSQAGDAIATLIDQGDADQFLGTQLQPAVLAEAARQKQWPLSLRIQPGYDHSYYFIATFIEDHLRFHAEHLFK

SEQ ID NO: 122412 - protein, 201 aa, Glycine max
  Coding DNA Sequence Number=SeqID_30727
MIMRGQDIYSSQDEATTSPSSSESEEAKGKESSEEIYPPKEGQPLMVKEECKEISVSFKRLAKKESHFAIKKKIKETSPLRQPPHLLLCKKTLVSIATPLGLEVFTQVNKLLDKGLVYKSLNPCALLVPKIGIIRHQIPIISDMMNVLSVTTLFCKITHAPNIFMIQVHRDSLGRNNQHENTEKVIKGFPRTLTLCLDGEI

SEQ ID NO: 122413 - protein, 183 aa, Glycine max
  Coding DNA Sequence Number=SeqID_30728
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHIIFPALSPDSVDNRITAFEKRKSAQYANRLSPRVGRFINAAGTTGFPTGKRAVSATQLIYDHDYEFELGTPKTDGGMQAWHWPSFYNVVTGKTLALPNLIALQHIPLSPAGVIAKRPAPIALPNSCAA

SEQ ID NO: 122414 - protein, 184 aa, Glycine max
  Coding DNA Sequence Number=SeqID_30729
  Pfam annotation: Domain name=G-patch; Domain location=2-41; Score =24.3; E_value=0.00022; Accession=PF01585.14; Description=G-patch domain
MARVMLGNGYEPGMGLGKDNGGITSLIKTQGNRGKYGLGYKPTQADMKRSIAGRKNSGLSSRWKQESEGNPPCHISRSFISAGLGDEGQVVAICEDDVPRTLDLVRPCPPDFQLGNWRVEERPGIYATSIIFDDESPEGTNTWDPSINFEQEMNQTEDEGMRMWDFLSELERWSPKRLRNGASS

SEQ ID NO: 122415 - protein, 182 aa, Glycine max
  Coding DNA Sequence Number=SeqID_30730
  Gene Ontology: Mol. function=helicase activity; Biological process =viral genome replication
  Homolog annotation: Hit_ID=Q9LW42; Match level="QueryCoverage=96%, HitCoverage=10%, E-value=2e-43, Identity=52%"; Hit description =Helicase-like protein
MLDENNAHAKSFRMARDRLIDTEVHNVRLKLIAGREKDGRTYNVPSVPEVAALIAGDIDANSNKDIIVKTQNGQLQRIHELHCSYLALQYPLLFPYGEDGYRSDIVHRDTLSGKKRKRNRLTMREWFAYRLQCRPNEGQTLLHSTKLFQQFVAEGYTMIESERLSYVRNNQKKLRVDKFYSL

SEQ ID NO: 122416 - protein, 45 aa, Glycine max
  Coding DNA Sequence Number=SeqID_30731
MAKYKASKEGKNKFFLQRRKWRSQEGSTYSFSSLTIGKVDPSSWG

SEQ ID NO: 122417 - protein, 67 aa, Glycine max
  Coding DNA Sequence Number=SeqID_30732
MYNYHEKGRTPDLESVLADFMTYQASSKGDCYSMQQQIINGSQNGNLIITMKQKGLSNLDDLVNAIQ

SEQ ID NO: 122418 - protein, 84 aa, Glycine max
  Coding DNA Sequence Number=SeqID_30733
VVINKKGDIVEAMPSKVILMMPKNQELSKVSSKDSRIKFQVSRFKIQESSFKNQVSRIKNNQDQDLRLKTQDSRIKRRLNQDKY

SEQ ID NO: 122419 - protein, 101 aa, Glycine max
  Coding DNA Sequence Number=SeqID_30734
MSSMTDLVSAEDDVNLRVSTGLSAAIDEGRRKRPKKNVYTDNHSGISARHRGSNTTKKNVYTDNHSGISARQHDSNVSITDLVSAKDDVNVRVSNVLVGHD

SEQ ID NO: 122420 - protein, 160 aa, Glycine max
  Coding DNA Sequence Number=SeqID_30735
MSSDVLPLEIDFIESDRTNHVSGSTHTSDFVYEQKFSSNYICVRRLVATCPFGGERKKAIGWILADIPSISPSTYMHQINLEDGACRNMPIWGRARRGSRVHFSKEERCAESPPTFICGKRQKNQRKPVKKKIPSSGVVFTFEEGISTSYVCLKGQQPIF

SEQ ID NO: 122421 - protein, 133 aa, Glycine max
  Coding DNA Sequence Number=SeqID_30736
  Gene Ontology: Mol. function=catalytic activity; Biological process =trehalose biosynthetic process
  Homolog annotation: Hit_ID=A7NV04; Match level="QueryCoverage=61%, HitCoverage=22%, E-value=2e-32, Identity=80%"; Hit description =Chromosome chr18 scaffold_1, whole genome shotgun sequence
MKTVPGAKVENNKFCLSLHFRCVDKKSWAALVEKVRLVLNENPQLRLTQGRKVLEIRPTIKWDKGKAHEFLLESLGYKNLNDVASWRSATFYTGPPVIKWATRSLMFATGSSELSFWVPDLSKLGSYVVDKGL

SEQ ID NO: 122422 - protein, 289 aa, Glycine max
  Coding DNA Sequence Number=SeqID_30737
  Homolog annotation: Hit_ID=A5C169; Match level="QueryCoverage=42%, HitCoverage=10%, E-value=5e-07, Identity=29%"; Hit description =Putative uncharacterized protein
MTGRLLAGSLTFDCRIMHYIIVRILLPRSSNLAQASEEDLILIWAFLTGRQIEWAHLVRYRMHKALRANAPLPYPQLVTLFLLHFQIPLDDEPFVQVKRSFAIGAGVVTSFGYRKDRDGQWLKKDTLPQQDERTPSHSPQRDDSSALMNEVLSELRGLRTYVGERFDSLDGRFEGMDTRITQLEEDVTYLRRSLNCHHQKGGECRSKEFDFDVLMMPYDRDDLMAYENVLLKFNSRQKFKNTRYNIRKISSVLGREFQIETAKGLAKKFKQKCLFQEIYSLVIDYQWPK

SEQ ID NO: 122423 - protein, 151 aa, Glycine max
  Coding DNA Sequence Number=SeqID_30738
  Homolog annotation: Hit_ID=Q6WAY6; Match level="QueryCoverage=48%, HitCoverage=12%, E-value=5e-07, Identity=39%"; Hit description =Putative uncharacterized protein
MGTNQTGKRFYQVKVKSPDTTSIKELGRLMEPLQMQAFRKTYGKILELTIAEIATVVKDAARGLDRIKQTRNGIAGLPQKYLEDKARGMANQGGWVPFMDVLALLIFGVVLFPNVDGLVDLAAIDAFLAYHHSKESPVVAVLADLFDTFDR

SEQ ID NO: 122424 - protein, 110 aa, Glycine max
  Coding DNA Sequence Number=SeqID_30739
TCKRNLQDSGTLKRVAWGLDVGTRISEATCDASSIGACRPRIFFINGFLCFLEDEWQWNGEWERERRRHFKEKMSLEEAHHHRRPWIRAWRKKEMNEGRGREEHEILCSK

SEQ ID NO: 122425 - protein, 109 aa, Glycine max
  Coding DNA Sequence Number=SeqID_30740
MCVQEEERHVMEMANIKKVAKYFFCKKKGYMKKNCPIFQKWLEKKDTLFELFYNSKCVGNGILSGGLYLLGLQNYATYSSMHVQIGIKRLGHTSIERIKGLVKDGVPNT

SEQ ID NO: 122426 - protein, 54 aa, Glycine max
  Coding DNA Sequence Number=SeqID_30741
MKKEYPKYAAWRVKKGLPVEPTAKCKKGRYNKQKGDRNKEKKKKIRRSPSPVRR

SEQ ID NO: 122427 - protein, 125 aa, Glycine max
  Coding DNA Sequence Number=SeqID_30742
  Homolog annotation: Hit_ID=A5C4S3; Match level="QueryCoverage=73%, HitCoverage=9%, E-value=4e-09, Identity=36%"; Hit description =Putative uncharacterized protein
MDPFPSVTKVFALIVQEEKQKEVDASTSGTSASEVSHAFAFKYSSNAINNSNNLSKDSSKNHPLYAHCGMLGHTHDCCFKLHGYPLNYKKNGYSSVVKKQSSSSSEPSHKAQCEIGAKLIFTYLC

SEQ ID NO: 122428 - protein, 134 aa, Glycine max
  Coding DNA Sequence Number=SeqID_30743
  Homolog annotation: Hit_ID=B0HC01; Match level="QueryCoverage=23%, HitCoverage=65%, E-value=1e-09, Identity=100%"; Hit description =Putative uncharacterized protein
MENASTRLLRFLAFCWPFAHMFFLRYPLILWITVLPPLSELIPLAAAERPSAARNSYDHDYEFELGTPPTRIIASTAREEHGATPSSLSSPSRPRERERERRENERSEGEEEGGSSRVDLQACKLGTGRRFTTS

SEQ ID NO: 122429 - protein, 160 aa, Glycine max
  Coding DNA Sequence Number=SeqID_30744
  Homolog annotation: Hit_ID=Q84VH5; Match level="QueryCoverage=72%, HitCoverage=23%, E-value=2e-46, Identity=66%"; Hit description =Envelope-like protein
IGAANWVPTNHTSTVATESFVVKLPIAFPTVLCGIMLSQHPNILNYTDSVMKRESPLSLHYKLFEGTHVPDIVSTSGKAAASGHMQGAGSNKATTEKKMELERLIKRLSESGIDDGEATEEEEEAAEQEDEAAEEEVEAAEEEEDAAEDTESDEDSEATP

SEQ ID NO: 122430 - protein, 55 aa, Glycine max
  Coding DNA Sequence Number=SeqID_30745
MTGIFFLLKQQNNLENYERSMKLEWRRRKGDWRRHFKEKMSQEQAHHHRKPWIRA

SEQ ID NO: 122431 - protein, 93 aa, Glycine max
  Coding DNA Sequence Number=SeqID_30746
DAGSRQARQGASAGVGGCRGWLNYAASEQIVLRVHHMRAIGAGLFAITPAGERGMCCKAIKLGNARVFPVTTFLENWGWQFGKGLGGQVDPKY

SEQ ID NO: 122432 - protein, 251 aa, Glycine max
  Coding DNA Sequence Number=SeqID_30747
  Gene Ontology: Mol. function=binding; Biological process=intein -mediated protein splicing
  Homolog annotation: Hit_ID=Q6WPM4; Match level="QueryCoverage=95%, HitCoverage=38%, E-value=1e-33, Identity=32%"; Hit description =Putative hemolsyin/hemagglutinin
  Pfam annotation: Domain name=Fil_haemagg; Domain location=157-240; Score=9.1; E_value=2.4; Accession=PF05594.5; Description =Haemagluttinin repeat
  Pfam annotation: Domain name=Fil_haemagg; Domain location=3-63; Score= 3.3; E_value=11; Accession=PF05594.5; Description=Haemagluttinin repeat
  Pfam annotation: Domain name=Fil_haemagg; Domain location=73-154; Score=23.0; E_value=0.0011; Accession=PF05594.5; Description =Haemagluttinin repeat
  Pfam module annotation: Pfam domain module=Fil_haemagg::Fil _haemagg::Fil_haemagg; Domain location=157-240::3-63::73-154
  Subcellular localization annotation: CTP_CleavageSite=79; ConfidenceScore=5.67e-01
MIAAQGDTRIAANALRSAQNSTLAAGLNSDGSTASSGALTLNSQSSLALNGRNMAAGTLTAQGRTVDLDNSRTSGARIVVSAASGDITTRDAVVAASEKLQLATSGKLNNHSGLLTASQLELKAMALDNQQGVIQQMGEDDLRLDFRAGLDNRGGEIASNSHALTLSTSQLLNQNGTLLHTGSGGMSITSEGALDNGEGTIAANGNIVLHSDNINNPSGKISTTQGNAQLTTRHELENSQGISLLAAAFLY

SEQ ID NO: 122433 - protein, 144 aa, Glycine max
  Coding DNA Sequence Number=SeqID_30748
MTVKTCDTCSSRRRSQLVSGVAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPARVVLLCAGFLKKFPASL

SEQ ID NO: 122434 - protein, 179 aa, Glycine max
  Coding DNA Sequence Number=SeqID_30749
  Homolog annotation: Hit_ID=UPI0000ECBAF8; Match level="QueryCoverage =20%, HitCoverage=42%, E-value=3e-12, Identity=100%"; Hit description= UPI0000ECBAF8 related cluster
SEQESARGSFQGETPGIFIVLSGFATSDLSVDFCDARQGVGAYGKTPATRPFYADTARRSRTTERSESVSEEAEERPIRKPPLPAPDNNFTQETAMTMITNSSSVPMFDGPIDVLMRIGDPLESTCRRASLALAVVYNVVTGKTLALPNLIALQHIPLSPAGVIAKRPAPIALPNSCAA

SEQ ID NO: 122435 - protein, 136 aa, Glycine max
  Coding DNA Sequence Number=SeqID_30750
MSGQDFAQTATGRRVRIMRTSMTTLTQTWMTMLLSNILPSDHNSDLPLRKCQLVYAILTRMSIHVAQLIADVIYLFAGMPPIRHPLDPDKSNRALGFPLLITGLCQLFGVPVTPSKVIRPPITRAFIEKYCTPRQA

SEQ ID NO: 122436 - protein, 71 aa, Glycine max
  Coding DNA Sequence Number=SeqID_30751
  Homolog annotation: Hit_ID=A5BI38; Match level="QueryCoverage=88%, HitCoverage=6%, E-value=2e-19, Identity=69%"; Hit description =Putative uncharacterized protein
MASFSNIQCDVPKFKGDNYKIWKERILLQLGWMDIDYAIRKDKSPAITDESSPTDVALYERWEPMAQRDVH

SEQ ID NO: 122437 - protein, 93 aa, Glycine max
  Coding DNA Sequence Number=SeqID_30752
  Homolog annotation: Hit_ID=UPI0000ECBAF8; Match level="QueryCoverage =44%, HitCoverage=48%, E-value=1e-16, Identity=100%"; Hit description= UPI0000ECBAF8 related cluster
MHDLHHHIISPTEAQEVAAYAESKAADPLLWKRLDAAMLQCMQAWHWPSFYNVVTGKTLALPNLIALQHIPLSPAGVIAKRPAPIALPNSCAA

SEQ ID NO: 122438 - protein, 184 aa, Glycine max
  Coding DNA Sequence Number=SeqID_30753
MDKGQIEVCSARKWEGDVCMLSNDKKPNKPKALVIHFTKDVATQRPRGLDGRKDAFIVFVKDDLSSAKVTNISGTSGMTRSGRIFVAPELSMQSKDLKRKAKADSIVDQYKEKLNLAASHEQRLEDEYAKVLTMQAQWEAREFTFTLNESQELPRLLARAKAMVDVYSAPEEVHGLFDYCQHMI

SEQ ID NO: 122439 - protein, 95 aa, Glycine max
  Coding DNA Sequence Number=SeqID_30754
KSIDEEDPRPTSSNGAYINYEQDEPLLSTCVPLFYCINYRASMTGCIGVVPSREGRLVDLLGVHYSHLGEFYRLLCWKIPSRIGACVGIGVADGT

SEQ ID NO: 122440 - protein, 35 aa, Glycine max
  Coding DNA Sequence Number=SeqID_30755
MAKFDPNIVLEFYANAWPTEEGVRDMRSWRKKKER

SEQ ID NO: 122441 - protein, 109 aa, Glycine max
  Coding DNA Sequence Number=SeqID_30756
MLTSPERVQMTTLASACQSNLGSPNDEVQITGRCLRMLPDSWVMIAKGGVVDKSGAFAPTYPPFVTRNSDLRSSFLCETKIVAVFFSLKCEHALVKKQNLKLIRATYDF

SEQ ID NO: 122442 - protein, 74 aa, Glycine max
  Coding DNA Sequence Number=SeqID_30757
MIGIVYQEDMEKGRTPSAESIDASDDLECHGKLCIRYPLPSVRIQGLPGADGGRLFLIRYVRRMEVSSMGMILE

SEQ ID NO: 122443 - protein, 196 aa, Glycine max
  Coding DNA Sequence Number=SeqID_30758
MGDQEETQEQMKADMSALKEQMASMMEAMLGMRQLMEEKTRPPLPLSVRLPKQTHSLGNYAPSSLRHSAYPYGLPPNYSPPVLQDDAGHIASPILEREPPQQPDEVHKDPQDYARRDVQLYPPIPEGPAPSTLPQPNIATQPIVLSTEGPPPATEEKRKLDLLEERLRAVEGFGDYPFADMTYLCLVPDVVIPPKF

SEQ ID NO: 122444 - protein, 114 aa, Glycine max
  Coding DNA Sequence Number=SeqID_30759
  Gene Ontology: Mol. function=nucleotide binding; Biological process =defense response
  Homolog annotation: Hit_ID=Q6L477; Match level="QueryCoverage=57%, HitCoverage=10%, E-value=5e-10, Identity=39%"; Hit description =Putative uncharacterized protein OSJNBa0009L15.8
  Subcellular localization annotation: CTP_CleavageSite=49; ConfidenceScore=5.76e-01
MASPPSSPPPPPPSPSDTSVSPSAVKRTRKATHLRSLSTRPPGAERPVVDVTYENWKEVPTAQKDLIWEDIQVEFEIPEASDDRTKKKLLHTIGERWRQFKSDLIRKWALQPIR

SEQ ID NO: 122445 - protein, 46 aa, Glycine max
  Coding DNA Sequence Number=SeqID_30760
MENHYEISRKRLEASYGRASACSFYHGNKREGYAQLAQPSLDVAIP

SEQ ID NO: 122446 - protein, 31 aa, Glycine max
  Coding DNA Sequence Number=SeqID_30761
MGAGMIKYVKSMTKAKRNGTSFVKAVETLHG

SEQ ID NO: 122447 - protein, 132 aa, Glycine max
  Coding DNA Sequence Number=SeqID_30762
MMHAPDSTLRCNVVHTNNQIPGNSLDSLTTFVPHEWVIRQGQCTPPPMNIHYIQRGPKQVPKTMDQLKRLSIPSEMLRFFNHACPPRMDHPTRLVHFAPHEHTQHPMYRTWAPSSAMTMDKLKCLSIPAMNA

SEQ ID NO: 122448 - protein, 72 aa, Glycine max
  Coding DNA Sequence Number=SeqID_30763
MSSVPIYYCPKLDIRDKTEWRMKRERICHFKEKMSLEEAHHHRRSWIRAWRKKEMNEGRGEKSTKFSALKEL

SEQ ID NO: 122449 - protein, 16 aa, Glycine max
  Coding DNA Sequence Number=SeqID_30764
SKRLDHLIQQYEHDTK

SEQ ID NO: 122450 - protein, 196 aa, Glycine max
  Coding DNA Sequence Number=SeqID_30765
QEEPDADRGFQTRQQRLRGGQIANAGGQRRHQRNGDHQVPQNPVNEVVAVALFIQIERDTGAFQTDGDNAQRPADQNKAQAPQRGGELRIVEVGESNQQHNQRYDQADRQRVITHGARDPRLRPAEVHDKQAVRTGKRRADHERPQQRQGGSDAIANRYGKRVRPGVLQAKAERRPTAPAAAPRPESTRRRCAASG

SEQ ID NO: 122451 - protein, 146 aa, Glycine max
  Coding DNA Sequence Number=SeqID_30766
MEVKQNFAQVQKNACAWLAVESLVQNEFWMFASISQRSKCRLIHYRLPLERIDGDPVLRETRIWATWEYASSVGGGQQGMVGLCAHCGCGKTCCAPSPDRHLVPHVMEWYLEICRGGQETLGTSGGVLLPKTKLDQSRPNPGIVGQ

SEQ ID NO: 122452 - protein, 167 aa, Glycine max
  Coding DNA Sequence Number=SeqID_30767
  Subcellular localization annotation: CTP_CleavageSite=35; ConfidenceScore=5.09e-01
KSNRALGFPALITGFCQSFGVPVTPSKVIRPPITRAFIEKYCTQRQVQGEAPQAADAPPPHQAGPAGSFDTEQYLRHLVRQQAANHRAHVQTHDCLYQMSLSLQSQGFTSFPCPTPDQFRAEIAWPGDWPEAQAGEALAEAPDEEDEAREDEEMTDLLDFLGGSGAT

SEQ ID NO: 122453 - protein, 83 aa, Glycine max
  Coding DNA Sequence Number=SeqID_30768
VAVSPAKPPPKPDPEVRWDATVFGVFNPNFPLYIKHEDLSKIAHGGQCLSISVLQLWILHLSETCMRVGNSDIYGFLEPQSIQ

SEQ ID NO: 122454 - protein, 60 aa, Glycine max
  Coding DNA Sequence Number=SeqID_30769
MSEIRKFGGLGMEERRERKGAAQGFLENVIFIEQDAWLICSSVIDYSIHVIDYQNKISLF

SEQ ID NO: 122455 - protein, 86 aa, Glycine max
  Coding DNA Sequence Number=SeqID_30770
MERSMMDAASGGAHGDMTPTEGKLDALVNLVTQLAMNQKSTPVARVCGLCSSVDHHTDLYPSLQQSGVSEQPEAYAANIYNRPPQQ

SEQ ID NO: 122456 - protein, 314 aa, Glycine max
  Coding DNA Sequence Number=SeqID_30771
  Homolog annotation: Hit_ID=A7QR16; Match level="QueryCoverage=92%, HitCoverage=33%, E-value=4e-98, Identity=65%"; Hit description =Chromosome undetermined scaffold_147, whole genome shotgun sequence
MSTAPSTTSDLDNSYISTLRNNVRSRAWGAAIGCSYKVERCCIVKKGGGTIDLEPCLTHTSTVEPTLAPVATERTITTRAAASNALRQQRFVREVTIQYNLCNEPWIKYSISIVADKGLKKPLYTSARLKKGEVLYLETHSCRYELCFTGEKMAKAIPATQMHDLDTEKSQNHHHHPTNGDKADSDNVMVDVFRWSRCKNPLPQKLMRTIGIPLPLEHVENFFSSIMTYESNSCITVEYFHLPVSLLTRLLRCTTYEMGEDGSVFLEGKGENLMVLEENLDWEDVQWSQTGVWIAGKEYTLARGGGDRRGTVLG

SEQ ID NO: 122457 - protein, 276 aa, Glycine max
  Coding DNA Sequence Number=SeqID_30772
MAAKNVDSTGVKYDAVASKRVARGHGTRRHAQFQRGAAAEGQRGFRAHAVFNPQYDRSQHEKQCHTVLAVGIAFCHVAINGPYDGPAERQPVAEGIAGNVGDQPVPGNAAVAAHHPDNAAQRQSDAGNDPGAGTLAVDQYRQDDGKARPQVIDDAQFDGLAAIGGETQRKRQADFVGDEQNAAADQIGAWERPQTGKPQQQDEKHRTYRIDQGRAADRPKTLADAADQADHGAPEHHGHQPKKGRRVPAGSKLHYFFRLPDVHPGAAPGNARQNDA

SEQ ID NO: 122458 - protein, 88 aa, Glycine max
  Coding DNA Sequence Number=SeqID_30773
  Homolog annotation: Hit_ID=Q949K7; Match level="QueryCoverage=48%, HitCoverage=48%, E-value=2e-08, Identity=58%"; Hit description =Putative gag polyprotein
MGKLDHLEERLRAIEGGEDYAFANLEELFLVPNIITPPKFKELLIHSFQESLTGVAVTWYTNLEPSRVHSWKDLVVAFVRQCQYNIFG

SEQ ID NO: 122459 - protein, 73 aa, Glycine max
  Coding DNA Sequence Number=SeqID_30774
MEDEVAKEAQQEPAPQWNPFESLMIQKMDAILHLHQVHQAEVHSSLENITTRLENIEPRLSLSNFLNSNKDET

SEQ ID NO: 122460 - protein, 163 aa, Glycine max
  Coding DNA Sequence Number=SeqID_30775
  Gene Ontology: Mol. function=structural constituent of ribosome; Cellular component=ribonucleoprotein complex; Biological process =translation
  Homolog annotation: Hit_ID=A4KYC1; Match level="QueryCoverage=81%, HitCoverage=28%, E-value=1e-42, Identity=65%"; Hit description =Ribosomal protein S3
MGQRIKRFDFVSRDSPQVGFESRVMGDYPARCILIHFPKRTFIHFFLPRRPRRLKRRKKSRPGKEKGRWWAFGKVGPIGCLHSSDNTEEERNEVRGRRAGKESSRSGSTTGRSKTKFGFGEKKQRYGYHDRSPSIKKNLSKSLRVSGAFKHPKYAGVVNDIAF

SEQ ID NO: 122461 - protein, 139 aa, Glycine max
  Coding DNA Sequence Number=SeqID_30776
  Homolog annotation: Hit_ID=Q9KHC4; Match level="QueryCoverage=30%, HitCoverage=8%, E-value=2e-07, Identity=69%"; Hit description=SocE
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQRRLRPPDEHHKIDAQVR

SEQ ID NO: 122462 - protein, 79 aa, Glycine max
  Coding DNA Sequence Number=SeqID_30777
MIGSFIKLPWSPQKPDEDMFKSKGKDPLEGLGGPMTRARARKAKEALQQVLSILFEYKPKFQGEKSKVVSCIMAQMEED

SEQ ID NO: 122463 - protein, 141 aa, Glycine max
  Coding DNA Sequence Number=SeqID_30778
MPHCLILILLPFSFNIPLDFEPYVPIKRSFLIGASLIASFGYIKEHDGSWIKKGARNVGEEGHEGEDSSLLSMILEKFNGLQTFVGERFDTLELQVDMRFNEMESRMTKVEEDVSYIRSSFDLPPPAPPSSWIYILILLVL

SEQ ID NO: 122464 - protein, 92 aa, Glycine max
  Coding DNA Sequence Number=SeqID_30779
MLRDGNGNWLEDEQQIRSLVNEFYINLFSDDDRDDRWSVSPLSFPILDQQHYDSLGVDVLAEKIVGHFSAKVGSYMEVTKTSINGWKLHGSY

SEQ ID NO: 122465 - protein, 36 aa, Glycine max
  Coding DNA Sequence Number=SeqID_30780
MASGNRLPRVAVMGHIVLLPVVRFLVKESTPFFYFL

SEQ ID NO: 122466 - protein, 41 aa, Glycine max
  Coding DNA Sequence Number=SeqID_30781
MGCSKQMLTSPLGRCCNLPFGGRATRDSQGVSLAPTYPQLR

SEQ ID NO: 122467 - protein, 277 aa, Glycine max
  Coding DNA Sequence Number=SeqID_30782
  Gene Ontology: Mol. function=transferase activity; Cellular component= 1-2nm peptidoglycan-based cell wall; Biological process=transport
  Homolog annotation: Hit_ID=A6T9A5; Match level="QueryCoverage=100%, HitCoverage=65%, E-value=1e-130, Identity=86%"; Hit description =Ascorbate-specific PTS system enzyme IIC
  Pfam annotation: Domain name=SgaT_UlaA; Domain location=1-277; Score =134.0; E_value=4.2e-37; Accession=PF04215.3; Description=Putative sugar-specific permease, SgaTUlaA
MVLGMLFNIVLARITPLKYIFLTGHHTLYMSAMLAVILSVGGLSPFWVVLVGAVILGIMMVVSPAILQPFTRKITGTDDLALGHFGSTGYLLSALVGKAIGKGSPSIEELKVPKTLNFLRDSSVAISLTMMILFLILVLVAGKEFVETSISGGQNFIIFAIIQSLTFAAGVWIILAGVRMIIAEIVPAFKGIADKLVKDAKPALDCPTVFPFAPNAVIVGFLSSFAAGLVSMFLCPLLGLSVIVPGLVPHFFCGATAGVYGNICGGRRGAVVGAFAH

SEQ ID NO: 122468 - protein, 76 aa, Glycine max
  Coding DNA Sequence Number=SeqID_30783
MPSRKLSAKRSRRDAAAEGTSAAPEFDSHCFRSAEHQQHFEAIKGWSFHRERRVQLRDDEYIDFQEEIARRRWTSL

SEQ ID NO: 122469 - protein, 303 aa, Glycine max
  Coding DNA Sequence Number=SeqID_30784
  Homolog annotation: Hit_ID=Q6WAY6; Match level="QueryCoverage=94%, HitCoverage=57%, E-value=2e-32, Identity=31%"; Hit description =Putative uncharacterized protein
FYQVKVKGLDVTSLKELGRLMGPLQRQAFRKVYVKILDLAAAEVFTEAVVSLAQYYDQSLRCFTLGDFQMVPTIEEFEEILGCPLGGGGEPYLFSGFLPSLSKIAAVVGDSAKELDRMKQIRNGVVGLPRKYLESKARDMASQEKWGPFADILALLIFGVVLFPNVDSLVDLATIDAFLAYHHSKESPVVAILADLFDTFDRSTINWFPRWKEGKEGVLFSCGDYPNVPLIGTRGCINYNPALAIRQLGYPMRGAPTEESLSPFLVRDLGAQGLKVIQRVHKAWRSPLRKDKELRGIRNGVIG

SEQ ID NO: 122470 - protein, 325 aa, Glycine max
  Coding DNA Sequence Number=SeqID_30785
  Gene Ontology: Mol. function=lactate transmembrane transporter activity; Cellular component=integral to membrane; Biological process=lactate transport
  Homolog annotation: Hit_ID=A7MNF4; Match level="QueryCoverage=72%, HitCoverage=42%, E-value=1e-100, Identity=78%"; Hit description =Putative uncharacterized protein
  Pfam annotation: Domain name=Lactate_perm; Domain location=104-325; Score=68.1; E_value=2.9e-17; Accession=PF02652.5; Description=L -lactate permease
TAKLEAEIERLREVKGQKLSNEAQKLMNMPHRRAITKKEQADMGKLKKSVRGLVVVHPMTELGREMGLKEMTAETHPPRRLSGPQETCMSLWQQNYDPAGNIWLSSLIASLPILFFFFALIKLKLKGYLAATYTVAIALLVALFFYKMPIDRALASVVYGFFYGLWPIAWIIIAAVFVYKISVKTGQFDIIRSSILSITPDQRLQMLIVGFSFGAFLEGAAGFGAPVAITAALLVGLGFNPLYAAGLCLIVNTAPVAFGAMGIPILVAGQVTGLDSFEIGQMVGRQLPFLTIIVLFWIMAIMDGWRGVKETWPAVMVAGGSFAIA

SEQ ID NO: 122471 - protein, 98 aa, Glycine max
  Coding DNA Sequence Number=SeqID_30786
MNIQLFSLHKDGDVDLNASPQALDKLLGYVLAFKIKVQPKFRKFAILKCSTDSSLIDVVMDMLPNAETSSKINVPTFDSNHSTEHEPVNFNHDLHPLI

SEQ ID NO: 122472 - protein, 101 aa, Glycine max
  Coding DNA Sequence Number=SeqID_30787
MPHGLFPYKSHALMPLRHFTEHLVGARLGVNSKRTGTMWHSTKRRSKYTNEKLESLGMEHLLIGDEQKRKTESKNAKNDHPGAANSSIPWVGLLKGGKRSF

SEQ ID NO: 122473 - protein, 53 aa, Glycine max
  Coding DNA Sequence Number=SeqID_30788
MESYSGHSSTEEGATPIWAGDQPRHAPAPDHEDYMQPDIPQVPVTFEPPQHVV

SEQ ID NO: 122474 - protein, 170 aa, Glycine max
  Coding DNA Sequence Number=SeqID_30789
  Gene Ontology: Mol. function=G-protein coupled receptor activity; Cellular component=1-2nm peptidoglycan-based cell wall; Biological process=transport
  Homolog annotation: Hit_ID=A1G0B7; Match level="QueryCoverage=100%, HitCoverage=41%, E-value=1e-87, Identity=97%"; Hit description =Lipoprotein releasing system, transmembrane protein, LolC/E family precursor
  Pfam annotation: Domain name=FtsX; Domain location=74-170; Score= -34.8; E_value=0.052; Accession=PF02687.12; Description=Predicted permease
MLLCKELAIWLGVDVGDQVLVTFAEVQGTPAGAVPRMKRFTVSGIFEAGYNEVDRGVGFANMKDLERVLRSDGATGVRLKLHDMDRSLEVGVDLAQNLGGAYRVSDWTQQNANLYHSLRMEKVVMGILLSLIIAMGAFNLVSSQVMLVTDKQADIAILRTLGLTPGGVKQ

SEQ ID NO: 122475 - protein, 216 aa, Glycine max
  Coding DNA Sequence Number=SeqID_30790
  Gene Ontology: Mol. function=nitrite reductase [NAD(P)H] activity; Cellular component=membrane; Biological process=nitrate assimilation
  Homolog annotation: Hit_ID=A6TAM5; Match level="QueryCoverage=100%, HitCoverage=42%, E-value=3e-96, Identity=66%"; Hit description =Putative nitrite reductase [NAD(P)H] large subunit
MAVQLDNGGAAMLREKILDLEVGVHTSKATTAIVRTADGLQLNFADGGTLQTDMVVFSAGIRPQDALARGAGLAIGERGGIGIDDHCRTSDADILAIGECALWDNKIYGLVAPGYHMARTAAAQLAGEAARFSGADMSTKLKLLGVDVASFGDAHGRTAGCQSYQWTDGPRQIYKKIVVSADGKTLLGGVLVGDAGDYATLLQMMLNGMALPSRPE

SEQ ID NO: 122476 - protein, 77 aa, Glycine max
  Coding DNA Sequence Number=SeqID_30791
MRYFLIGVAMVASFAYAKSVMALGFDGLQTYVGERFDSLERQVDTRFKEINSRTAKVEEDVTIIRDYFDLPPPPPSV

SEQ ID NO: 122477 - protein, 77 aa, Glycine max
  Coding DNA Sequence Number=SeqID_30792
MDKSSKVGEDEWRERERRDMKFCASNEGPMTRSKTKQSVDTLHQMVADILNKVQVEKDEGPEVEAPLNILIVVEAQD

SEQ ID NO: 122478 - protein, 123 aa, Glycine max
  Coding DNA Sequence Number=SeqID_30793
MALGVMSWLKANLSCEHVVYESPWNHLLGGGGTPIFSSKICRMPRLFTKLDDWRQTIPKEWWDKGCCVVVFRDQTAKRDNSGLAIEDKPEESSFTSTRTQCVCSSLSKTVVSSTLSQISLTRA

SEQ ID NO: 122479 - protein, 80 aa, Glycine max
  Coding DNA Sequence Number=SeqID_30794
  Homolog annotation: Hit_ID=A6FJQ2; Match level="QueryCoverage=47%, HitCoverage=84%, E-value=3e-11, Identity=92%"; Hit description=50S ribosomal protein L5
MQLRRRSQLVCKRMREQTSPSGRMRKEKIPHQAPFAIQAAQLLGRAIGAGLFAITPAGERGMCCKAIKLGNARVFPVTTL

SEQ ID NO: 122480 - protein, 205 aa, Glycine max
  Coding DNA Sequence Number=SeqID_30795
  Gene Ontology: Mol. function=protein disulfide oxidoreductase activity; Cellular component=outer membrane-bounded periplasmic space; Biological process=cytochrome complex assembly
  Homolog annotation: Hit_ID=Q2NUY0; Match level="QueryCoverage=56%, HitCoverage=47%, E-value=8e-41, Identity=75%"; Hit description =Suppressor for copper-sensitivity C
ALEQDKRVFVDVTADWCITCKVNKSRVLNQPDVRAALGAEDVVLLRGDWTQPDPAIGEFLRRRDRVAIPFNQIYGPALPHGQILSPLLSRDAEARIKQLIRETLVQNPAILAEAADAFDKEAARQQQNVVAQMVEKNRAALFNDAGSPRIGAKKPALTLVYFTDYNCVFCKKFEADIEKLLQNYPQVAVVLKPLPYRAESSLSSA

SEQ ID NO: 122481 - protein, 49 aa, Glycine max
  Coding DNA Sequence Number=SeqID_30796
PEYEEPRDLRSNPFQGGGNDAILLRKGIGGELSYYRGCVAKFLASHLKE

SEQ ID NO: 122482 - protein, 158 aa, Glycine max
  Coding DNA Sequence Number=SeqID_30797
MCDTLESDLKNFLYPVCKKSLTLLSTVLSMVNMKARYGWSDKSFTSLFKVVQEMHKCPRCGISWYKVTNDDKCSNDESAKKRLPQQRCYGIFISFQGLSVSLLMEMMQKTLHFMQMGETTMECSAIQMIFPNGRRLIISIQISGKRQEILGLDLALME

SEQ ID NO: 122483 - protein, 66 aa, Glycine max
  Coding DNA Sequence Number=SeqID_30798
MDLLEQAKPSSTNGDVPFLVLFEPKVMSFQLRTLGHHIPRYVLCLLGTTKMYLQCVKTEGDSGRTS

SEQ ID NO: 122484 - protein, 214 aa, Glycine max
  Coding DNA Sequence Number=SeqID_30799
LAFRGLHVLAFRGLQALAFRGLHALAFRGLDILAFRGMHALTFKGRHVLNFRVLHALAFRGLRVVAFRGLHICTLREFKQHSAQRPQCRSPPTEVLVGLCRPDIGVAPIRHPVDPKKSNRALGFPALVTGLYQSYRVPVPPGKGSRLQDTQWTRRSPTGSWSCQALITGLYQFYGVPVTSSKGIRPPTNRAFIKKYCAPRQAQGETPQQHWDGR

SEQ ID NO: 122485 - protein, 110 aa, Glycine max
  Coding DNA Sequence Number=SeqID_30800
MDNPKHHLWLGSLHKIENSSFGPWRKGGTETFSISQVIQNYVGLVPHWGIRRSQDPDFFDHNPFTQAKKKRRKISNQRESQKEKKGNSQSKSGRKQKEKKENSQPKNGRK

SEQ ID NO: 122486 - protein, 36 aa, Glycine max
  Coding DNA Sequence Number=SeqID_30801
MESHNFLEKSFEMWEASSTLCMDKVHTNVYPRCRGD

SEQ ID NO: 122487 - protein, 70 aa, Glycine max
  Coding DNA Sequence Number=SeqID_30802
VGPIVQGTKPDDNIALRTYKDHLPICTALENIRSMTTEWRRKKDDWRHYFKEKMSQKQAHYHRKPWIRAL

SEQ ID NO: 122488 - protein, 39 aa, Glycine max
  Coding DNA Sequence Number=SeqID_30803
MEAPNTLPMKGLLLHILKAMKIPMRELNSSKKFQKRLYD

SEQ ID NO: 122489 - protein, 121 aa, Glycine max
  Coding DNA Sequence Number=SeqID_30804
QKNACVWLAMESLVQNEFWMFLVDPNEFCLCPVLLGCDSLCCLNVVLLGCCGSLGGLMGTRGWWVYARIVDVENLLCTIARPPPKWYLEICRGGQETLGTSGGVLLPKTKLDQSRPNPGIV

SEQ ID NO: 122490 - protein, 80 aa, Glycine max
  Coding DNA Sequence Number=SeqID_30805
  Gene Ontology: Mol. function=endonuclease activity
  Homolog annotation: Hit_ID=Q9AY32; Match level="QueryCoverage=78%, HitCoverage=95%, E-value=7e-27, Identity=96%"; Hit description=RRNA intron-encoded homing endonuclease
VDSRGSPINQERKLGARRRSDTVLVSTINDADQGSADVAFRTPLAPYEKSKSLGSGGSMVARLKLKGIDGRAPPGVEPAA

SEQ ID NO: 122491 - protein, 140 aa, Glycine max
  Coding DNA Sequence Number=SeqID_30806
  Homolog annotation: Hit_ID=A5B6Y9; Match level="QueryCoverage=43%, HitCoverage=12%, E-value=4e-24, Identity=85%"; Hit description =Photosystem I P700 chlorophyll A apoprotein
GGQRRPPSGGPEPSVRYTLEELEFYLVPGPTGRGTVSGRQFLWGVGLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 122492 - protein, 117 aa, Glycine max
  Coding DNA Sequence Number=SeqID_30807
  Subcellular localization annotation: CTP_CleavageSite=89; ConfidenceScore=5.52e-01
MTLSSWQNKLDKYFTCKTLVMKGETKVTKANGILRTSYSSCLSPVSSSTTLFFSVFSQIGVDRSSATFNKAEIYKEEARNATQKHKPKRVESVNADAEAFGDHSKILIALCILKLKH

SEQ ID NO: 122493 - protein, 459 aa, Glycine max
  Coding DNA Sequence Number=SeqID_30808
  Homolog annotation: Hit_ID=A7PMI9; Match level="QueryCoverage=87%, HitCoverage=88%, E-value=1e-49, Identity=41%"; Hit description =Chromosome chr14 scaffold_21, whole genome shotgun sequence
MEGRESKSSLTSQTEPRDNPHSRFSTPMQQHQSHHELPMWNSKSDWRRVQKEMVALKKAYADVILNTVKEAAGRVMVAERRALMFQQEHASSKEEALHMLMRLKQMMDAKTAEAEKASLEKQRKIDELEAQLNEAEDIITDLRAELKLVYLELEMARNNQVRPLSGQKSQNEKQAVTFQESAKPEISISSPHKELRCVTSCDVANKSLTMNVLDNKCCNAKQQTEQLRISNLEDSCGHDSDFASIITKSKEPELFRNGFTQRIHALEGNLLDEKLLKQDVHNQHYGKKLRIIAKDSNGQCPSVSDNKKCCEDEYDAKMKSVAPLTDVEPVLGTTGVTESVQAVNKFKLVEKAIEKDNELLNLEESAAQNLTGPSSDMKVEVFDVPSTNTDLEDAKAFEKNDRSASQVNDSRPLKYTFQRKRKKESLGNTDQNIDSEKRIVKRRLEDKQNGALEHQNLAS

SEQ ID NO: 122494 - protein, 81 aa, Glycine max
  Coding DNA Sequence Number=SeqID_30809
MWLLVNLAPVFQNPSQEKNAVPLSFLPKHCKRDLEATNLLDGALEVTDLFIDLSGVPARVCCHNWNQHGLEDDNLVGLLPE

SEQ ID NO: 122495 - protein, 597 aa, Glycine max
  Coding DNA Sequence Number=SeqID_30810
  Homolog annotation: Hit_ID=A7UQU7; Match level="QueryCoverage=58%, HitCoverage=72%, E-value=1e-22, Identity=27%"; Hit description=IMP dehydrogenase/GMP reductase, putative
  Pfam annotation: Domain name=DUF1723; Domain location=244-293; Score =43.2; E_value=9.3e-10; Accession=PF08330.1; Description=Protein of unknown function (DUF1723)
MGGEEAFFAYGRTFFRMRDCLKMLRTKERSFVSSYGRTFFRKNLQNKDFLVTEEGSFVCSYVRTFFRNKNILHTGEGCSIMVRTRGLGRALASVRGRGMGQDEHHADVSQRRRPTAFARRQRVHVDVTEDVPQVTEDVPHMDKDIPERIADVDAADVEGITIDGAKGSPADHAEGFPGGPRDPSILTSFGDHVAHSIWSGKERPELKLVSQGMKVDKFGRSAPEIEGLVAATGLSPLIGCSVVTNDPRLIFAFVERWHRETSTFHLPVRELMITLDDAAALLHLPITGVLHSFEPLLVDEAIFLLMELLEVFGDEAGVETVYQSRCHVRWWIVAAHAYLLHLGAATLVHMYDQLNEACQTPTRQMTRYLTLSQCWIYEHFPSVYQCVTDDAYAETTPCASWWLTTKAHMRGVTGASYRARSAEMGPIVVFVRPERVVRQFGYIQMIPLSPVSASLSYEEIGDRWMHFLDHVAPAGEICVVPGQVSADYMDWFFQISHPFVTLTQAGDQPRHPPTPHDEEYVEPHIPEVLVAFDLPRHSVDACEGCEAIAERLERVLNLRMVTEGTELHEIMQDCLRIARGNTSDGSLRARHRRRIDH

SEQ ID NO: 122496 - protein, 87 aa, Glycine max
  Coding DNA Sequence Number=SeqID_30811
MNYGQGIPRLVLVGMINGIGNCHVKNDEGNGKEMRLKDKRSYLLISEYVQRAELRRQIKIGMKRRTRRREPNRIVPRFSSIPKPQSA

SEQ ID NO: 122497 - protein, 115 aa, Glycine max
  Coding DNA Sequence Number=SeqID_30812
MEDRPNKLDSAPHMQDLSPILTLECFDGTNYSECALNAENKIRDRRRWGYTQSFGVDYQETFASVARGYTQSFGVTLNPLGLITKKPLHQLQGVTLNHLGLITKKPLHQLQSSIQ

SEQ ID NO: 122498 - protein, 147 aa, Glycine max
  Coding DNA Sequence Number=SeqID_30813
KYQDINGRSEHPGRVRGAGTGVTITQYFGPSSCRSTSSSNIIVEQLADIIGNLKEEWQRQAEQENIKREEVWMRRVEEEKQRTMDTFKGQIQEAIKLELSQIVSQHSAPLQPNDIQVLAARVSTKGSCAAAETNALAKKPSELNVEW

SEQ ID NO: 122499 - protein, 349 aa, Glycine max
  Coding DNA Sequence Number=SeqID_30814
  Gene Ontology: Mol. function=triacylglycerol lipase activity; Biological process=lipid metabolic process
  Homolog annotation: Hit_ID=Q45NK3; Match level="QueryCoverage=53%, HitCoverage=98%, E-value=3e-57, Identity=61%"; Hit description =Putative uncharacterized protein
  Pfam annotation: Domain name=Lipase_3; Domain location=60-208; Score =19.2; E_value=1.7e-05; Accession=PF01764.16; Description=Lipase (class 3)
MTQSALLGRGIELASSLTSSAVLLRKPWDVITSRYAGIITSEGEGISWKLFREPGLDLTILAFDVTQDSSNPPKELVYSNACGEKIFRHFEFLHTKKSPFFSVNSAAILLLDKNYEQLDQLKSEINSSPRLIVTGLGLGGPIASLFTLSLLDTNNDKKKPPLCITFGSPLIGDKKFQKAISRSSNWNSCFLHVVSLNDPLPRLFVTNSPAASTPQTSAYMPFGTFLLCSDVNSTCFENPDSILEQLIAMGSIHTQNQGFQSSDYGNIVEKLNDKVICKDFSTTHLQQQNIDTNTLETKSKIQQKFIFPRRVIIYPAKKLNEMKVHMAQLEWYKKKTKNQRIDTMTATRI

SEQ ID NO: 122500 - protein, 104 aa, Glycine max
  Coding DNA Sequence Number=SeqID_30815
  Gene Ontology: Cellular component=mitochondrion
  Homolog annotation: Hit_ID=Q6YSQ6; Match level="QueryCoverage=48%, HitCoverage=46%, E-value=2e-10, Identity=68%"; Hit description =Putative uncharacterized protein orf108a
MKFKEVESEGHAPVWGSGRWNHGIVRESRFRLFPFRSPLLQESLLLSFPLATKMFQFTRLSLACPWIQQQFERLTYIGNPRIYAYFQLPEAFRRLLRPSWSLGT

SEQ ID NO: 122501 - protein, 97 aa, Glycine max
  Coding DNA Sequence Number=SeqID_30816
MFDTSISKKAVSKFLGVSRKSISQYDIDYRCLLVCGAYGSSKLTALHLQNKLLTVKLSHSMQAGAYKCIVDAAGFFQDRNSTQDLDFVLEMIVVILL

SEQ ID NO: 122502 - protein, 523 aa, Glycine max
  Coding DNA Sequence Number=SeqID_30817
  Gene Ontology: Mol. function=transition metal ion binding; Cellular component=cytoplasm; Biological process=inositol metabolic process
  Homolog annotation: Hit_ID=A2Q2R2; Match level="QueryCoverage=80%, HitCoverage=38%, E-value=1e-177, Identity=76%"; Hit description =Histidine acid phosphatase
  Pfam annotation: Domain name=Acid_phosphat_A; Domain location=18-430; Score=17.4; E_value=1.2e-08; Accession=PF00328.13; Description =Histidine acid phosphatase
MEEVKKRIQSWSTNEQLLVDKVYEYIRGVKPTVSWYSIIWNPAIPPKMSFILWKSLQVWAHIRDLTPFHRRFTSLQRIIDSLIRGRSTSGGLLIFSSCGVKLTKKVTKQVRLLAQDENEKLAERSLYDVIPPYDQATALGKTNIDVDRIAAGLPCGSEGFLLMYARWKKLETDLYNERKERFDITQIPGVYDSCKYDLLHNAHLNLEGLHELFKVAQMLADGVIPNEYGISPKQKLKIGSKIARRLLGKLLIDLRNTREEAITVAELKNNHDHSLSINIEKEDAEAKSKLFHKNDEIDQDDDDDKETKYRLDPKYANVKTPERHVRTRLYFTSVYKIIARLSPNRLKHFGKLACDTYKRESHIHSLMNVLRYCNLEESLQEESLVCRNALERLCKTKELDYMSHIVLRMFENTEVALEDPKRYRIELTYSRGADLSPLEKKGSAATSLHQEHTLPIMGPERLQEIGSYLTLETMEEMIRPFAMPAEDFPPATPAAFSGYFSKSVLDRLVNLWPFHRQASSLGK

SEQ ID NO: 122503 - protein, 606 aa, Glycine max
  Coding DNA Sequence Number=SeqID_30818
  Gene Ontology: Mol. function=oxidoreductase activity, acting on single donors with incorporation of molecular oxygen, incorporation of two atoms of oxygen; Cellular component=endoplasmic reticulum; Biological process=...
  Gene Ontology: Biological process=response to oxidative stress
  Homolog annotation: Hit_ID=Q5GQ66; Match level="QueryCoverage=99%, HitCoverage=93%, E-value=0.0, Identity=83%"; Hit description=Alpha -dioxygenase
  Pfam annotation: Domain name=An_peroxidase; Domain location=56-588; Score=600.1; E_value=2.1e-177; Accession=PF03098.6; Description =Animal haem peroxidase
MWSAIVHSVDKLGIWPRLPVFLGLLYLAFRRHLHQEYNLFNVGTTPVGVRFNHSDFPYRTADGKYNDPFNEVSGSHGTFFGRNILPVDQKKKLLKPDPMVVATKLLARRTYKDTGKQFNVIAASWIQFMIHDWIDHLEDTNQIELIAPREVASQCPLRSFKFYKTKEIPTGFFEIKSGSSNIRTPWWDASVVYGSNGEVLQRVRTFKDGKIKISKDGHLLHNENGTAIAGDIRNSWAGVSTLQSLFIQEHNAVCDTLKKHYPHLGDEELYRHARLVTSAVIAKVHTIDWTVELLRTDTLLAGMRANWYGLLGKPFKDTFGHVGGVILGGLVGLKRPENHGVTYSLTEEFATVYRMHSLLPDNLQLRDISATPGPNKSLPLIKEIPMKNLIGLQGEKTLSEIGLARQLVSMGHQACGALELWNYPEWLRDLVPQEIDGTDRPDHVDLAALEIYRDRERSVARYNQFRRALLLIPISKWEDLTDDKEAIQVLEEVYGDDVEELDVLVGLMAEKKIKGFAISETAFVIFLLMATRRLKADRFFTSNFNEETYTKKGLEWVNTTESLKDVIDRHYPEMTHKWLNSSSAFSVWDSPPNTHNHIPLYLRVPH

SEQ ID NO: 122504 - protein, 452 aa, Glycine max
  Coding DNA Sequence Number=SeqID_30819
  Gene Ontology: Biological process=intracellular signaling cascade
  Homolog annotation: Hit_ID=A7PME5; Match level="QueryCoverage=59%, HitCoverage=98%, E-value=4e-98, Identity=59%"; Hit description =Chromosome chr14 scaffold_21, whole genome shotgun sequence
  Pfam annotation: Domain name=DUF231; Domain location=271-446; Score =93.3; E_value=7.4e-25; Accession=PF03005.6; Description=Arabidopsis proteins of unknown function
  Subcellular localization annotation: CTP_CleavageSite=25; ConfidenceScore=5.12e-01
MKTSSTMFQDRHHNHSSGKKERCLSLTLGKGVPFVLTSLLMASIFSLFFLYNPNPLTLTPHQGHDMFENPSDPKQEEHPITTTKVSPSKPQKEQKTCDLSKGNWVPVLRGSSTYYTNSSCTTIPDSKNCFKQGRVDTDFLNWKWKPEQCDLPRFDPRTFLHMVRGKKMAFIGDSVARNHVDSLLCLLSQDEIPKDIHKDSEDRFRKWYFPIHDFTLTMVWSRFLIVGEERMVNGTVGTSIFDMQLDKVDNDWANELPNLDYAIISAGHWFFRVMHLHEAGKQVGCVYCNQPNITSYNPDITIRKAFRTAFKHINACKECGRKKMVTVLRTFAPAHFENGDWNTGGYCNRTSPVSESEVDFGRFDWEVRGIQMEEFERARSEGIIMGKLGLHNRFEVVDVARAMLMRPDGHPGEHWGNKWMRGYNDCTHWCLPGPIDVWSELLLAVLKRVNEF

SEQ ID NO: 122505 - protein, 84 aa, Glycine max
  Coding DNA Sequence Number=SeqID_30820
MEKISVRIERVTQNQQQSELAGDLSKSSMFSSIDEFNKLKELGVICHPRKVQIMQVTWYPPFKEWLSVTRMEWPEDPRAWQAVG

SEQ ID NO: 122506 - protein, 389 aa, Glycine max
  Coding DNA Sequence Number=SeqID_30821
  Gene Ontology: Mol. function=molecular_function; Cellular component =membrane; Biological process=auxin mediated signaling pathway
  Homolog annotation: Hit_ID=A7PMD8; Match level="QueryCoverage=60%, HitCoverage=64%, E-value=4e-60, Identity=51%"; Hit description =Chromosome chr14 scaffold_21, whole genome shotgun sequence
  Pfam annotation: Domain name=DUF6; Domain location=73-202; Score =16.3; E_value=0.0081; Accession=PF00892.11; Description=Integral membrane protein DUF6
MEKIAVKRRTTQAKILGSIISILGAFVVTFYKGQSIIIADNSPSIQLPQSNGILTSVDRNWVIGGLLLTACNILLTVWFVYQVEILKEFPDELTMVFFYNLCAAIVASIIGLLGEKNSSAWKIRPDISLISIVCTGIFNKFLSSAIYAWGIHLKGPVYVAMFKPLSIVIAVAMGVMFLGDSLYVGSIIGATIISIGFYTVMWGKATEQKEEEEEEENVGSQESSITENIPLLQSYITVNSTKKIDGNKILETIFYHRTAYCCEGPLVSLFPEWPSCYPFARQCMEDFQQWFTRFMAMNGNAFSKISLFYAFIKKQVIRSDIAKVIECAAEISEVAAGVVQDIYEERGWHHSNHQQSSAQTECINQKIEEKTIQGTRGVKNQTLGRKAKL

SEQ ID NO: 122507 - protein, 850 aa, Glycine max
  Coding DNA Sequence Number=SeqID_30822
  Gene Ontology: Mol. function=transition metal ion binding; Cellular component=cytoplasm; Biological process=inositol metabolic process
  Homolog annotation: Hit_ID=A2Q2R2; Match level="QueryCoverage=40%, HitCoverage=30%, E-value=1e-155, Identity=83%"; Hit description =Histidine acid phosphatase
  Pfam annotation: Domain name=Acid_phosphat_A; Domain location=48-772; Score=69.1; E_value=1.5e-17; Accession=PF00328.13; Description =Histidine acid phosphatase
MLLDAKAPHLSSAIPPTLPWKVNELVQPSEPLTRQGSGINGSFGDSEELRCVIAVIRHGDRTPKQKVKLKITEEKLLNLMLKYNGGRPRSETKLKSAVQLQDLLDATRMLVPRTRPDRESDSEAEDVEHAEKLRQVKAVLEEGGHFSGIYRKVQLKPLKWVKVTKGNGEVEEQPVEALMVLKYGGVLTHAGRKQAEELGRYFRNKMYPGEGTGLLRLHSTYRHDLKIYSSDEGRVQALFISLICPLASYVSHFFMTHIKQMSAAAFAKGLLDLEGQLTPILVSLVSKDYSMLDGLENASSEMKEAKAWLNEIITSNANTVDSNGSPEFPWMVDGAGLPPNASELLANLFVTTCNSQLELFPMRKNKSRQSHSAAKQIMVKGITSGSGKSQTSATSGLAGCLDVVQANQNAQDNLVGKVLVKKAETSSAKTDDVAHQVFDNLSECRAESESSPEVSCTLGDNDSTTDDDSSHSYGSKNPSKDFGMKFSLPPSDDEVLLEETDLQPLEEAWGHSLNGYVADCFPGKKALLDCCQKWGVKFSFSVHESGWLVMPAFFDFGNEELNKIPVWGSISFVRALVEVDASLELIDEVRFRLPTGNTFVQKIEYENRPSFCTHCKMIRHRLTNCKTVTANKSALITTSPTLDQPQVGDSAMPPHTNTAGPSDNPKTVQTNLSVPLHTQKICSGNTEFGDPIEEGFVQGGFLLSKSMIIASWNIRGFNLPLKHHANVMVVLETKLNKDKIHLSVLESNAQLIHCAIDCKTTAKRFQVSFIYGLHSIVVRSLWINLNSTNANMNCPWLLIGDFNSILSLTDRFNKAEPNAYELQDFVDCCSDLGLGSINSHDPLYTWTNGR

SEQ ID NO: 122508 - protein, 60 aa, Glycine max
  Coding DNA Sequence Number=SeqID_30823
MSLRILAISLKSGESSSCMAAIKGVLKFHQNPNRATRGGALESTRDATIANREHLSDYLE

SEQ ID NO: 122509 - protein, 349 aa, Glycine max
  Coding DNA Sequence Number=SeqID_30824
  Homolog annotation: Hit_ID=A7PI75; Match level="QueryCoverage=89%, HitCoverage=21%, E-value=9e-31, Identity=32%"; Hit description =Chromosome chr13 scaffold_17, whole genome shotgun sequence
VDNTLCMKAETVDNDVCDLEGSPDTVSPKNHQLKFPLSSQRTDANSWNRLSSSIAELLHSDKSSSVDSSPEGFTTMTRLQIWKNVISQVLEQTETEICSLENELKPLQSEFGDGMPCHNAKTCDIEFGGYDKVTRRPEPSQIDPSHDDNNIEKMMPLSTNLHGMHDTTKENDINNPATSTLKFLEAEPLIKMVSSLSGVDDTLPNTIISSNRETAQSACAVFEKFLPNETSKTISNVGVSSSSLSHVDEFIKDKFAEKKRFAGFKEKDLTIKHKTFDHPWKKDMCLRYLRKCTRTSPNNLKLHLKVATSYCQKNLSSTHYRCFPFQPASKRTLVLFPKRISQPESADNS

SEQ ID NO: 122510 - protein, 46 aa, Glycine max
  Coding DNA Sequence Number=SeqID_30825
MGSHFLRKRKHPASIIRRKEVCFLLIVALPQAGGELPYGWLRIIHI

SEQ ID NO: 122511 - protein, 484 aa, Glycine max
  Coding DNA Sequence Number=SeqID_30826
  Gene Ontology: Mol. function=RNA-directed DNA polymerase activity; Cellular component=exocyst; Biological process=exocytosis
  Homolog annotation: Hit_ID=A7PP53; Match level="QueryCoverage=99%, HitCoverage=77%, E-value=0.0, Identity=73%"; Hit description =Chromosome chr8 scaffold_23, whole genome shotgun sequence
  Pfam annotation: Domain name=Exo70; Domain location=3-475; Score =321.5; E_value=1.6e-93; Accession=PF03081.6; Description=Exo70 exocyst complex subunit
MFNKLDFDFSKPVEPDRLFECLPNSLRPSNSGKQSEGGGKNHSEKQSSETVTFALPILIPPRVIPLLHDLAQQMVQAGHQQQLFRIYRDTRATVLEQSLRKLGVERLSKDDVQKMQWEVLEAKIGNWIHYMRIAVKLLISGEKKICDQIFDSVDSLKAQCFAEVTASSVAMLLSFGEAIAKSKRSPEKLFVLLDMYEIMRELQPEIERLFESKACIEMRDAAMNLTKRLAQTAQETFIDFEEAVEKDATKTTVMDGTVHPLTSYVINYVKFLYDYQSTLKQLFHEFDPNDPEGQLAIVTTRIMQALQSNLDGKSKQYKDPALTQLFLMNNIHYIVRSVRRSEAKDMLGDDWVQIHRRIVQQHANQYKRISWAKILQCLTIPGGDNNGGVSRTMVKDRFKTFNDQIEEIHQRQSQWTVPDSELRESLRLAVAEVLLPAYRSFLKRFGPMIENGKNPHKYIVYSPEHLEQMLGEFFESKIWGEQKR

SEQ ID NO: 122512 - protein, 212 aa, Glycine max
  Coding DNA Sequence Number=SeqID_30827
  Gene Ontology: Mol. function=oxidoreductase activity; Biological process=electron transport
  Homolog annotation: Hit_ID=Q8GUI2; Match level="QueryCoverage=94%, HitCoverage=45%, E-value=1e-43, Identity=42%"; Hit description =Putative uncharacterized protein At5g39940
  Pfam annotation: Domain name=HI0933_like; Domain location=1-199; Score=-235.8; E_value=0.00046; Accession=PF03486.5; Description =HI0933-like protein
MELHMIGEACLWVTFPKVKVRLKLGSVQRNIPHLTQVGPMLVTHWELSGPVVLRLSAWGARFLFSSGYKDIVIIWVQANFFVDFIPDLQFCMRKFEVSSFSSQASICETGIKFNKQEVLNSCPPEFGITKRFWSYVLERKGLRGDILWASISNSSLMSIDSLLKDCIFDVTGKILNVDGVTGGFNFQNAWSGGFIAGTTIGGLALGSYLGSK

SEQ ID NO: 122513 - protein, 109 aa, Glycine max
  Coding DNA Sequence Number=SeqID_30828
  Gene Ontology: Mol. function=RNA-directed DNA polymerase activity; Cellular component=exocyst; Biological process=exocytosis
  Homolog annotation: Hit_ID=UPI0001505864; Match level="QueryCoverage =80%, HitCoverage=13%, E-value=8e-31, Identity=76%"; Hit description =ATEXO70A2 (exocyst subunit EXO70 family protein A2); protein binding
MGISQAMDALRQRAVFVKESLHKSQTITDNMVSILGSFDHRLSALETAMRPTQIKTHSIRSAHDNIDKTLKAAEGILSQFDQTRMGQSPGDQLITARKCNTTYIRHNNV

SEQ ID NO: 122514 - protein, 161 aa, Glycine max
  Coding DNA Sequence Number=SeqID_30829
  Gene Ontology: Mol. function=isopentenyl-diphosphate delta-isomerase activity; Cellular component=cytosol; Biological process=isoprenoid biosynthetic process
  Homolog annotation: Hit_ID=Q6K683; Match level="QueryCoverage=49%, HitCoverage=10%, E-value=1e-23, Identity=70%"; Hit description =MutT/nudix protein-like
  Subcellular localization annotation: CTP_CleavageSite=53; ConfidenceScore=5.52e-01
MAATKLSSGSRTSNSGISQKQSTTPTQKGLRSNPPTKHGRNDESGPKKGPGASGEYYGGGLVMFGRCMAAYLNLLHIVRKGQALQFNWLYEKGAFVWDSEGKVSVDFTKIEGAVESLSREILTIQANGDKETAGLLLLKYCVLTEPLKVALKNLEDIQIWE

SEQ ID NO: 122515 - protein, 94 aa, Glycine max
  Coding DNA Sequence Number=SeqID_30830
MVVALAMVPFLIEVLNVGMVAQAEAVEVPIPYSAGPPRTSNTWVNPNSKSTGSGHNQPSAMLTNLASHGTAPAGSTWIPDFGGSFHVTGDSQKH

SEQ ID NO: 122516 - protein, 219 aa, Glycine max
  Coding DNA Sequence Number=SeqID_30831
MWRRGKPVGQLIQRKQVMSHSAMTAGSHVTILKKKERDVDRIEEIFTEQVSKGISGPAKGMGLSPKKQGLLSHTPNGKEGNMGLNPENSKAGTENGWQVYSRLRRGQKKSHLGLYDPTSEIDMQGANLQNQSTQNMAQQGIIQNADQVHNNDTSDHNGDIVANSESESQHNQEATYIWSKAKQLGVSGVEEQKIIIEKINQMEARDKTEAERRGDNIRS

SEQ ID NO: 122517 - protein, 310 aa, Glycine max
  Coding DNA Sequence Number=SeqID_30832
  Gene Ontology: Mol. function=isopentenyl-diphosphate delta-isomerase activity; Cellular component=cytosol; Biological process=isoprenoid biosynthetic process
  Homolog annotation: Hit_ID=A7PVI7; Match level="QueryCoverage=62%, HitCoverage=25%, E-value=2e-80, Identity=75%"; Hit description =Chromosome chr9 scaffold_33, whole genome shotgun sequence
  Pfam annotation: Domain name=NUDIX; Domain location=33-186; Score =53.7; E_value=6.2e-13; Accession=PF00293.19; Description=NUDIX domain
MQQAEEHLDVLTKTGLKTGVSKPRGDVHRDGDYHRAVHVWIFAESTRELLLQRRASCKDSWPDLWDISSAGHISAGDSSLTSARRELEEELGITLPKDAFELIFVFLQECVINDGKYINNEYNDVYLVTTLDPIPLEAFVLQLVLHVLELSMKETEVSAVKYISYEEYKRLLAKEDSGYVPYDVNGQYGQLFDIIEKRERHVLRCWFDKVKSGHYKYGYFSPNIPKTAKTKRVHKIQTLSSSESFYGQTKYSSNKPTVIEFRWERERNRKTEKERGKERRNRIERIEGKRRETERSRKCALHPVIIIQSV

SEQ ID NO: 122518 - protein, 269 aa, Glycine max
  Coding DNA Sequence Number=SeqID_30833
  Gene Ontology: Mol. function=4-(cytidine 5'-diphospho)-2-C-methyl-D -erythritol kinase activity; Cellular component=chromoplast; Biological process=isoprenoid biosynthetic process
  Homolog annotation: Hit_ID=P93841; Match level="QueryCoverage=86%, HitCoverage=68%, E-value=3e-96, Identity=66%"; Hit description=4 -diphosphocytidyl-2-C-methyl-D-erythritol kinase, chloroplast/chromopl ast precursor (EC ...
  Homolog annotation: Hit description=2.7.1.148) (CMK) (4-(cytidine- 5'- diphospho)-2-C-methyl-D-erythritol kinase)
  Pfam annotation: Domain name=GHMP_kinases_N; Domain location=110-168; Score=60.7; E_value=5.1e-15; Accession=PF00288.17; Description=GHMP kinases N terminal domain
MGPPIFTQSFGFRDPTWSEPCFGVVVSVEWHLFRHKIVYDPEGRINKLADEVDRETPLSRLTLFSPCKINVFLRITNKREDGYHDLASLFHIIKALNLYRKKTGSDKYFWIHLDKRVPTGAGLGGGSSNAATTLWAANQFSGCPASEKELQEWSSEIGSDIPFFFSQGAAYCTGRGEVVQNIPPPVSLDVPMVLIKPPEACSTAEVYKTSNVEPLTLLEKISKIGISQDVCINDLEPPAFEVLPSLKRLKQRISAAGRGEYDAVFMSGR

SEQ ID NO: 122519 - protein, 89 aa, Glycine max
  Coding DNA Sequence Number=SeqID_30834
MSQRALLWVSEGEAHGCAFQGRKDERSRHQHLFVENGDHFKALDLKNDPFYLQNRGGACHPARPGEQGCFCFLQKQQPSGGRIWKAQGA

SEQ ID NO: 122520 - protein, 66 aa, Glycine max
  Coding DNA Sequence Number=SeqID_30835
  Homolog annotation: Hit_ID=A5BTR2; Match level="QueryCoverage=98%, HitCoverage=3%, E-value=1e-12, Identity=58%"; Hit description =Putative uncharacterized protein
MEEERLVMKMGESALLATACGDNKDTKSQANQKGNGKIPPPVGIKKVTNIFFYKKKGHMKKNCPRF

SEQ ID NO: 122521 - protein, 463 aa, Glycine max
  Coding DNA Sequence Number=SeqID_30836
  Homolog annotation: Hit_ID=Q2HW90; Match level="QueryCoverage=39%, HitCoverage=43%, E-value=2e-15, Identity=27%"; Hit description =Putative uncharacterized protein
MGSSQAPSLKKRLYQVKVKSLGITSLKELGQLMGQLQRQAFRKAYSKIWDLAMAEISTEAIASLAQYYDRPLRCFTFGDFQLSPMVEEFEEILGCPLGGRKPYLFSGFYPSLARISKIVQILAGEWAPFIDILTLLIFRGVLFPNVDGLVDLAVIDTFLAFHDRKESPVVAILADLYDTFDRRCEKSSTRIVCCTPALYVCYNPVLAIRQLGYPMRGAPLKEELAPIIAPGFNNTNAKALQKVRKAWEMVQKKDKELRGNSNGPIGGYRRWLKAHMQGLDWLPSLRTTKGVEVEAPEEDEEVQALRAELEKAQTVKEKFKSEGLKIRKENAELRDDELRICLRSKRSLSQQLCETETNMLAIISKYQEELNLATAHEHKVADDYARMYAEKEARGRVIDSLHQEATMWMDRFALTLNGSQELPRLQAKAKAMADTYSAPEEIHRLLSYCQHMIALMAHIIRNR

SEQ ID NO: 122522 - protein, 109 aa, Glycine max
  Coding DNA Sequence Number=SeqID_30837
MASKPQVGQGALAGSMDGSVSGLELCVLAFELKRFFKWEGRRAILPSARISNVVFKKFSKTNYLEVIRDGGRVVDKALSYPNFVQGLSFTDVLILASRTTLFNTSYRTR

SEQ ID NO: 122523 - protein, 136 aa, Glycine max
  Coding DNA Sequence Number=SeqID_30838
MCTVATYPTTRVRAKSKRSVFQKGKCVEITINVYSRKMLEKPKRGLGILKIMVRELFTHGEEKKALRTMATRSCKLELTLEVAGSPKQAGYFTLKSFGGLGEPEASLGELGSKKLNEKTLLPFFFGIFHILDQNIE

SEQ ID NO: 122524 - protein, 427 aa, Glycine max
  Coding DNA Sequence Number=SeqID_30839
  Homolog annotation: Hit_ID=A9P9Q8; Match level="QueryCoverage=87%, HitCoverage=78%, E-value=1e-137, Identity=64%"; Hit description =Putative uncharacterized protein
  Pfam annotation: Domain name=DUF1336; Domain location=177-418; Score =426.4; E_value=4.1e-125; Accession=PF07059.3; Description=Protein of unknown function (DUF1336)
MSLNEYEIGSRPNDSSPKGVDSVFVDHQQQKQRVHPYNYFRSNSSLKVAKNQGKPKDSTLKSDGSRVELDSVSTGEVSTGQADEIGEYRKLSLDHCGILPNTCLPCLTSNALAVEKRRPMSPDTPSSRRKSLSKLSFKWREGSSDMTLLSPKAFKQKHLAGSSIPFCPIEKQTPGSWSQIEPSSFRVRGKNYFRDKKKDFAPGSAAFYPLGADLFLSSRKIDHIARFIQIPSINVPGDVPSILIVNIQIPLYPATIFQSENDGEGMNVVLYFKLSEKYSKDLPDQFRESISKLINDEVERVKGFPLDTIAPFRERLKILGRVANLENLSLSTTEKKLMNAYNEKPVLSRPQHEFFLGENYLEIDLDVHRFSYIARKGFEGFIERLKLCNLDFGLTIQGNKAEDLPEHLLCAIRLNKLDYSNFNQFGF

SEQ ID NO: 122525 - protein, 50 aa, Glycine max
  Coding DNA Sequence Number=SeqID_30840
MAEEPRRLTLEDYSKFFYNRGVHRTTKQSPLKLKDLASIEAPQASFHQDH

SEQ ID NO: 122526 - protein, 169 aa, Glycine max
  Coding DNA Sequence Number=SeqID_30841
MNEESVWVMASIAPTWVSLGASEKVIQVSCSMLSHLHDNTFFVKALGQVLTGARPMIRSITTQCPAKDVKEALLGGNLGGSSAAPQAKIEFDGHYFRSEEHQCHFEEIKSWSFLKERRVQLREGEYTEFQEEVARRQWTQLIEPMAKYDPKIVMEFYANAWPTEEGVMD

SEQ ID NO: 122527 - protein, 156 aa, Glycine max
  Coding DNA Sequence Number=SeqID_30842
  Subcellular localization annotation: CTP_CleavageSite=50; ConfidenceScore=5.54e-01
MNLLPSAVHASSTNESGAPRIYCLALFANSPFSTFIRSPGNLLPSTVNASSTHESGVPRIYCLALFANSPFSTFIRSPMNLLPSAVHASSTHETGSPRIYCLALFANSPFSTFIRSPMNLLPSAVHASSTHESGAPRNYCLALFANSPFSTFFGAP

SEQ ID NO: 122528 - protein, 93 aa, Glycine max
  Coding DNA Sequence Number=SeqID_30843
  Homolog annotation: Hit_ID=A5ZQM3; Match level="QueryCoverage=77%, HitCoverage=99%, E-value=2e-22, Identity=54%"; Hit description =Putative uncharacterized protein
  Subcellular localization annotation: CTP_CleavageSite=57; ConfidenceScore=5.11e-01
MGVASQKVTEACKGFLGPDGDWPSSAKAEGSLTARPTRRAGTKVGFSDPTVPSGRAVAQRIKGWAVRPLKRYVSWVQNVVRQFGPYPVWALEH

SEQ ID NO: 122529 - protein, 90 aa, Glycine max
  Coding DNA Sequence Number=SeqID_30844
  Subcellular localization annotation: CTP_CleavageSite=51; ConfidenceScore=5.70e-01
MPHLLAKKARKASIAARSTNPSTFGKRTPPKINSVRISMNGAHSPLPAKILAFASKHFLGIPTTPFSTCFLWSNSCAEIWTILEILANEG

SEQ ID NO: 122530 - protein, 92 aa, Glycine max
  Coding DNA Sequence Number=SeqID_30845
MRIKRSFKVVMGPRTRYGEIWNKWLNPKGIEEQRGACSELQNKERETRLKRAIKGINSRTHQQESSQGYCASNQWGKTHQMIIMMDGSNSHK

SEQ ID NO: 122531 - protein, 65 aa, Glycine max
  Coding DNA Sequence Number=SeqID_30846
MEEWEKAKKKGKILDQGSKENRRNMQKGLRTRQYLNNTELSPRNDLQNQVMTYLWFGIRIKHLPV

SEQ ID NO: 122532 - protein, 91 aa, Glycine max
  Coding DNA Sequence Number=SeqID_30847
MIYYGPQSDMRVKTLARRNSPESSMLNFERRDRLLSLFEDPEEKLRPFVFAMGFIFILRASPEYYELQSGIRVKRYGCPNCWAVHFNFRGP

SEQ ID NO: 122533 - protein, 127 aa, Glycine max
  Coding DNA Sequence Number=SeqID_30848
MGEVEEIQEKMKPDMEAMKEQMATMMEVMMSMKKIMEANAVIVAATSAVAKVNPMPPSGLNQMNHQTSNMAHISQTMGETHEIPHHNLADFEPWLRYATEGQAVGGIPFENTLEGPQFLLDKWPQIS

SEQ ID NO: 122534 - protein, 82 aa, Glycine max
  Coding DNA Sequence Number=SeqID_30849
MRKVMRKRYVPVEAKLHGESKNNSRVQDKNQEEFKTQEEILESRIKIQGSRSQESRSRFNTQDSRIKRRLNQDKYENFFSKM

SEQ ID NO: 122535 - protein, 42 aa, Glycine max
  Coding DNA Sequence Number=SeqID_30850
VAILAYRGQLARCLATVSIGPPSSRMRGESVALDAILPCKGI

SEQ ID NO: 122536 - protein, 217 aa, Glycine max
  Coding DNA Sequence Number=SeqID_30851
MGDQEETQEQMKADMSALKEQMASMMEAMLGMRQLMEKNVATAATVSSAAEADPTLLATAHHPPSNIVGRGRDTLGHNGNPHLGYNRAAYPYGLPPNYSPPVLQDDAGHIASPVLEREPPQQPDEVHKDPQDYARRDVEFYPPILEGPAPSTLPQPNITTQPIVLSTEGLPPATEERRKLDLLEERLRAVEGFGDYPFADMTDLCLVPDVVIPPKFK

SEQ ID NO: 122537 - protein, 52 aa, Glycine max
  Coding DNA Sequence Number=SeqID_30852
MLLDSTYFHSHYLEKPRSGCNSFKGCQQPALRQEGDAGLAGVSLAPTYPQLR

SEQ ID NO: 122538 - protein, 254 aa, Glycine max
  Coding DNA Sequence Number=SeqID_30853
LHALSFRGPTRPRLQRATCPRLQRATRLAFKGLHVLAFKGLHVLAFRGLHVLTFRGLHFLAFRGLHFLTFRGPHVLAFRGYTSSPLEATHPRLQRTTRPRLQRTTCPRLQRATRPRFLRALHLHLQRTQGPPPLMLNRGLCSWVRGIVPARHPVDSKKSNRVLGFPALITSLCQFYRVSITPSKVIRPPTNRAFIKKYCAPRQAQGETPQQPRDGRQRATDAPPPPPEPLSSSTKAGALPMTRGQLASDQVQSQ

SEQ ID NO: 122539 - protein, 116 aa, Glycine max
  Coding DNA Sequence Number=SeqID_30854
MVWYRRKTKMFVDPENAKTATLGEVAEALQYMVSPQGRKTCTFDDLVPYVEKITILSEEQERVTEPVSHGPASERQFPAQQFHMLQSSIETQGIARRRDTVEAEEYSQQMVERGHG

SEQ ID NO: 122540 - protein, 70 aa, Glycine max
  Coding DNA Sequence Number=SeqID_30855
MDHQQQGAQHPRGANHPTVMTHPRGANHLIVMTHPKGVNHPIVRIHPKGARSEDVNQRDMTLGNSHNQLL

SEQ ID NO: 122541 - protein, 117 aa, Glycine max
  Coding DNA Sequence Number=SeqID_30856
NNRHENTKKAPLIQLVRNHVTSWEDAQEMGFQTLPYSNIPNTTNIYVFILFTCVEGRSLEFQEPMDLRSNPFQGVGNDAILPPPKALDRRLQEDWARDAKEDPRVLMSLRVDFEPMS

SEQ ID NO: 122542 - protein, 69 aa, Glycine max
  Coding DNA Sequence Number=SeqID_30857
  Homolog annotation: Hit_ID=A5C3T2; Match level="QueryCoverage=100%, HitCoverage=7%, E-value=1e-19, Identity=68%"; Hit description =Putative uncharacterized protein
MNLTSQTVSFSDIQCNVLELKGDNYKIWKERILLQLGWMDIDYAIRKDEPLAITDESSPTDVALYERWE

SEQ ID NO: 122543 - protein, 64 aa, Glycine max
  Coding DNA Sequence Number=SeqID_30858
MYDFEEVFMLYVEWEVWIKDPEHGDIPCNLVRPQEKLWDDQCHQIKQIIDLWIWVLRWFFRETQ

SEQ ID NO: 122544 - protein, 94 aa, Glycine max
  Coding DNA Sequence Number=SeqID_30859
MTTFKVPNETLTILRKFGNLLEAPNTLPMKGLFVTKLESNEVLLSPIDLKVVGPLLLDSNSSRDGTNRPFQFPIWQLPKKETKRQAITKDQKMK

SEQ ID NO: 122545 - protein, 214 aa, Glycine max
  Coding DNA Sequence Number=SeqID_30860
MVGWWVNCPFFKTYLKVTSTGISQPLSGCVDGIIDPPSPVRRHDSFEEQASQGSFVPHRRQDVLTIAIGCPEHPGRVHVAGAGVTIMKYFRSAPRMSRNSSSLPLEELHQLTQQIRDQLEELITEKVTRQLMTSFSQMQSHFRSQMQSQGLALPPEPLVGSSGPRVSTIESCVDPSGNDPETGDSDRCGLYIEAKVGVEEVKDPDVPVPVSTDE

SEQ ID NO: 122546 - protein, 274 aa, Glycine max
  Coding DNA Sequence Number=SeqID_30861
  Homolog annotation: Hit_ID=Q6WAY6; Match level="QueryCoverage=91%, HitCoverage=45%, E-value=2e-34, Identity=35%"; Hit description =Putative uncharacterized protein
MAEVSTEAIASLVQYYDQLLRCFTFGDSQLSPTVEEFEEILGCPLGERKPYLFSGFYPSLARIFKIVQILTQELDHRKQVENGVVGVPRKCLEAKARVLAGKGEWALFIDILALLIFGGVLFPNMDGLVDQAAIDAFLAFHDRKESPVVAILADLYDTFDRRCEKNSTRIVCCTPALYATANAQKKEASWDRLLASKEGASINWFPRWKEGRIEILISCGGFPNVPLMGTRGCINYNPVLTIRQLGYPMRGAPLEEDLTLIIARGFNGTNAEAL

SEQ ID NO: 122547 - protein, 142 aa, Glycine max
  Coding DNA Sequence Number=SeqID_30862
MGEVEEVQKQMKADMEAMKEQMATMMEAMMSMKKIMKANAVAVATSSAVAKVNPMPPSGLNQMNHPTSAMVGKDLGSTRSPYYVQIQNKHAFLPYGLPPKYTPANVAYTPSEDVNNFAPILIESRQAQTDSCTCLSTNGGDT

SEQ ID NO: 122548 - protein, 72 aa, Glycine max
  Coding DNA Sequence Number=SeqID_30863
MPIGCTSQKSGADIEEEELTDLRTNPLQGGGDDAILPRKGPVTRAMSKRLQEDWARAAEEGLRVLMNLRIGL

SEQ ID NO: 122549 - protein, 135 aa, Glycine max
  Coding DNA Sequence Number=SeqID_30864
  Homolog annotation: Hit_ID=A2Q186; Match level="QueryCoverage=45%, HitCoverage=15%, E-value=2e-07, Identity=37%"; Hit description =Reverse transcriptase-beet retrotransposon, putative
MSAYEHNDTAPQDVETSPLLFDQPSTLSSKSTLPLSGRRRRILHERGRRSLLRYIQKEFYQGGIIDGSWTNNPHKVKEEVKSFFFHRFQEPIGQRPKIDGIRFQTVNQQQNNELVAPFMDEEIRRQFLKLRRSFL

SEQ ID NO: 122550 - protein, 82 aa, Glycine max
  Coding DNA Sequence Number=SeqID_30865
  Subcellular localization annotation: CTP_CleavageSite=59; ConfidenceScore=5.27e-01
LSSLVTDVWGANTFPVRKYNSQTFHLKFVDYVFSSFSDVPSNKRWWRLRAHSFLGRCTRESHVALPPKGGLRQLATPLGTVF

SEQ ID NO: 122551 - protein, 121 aa, Glycine max
  Coding DNA Sequence Number=SeqID_30866
DIRELPNRWHVPFVLFQSSLHPAKSESEKPGRFRAHGLSMSPLIFVNIRIGYEACLWGFYGGWIFELQWGPLMVIFHHGDAAKDKGKELGEDASMEEKKEEEKERGGSTKLKEEKGREVEL

SEQ ID NO: 122552 - protein, 407 aa, Glycine max
  Coding DNA Sequence Number=SeqID_30867
  Homolog annotation: Hit_ID=Q2HW90; Match level="QueryCoverage=52%, HitCoverage=40%, E-value=3e-23, Identity=34%"; Hit description =Putative uncharacterized protein
MASQEKWGPFTDILALLIFGVVLFPNVDGLVDLAAIDAFLAYHHSKESLVVAILADLFDTFDQRCEKNSARIVCCLPALCVWLVSHLFQPDIRHPCLLQSYRSCVEKRIVDWDRHLAGIGGSAINWFSRWKEGKEGVLFSCGDYPNVPLIRTRGCINYNPALAIRQLGYPMRGAPTEESRSPFLLRDLGAQSLKVIQRVHKAWRSPLRKDKELRGIRNGVIGGYHGWLRVHMRGLDWLSKWKVIDEENFEAPEEDEEVQALKLELGKARLAKEKFKSAATHIRRECTELREENATTARALEQETKRARKEEHGRGKFRGALWGSNNELKLRREERDRSWVHGMILKEELAASARSKRSLAQHLDAMEQSMLAIIGQYKEELNQSVTHEQKLVEDFAQLYAEKKQEGG

SEQ ID NO: 122553 - protein, 123 aa, Glycine max
  Coding DNA Sequence Number=SeqID_30868
  Gene Ontology: Mol. function=mannosyl-glycoprotein endo-beta-N -acetylglucosaminidase activity; Cellular component=intracellular; Biological process=metabolic process
  Homolog annotation: Hit_ID=A7Q3P1; Match level="QueryCoverage=87%, HitCoverage=14%, E-value=7e-43, Identity=74%"; Hit description =Chromosome chr13 scaffold_48, whole genome shotgun sequence
  Pfam annotation: Domain name=Glyco_hydro_85; Domain location=1-123; Score=-42.2; E_value=5.2e-09; Accession=PF03644.4; Description =Glycosyl hydrolase family 85
MEVSLKPEQISNLKEFVNHLSLTTHSSVPGSQVIWYDSVTINGDLWWQNELNEHNKPFFDICDGIFTNYSWQEDYPRRSAAVAGDRKFDVYMGIDVFGRNTYGGGMWNILQKCMQSVLQSASF

SEQ ID NO: 122554 - protein, 122 aa, Glycine max
  Coding DNA Sequence Number=SeqID_30869
  Subcellular localization annotation: CTP_CleavageSite=27; ConfidenceScore=5.18e-01
MLLSSNVIYICVRVVMLVRMVRTLLFAAARVKSCPSMHSSCVIASLSGCARTVGPSPISGGGPGTVKMRTRSPLKARACSPLKFRTCRLSTARECSPMMARTCNPLKVRACPPLKMGNHVVL

SEQ ID NO: 122555 - protein, 83 aa, Glycine max
  Coding DNA Sequence Number=SeqID_30870
GSATVHDIPLCHDQVKVALEEVTDADAPIPVPTEEVQLVGQTLNTFVAWETHLVMWDVAVFGVFNDNLHLYIKHEDLFEIAHG

SEQ ID NO: 122556 - protein, 46 aa, Glycine max
  Coding DNA Sequence Number=SeqID_30871
GNTGSNKDRRKSLKVYQSHTGARFMVSWDFGSRLVERMDMIYVRAL

SEQ ID NO: 122557 - protein, 81 aa, Glycine max
  Coding DNA Sequence Number=SeqID_30872
MKAQVEKDEGPEAEALSRQLMLLKAQTNLKAQTYQGNPCGVYPDLSSFTGSGVYRDLSSFTGSGVYPDLSSFIGSGVIQTL

SEQ ID NO: 122558 - protein, 172 aa, Glycine max
  Coding DNA Sequence Number=SeqID_30873
MLDALKYKVQHLMEMLDIGNAFPLKSEFAQCENRQLRGTRRDLGARGSTQWELCPLLHHKVGSMKSGSEGKDILVSCPSSMPYAEAAEESAASQKPGHPSAAKPVPFPYQSSHAVPWRYTPPRGKEEEVTDVSSLSAKVTNIMGLSGVTCSGRVFAPPDLPVQPADVKGKGK

SEQ ID NO: 122559 - protein, 174 aa, Glycine max
  Coding DNA Sequence Number=SeqID_30874
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=97%, HitCoverage=51%, E-value=6e-32, Identity=74%"; Hit description=DNA -directed RNA polymerase subunit beta
  Pfam annotation: Domain name=RNA_pol_Rpb2_7; Domain location=125-173; Score=50.3; E_value=6.8e-12; Accession=PF04560.11; Description=RNA polymerase Rpb2, domain 7
MNTIWVATGILGHVIEDIQEEQTGSSPIPSRISYDCMGTASLIPFIEHNDANRALMSSNMQRQAVPLSQSEDNALLELDWNAKLYFRSGFPCKGNFINYYRRYRVICGHYALVTQQPLRGRAKQGGQRVGEMEVWALEGFGVAHILQEMLTYKSDHIKTRQEVLGTTIIGGTIP

SEQ ID NO: 122560 - protein, 305 aa, Glycine max
  Coding DNA Sequence Number=SeqID_30875
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMGGRQGNSYRGPGVGTIWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 122561 - protein, 83 aa, Glycine max
  Coding DNA Sequence Number=SeqID_30876
MDLFRFRKMININACRLISQKSMELAGLLPLRFNSFWGRDDAILPRKGPVTRATRAMSKRLQEDSTRAAKEGLRVLMNLRVDF

SEQ ID NO: 122562 - protein, 36 aa, Glycine max
  Coding DNA Sequence Number=SeqID_30877
MDTSVPYIGAMKGTMHKPQANLGTDHKFSPNRFPAT

SEQ ID NO: 122563 - protein, 194 aa, Glycine max
  Coding DNA Sequence Number=SeqID_30878
MSFIVGQALHTFLAWPTHLVVVFSAKPPPKPDPEVDDPLYLMTLTIPELFLRPYQVTWDATVFEVFNPDFLLYIKHEDLLEIAHGGQCLAYQHLTDTSMQAGNSDIYGFLEPQSIQRSGQSQFESESYIKTWMQSSKCDVYLGAYLNGSNNYLKGITNSLNQRLLLGGLSSSVIDKKEVLSAATMSCTGCPPSF

SEQ ID NO: 122564 - protein, 49 aa, Glycine max
  Coding DNA Sequence Number=SeqID_30879
MMQSYPARALARRLQVDWARDPRKGPRVLMSLRLSSSFSSQGGELSYYR

SEQ ID NO: 122565 - protein, 214 aa, Glycine max
  Coding DNA Sequence Number=SeqID_30880
  Gene Ontology: Mol. function=NAD+ synthase (glutamine-hydrolyzing) activity; Biological process=NAD biosynthetic process
  Homolog annotation: Hit_ID=A4W9K3; Match level="QueryCoverage=99%, HitCoverage=77%, E-value=1e-111, Identity=91%"; Hit description =NH(3)-dependent NAD(+) synthetase
  Pfam annotation: Domain name=NAD_synthase; Domain location=1-204; Score=294.7; E_value=1.8e-85; Accession=PF02540.8; Description=NAD synthase
MAIDELRAESGDRSLQFIAVRLPYGIQADEQDCQDAIEFIQPDRVLTVNIKGAVLASEQALREAGIELSDFVRGNEKARERMKAQYSIAGMTKGVVVGTDHAAEAITGFFTKYGDGGTDINPIFRLNKRQGKQLLAQLGCPEHLYMKQPTADLEDDRPSLPDEVALGVTYENIDDYLEGKTLDENIAKTIEGWYLKTEHKRRPPITVFDDFWKK

SEQ ID NO: 122566 - protein, 98 aa, Glycine max
  Coding DNA Sequence Number=SeqID_30881
  Subcellular localization annotation: CTP_CleavageSite=21; ConfidenceScore=5.09e-01
MDNGSSLNIMPKATLDKLPFNASHLRSSSMVVQSFNDSHRDKLKFMVEGQLIIVSGEEDILESCPSSTPYVEAAKESLETSFQGLDVVSNAYVESPPV

SEQ ID NO: 122567 - protein, 49 aa, Glycine max
  Coding DNA Sequence Number=SeqID_30882
MEVVAAQRLLEEDCRAYPCTNKGRRVLRSTGEKDIEVFEVKTLLSSKCK

SEQ ID NO: 122568 - protein, 36 aa, Glycine max
  Coding DNA Sequence Number=SeqID_30883
MAVSKLRMMQRFWEYSRRRRMGFFRSYLDYKAQNAL

SEQ ID NO: 122569 - protein, 145 aa, Glycine max
  Coding DNA Sequence Number=SeqID_30884
DGVEGATKVRAKEGAADVEGASPGLALALLAPLIAKLMIELKRSKTRLSEATPLDLHSVEAKLHDESRLIQRCFDDNKDDDKGDDKKLKGQSKNEFKMFKIESRTLQDPRGKLKNTSRFKRKVDFKNQESSFQESRSRFKNQEKA

SEQ ID NO: 122570 - protein, 82 aa, Glycine max
  Coding DNA Sequence Number=SeqID_30885
MAMGNFISRLSFPEAAGPMTRRDKIWSFCTLVSSRGGGPDDTRRYLTVIRTLLSSRGGGPDDTQRQNLVILHPCVIQRPELR

SEQ ID NO: 122571 - protein, 89 aa, Glycine max
  Coding DNA Sequence Number=SeqID_30886
MEGSLLQLVPCSSNGSLSCCEGCPKAIYKAYPVKLTNLIVEISLFLYFRNMSVRLVLMDPIESTEHKKGSSHLLIEIFIPSDIYFHIEN

SEQ ID NO: 122572 - protein, 134 aa, Glycine max
  Coding DNA Sequence Number=SeqID_30887
MMRIMKLAKYRLKTQVEKDEGPSGEGQSPQVEKDEGPEAETLSRLLITYQGNPCGVYPDLSSFTGSGVYPDLSSFTGSGVYPDLSSFIGSGVYPDLSSFTGSGVYPDLSSFTGSGVIQTFVTCIKRSTPYGSHH

SEQ ID NO: 122573 - protein, 257 aa, Glycine max
  Coding DNA Sequence Number=SeqID_30888
  Subcellular localization annotation: CTP_CleavageSite=37; ConfidenceScore=5.47e-01
MPKVKRFRNPQKSAPQPQCPSPSDSTQAPEVPTGNVPLSHESTSEVPAMNPEISSPPSDSTQAPEVPTGNVPLSHVSTSEDPQEDETTRRHVGRESTHCWTVEAIDSEETIKKIKVKVRGVNSLPRELRIIVNFDDQGQAIGEAQALLAGFLGTLAADCKLFPMDYDRWSGSSGVPKAYFDDCFETILKINEAGAKWYYKLSMRRKWATNRQSLWNEFNDPTKTRDEIIKNVPIGIDKDQWARFVHYRHKPSTLLII

SEQ ID NO: 122574 - protein, 88 aa, Glycine max
  Coding DNA Sequence Number=SeqID_30889
  Homolog annotation: Hit_ID=UPI0000ECBAF8; Match level="QueryCoverage =48%, HitCoverage=50%, E-value=1e-17, Identity=100%"; Hit description= UPI0000ECBAF8 related cluster
  Subcellular localization annotation: CTP_CleavageSite=21; ConfidenceScore=5.16e-01
MKHFTDTLISANIPGGSTSSRAAATAGGAPIRPIVSRITIHWPSFYNVVTGKTLALPNLIALQHIPLSPAGVIAKRPAPIALPNSCAA

SEQ ID NO: 122575 - protein, 172 aa, Glycine max
  Coding DNA Sequence Number=SeqID_30890
  Gene Ontology: Cellular component=integral to membrane
  Homolog annotation: Hit_ID=Q2HUS3; Match level="QueryCoverage=34%, HitCoverage=13%, E-value=1e-22, Identity=86%"; Hit description=Amino acid/polyamine transporter II
DAGSRQARQGASAGVGGCRGWLNYAASEQIVLRVHHMRAIGAGLFAITPAGERGMCCKAIKLGNARVFPVTTLSTLEDPPIAAAPFYTGTLIKRCMDKNSNIRTYPDIGELAFGKTGRLIVSVSMYTELYLVSIGFLILEVGKPVVPAALMNRPTRGERRFAYWALFRFLAH

SEQ ID NO: 122576 - protein, 88 aa, Glycine max
  Coding DNA Sequence Number=SeqID_30891
MSKKNQTRPLQRINICFKIASTNKALFQDSLQIKPCLKTKGFKVMQGSGNRLPEGKNEKELLKKVLNLNFEHVIDYHMSVIDYQQRNS

SEQ ID NO: 122577 - protein, 97 aa, Glycine max
  Coding DNA Sequence Number=SeqID_30892
MAHFIPFQQGRKLGCFPAASQKLFIPREVVRLYTVSLHGPLCQEEMLSSLATSGKPYGLKIGTNFLFSTTSKKKLTRVKNFMVPPSTTPPMIKSFMP

SEQ ID NO: 122578 - protein, 160 aa, Glycine max
  Coding DNA Sequence Number=SeqID_30893
SGGPGLPHQIMLFRSLALGPVAVYYRPERVVRQFGYTQTIPAPPIDSWVSYDNIHNRWMHYEDHIVPAGEVCVVSGACFSDYIDWFFRISHPFMTPGHTLDPLPHGHAPQPRVVPQAPQTDIPHVPEPGASSTSAEEPRHAVEVCDDIAKRSECHLSLGV

SEQ ID NO: 122579 - protein, 160 aa, Glycine max
  Coding DNA Sequence Number=SeqID_30894
  Homolog annotation: Hit_ID=B0HC01; Match level="QueryCoverage=20%, HitCoverage=70%, E-value=4e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTRSRSFILNEVIPHGVVVLKDPATKRTETVNGSRIKHYLGGDVERLTTIVQL

SEQ ID NO: 122580 - protein, 167 aa, Glycine max
  Coding DNA Sequence Number=SeqID_30895
  Homolog annotation: Hit_ID=A0ST23; Match level="QueryCoverage=26%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPRVHVDPTIGKVDSPHSKKLRTYLEIVAYYKVDVMGTELEFVIMVIAVSFGKPVVPAALMNRPTRGERRFAYWALFRFLAH

SEQ ID NO: 122581 - protein, 221 aa, Glycine max
  Coding DNA Sequence Number=SeqID_30896
MIMRGQDIYISQDEATTSPSSSESEEAKGEESSEEIYPQEEGQPLVVKEKCKEVSVSSKNLAKKETHFTIKTNIKETFPLRQPPHFLFCKKTLASIATPLGLKFIPQVKKLLDEGLVRKSLNLCALLVPKIGIIRHQVPKIGGMMNVLSAAILFCKITRTPNISCDQGVPMNPKRIKVIPEWLTPPSVEGRNPEYEEPRDLRSNHFQGGGNDAILPRKGIG

SEQ ID NO: 122582 - protein, 79 aa, Glycine max
  Coding DNA Sequence Number=SeqID_30897
MVFFLSYTKAKAENAQVRNGLGHGNIAHTQDIFSKIPTVRSWTSVLRSCRPNFEKIQRLTKAGKHFYRGSSCSFLKKLH

SEQ ID NO: 122583 - protein, 153 aa, Glycine max
  Coding DNA Sequence Number=SeqID_30898
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTFACGWWCWVFDAVLVVGGTELEFVIMVIAVSFGKPVVPAALMNRPTRGERRFAYWALFRFLAH

SEQ ID NO: 122584 - protein, 35 aa, Glycine max
  Coding DNA Sequence Number=SeqID_30899
MEYFNDPRPLELERLKALRIRGHSIISELVIRPSI

SEQ ID NO: 122585 - protein, 117 aa, Glycine max
  Coding DNA Sequence Number=SeqID_30900
FDGLQTYVGERFDALEQQVDMRFNAMDSRITKVEEDVTIIRDCLDLPPPPPSDCHHQKGGDCGSCHTLISSGDHPLLGCDPRLTTLRNLAPIVRQFVKFRDMPEVKRKHCSTIREVP

SEQ ID NO: 122586 - protein, 124 aa, Glycine max
  Coding DNA Sequence Number=SeqID_30901
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=96%, HitCoverage=26%, E-value=4e-50, Identity=64%"; Hit description=DNA -directed RNA polymerase subunit beta'
  Pfam annotation: Domain name=RNA_pol_Rpb1_2; Domain location=13-91; Score=49.5; E_value=1.1e-11; Accession=PF00623.11; Description=RNA polymerase Rpb1, domain 2
VDSRGSPRETLLGKRVDYSGRSVIVVGIAKSKIREKEPIVWEILQEVMQGHPVLLNRAPTLHRLDFDGDQMAVHVPLSLEAQAEARLLMFSHTNLLSPAIGDPISVPTQDMLIGLYILTSGNRR

SEQ ID NO: 122587 - protein, 85 aa, Glycine max
  Coding DNA Sequence Number=SeqID_30902
  Subcellular localization annotation: CTP_CleavageSite=29; ConfidenceScore=5.01e-01
MDAFSPSSDLFSTLLELFLQGCHNALVEQASHVSRSTPSFPSCVIGHERSGSASHELSRMFVNIDGSVLFLAGTNSVMVVLPADL

SEQ ID NO: 122588 - protein, 177 aa, Glycine max
  Coding DNA Sequence Number=SeqID_30903
MTTLTQIWMTFLLSSILLSDHNSDLTLPKSQLVYSIMTQISVHVAQLILDFIHQFVGIAPPRNPVDPENSNKALGFPILITGLCQFYRVTVTPMKLIRPPINRSFIEKYCMPRQDPNPYPWPTPEQFRATVAWPGDRPNFQEKAGPVDAQGAAQGDEGGAEDDGDMADLLDYFIRGD

SEQ ID NO: 122589 - protein, 212 aa, Glycine max
  Coding DNA Sequence Number=SeqID_30904
MGKAEEVQEKVKADMEAMKEKMAAMMEAMISVNKIMEANAVAIAATSVVAKVNPTSPSGINQMNHPTSDMVGKDLGSTGGPHDVQIQNEHAFSPYGLPLNYTPPNVAYTPNKNVNNSTPIPIGSQQPQTDHAHGKQLVVYPYKTLWKALSITHNYTSCIPQTSKNPHAMAEMGKLDHLKERLRAIEGGEDYAFANLEELFLVLNIITPPKFK

SEQ ID NO: 122590 - protein, 37 aa, Glycine max
  Coding DNA Sequence Number=SeqID_30905
MAFFPLRSQPPGDPSVHRIICIGHVYDNRFVQLYTMS

SEQ ID NO: 122591 - protein, 115 aa, Glycine max
  Coding DNA Sequence Number=SeqID_30906
  Homolog annotation: Hit_ID=A5BUS6; Match level="QueryCoverage=100%, HitCoverage=8%, E-value=2e-09, Identity=31%"; Hit description =Putative uncharacterized protein
MATSQDGNGCVLPLAFAVVEGYTPYKHTFDQNLEKFHQLSPVIATRIDKEGHRYGHMTINLSECVNKVLKDCRNIPITTLVKSTYSRCRKYFVDRGRQAQRQLNEGQVYCSKVVK

SEQ ID NO: 122592 - protein, 115 aa, Glycine max
  Coding DNA Sequence Number=SeqID_30907
MKSLEAHLLIACSGYGTLCVAIVVRSLVKESTPFLLFLWRWSALRELGRPSKEDPEEDPEELPPEPVVDALDFLERDEDPLPEEDSPEDVMSASEADSMEESGPREMATSGGSSS

SEQ ID NO: 122593 - protein, 73 aa, Glycine max
  Coding DNA Sequence Number=SeqID_30908
MEAMKEQMTTMMEAMMSMRKMMEVSTTTVIAISTTTEVDPTHPPGLNQVNRPVSDMVGQGGEALGSTGDPHFV

SEQ ID NO: 122594 - protein, 256 aa, Glycine max
  Coding DNA Sequence Number=SeqID_30909
  Homolog annotation: Hit_ID=Q6WAY4; Match level="QueryCoverage=49%, HitCoverage=22%, E-value=2e-10, Identity=32%"; Hit description =Putative uncharacterized protein
MVPTIEEFEEILGCPLGGRKPYLFSGFLPSLSKIATVVRDSAKELDRTKQTRNGVVGLPRKYLEGKARDMESQEKWGLFADILALLIFGVVLFPNVDGLVDLAAIDAFLAYHHSKESPVVAILADLFDTFDRRGCINYNPALAIRQLGYPMRGAPAEGSLSPFLVKDLGAQGLKVIQRIHKAWRSPLRKDKELRGIRNGVIGGYHGWLRIHTRGLDWLSKLKVINEENFEVPEEDEEVQDLKLELGKARLAKEKFK

SEQ ID NO: 122595 - protein, 164 aa, Glycine max
  Coding DNA Sequence Number=SeqID_30910
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPDDCPYP

SEQ ID NO: 122596 - protein, 25 aa, Glycine max
  Coding DNA Sequence Number=SeqID_30911
MGTDREKTIADVNLSRSGSFDTGYG

SEQ ID NO: 122597 - protein, 104 aa, Glycine max
  Coding DNA Sequence Number=SeqID_30912
MYIKYGPKYIMKHSKQNKLSNEQKPPTLIPKTIPKLQNSLRIWKGKQGSKGLSKELIQGKSIWLEAYKNKIALIISKYACELGRINKNQAKAIVQAINGAKHTK

SEQ ID NO: 122598 - protein, 63 aa, Glycine max
  Coding DNA Sequence Number=SeqID_30913
MSSTRTEILVWNKKGKSSFDSDFQITGLWQPSVHSDVAFDPSMSALPIIVKQSSPSVGLFTHQ

SEQ ID NO: 122599 - protein, 364 aa, Glycine max
  Coding DNA Sequence Number=SeqID_30914
  Homolog annotation: Hit_ID=A5AZ88; Match level="QueryCoverage=30%, HitCoverage=13%, E-value=7e-13, Identity=33%"; Hit description =Putative uncharacterized protein
LCPFHAATGAIEQPEAYAANIYNRPPQPQQQNQPQQNNYDLSSNRYNPGWRNHLNLRWSSPQQQQHQPAPSFQNAAGPSRSYIPPPIQQQQQPQKQPTVEAPPQPSLEELVRQMTMQNMEFQQETRASIQSLTNQGKQCQGPQPVAPSSSAIEPAKLQSTPVKGDDKNLPNNFCAGESSTGHSDLQKQHIPLPFPPRAVPNKKLEEAEKEILETFRKRNSKFDNAMLDLGASVSVMPLSIFNSLSLGPLQSTDVDGFSQGSVPIILGRPFMKTARTKIDVYAGTLSMEFGDITVHFNILDAMKYPSEDLSIFRAEIIDHVVDEYMTDLYSNLHASHSSCIESEIVLDHMSEFDAESESESDIDC

SEQ ID NO: 122600 - protein, 157 aa, Glycine max
  Coding DNA Sequence Number=SeqID_30915
  Pfam annotation: Domain name=Transposase_23; Domain location=41-108; Score=-5.2; E_value=0.0044; Accession=PF03017.5; Description =TNP1ENSPM transposase
MSNHRDLALPPEPELGPSATCISTNGSCVDPSATDPDTGDSNKSGLYIEENPSRLVALGRVYEGSTTIHNIPLLHGQMKVGVKEVKDAEAHVPVPTNEVILVGQALNTFLSWPTHLVKRLSEQAAVPTKPPDRPDHEVDDPLYLMSLTIPQIFLKPF

SEQ ID NO: 122601 - protein, 329 aa, Glycine max
  Coding DNA Sequence Number=SeqID_30916
  Homolog annotation: Hit_ID=Q6WAY6; Match level="QueryCoverage=89%, HitCoverage=59%, E-value=1e-17, Identity=25%"; Hit description =Putative uncharacterized protein
KHLEEKAKALADEGEWASFIDVSALLVFGVVLFPNVDGLVDLATIDAFLAYHHSKESPVVPVLANAYDTFDRRCEKSGARIVCYTPALYVWLGFSNVPLMGTRGSINYNPVLAIRELGYPMRGAPSEEIITHFIARGFSDPNARILQGVHKAWGTMQIKDKELRGSNNGIVGGYHKWLKAWTQELDWVPKLKTSNEEEAETPEESEEVQALKVKLERAQAVKEKFKTMTIKRDQPSVEGMILEIKLKAYQRSKRSLSEQLSKTEENMWAIIDQYKEKLSLAATYEQRIEGEYAKVRFRLKWESRASKTASQGQGDGGRVLSPRGSSWAL

SEQ ID NO: 122602 - protein, 198 aa, Glycine max
  Coding DNA Sequence Number=SeqID_30917
  Pfam annotation: Domain name=Transposase_23; Domain location=35-103; Score=-6.8; E_value=0.0067; Accession=PF03017.5; Description =TNP1ENSPM transposase
MASISQLQSQMQSQGLAVPPEPLVGPLVFKNDPETSDSDRCGLYIEEDPARLVAMGRVYEGSTVVHNTPLLLGQVNVSVEEVADAPVPVPTDEVSLVGQALHTFLTWPTHLVKSLSQQVAVSPVKPPLKPDPEVDDPLYLMTLTIPELFLRPYQVRWDATMFGVFNPDFPLYIKHEDLSEIAHGGQCLSISVLQLWIL

SEQ ID NO: 122603 - protein, 94 aa, Glycine max
  Coding DNA Sequence Number=SeqID_30918
  Subcellular localization annotation: CTP_CleavageSite=85; ConfidenceScore=5.66e-01
MASIIVAICSFMASMSAFIFSCTSSTSPITLALAQVKLEVTRISTILNVFGNRRSNDVTRSIYCPNFCKMVTSILQLDSMNLFVKARAWFNPIT

SEQ ID NO: 122604 - protein, 162 aa, Glycine max
  Coding DNA Sequence Number=SeqID_30919
  Homolog annotation: Hit_ID=Q6WAY4; Match level="QueryCoverage=91%, HitCoverage=26%, E-value=2e-14, Identity=32%"; Hit description =Putative uncharacterized protein
MVEVSTEAIASLAQYYDQLLRCFSFGDFQLSPMVEEFEEILGCPLGGRKPYLFLGFYPSLAKISKIVQISAQELDRQKQVENGVVGIPRKCLEAKARILVGKGEWALFIDILALLIFGGVLFPNVDGLVDLAAIDAFLAYHDHKESPVVAMLADLYDIFDRR

SEQ ID NO: 122605 - protein, 80 aa, Glycine max
  Coding DNA Sequence Number=SeqID_30920
VSMNPKRIKVIPEWPTPPSVEGRSPKYEEPRDLRSNPFQALASHLKEVSLPIRELLLLKEVFSKKLLKEVFSRKLLKEAT

SEQ ID NO: 122606 - protein, 638 aa, Glycine max
  Coding DNA Sequence Number=SeqID_30921
  Gene Ontology: Mol. function=lysine decarboxylase activity; Cellular component=cytoplasm; Biological process=amino acid metabolic process
  Homolog annotation: Hit_ID=A4W6T1; Match level="QueryCoverage=77%, HitCoverage=69%, E-value=0.0, Identity=93%"; Hit description=L -lysine decarboxylase
  Pfam annotation: Domain name=Glyoxalase; Domain location=515-635; Score=115.3; E_value=1.8e-31; Accession=PF00903.16; Description =GlyoxalaseBleomycin resistance proteinDioxygenase superfamily
  Pfam annotation: Domain name=OKR_DC_1; Domain location=1-348; Score =591.5; E_value=8e-175; Accession=PF01276.11; Description=OrnLysArg decarboxylase, major domain
  Pfam annotation: Domain name=OKR_DC_1_C; Domain location=356-490; Score=285.3; E_value=1.2e-82; Accession=PF03711.6; Description =OrnLysArg decarboxylase, C-terminal domain
  Pfam module annotation: Pfam domain module=Glyoxalase::OKR_DC_1::OKR _DC_1_C; Domain location=515-635::1-348::356-490
MVTNGTSTSNKIVGMYAAPAGSTLLIDRNCHKSLAHLLMMSDVVPLWLSPTRNALGILGGIPRREFTHDAIESKVAAIPGASWPVHAVITNSTYDGLLYNTDWIKKTLDVPSIHFDSAWVPYTNFHPIYAGKSGMSGERVPGKVFFETQSTHKMLAAFSQASLIHIKGEYDEETFNEAFMMHTTTSPSYPLVASIETAAAMLRGNPGKRLINRSVERALHFRKEVQRLKEEADGWFFDIWQPEEIDEAACWPVSPGEGWHGFRDADGDHMFLDPVKVTILTPGMDEQGRMSDEGIPAALVAKFLDERGVVVEKTGPYNLLFLFSIGIDKTRAMGLLRGLMEFKRAYDLNLRVKNMLPDLYAEDPDFYRNMRIQDLAQGIHRLIRQHDLPRLMLQAFDVLPEMKLTPHNAWQRQVKGEVETVELENLVGRVSANMILPYPPGVPLLMPGEMITEASRAVLDFLLMLCSVGRHYPGFETDIHGAKRDENGVTACQVRVFGCNVQASLKGEAMLGLKQVHHIAIIATDYAKSKAFYCDILGFTLMSEAYREERDSWKGDLALNGQYVIELFSFPFPPARPSRPEACGLRHLAFSVDDLDNAVKHLEAHAVACEAIRVDPFTDKRFTFFNDPDGLPLELYQQ

SEQ ID NO: 122607 - protein, 94 aa, Glycine max
  Coding DNA Sequence Number=SeqID_30922
MWPKASAKDPGRSVHFALHEHTQHPTYERGPKQVPKTLEGQCTLPPTNIHNMHMPMHFQHQSTFHFHIILDINIISSQWRYQQQQQQQPHFIFI

SEQ ID NO: 122608 - protein, 122 aa, Glycine max
  Coding DNA Sequence Number=SeqID_30923
MASWKRNSIGSRPTTQYDTRRFSSLDVWTRYTDNVLGRNILPERKVEIYHSELDELKAELERRNFHKCLINLVDGSIDLALVNEFYANLYSSEDHPQKQSKVRGHLVMIDVDSLNAFLETLV

SEQ ID NO: 122609 - protein, 70 aa, Glycine max
  Coding DNA Sequence Number=SeqID_30924
MEACLWGFYGGWIFELQWGPLMVIFHHGDAAEDKGKELREDASMEEKKEGEKERGGSTKLKEEKGREVEL

SEQ ID NO: 122610 - protein, 194 aa, Glycine max
  Coding DNA Sequence Number=SeqID_30925
  Homolog annotation: Hit_ID=Q2HTA0; Match level="QueryCoverage=32%, HitCoverage=9%, E-value=9e-10, Identity=53%"; Hit description=IMP dehydrogenase/GMP reductase, related
  Pfam annotation: Domain name=DUF1723; Domain location=88-137; Score =42.6; E_value=1.4e-09; Accession=PF08330.1; Description=Protein of unknown function (DUF1723)
MVRTRGLGRALGRVIGRALGERIVMIQMMLPSGEGLPHRHEGHMTHQCLPSMLTMLLSAHGTERSAPEIEGLVAATRLSPLISCSIDTGNRGLISTFVERWHKETSSFHLLVGEVSITLDDLASLLHLPTVGAFHTFEPLHVDEVVLMLVELLEVYGEAARDETAQCHGPYIHLSWLRDIYQSRCQARHWNPAA

SEQ ID NO: 122611 - protein, 160 aa, Glycine max
  Coding DNA Sequence Number=SeqID_30926
MRTCFSKEIKLPTGQSNICFLDEKQCVYRGRRHFISKRPFRGNTGSNKDIRESLKVYQFHTDMSGPKTFLDVSSVFFRSLIENFLSFFAFSHSLIRGIFPFFVFFRGQGLTLSQWVKVYGKLGFWLKACRTTGHDICQGLASGSGIKGMSHIISMIRMQQ

SEQ ID NO: 122612 - protein, 269 aa, Glycine max
  Coding DNA Sequence Number=SeqID_30927
HPRFGGRRAVRDAAGGGAGGDGDLRVPAQPDRDADSQRGGAAVAGGHLRHHVPGRLLHQQPDADGADHRHRLRGGRRHRHDREHRPPHRRGRDAAAGRAQGRAADRFHDDLADLLADRGADPAAVHDRGGGAAVPRIRHHAGGVHPDFAGGVADADADDVRALAARRIRAETRALSPGHRRLHRPHHRRLRPHVAEGAAPPAADVAGGPGHFRADGAVVHPGSQGLFPAAGYRADPGHHAGAAVHFVHRHGRAPAGGGAAGAGGSGRAG

SEQ ID NO: 122613 - protein, 257 aa, Glycine max
  Coding DNA Sequence Number=SeqID_30928
  Homolog annotation: Hit_ID=A4F258; Match level="QueryCoverage=98%, HitCoverage=46%, E-value=6e-28, Identity=33%"; Hit description =Putative endo-b-1,4-glucanase
MFELANEPVEILGTNGAWGSTGNEHFAALKNFFQPLVNIIRNNGANNVCWIPGTGWQSHYQGYVNNQITGGNIGYAVHIYPGYWGGLNNYQSFQNAWNVNVKPIADIAPIAITETDWAPQGYGTFGIGNTGTAGGSGFGANLKYIVDQSGNVSWNVLAPDNLLHKGDPNAGTAYNNDWEACAAPVKQWFQQYASSNYPVANCNTNSSLVNNGIYEIEFQTDANKVVDLKSGEDANGAVLRPWTRNGAAAQRWVAIDA

SEQ ID NO: 122614 - protein, 107 aa, Glycine max
  Coding DNA Sequence Number=SeqID_30929
  Subcellular localization annotation: CTP_CleavageSite=26; ConfidenceScore=5.13e-01
MTLCQTIQSIWSNNLSSQTFPERDIQAMMVLMPGYSRRNRAGSVKRLLTKLSAKRLPFIFGRRLHSHGHNNHFPCMPVGVRSKRALMDFLDHVICLLGIHTSQSVMS

SEQ ID NO: 122615 - protein, 45 aa, Glycine max
  Coding DNA Sequence Number=SeqID_30930
MDPKRIKVIHEWPTPPSIREIWGFNILTNFYKRLVELLERSMSFK

SEQ ID NO: 122616 - protein, 68 aa, Glycine max
  Coding DNA Sequence Number=SeqID_30931
MVKARQKGGKRGRWLPPSSPRQVGLLPPEGTAFYWNTLEGLSGPDCATMLPFNFRHAAELHGLPNNGC

SEQ ID NO: 122617 - protein, 37 aa, Glycine max
  Coding DNA Sequence Number=SeqID_30932
MVAKHVARTIARRTNNAPTTLQSWAWYRMPFIAPRVP

SEQ ID NO: 122618 - protein, 65 aa, Glycine max
  Coding DNA Sequence Number=SeqID_30933
MCVGPRMRKENAESDLRTNPSQEVENDEDMTKSKGKDPLEGLGGPMTRARARKAKKLFTSVVHTI

SEQ ID NO: 122619 - protein, 84 aa, Glycine max
  Coding DNA Sequence Number=SeqID_30934
MANSTCFQQVSSQITIMKQKTSKTTHHISQNPIPTKIKGERSPPKPEISKSHTNGHQRLKLCWATMVDEEEGEKQREGEGERAV

SEQ ID NO: 122620 - protein, 136 aa, Glycine max
  Coding DNA Sequence Number=SeqID_30935
  Gene Ontology: Mol. function=nucleoside-triphosphatase activity; Cellular component=chloroplast
  Homolog annotation: Hit_ID=Q2PMM5; Match level="QueryCoverage=99%, HitCoverage=5%, E-value=7e-54, Identity=80%"; Hit description =Protein ycf2
MEREKQINNHLVPQDIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPIDLLEGGSHWRASSRN

SEQ ID NO: 122621 - protein, 169 aa, Glycine max
  Coding DNA Sequence Number=SeqID_30936
MASMMEAMLGMRQLMEKNVATAAAVSSAAEADPTLLATAHHPPLNAVGRGRNTLGHNSNPHLGYNRAAYPYGLPPNYMPPVMQDDAGHIFSPILEGEPPRQPDEVHEDHQEYAQRDVEFYPPIPVEGPAPNTLPQHNLTAQSIILSTEGPPPATEERRNLISSREIEGC

SEQ ID NO: 122622 - protein, 277 aa, Glycine max
  Coding DNA Sequence Number=SeqID_30937
MAMGDFISRLSFPGRRIVCHSKKAYAALIGWNICLFAKACLHFSGENTETFSSLTSYPELRRSEFLIGGYVGAKASLLSTTQLSVTMTQELASSGGDFFKSHKLSRTTGDGPNDTRRYLTVIRTLLSSRGGGPDDTRRQNLVIPHPFAIQTQSCPMARRDKNWSFCTLVSSRGGGIDDTRRHLTVIRTLVSSRGGGPDDIRRYLTVIRTLLSSRGGGPDDTRRHLTVIRTLVSSRGGGPDDTRRHLTIIHTLVSSRGGGPDDTRRHLTVIRTLVSSR

SEQ ID NO: 122623 - protein, 241 aa, Glycine max
  Coding DNA Sequence Number=SeqID_30938
MKREKHASYSSHNSCKSLSEELRDYYEGRHRSHLRPHSHRREKERKPQDANIKLSYFHGKDNVEANLDWEIRVEQQLKKKSTSKSYGSHSYPKKDQSQGILGVTPSKPKDDKGKTIEKQAPKASMQEKTSSINQDEATTSPSSSESEEAKEEESSEEIYPQEEGQPLMLKEECKEVSVSTKRLAKKERNFEIKTNIKEISPFRQPPHFLLCKKTLVSIVTPLGLEFIPQVKELLEVWFARA

SEQ ID NO: 122624 - protein, 93 aa, Glycine max
  Coding DNA Sequence Number=SeqID_30939
  Homolog annotation: Hit_ID=A5AL21; Match level="QueryCoverage=69%, HitCoverage=5%, E-value=6e-10, Identity=45%"; Hit description =Putative uncharacterized protein
MTSSNGNFPASIHVLIGKNYDDWCAQMKEAWDIQDKSYAGDSKLKKVKLQTLRRQYELLQMSDQESIDLGIIDKVLRTLTPRFDHIVVAIEQG

SEQ ID NO: 122625 - protein, 103 aa, Glycine max
  Coding DNA Sequence Number=SeqID_30940
MACEHRWIFNLHFTPLLEQQACKRPLLAARMHVWTLELTQALLGDPKPLMLPPLAAIHLPSCGFHMMILRRFDPPLQWHVLPVGPGFHGKHVAQPWYQFSCLR

SEQ ID NO: 122626 - protein, 132 aa, Glycine max
  Coding DNA Sequence Number=SeqID_30941
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=100%, E-value=5e-15, Identity=33%"; Hit description= UPI00006A17C9 related cluster
  Subcellular localization annotation: CTP_CleavageSite=41; ConfidenceScore=5.52e-01
MARMCSPLKVRACSPLMARTCSPPMARACSPLKARTCSPLKARTYSPLTVRTCSPLKVRACNPMKARTHSPLKVKVCSPMKARACCPLKVRMCSPLKVRACSPLKARTCSPLKVRTCSPLRVRVLVAKGPPL

SEQ ID NO: 122627 - protein, 83 aa, Glycine max
  Coding DNA Sequence Number=SeqID_30942
MVILRPLSFRSSKSRDKRVETNMVILHHLLFRSRATSRVINAQRQIMVILRPLSFRSNESSYKRLETNYGHFVPFVIQEQQVE

SEQ ID NO: 122628 - protein, 96 aa, Glycine max
  Coding DNA Sequence Number=SeqID_30943
EPWCLPTWMAKSYLHPDFLSVVSLVTIFQRNERGFEAFSPHGQDHLGLPSGVETKHERQKPIKVLKDGCKWGWGHDRPIVVPSLCETSRGCRCKAA

SEQ ID NO: 122629 - protein, 86 aa, Glycine max
  Coding DNA Sequence Number=SeqID_30944
GLSVHPSLSALSTIEESGRASISRLRAKREISALSAAVVFNHLSSFSIPLPVILKKQRTPLMKKIQGLQAPHGATSCGIKSIFVYV

SEQ ID NO: 122630 - protein, 197 aa, Glycine max
  Coding DNA Sequence Number=SeqID_30945
MERSMIDAASGGALGDMTPAEARNLIEKMASNSQQFNARNDAIILRGVHEVAMDSSSSTENKKLEGKLDALVNLVTQLAMNKKSAPVARVGGLCSSEDHHTDLCPSLQQFGINEQPEAYAANIYNSPLSSKTNNSKIIMIFQAINTIQNAAGPSKPYVPPPIQQQQQSQLRQQATEAPPQPSLEELVRQMTIQNMQF

SEQ ID NO: 122631 - protein, 112 aa, Glycine max
  Coding DNA Sequence Number=SeqID_30946
MEDPLLPAVKVSVDEVKDADAPVPVPTADVSLVGQALHTFLAWPTHLIKSLSHLGLQGLMISQPKPPPKAPDWRSMSSRHLTETCMRAGNSDIYGFLEPQSIQRSGQSQFES

SEQ ID NO: 122632 - protein, 387 aa, Glycine max
  Coding DNA Sequence Number=SeqID_30947
  Gene Ontology: Mol. function=helicase activity; Biological process =viral genome replication
  Homolog annotation: Hit_ID=A2Q378; Match level="QueryCoverage=98%, HitCoverage=26%, E-value=2e-96, Identity=41%"; Hit description =Putative uncharacterized protein
MDRLYFDGIAICSHVGFPNLFITFTCNPNWPEIHKLLTPLNLTPIDRPEIISRIFKLKYEQMLSYITKNHLLGKVVGYMYTVEFQKRGLPHVHLLLFLHANNKYPSPNDIDHIISTEIPSQKDDPELYKLVQNHMVHGPCGILRPASPCMKEGKCSRFYPKKFQATTIIDGDGYPVYRRRNTGRTITKNGYDRVTVVMVHDDNETVPHANTPNDEMKEYMDCRYISPCESTWRIFGFPIHGRKPSVERLQFHLPGQHSVLCQDHDDIDDLLSNPSISESKFIAWMNTNQVFLEGQKLTYFEFVTKFVYNQKQRCWQLRKKGYTIGRLQWVPPTTGELFYLRMMLTVCRGPISFEDIRKIDGVEYSTYREACFAMGFLQDDREFIAAI

SEQ ID NO: 122633 - protein, 206 aa, Glycine max
  Coding DNA Sequence Number=SeqID_30948
MARRKLSSKISRKDAASGTSAAPEFDSHRFRSAEHQQRFEAIKGWSFHRERRVQLRDDEYTDFQEEIARRRWTSLVTPMAKFDPDIVLEFTPMLGLQRRAYGTSDALSQFLGYPLVLEEGQECEYGQRRNRADGFDEEAIAQLLCIPSQDFARTAAGRWVRIMRTNMTTLTQTWMTLLLSNIQPIDHNSDLPLLKCQLVCRLPDTL

SEQ ID NO: 122634 - protein, 145 aa, Glycine max
  Coding DNA Sequence Number=SeqID_30949
  Pfam annotation: Domain name=Transposase_23; Domain location=45-111; Score=-15.0; E_value=0.052; Accession=PF03017.5; Description =TNP1ENSPM transposase
MQSQIQSQMQSQGLALPPEPLVGPSGPRVSTKGSCVDPSGNDLETGDSDRCYGLYIEANPAHLVALGRVYEGSTVVHNTPLLPGQVKVGVEEVKDADAPVPVPTDEVAVSPTKPPQKPNPEVDDPLYLMRSTIPELFLRPYQASD

SEQ ID NO: 122635 - protein, 89 aa, Glycine max
  Coding DNA Sequence Number=SeqID_30950
MAKELSISIRHNSLRQTMKPHNFSKEESWDMTSIIYLVAWYEICHLAKPIHHHKDRFYTSLGPRKPKDKVHTNIYPGCRWNGVYEVFPP

SEQ ID NO: 122636 - protein, 184 aa, Glycine max
  Coding DNA Sequence Number=SeqID_30951
MFSLADTVQLSQFCRSCICATFAKRLHMSLSDAWTRYTDNILGRNILPERKVEIYHYELDEFKAELERQNSHKRLTNLVDGSIDLALVKEFYANLYSSEDHPPKQSRVRGHLVKIDADSLNTFLETPVVLAEGETLPAYSRYCSLPIDYREIEAALCIPARGFILNSEGHPRKILRKDLTTLAQ

SEQ ID NO: 122637 - protein, 45 aa, Glycine max
  Coding DNA Sequence Number=SeqID_30952
PYTGTMRGTVHEPQANLGADQKFSPVDVFKQKKGGGQTLGFQWID

SEQ ID NO: 122638 - protein, 118 aa, Glycine max
  Coding DNA Sequence Number=SeqID_30953
  Gene Ontology: Mol. function=signal transducer activity; Cellular component=membrane; Biological process=signal transduction
  Homolog annotation: Hit_ID=Q7D1L0; Match level="QueryCoverage=100%, HitCoverage=15%, E-value=2e-58, Identity=98%"; Hit description =Methyl-accepting chemotaxis protein
MFNLKVKSLATKLILVTGCAITTVLVASNSFLISQTSERVHALTMDQANTEARAIANVIAADVGELGSAARSMAGVIGRAHQAKSMDRPGIVNILKANVEQNTFAFGSWFCEQLGLFD

SEQ ID NO: 122639 - protein, 150 aa, Glycine max
  Coding DNA Sequence Number=SeqID_30954
  Subcellular localization annotation: CTP_CleavageSite=19; ConfidenceScore=5.24e-01
MAPVVPRRDAVPPCAARPRAVTPQPGRGAAGRAGPPDCVRTGSDHPGTARARRIRRPRSRYRPIAKGRGGRATADGTRPCAGAGRASSNGSAALAACCCRRAWGAYGRSAAASAPAQPPRACSRGRAGRNTGCAAGCADGEGWRPVDLHP

SEQ ID NO: 122640 - protein, 155 aa, Glycine max
  Coding DNA Sequence Number=SeqID_30955
MAGTFFHLKQQNSLEIMSGTPQLVVSEEKLDPSEPVMVLLCECCVSLKLGSRFRGVTLSHTLCVFLPSCLEHGCVTDSQDCCVYGIGMAGRGRDQNRDVLDRITAVLETLVQERDVEPAEYRGLMAFRKNHPPKFSGDYDPEGARLWLAGDGEDF

SEQ ID NO: 122641 - protein, 75 aa, Glycine max
  Coding DNA Sequence Number=SeqID_30956
MDSFASWKMNGSGMERGRERGDAMMQAPLELVGLGSSSSMDSFASWKINGSGMEKEEREETPLQGEDESRRSSPP

SEQ ID NO: 122642 - protein, 153 aa, Glycine max
  Coding DNA Sequence Number=SeqID_30957
MESWGEYFGGCLERIFVPVFWFHLYGKTENNKQYPPLQRHAFVKWWSQFDTSKAAPEQVKNRFQSNPEFLKPADPETSLFLNQKSQLAAFLASSKSKESLAQNLKEVLQLLQQEEEEEPPKKEVESSANNDDQEDDPFYQNEDDCFGISLDDD

SEQ ID NO: 122643 - protein, 183 aa, Glycine max
  Coding DNA Sequence Number=SeqID_30958
GTNIGATLWQELFPEFEPKLRCGGAYVIQNVKVVDTHSDYKTTSVKEVDRPEIPPNVHAITSFADIISGVAKPDTLVNIVGVIVEVIERKTINPAYRVTVKLRDNSHVEIIMTVWEEYALQLDDAIEQNHFVQKLLVVMLTLAKIKEPKDKYPLSVQNIKHGSKLYVNGDIVEIQQFHDRYNE

SEQ ID NO: 122644 - protein, 177 aa, Glycine max
  Coding DNA Sequence Number=SeqID_30959
  Subcellular localization annotation: CTP_CleavageSite=90; ConfidenceScore=5.81e-01
FPYSDLFPTSTSSVTNLDSYFSLNPNLSPPSVSSISQTSQVSDTASVPLVPPGFSSLSTQSSSNTDSVPQNSTCAVSASVHPVNSEPTALASSFSKYISIPNSVPVNTHPMLHPSLFLTHFEPKTVKQALANADWLTVMRQEYNALLKNRTSDLNGSLEETIFMTQPPGFEVADKSL

SEQ ID NO: 122645 - protein, 76 aa, Glycine max
  Coding DNA Sequence Number=SeqID_30960
MAAEWRRKRERRRHFKEKMSLEEAHHHRRPWIRAWRKKEMNEGRGREEHKILCSKRALKSEPTNPRSIQGFSTKCA

SEQ ID NO: 122646 - protein, 58 aa, Glycine max
  Coding DNA Sequence Number=SeqID_30961
MSPDFMGQDDKGAEDDPLGYLRMSSDFTGHDSKRWGGQQKRGFCSYVSSICDEELRPT

SEQ ID NO: 122647 - protein, 19 aa, Glycine max
  Coding DNA Sequence Number=SeqID_30962
MGARDESIKHKIILSPGCG

SEQ ID NO: 122648 - protein, 148 aa, Glycine max
  Coding DNA Sequence Number=SeqID_30963
MHKALQSNAPLSYPHLITLFLQHLNVPLDYEPFVKVKRSFPISVNVVSSFEYRKERDGSWVKKDAPIQAIEDRSPSPPPQRDDSSSLMHNILDRLDGLHTFVNKHFNSLDSRIDAMDARFAGMDTRITKLEEDVSFVRQCFDLPLPSS

SEQ ID NO: 122649 - protein, 116 aa, Glycine max
  Coding DNA Sequence Number=SeqID_30964
MATDASGDRVTTDRSLPFPGAKQAENIAARQPSILCIHALGISFSAGRGSGVRVWPEEEPVRWVRRGGHRPVAMYTGAGFCLDCCRETGADHAHQHDHPDSDMDDFAAQQHPAQRP

SEQ ID NO: 122650 - protein, 266 aa, Glycine max
  Coding DNA Sequence Number=SeqID_30965
SWRADPSEERRRHLEQLFHARHLLARGHEDDDVVVGLDHGIGVGQDDFVLAHQGADAGALGQADLAHRPAHHLGIGAVAVGDRLQRLGHALAQAVHRRHVAAAHVAQQFAHGGLRRRHGDVDMAALHQFAIGLAVDQRDHLARAQPLGQQRRHDVVLVVAGQGQPGVHVLDVLAFQQRLVGAAAMQHQHAVGQLRGQVFAALEVALDDAHAVVFLGQRARQPQADIAAAGDHHAAHGLLGLAQLAHGAAGMARVHHQHHFVAGRDH

SEQ ID NO: 122651 - protein, 380 aa, Glycine max
  Coding DNA Sequence Number=SeqID_30966
  Gene Ontology: Mol. function=transcription factor activity; Cellular component=cytoplasm; Biological process=regulation of transcription, DNA-dependent
  Homolog annotation: Hit_ID=Q8KNM0; Match level="QueryCoverage=44%, HitCoverage=58%, E-value=8e-92, Identity=97%"; Hit description=AmpR transcriptional regulator
  Pfam annotation: Domain name=LysR_substrate; Domain location=48-239; Score=46.7; E_value=8.1e-11; Accession=PF03466.11; Description=LysR substrate binding domain
AHAEEQLAIQLFRRLPRGQDLTEEAQALLPVLSDAFDRIEAVLQQFEEGHFHEVLTVAVVGTFAVGWLMPRLAAFRTAHPFIDLRVLTHNNLVNLSADGMDFAIRFGEGLWPATCNIKLFDAPLTVLCPPAVAARLRTPQDLQHEQLMRTYRKDEWERWFAAAQVTPWRINGPHVPPRTGRRRAAAAVRRRGRARRLLADPFEIAGSDAGDENLYRLDPPGGGGGTAAGLGRTAPDQRRWQNDVLRRQVGVTDALQQARGGAAPHFPRRTGDEGQRRLGQFGLRHVAEADQRHLPPVVGVYPVRTDAAAAARQAKIGAERHRRLVADDGGNVRVMAQQLLRRFRRLALPAIALDDPFAAKRQAILHQRGAKAAQPLGARQ

SEQ ID NO: 122652 - protein, 178 aa, Glycine max
  Coding DNA Sequence Number=SeqID_30967
SGRPSSSRYHRTCSSLDDKRDFDSLWIGRVWVTICCLRASLDLSSLDDEGADNHKVCPRATRPSGHDSRIETFSRSRPDDANISEKDNHKVCSRATGPLGHDSEIETFLRSRPEDADISGKLTKGADNHKVCPHATGPLGHNSEIDTFLRSRPEDVDIFGKDADDHIGLCVSTGSFAS

SEQ ID NO: 122653 - protein, 212 aa, Glycine max
  Coding DNA Sequence Number=SeqID_30968
  Homolog annotation: Hit_ID=Q84VI1; Match level="QueryCoverage=91%, HitCoverage=29%, E-value=5e-93, Identity=85%"; Hit description =Envelope-like protein
MAQKKSTPITPTTSRRSKVAIPSKKRKEISSSDSDDDVELDVSTSKRAKKSGKKVPGNVPDAPLDNISFHSIGNVERWKFVYQLGRDALDCKETMDLIKAAGLMKTVTKLGDCYEGLVREFIVNIPSDITNRKSDDYQKVFVRGKCVRFSPAVINKYLGRPTDGVIDIAVSEHQIAKEITAKQVQHWPKKGKLSAGKLSVKYAILHRIGAAN

SEQ ID NO: 122654 - protein, 120 aa, Glycine max
  Coding DNA Sequence Number=SeqID_30969
  Gene Ontology: Mol. function=aspartic-type endopeptidase activity; Cellular component=chromatin; Biological process=chromatin assembly or disassembly
  Homolog annotation: Hit_ID=Q53LV2; Match level="QueryCoverage=63%, HitCoverage=13%, E-value=3e-07, Identity=31%"; Hit description =Retrotransposon protein, putative, unclassified
MTSFPLAIVVRISNILFHSGKKRMNLHYNQIHQTRLRQLVLVGNGNALTAEGLILDLEVKIQGHTLKLPVYLLQVSGADLVLGAAWLATIRPHLSDYSTLTLKFYLGNQFITLHGERPSL

SEQ ID NO: 122655 - protein, 228 aa, Glycine max
  Coding DNA Sequence Number=SeqID_30970
MAHEQKLVEDFAQVYAEKEARGRVINALHQEATVWMDRFALTLNGSQDLPRLLAKAKAMAEEQMKADLSALKDQMASISEPALNPGLDRNTAVFGRRYSPQAYPYGLPPNFTPRATPEDLSQAPTFEGQLPPYEDYPGQDDGEGDTHLGPLLHLKDPSPHELPHPNIARHIPTSPTPVKESVPFAEDKGKIEALEERLKAVEGLGNYPFSDLANLCLVPNIVIPPKFK

SEQ ID NO: 122656 - protein, 67 aa, Glycine max
  Coding DNA Sequence Number=SeqID_30971
MDALEIYLNKVERQLDRKLKVVRSNRGETSFMMMNQVDSSSFDDDKDDDKKPKKMISRLSQQVQDQV

SEQ ID NO: 122657 - protein, 295 aa, Glycine max
  Coding DNA Sequence Number=SeqID_30972
  Subcellular localization annotation: CTP_CleavageSite=41; ConfidenceScore=5.52e-01
MAEPSKKRKGSSSTATAAAHRRHGPSGAPTAHIPPSLSSPRSSTLFSSDDQRLRYLSQFSSRIILDPKYLDVEFFNDETFDCYQVFQNSGLVDFMSFKLPYYPELVKVFYCNLKIQDGIIMSEVHAQASEEDLILMWAFLTGRQIDWAHLVRYRMHKALRANAPLPYLHLITLFLRHFQIPLDDEPFVQVKRSFAIGAGAVTSFGYRKDRNRQWLKKDALPPQDERTPSPPPQREDSALMNEVLSELRGLRSYVDDRFDSLDSRFAGMDIRLTQLEEDVGYIRQSFDLPPPPSSS

SEQ ID NO: 122658 - protein, 170 aa, Glycine max
  Coding DNA Sequence Number=SeqID_30973
MIMRGQDIYSSQDEATTLPSSSESEKAKGEESSEEIYPQEEGQPLVVKEKCKEALASIATPLGLEFIPQVKKLLDEGLVRKSLNPCALLVPKIGIIRYQVPKIGGMMNVLSGATLFCKITRTPNIFMVCVHRDPLGVEGRSQEYEEPRDLRSNPFQGGGNDAILSRKGIG

SEQ ID NO: 122659 - protein, 339 aa, Glycine max
  Coding DNA Sequence Number=SeqID_30974
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=98%, HitCoverage=25%, E-value=1e-179, Identity=91%"; Hit description=DNA -directed RNA polymerase subunit beta''
  Pfam annotation: Domain name=RNA_pol_Rpb1_4; Domain location=86-158; Score=52.7; E_value=1.3e-12; Accession=PF05000.8; Description=RNA polymerase Rpb1, domain 4
  Pfam annotation: Domain name=RNA_pol_Rpb1_5; Domain location=160-338; Score=-101.2; E_value=0.00012; Accession=PF04998.8; Description=RNA polymerase Rpb1, domain 5
  Pfam module annotation: Pfam domain module=RNA_pol_Rpb1_4::RNA_pol _Rpb1_5; Domain location=86-158::160-338
MEVLMAERANLVFHNKVIGGTAIKRLISRLIDHFGMAYTSHILDQVKTLGFRQATDTSISLGIDDLLTIPSKGWLVQDAEQQSFILEQHHHYGNVHAVEKLRQSIEIWMTDPFNPVHIMSFSGARGNASQVHQLVGMRGLMSDPQGQMIDLPIQSNLREGLSLTEYIISCYGARKGVVDTAVRTSDAGYLTRRLVEVVLHIVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQ

SEQ ID NO: 122660 - protein, 86 aa, Glycine max
  Coding DNA Sequence Number=SeqID_30975
MTVKTSDTCSSRRRSQLVSGVDGCRGWLNYAASEQIVLRVHHMQAAQLLGRAIGAGLFAITPAGERGMCCKAIKLGNARVFPVTTL

SEQ ID NO: 122661 - protein, 98 aa, Glycine max
  Coding DNA Sequence Number=SeqID_30976
MAFVDNWMVGKERVCFWLSNDIVGLVGNLAMLERQSQHGPTSIISPTKTKSAKLEGNHLGCQIPPPLGVFFERFMPPFCTCSIVASYPESYQNCADTT

SEQ ID NO: 122662 - protein, 59 aa, Glycine max
  Coding DNA Sequence Number=SeqID_30977
AVHVSSIVKREASGDWETRYSVVFRIEKREGVETRVVITERAGWTKSVSYLCFPLISDE

SEQ ID NO: 122663 - protein, 227 aa, Glycine max
  Coding DNA Sequence Number=SeqID_30978
  Homolog annotation: Hit_ID=Q2KZB6; Match level="QueryCoverage=63%, HitCoverage=69%, E-value=3e-47, Identity=63%"; Hit description =Putative uncharacterized protein precursor
MKAVHVAQFVVNGYIPCRAIRKSPGTADRRQGLLAGLPQGQIIDIHHPVASLGGIVEMKNVNRVLAASVLMLVLAACSSSQTANKGNFGKAIQKYLDTKNGLCAALPARELPFRLANDGSLGERARLQANALVEAGLLSRQASEMKSMFGTSTVPAGEYALTSKGKKFLVEGGAETIAGQAAFCTGKFRVTEVDTFTEPSEMMGVKLSQVNFRYKVEDADSWARSKE

SEQ ID NO: 122664 - protein, 56 aa, Glycine max
  Coding DNA Sequence Number=SeqID_30979
MGGGGGFGCLGKLPGNHITNETSKRVGLRPQKETTPENLAFHGFKQKTQMKHEAEM

SEQ ID NO: 122665 - protein, 110 aa, Glycine max
  Coding DNA Sequence Number=SeqID_30980
MANQDEWVPFMDVLALLIFGVVLFPNVDGLVDLAAIDAFLAYHHSKESPVVAVLVDLFDTFDRRCEKSSAGIIYCLPACRNLPFGGRATRDSRDACSTKGIRAESPPTFI

SEQ ID NO: 122666 - protein, 93 aa, Glycine max
  Coding DNA Sequence Number=SeqID_30981
MSYRSMCLCCRWVTGERENGEENKERVRARRELGSTDGARYNQGYELERSKGLCYVVSSIEVVGNIEEGRRKRKVIDTKEECFTSSKSSIVLT

SEQ ID NO: 122667 - protein, 105 aa, Glycine max
  Coding DNA Sequence Number=SeqID_30982
MWAFLTGRQIDWAHLVRYRMHKALRANAPLPYPQLITLFLRHFQIPLDDEPFVQVKHSFAIGAGAVTSFGYHTRFSGMDIRLTQLEEDVGYIRQSFDLPPPPPPS

SEQ ID NO: 122668 - protein, 391 aa, Glycine max
  Coding DNA Sequence Number=SeqID_30983
MALRKLASKRSRKDKAAEGTSSAPEYDSHRFRSAVHQQRFEAIKGWSFLRERRVQLRDDEYTDFQEEIGRRRWASLVTPMAKFDPEVVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLVWRPLGTLWTQISPTGPGIPALITGLCQSLGVPVAPTKVIRPPITRAFIEKYCTQRQAQGDAPQAAGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 122669 - protein, 107 aa, Glycine max
  Coding DNA Sequence Number=SeqID_30984
MQRQIMVILRLVSTERNKFGSIRMMFCWQGGSLAEWCFARTKLVCYLYFPFISNKRQVKRGNCHTLISSGDHPLLGCDPRWTTSRYLAPTVRQFVKFRDKPEIKRKC

SEQ ID NO: 122670 - protein, 468 aa, Glycine max
  Coding DNA Sequence Number=SeqID_30985
  Gene Ontology: Mol. function=transferase activity, transferring phosphorus-containing groups; Cellular component=integral to membrane; Biological process=two-component signal transduction system (phosphorelay)
  Homolog annotation: Hit_ID=A6T9G6; Match level="QueryCoverage=53%, HitCoverage=56%, E-value=2e-79, Identity=60%"; Hit description =Sensor protein
  Pfam annotation: Domain name=DsbD; Domain location=292-451; Score= -47.4; E_value=0.0022; Accession=PF02683.6; Description=Cytochrome C biogenesis protein transmembrane region
  Pfam annotation: Domain name=HATPase_c; Domain location=148-257; Score=103.3; E_value=7.3e-28; Accession=PF02518.17; Description =Histidine kinase-, DNA gyrase B-, and HSP90-like ATPase
  Pfam annotation: Domain name=HisKA; Domain location=49-107; Score =32.7; E_value=1.4e-06; Accession=PF00512.16; Description=His Kinase A (phosphoacceptor) domain
  Pfam module annotation: Pfam domain module=DsbD::HATPase_c::HisKA; Domain location=292-451::148-257::49-107
MTRFTRAIDTLQPATPAAGPLAEKGPQEVQRAARAFNAMQKRIQDHLQERARILAAISHDLQTPITRMKLRVEMADQSALRDKLLQDLDSMTRLVREGIALARSAEPLAEAPQRTSLNALLDSIACDYADIGKAVSFRAGKGADVMTLQPQALRRIMSNLIDNGLKYAEKVEISLSYPPNGDVIIHVVDDGPGIPEGELTAVLQPFYRLEQSRNRDTGGTGLGLAIAAQLAGQMQGSLTLHNLQQGGLEARINPYTKPPFHGHIRHTVACCNADVATSATLRRRMIMAVVIAFLAGMLTLLSPCTLPVIPLVFASVSGRKGQLILLLFGMGLMFTAVSLLATAAGGWLVNLTIVGRWLALGFLVVVAISLLSTRVAGWLGSPAVALGNQLNQQSYRYGSGLASVFAGLAIGLLWAPCAGPRMRADVAAIGVVRRAADFPFARWSGDKWAVTPTGWRGNVGRSGINRQR

SEQ ID NO: 122671 - protein, 161 aa, Glycine max
  Coding DNA Sequence Number=SeqID_30986
GYTPSPWVLVTLTVERTTRPRLERTTRPHHQRAARPHLRGLHVLALRGLHALTLGTSYPHRQRTTRPRLERTTRPHHQRAARPHLQRTISPRLERATRPHLGATCPHLQRTTRPHLLEDYTSSPSEDYMFPIFKGGHALTFRGLHVLAIIGLHSLAFERQQ

SEQ ID NO: 122672 - protein, 141 aa, Glycine max
  Coding DNA Sequence Number=SeqID_30987
MTLTNNLDVLCIQETKIEAIDRRICQYLWADCNVNSECAPSINPTLFLISNQPTSSINSMGNFVEERWEWKLTWRRNFFDREIDMVADFIADIESGNINHSSRDFLCWKSDPNGLYSTKSAYKVLQEGHASAIEDRVLNIM

SEQ ID NO: 122673 - protein, 47 aa, Glycine max
  Coding DNA Sequence Number=SeqID_30988
MPYLLSKAVNHIKNSFSLDACTSFFLLRLDFKGTVDSRYERIEPEPR

SEQ ID NO: 122674 - protein, 140 aa, Glycine max
  Coding DNA Sequence Number=SeqID_30989
PLPQPVPTYVEPPPSLTLAAGDDTRGIPSPGVDTFGVADDDENPETGQIQATDSSGEGQSPQVEKDEGPRTFGIFIKFGESFSMDSLLNQSQTYQGNPCGVYYGLSSFTGSGVIQISVACIKRSAPSQDHSGIRALALDT

SEQ ID NO: 122675 - protein, 148 aa, Glycine max
  Coding DNA Sequence Number=SeqID_30990
GKLGNDHTPFVAASEVATGLPSEIELLFSLDLATFIAIAGSLATFFRDMVEEKANALTPTAPTPSPKAGYLPEYNKRKAKKRRKRRMQKKVGTRFVGSTPLSKRSVGIRLYRTELSSHTYNLRCSPVSLLSYSTALGTDARLSAFHRY

SEQ ID NO: 122676 - protein, 64 aa, Glycine max
  Coding DNA Sequence Number=SeqID_30991
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=9%, E-value=3e-24, Identity=63%"; Hit description=DNA -directed RNA polymerase subunit beta
  Pfam annotation: Domain name=RNA_pol_Rpb2_3; Domain location=1-45; Score=48.8; E_value=1.8e-11; Accession=PF04565.7; Description=RNA polymerase Rpb2, domain 3
LTGRTASFRIRDIHPSHYGRICPIDTSEGINVGLIGSLAIHARIGNSLALNRDIQEEQTVPARY

SEQ ID NO: 122677 - protein, 152 aa, Glycine max
  Coding DNA Sequence Number=SeqID_30992
  Homolog annotation: Hit_ID=Q6L477; Match level="QueryCoverage=46%, HitCoverage=11%, E-value=6e-10, Identity=35%"; Hit description =Putative uncharacterized protein OSJNBa0009L15.8
  Subcellular localization annotation: CTP_CleavageSite=60; ConfidenceScore=5.79e-01
MTLSSWQNKLNRTMATPPALSPPSSPSPSLSTLKQTRKATRLRSLATRSLGAERPVVHVDSATGKADDPHKKKLRTYLGIVAHDKVNVTYETWKEVPVAQKDLIWEDIQAEFEIPEVSDSRTKRKLLQTVGERWRQFKSDLTRKWALAADQD

SEQ ID NO: 122678 - protein, 42 aa, Glycine max
  Coding DNA Sequence Number=SeqID_30993
MDKSLKVGEDEWREKERRSTKFYVSNEPTNPRSSSRFSTKCA

SEQ ID NO: 122679 - protein, 164 aa, Glycine max
  Coding DNA Sequence Number=SeqID_30994
MAHLELSIPWRGSTEQPHRPTYLNYPEGNFGGNQLLDGSISLSPYTQVRRTICTYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 122680 - protein, 124 aa, Glycine max
  Coding DNA Sequence Number=SeqID_30995
MGSVLIPAVNQPTEGPCRLLKNVRWGISLPLDVVSKKGTNSPDPLSMGTNQTGKRFYQVKVKSPDTTSIKELGRLMEPLQMQAFRKTYGKILELTIAEVSIEAIASLTQYYDQPLSASHSETSN

SEQ ID NO: 122681 - protein, 122 aa, Glycine max
  Coding DNA Sequence Number=SeqID_30996
MSGGTRDSPQISASPQQLDLAPYASGPYNAQWYAPTLLHDKHTLRSSRILGETEVDEPWLGLWRPLNYQVDMGASGVRHWKCGRHFVVDSGMAFVDNWAVGKEKLCYWLSNDIVGLVGNLAV

SEQ ID NO: 122682 - protein, 57 aa, Glycine max
  Coding DNA Sequence Number=SeqID_30997
MHGVATNVYLRKTSKKLERCGLRTLSVKGLGIVFTHGEGCFPCSYVFFNCDKEIRPT

SEQ ID NO: 122683 - protein, 351 aa, Glycine max
  Coding DNA Sequence Number=SeqID_30998
  Homolog annotation: Hit_ID=Q6WAY6; Match level="QueryCoverage=27%, HitCoverage=16%, E-value=3e-09, Identity=40%"; Hit description =Putative uncharacterized protein
MKQTQNGVVGLPQKYLEGKARDMASQEKWGPFADTLALLIFGVVLFLNVDGLVDLAAIDAFLAYHHSKESPVVAILADLFDTFDRRCEKNSARIVCCLPALCVWLGLGVVLTITRTRHKTARVSMRGAPTEESLSPFLVRDLGAQGLKVIQRVHKAWRSPLRKDKELRGIRNGVIGGYHGWLRIHTRGLDWLSKFKVIDEENFEAPEEDEEVRALKLELGKARLAKEKFKSAATHIRKECTGLQEENAATAKALEQETKRARKEEYGREKFRGALWGSNNELKLRREERDRSRVHGMILKEELVACARSKRSLAQHLEATEQSMLAIIGQYKETLNQSMAHEQKLVEDFAQ

SEQ ID NO: 122684 - protein, 62 aa, Glycine max
  Coding DNA Sequence Number=SeqID_30999
MGAKYLEVVKRGSHPNNGWSPDEIRKHSSLATRGILLYWAETIGCNCKGKCRGCPTLSFSKH

SEQ ID NO: 122685 - protein, 118 aa, Glycine max
  Coding DNA Sequence Number=SeqID_31000
MWKLKKLEYNNEEEQHNNEPMIHNEPIVEEPQEVALRRSQRERRQIISNDYMDLVELPKDCKRVGCKWVFKTNVTLMATLNVTRLKFLLRDLLRKMTLITNRRFHQSHERIISGLSWH

SEQ ID NO: 122686 - protein, 43 aa, Glycine max
  Coding DNA Sequence Number=SeqID_31001
MTSQTFTKGVKGRSPEYEEPRDLRLNPFQGGGDDAILPPKGIG

SEQ ID NO: 122687 - protein, 99 aa, Glycine max
  Coding DNA Sequence Number=SeqID_31002
  Homolog annotation: Hit_ID=A2Q1D6; Match level="QueryCoverage=97%, HitCoverage=22%, E-value=2e-13, Identity=35%"; Hit description =Ovarian tumour, otubain, related
MVKPRNILLTLKEHNVNSCMTVKQIYNAKSAFHCSIRGSDLEMQHLMKLLEHNTYKTNRYRLSLLNFIWVTPTGMTFSAGFAYVEGERVNNLVWTLQRF

SEQ ID NO: 122688 - protein, 169 aa, Glycine max
  Coding DNA Sequence Number=SeqID_31003
  Homolog annotation: Hit_ID=P0A8B3; Match level="QueryCoverage=100%, HitCoverage=92%, E-value=5e-87, Identity=91%"; Hit description =UPF0115 protein yfcN
  Pfam annotation: Domain name=Smr; Domain location=98-169; Score=99.0; E_value=1.5e-26; Accession=PF01713.12; Description=Smr domain
MKKKTPLSAEDQALFRQLMTGTRKIKQDTIVHRPQRKKLSEVPPKRLLQEQVDNSHYFSDEFQPLLNTEGAMKYVRADVSHFELKKLRRGDYSPELFLDLHGLTQQQAKQELGALIAACRREHIFCACVMHGHGKHILKQQTPLWLAQHPHIMAFHQAPKEYGGDAALL

SEQ ID NO: 122689 - protein, 89 aa, Glycine max
  Coding DNA Sequence Number=SeqID_31004
  Gene Ontology: Mol. function=nucleic acid binding
  Homolog annotation: Hit_ID=A5C693; Match level="QueryCoverage=65%, HitCoverage=27%, E-value=3e-11, Identity=56%"; Hit description =Putative uncharacterized protein
MRGDASKFTHISPKKSEHVTYGDNNKGRILGVGKISTNSSNSIENVLLVEGLKHILLSFLLETSRNFTDSTTMGVKHFEVVKRRSHANK

SEQ ID NO: 122690 - protein, 100 aa, Glycine max
  Coding DNA Sequence Number=SeqID_31005
MSILTLGSKKGEGKFPIKEKAKKRGKEIPNQRVRESEKKRKKIPNQRMGENKKKKKKNEGKKVPDQRSRRNVQKGLLTGQYLNNTELSPNERKEGKEAMT

SEQ ID NO: 122691 - protein, 81 aa, Glycine max
  Coding DNA Sequence Number=SeqID_31006
MQGEVAEALQYMVSPQGRKTCTFDDLVPYVEKITILSEEQERVTEPVSHGPASERQFPAQQFHMLKSSIETQGIDRRRDIV

SEQ ID NO: 122692 - protein, 102 aa, Glycine max
  Coding DNA Sequence Number=SeqID_31007
  Homolog annotation: Hit_ID=Q9KHC4; Match level="QueryCoverage=71%, HitCoverage=12%, E-value=8e-08, Identity=47%"; Hit description=SocE
MAVNISDKPKIKYCGYRARIRNHGHSCFLRETCRASCINESANARGEAVCVLGALPLPRSLTRCARSFGCGERYQLTQRRSFAPSWAVCTNPPFSPSAEPYP

SEQ ID NO: 122693 - protein, 239 aa, Glycine max
  Coding DNA Sequence Number=SeqID_31008
  Gene Ontology: Mol. function=hydrolase activity, hydrolyzing O -glycosyl compounds; Cellular component=membrane; Biological process =carbohydrate metabolic process
  Homolog annotation: Hit_ID=Q2NXQ6; Match level="QueryCoverage=100%, HitCoverage=26%, E-value=6e-93, Identity=69%"; Hit description =Glucan 1,4-beta-glucosidase
  Pfam annotation: Domain name=PA14; Domain location=63-213; Score =138.0; E_value=2.7e-38; Accession=PF07691.3; Description=PA14 domain
MALLGNYFGTPAAPVTILQGIREAAKGVEVRYARGVDLVEGRDDPGATPLIEPTYLRPSADSPERGLRGEYFRTPDLSGTPTLVRTDAQIGFRWDRGSPTDNLLARGEAAPGQGIPNDRFSIRWSGQLLPPMSGRYRLEVAGDDGYRLYLDGKRVIDHWVNTDRLHAEGVELDLQAGRAYALKLEYYDDQRDAGVRLGWRMPGAKAPFDEALDAARDADVVVFVGGLTGDVEGEEMTVN

SEQ ID NO: 122694 - protein, 114 aa, Glycine max
  Coding DNA Sequence Number=SeqID_31009
MTTLCKSRRKVSKDNNCQFCEIKTFPKGLPKVENKQNIQRKELQEALSFLKLCILIFVDLLIYDRGDKYYGRYDETGQHPSPFAKLVQKRVFVCNTQFPVHHNKMMYQKGVIEL

SEQ ID NO: 122695 - protein, 20 aa, Glycine max
  Coding DNA Sequence Number=SeqID_31010
IMVRTQGLGRALRHDTDRGG

SEQ ID NO: 122696 - protein, 251 aa, Glycine max
  Coding DNA Sequence Number=SeqID_31011
  Pfam annotation: Domain name=Transposase_23; Domain location=37-107; Score=11.2; E_value=7.1e-05; Accession=PF03017.5; Description =TNP1ENSPM transposase
MQSQGLALPPEPLVGSSGPRVSTKGRCVDPSGNDPETGDSDRCGLYINAYPARLVALGRVYEGSTVVHNTPLWPGQVKVSVEEVTDADAPVPVPTDEVSLVGQALHTFLAWPTHLVVVSPVKPPPKPDPEVDDPLYLMTLTILELFLRPYQVSWDDTMFGVFNPDFPLYIKHEDLSEIAHGGQCLSISVLQLWILHLTDTSMRAGNSDIYGFLEPQSIQRSGQSQFESESYIKTWMQSSKCDVYLGAYLNG

SEQ ID NO: 122697 - protein, 148 aa, Glycine max
  Coding DNA Sequence Number=SeqID_31012
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=5e-14, Identity=30%"; Hit description= UPI00006A17C9 related cluster
  Subcellular localization annotation: CTP_CleavageSite=50; ConfidenceScore=5.24e-01
VWIWSPLKVRTRSPLKARACSLLKFRTCRLLKARQCSPIMARTCNPLKVRACSPTKVKVHDPLKARTCSPLKVRACSPLLARTCSPRKVRACSPQKVKECSPLMVRTCSPLKARTSSPLTVRVRACSPLMVRTCSPLKARTCSPLNGE

SEQ ID NO: 122698 - protein, 66 aa, Glycine max
  Coding DNA Sequence Number=SeqID_31013
MSSRHRDRARRTPRGPKEVQQGPGLPALITGLYQFYGVPVTPSKVIRPPTNRAFIKKYCAPQASAR

SEQ ID NO: 122699 - protein, 198 aa, Glycine max
  Coding DNA Sequence Number=SeqID_31014
  Homolog annotation: Hit_ID=Q5XM22; Match level="QueryCoverage=39%, HitCoverage=44%, E-value=2e-34, Identity=89%"; Hit description =Resistance-like protein HAAS-2
GFPGGPRDPSVLTSFVEHVAHAVWSRQERPDLKLVSHGRKVALIGRPVPEIEGLVAATRLSPLIDCLVITGDPGLISAFVERWHISHALSTEEARFLLTELLEVSAEEASAETALTRGAYVRLGWVRDIYETRCQARRWIVAARAYLLHLVSCTLFANKSATYVHVVHLDAFRDLAHSGGYAWEVAALVHMHDQLDEA

SEQ ID NO: 122700 - protein, 50 aa, Glycine max
  Coding DNA Sequence Number=SeqID_31015
MVLRLQSSFFLLHSTTIDLQEAKDSIDDEDPRPTSSTWSYIKTLEKTNKH

SEQ ID NO: 122701 - protein, 239 aa, Glycine max
  Coding DNA Sequence Number=SeqID_31016
  Subcellular localization annotation: CTP_CleavageSite=59; ConfidenceScore=5.02e-01
EVLAAQLAQASSGRPGEPGCFLQKQQPSGGIFWRAQGMTASMMEAMLGMRQLMEKNAATAAAVSSAAEADPTLLATAHHPPSNIVGRGRDTLGHDGNPHLGYNRAAYPYGLPPNYSPPVLQDDAGHIASPVLEREPPQQPDEVHKDPQDYARRDVEFYPPIPEGPAPSTLPQPNIATQPIVLSTEGPPPATEERRKLDLLEERLRAVEGFGDYPFADMMDLCLVPDVVIPPKFKVPDST

SEQ ID NO: 122702 - protein, 173 aa, Glycine max
  Coding DNA Sequence Number=SeqID_31017
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=27%, E-value=6e-94, Identity=83%"; Hit description =Photosystem I P700 chlorophyll a apoprotein A1
MIIRSPEPEVKILVDRDPIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFAGWFHYHKAAPKLAWFQDVESMLNHHLTGLL

SEQ ID NO: 122703 - protein, 177 aa, Glycine max
  Coding DNA Sequence Number=SeqID_31018
MLKNGRESSRNYSQKRYGNVMEAPRLGFSSRKQFSSANLREYEMPRRLTLFFFTPPPIYSKIGEELATQLAQASMLLPPEAQPSGGRIWNPKWARLLFAPPLLLSAPPFYFFAFEEVTETYGLRKNTSFRLPPHYGISRIAQACFLLISETSQDFVYCATKDAKYLKAANQRLHVIK

SEQ ID NO: 122704 - protein, 156 aa, Glycine max
  Coding DNA Sequence Number=SeqID_31019
MVPTRHPLDPDKSNRALGFPALITGLCQSFGVPVAPTKVIRPPITRAFIEKYCTQRQAQGDAPQAADAPPPHQAGPAGSFDMEQYLRHLSQGFTSFPCPTPDQFRAEVAWPGDWPEARAGKAPAEAPVEAPDEADEAREDEEMTDLLDFLGGSGAT

SEQ ID NO: 122705 - protein, 75 aa, Glycine max
  Coding DNA Sequence Number=SeqID_31020
MEFGDIVVHFNILDAMKHPSEDHSIFCAEIIDQIVDDYMFDFDSVLHGVVPLDAEEPSSSPTLVPPTVQPHPHQS

SEQ ID NO: 122706 - protein, 183 aa, Glycine max
  Coding DNA Sequence Number=SeqID_31021
  Homolog annotation: Hit_ID=UPI0000ECBAF8; Match level="QueryCoverage =19%, HitCoverage=42%, E-value=3e-12, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTQPTEAGHASLALAVVYNVVTGKTLALPNLIALQHIPLSPAGVIAKRPAPIALPNSCAA

SEQ ID NO: 122707 - protein, 245 aa, Glycine max
  Coding DNA Sequence Number=SeqID_31022
  Subcellular localization annotation: CTP_CleavageSite=38; ConfidenceScore=5.08e-01
HGIKTNASAQEKVLPSQDQGSRGHQFTRMKGVNGAAPAASLAQSLRALASQNEWPPFIDILALLIFGVVLFLNMDGLVDLAAIDAFLAFHHNKESPVVVVLADIYDTFDRRGASSVESLTPFITQGFSDPNARLRAAKEEEAKAPEESEENDKLRDINTTTAKALEQETKRARKKEHDRNKFRGALSLSQQLSKTKANMLAIMGKYKEELDLATAHEHMVMDEYAQVYAEKEARGRVIDSLHREA

SEQ ID NO: 122708 - protein, 204 aa, Glycine max
  Coding DNA Sequence Number=SeqID_31023
  Homolog annotation: Hit_ID=A7QK20; Match level="QueryCoverage=92%, HitCoverage=33%, E-value=1e-08, Identity=25%"; Hit description =Chromosome chr16 scaffold_110, whole genome shotgun sequence
MAANNQQFGTRVVAPLRTTTSEVFVSMVADNQRLENKLKEFTSLVRQLAIGQQKNMMIANQPRLCGICCASDHSTDACSTIQETKQAADVSAMQPGQPFKPQQQQYNPYSNTYNSGSSNIPAQTIINPKGNMSAITFRSGGELLKPTDAGAKIDDSVQTDSTPKHIPLPFPSRSIPTKKVELHSDLLETFRRVDVKIPLLDAIK

SEQ ID NO: 122709 - protein, 189 aa, Glycine max
  Coding DNA Sequence Number=SeqID_31024
  Gene Ontology: Mol. function=NADH dehydrogenase (ubiquinone) activity; Cellular component=mitochondrial respiratory chain; Biological process=ATP synthesis coupled electron transport
  Homolog annotation: Hit_ID=O05000; Match level="QueryCoverage=24%, HitCoverage=9%, E-value=1e-13, Identity=84%"; Hit description=NADH -ubiquinone oxidoreductase chain 2
AEAPCSTQGWINLVETGIVGLAAGLAIPPSRRLECSLPVEDQIFISNATSILLIHGVVFSTSKKYDYPPLVSNVGWLGLLSVARLGGQRALGCGGAKQLERMNVRGAKKAQLPNLMRHRVRTAGNRSMGGSGSNTPGSGRHMSPNAMLNVRPTLHYVVGKPVVPAALMNRPTRGERRFAYWALFRFLAH

SEQ ID NO: 122710 - protein, 106 aa, Glycine max
  Coding DNA Sequence Number=SeqID_31025
DKELRGSSNGIIGGYHKWLRVRTQGLDWLPNLKTVRDDEVKASEESDEVQALKAKLERARVVEEKFKSIAIKGLYMAELVSSSSEEVKGIITGQRHDLEGRAKGLP

SEQ ID NO: 122711 - protein, 274 aa, Glycine max
  Coding DNA Sequence Number=SeqID_31026
LKTPEEATELIENMSASDHDILRDRTHQPTKKSLSQVVPFVVKFMRQVNASQLKKTLKKFISWGINNGKGFQQGPYNQQGQWRTHPGNQFNKDQGGSSNIPIQQGPNIFQRTTKLEETLTQFMQVMMSNHKSTESALKNLEVQVGQLAKQIANKSSNSFGANTKNNPKEECKAVMTRSKKFVEAEHKESVVYKEQTGEKTSVKVKENDVKGKENQEKGKKIMVQNKEMENQEKEKDGEKEKENEKNEKEEKNKISEKSRSGKAVDKGVEVPYLV

SEQ ID NO: 122712 - protein, 231 aa, Glycine max
  Coding DNA Sequence Number=SeqID_31027
  Gene Ontology: Mol. function=chloramphenicol O-acetyltransferase activity; Biological process=response to antibiotic
  Homolog annotation: Hit_ID=P62577; Match level="QueryCoverage=70%, HitCoverage=74%, E-value=3e-95, Identity=100%"; Hit description =Chloramphenicol acetyltransferase
  Pfam annotation: Domain name=CAT; Domain location=6-179; Score=323.6; E_value=3.6e-94; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDTSSPRFHHGQILYARRQGADAAGDSVVLLHVFPGWTQDDSYRIRRSGRTERGVRAYSPAWSELPTRN

SEQ ID NO: 122713 - protein, 161 aa, Glycine max
  Coding DNA Sequence Number=SeqID_31028
  Homolog annotation: Hit_ID=B0HC01; Match level="QueryCoverage=20%, HitCoverage=70%, E-value=4e-11, Identity=100%"; Hit description =Putative uncharacterized protein
GVGAYGKTPATRPFYGSWPFAGLLLTCSFLRYPLILWITVLPPLSELIPLAAAERPSAARNSYDHDYEFELGTPVTRLPLLTDQHTTLTDQPNSGNNELNDMVMMLTSTVDGDEAPSTVDSGVALHGNLLNAPRNLFTTSSSSRQQWWLKKKKNLFPTTSS

SEQ ID NO: 122714 - protein, 251 aa, Glycine max
  Coding DNA Sequence Number=SeqID_31029
  Homolog annotation: Hit_ID=Q84VI1; Match level="QueryCoverage=86%, HitCoverage=31%, E-value=2e-92, Identity=82%"; Hit description =Envelope-like protein
MATSPKELPLLVHPLYHHLRTRTTRIQHPTHTNIPGQASVPEKLVPRRQQGVKIAENPNPAISPREVDTEMDKKIRSIVSSILKDASVPEADEDVPTSSNPNVSVPNVKKDVPTSSGPNAEVLSSPSKERSTEEDDQATKETPAPRAPEPAPGDLIDLEEVESDEEPIANRLAPGIAERLQNRKGKTPLKRSGRIKTMAQKKSTPITPATSRRSKVAIPSKKRKEISSSDSDDDVELDVSTSKRAKKSGRK

SEQ ID NO: 122715 - protein, 83 aa, Glycine max
  Coding DNA Sequence Number=SeqID_31030
MNHPGSARVHPPPLRQLEHHVPEPPKHPRCHALISSGDYYLMTCNLCPETSQKSKGSWLTQSVKFRNVAEIEKRCFCAIREFP

SEQ ID NO: 122716 - protein, 74 aa, Glycine max
  Coding DNA Sequence Number=SeqID_31031
  Subcellular localization annotation: CTP_CleavageSite=28; ConfidenceScore=5.26e-01
AQSETLQQPGDGRQRATDAPLPPPKSLSSSTKAGALPTTRGRPAGDHVQSQSMQQGQANILIARFPDPNHGVKT

SEQ ID NO: 122717 - protein, 59 aa, Glycine max
  Coding DNA Sequence Number=SeqID_31032
MSFLAIITPISLCLSASWCTPPTRHPLDPDKSNRALGFSDLIIGLYQSFGVQVTPSKVI

SEQ ID NO: 122718 - protein, 192 aa, Glycine max
  Coding DNA Sequence Number=SeqID_31033
  Gene Ontology: Mol. function=exoribonuclease activity, producing 5' -phosphomonoesters; Cellular component=intracellular; Biological process=nucleobase, nucleoside, nucleotide and nucleic acid metabolic process
  Homolog annotation: Hit_ID=A8G8U2; Match level="QueryCoverage=93%, HitCoverage=98%, E-value=1e-90, Identity=89%"; Hit description =Oligoribonuclease
  Pfam annotation: Domain name=Exonuc_X-T; Domain location=19-182; Score=147.1; E_value=5e-41; Accession=PF00929.15; Description =Exonuclease
MTTLATGGKCMTAGNENNLIWIDLEMTGLDPERDRIIEIATIVTDANLNILAEGPVLAVHQSDAQLALMDDWNVRTHTNSGLVARVKASQHDDRAAEQATIAFLQQWVPANTSPICGNSIGQDRRFLFKYMPELEAYFHYRYLDVSTLKELARRWKPEILPGFKKAGTHQALDDIRESIAELAYYREHFLQL

SEQ ID NO: 122719 - protein, 64 aa, Glycine max
  Coding DNA Sequence Number=SeqID_31034
MNVSSGATLFCKITCTPNIFMIHVHRDSLGVEGRSPEYEELWDLRSNPFQGEGDDAMLPRKGIG

SEQ ID NO: 122720 - protein, 144 aa, Glycine max
  Coding DNA Sequence Number=SeqID_31035
  Gene Ontology: Mol. function=endonuclease activity
  Homolog annotation: Hit_ID=Q9AY32; Match level="QueryCoverage=43%, HitCoverage=95%, E-value=7e-27, Identity=96%"; Hit description=RRNA intron-encoded homing endonuclease
KKLVVGPWVGSIGPPPVCTGRLVPSAGDALLSLTGRVVPPHGITPQDSDPIVLAFGIGVMINRDSRGHSYFIVRERKLGARRRSDTVLVSTINDADQGSADVAFRTPLAPYEKSKSLGSGGSMVARLKLKGIDGRAPPGVEPAA

SEQ ID NO: 122721 - protein, 258 aa, Glycine max
  Coding DNA Sequence Number=SeqID_31036
MGNPVKERSNWLAKLKVVSEESFEAPEEDEEVQALIYELGKLKLAKEKFKLAATHIRKKCAGLREENATTARALEQETKRARKEEYGRNKFRGALWGSNSELKLRREERDQSRAHSMVLKEELVACSRSKRSLSQRLCETETNMLAIIAKYQEELGLATAHEHRVADEYAQVYAEKKARGRVIDSLHQEATMWMDRFALTLNRSQELPRLLAKAKAMADTYSAPEEIHGLLGYCQHMIDLMAHIIRIARKLVCLSDLD

SEQ ID NO: 122722 - protein, 60 aa, Glycine max
  Coding DNA Sequence Number=SeqID_31037
MQSQGLALPPEPEVAMSPAKPADRPDPEHLTETSMRAGNSDVYGFLEPQSIQRSGQSQFE

SEQ ID NO: 122723 - protein, 259 aa, Glycine max
  Coding DNA Sequence Number=SeqID_31038
  Homolog annotation: Hit_ID=Q6L477; Match level="QueryCoverage=84%, HitCoverage=36%, E-value=4e-11, Identity=26%"; Hit description =Putative uncharacterized protein OSJNBa0009L15.8
MSLGGYEYLEKKLIDEKRKKKLEEVTQSGSTNTVIDPPSPIKRHVKWKLAHTKKTGDMTSEAAKEIADKIDALEEQASQGSFVTHEHQDILTAAIGRPEDPGRVRAVGVGITIKQYFGSTSRTSSIAPEYLQQLTQQIKDQLEDSITEKVTRRLMLSLSQMQSQGLALPLEPDVGPSAVRVSTKESCVNPSGNNPDTGDSYKCGLYIKEYPSRLVVLGRVYEGSTTIHNIPLLHDQVKVGVKEIRDADAPIPVPTKEVK

SEQ ID NO: 122724 - protein, 32 aa, Glycine max
  Coding DNA Sequence Number=SeqID_31039
MEMMAGRNDRAIADALQALAQAIWNPNRGEAA

SEQ ID NO: 122725 - protein, 197 aa, Glycine max
  Coding DNA Sequence Number=SeqID_31040
MRAHPEREAITHLLCIPGQDFTCAAAKRRVWIMRTNMTTFTWIWMTLLFSNILPSDQNANLPLQMYRDRAHKTPSGPEEVQQGPGVSSSCCGPLSVQQGVHSPSEESRPQDTQWTRRSPTGSWSCQALITGLCQFYGVPIAPSKIIRPPTNRDFIKNYCVPRQAQGETPQQPRDGRQWATDAPPSPLEFTSAHPQKG

SEQ ID NO: 122726 - protein, 48 aa, Glycine max
  Coding DNA Sequence Number=SeqID_31041
  Gene Ontology: Mol. function=ATPase activity, coupled to transmembrane movement of substances; Cellular component=integral to membrane; Biological process=transport
  Homolog annotation: Hit_ID=Q94IH6; Match level="QueryCoverage=66%, HitCoverage=2%, E-value=9e-09, Identity=84%"; Hit description=CjMDR1
MKECSWLDMLDISFFDKETNTGEVVGRMSGDTLLIQEALGEKYLMGIL

SEQ ID NO: 122727 - protein, 70 aa, Glycine max
  Coding DNA Sequence Number=SeqID_31042
  Subcellular localization annotation: CTP_CleavageSite=17; ConfidenceScore=5.06e-01
MASYGVASPLSLPSPFRCHLSSKKQKNPLMKKILGLQAPMELTSCGIQQLLYLRNNLKLKRYGGAKGCIP

SEQ ID NO: 122728 - protein, 92 aa, Glycine max
  Coding DNA Sequence Number=SeqID_31043
  Subcellular localization annotation: CTP_CleavageSite=65; ConfidenceScore=5.25e-01
MRIDEFCALGHSDFANWVINAHRRILHPLSFRSSESSGTSNWVVNAQRQILRPLSFRFRKSSDKRAETDSAPFVIQGQFRWQGGSLAEWCFA

SEQ ID NO: 122729 - protein, 60 aa, Glycine max
  Coding DNA Sequence Number=SeqID_31044
MEALREAGVIDLDGKKRDSCLMHPEVLHNVETCPIAEDLLQGLISRGQIEICSAKKEEGK

SEQ ID NO: 122730 - protein, 69 aa, Glycine max
  Coding DNA Sequence Number=SeqID_31045
MDKSLKVGEDEWREKERRSTKFYASNEPNPDQALSANSSCWTKLDQNRIKTNIQQLGYRTPIPRDNTIN

SEQ ID NO: 122731 - protein, 50 aa, Glycine max
  Coding DNA Sequence Number=SeqID_31046
LVDPLTLQLEIVKLQTLKVGIASFDSGMIERVREIEDFEDVVVVMTGKGL

SEQ ID NO: 122732 - protein, 146 aa, Glycine max
  Coding DNA Sequence Number=SeqID_31047
  Subcellular localization annotation: CTP_CleavageSite=30; ConfidenceScore=5.05e-01
MASFFFRTLKFGSLLLLHRYWHPPLTSFVRFFRHPDEGSSARRTFFHACGRGSWILKRKKEFFRGNLRKKREKVLPRVLVEEGSEGSSAGSSERTMSSADLAEEPAEPSSAGNISWSRKNLWNLLPQATYPSRRRTFETSFAEHVL

SEQ ID NO: 122733 - protein, 80 aa, Glycine max
  Coding DNA Sequence Number=SeqID_31048
MEELDNKNDFDIEYNPLVPAGATIIVGNENIAVIERKSFVFTQGWDFDPNNDVYHFREAGMARTGLMIYSLLVFLKVKSF

SEQ ID NO: 122734 - protein, 537 aa, Glycine max
  Coding DNA Sequence Number=SeqID_31049
  Gene Ontology: Mol. function=transporter activity; Cellular component= integral to membrane; Biological process=transport
  Homolog annotation: Hit_ID=UPI0000196CE7; Match level="QueryCoverage =91%, HitCoverage=96%, E-value=0.0, Identity=64%"; Hit description =transporter-related
  Pfam annotation: Domain name=MFS_1; Domain location=37-446; Score =107.2; E_value=4.9e-29; Accession=PF07690.7; Description=Major Facilitator Superfamily
  Pfam annotation: Domain name=Sugar_tr; Domain location=35-487; Score=- 174.0; E_value=0.035; Accession=PF00083.15; Description=Sugar (and other) transporter
  Pfam module annotation: Pfam domain module=MFS_1::Sugar_tr; Domain location=37-446::35-487
MSRHCDCCCGGIPPGILLIRGKQWNLQTHRYMVLLTTFVAYACYHASRKPTGIVKSVLCPEHKGTSQGWSPFNGHDGTSKLGEIDVAFLACYSIGMYVAGHLGDTLDLRLFLATGMVGSGIFVSLFGMGYFWNIHSFLFYLSMQMIAGMFQATGWPSVVAVIGNWFGKRKRGLIMGVWNAHTSVGNISGSLLAASVLEYGWGWSFVVPGALIVGGGVVVYLFLAPYPEDVGFSCVHGGGDEEAQVNDEKGGGVPTREGSVNRKSVGLVEACMIPGVIPFALCLFFAKLVAYTFLYWLPFYLTQTDVNCMGHKSLHLNFAEIGGKYISVKSAGNLSTLFDVGGIVGGILAGYVSDKLNARAITAASFMYAAIPSMLLYRHYGSVSMNANIGLMMVTGLFVNGPYALITTAVSADLGTHSSLKGDSRALATVTAIIDGTGSVGAALGPLLTGFISTRGWNEVFMMLVLGAFIAGLLLSRLIIAEIAERSGKPLSSGQQNPEATASQPLLEEDRLWKVPKGIRTHNWGWNSIPFHRELIF

SEQ ID NO: 122735 - protein, 156 aa, Glycine max
  Coding DNA Sequence Number=SeqID_31050
  Gene Ontology: Mol. function=binding; Cellular component=nucleus; Biological process=mRNA modification
  Homolog annotation: Hit_ID=A7R0F5; Match level="QueryCoverage=99%, HitCoverage=36%, E-value=2e-41, Identity=39%"; Hit description =Chromosome undetermined scaffold_306, whole genome shotgun sequence
  Pfam annotation: Domain name=PPR; Domain location=5-39; Score=24.3; E_ value=0.00045; Accession=PF01535.11; Description=PPR repeat
  Pfam annotation: Domain name=PPR; Domain location=79-113; Score=43.8; E_value=6.1e-10; Accession=PF01535.11; Description=PPR repeat
  Pfam module annotation: Pfam domain module=PPR::PPR; Domain location =5-39::79-113
MKDIASWNTMISGYAQVGLMADTRRLFTAMPEKNCFSWSAIVSGYVACGDLDSAWSVFMLRLVELAERLFQQMSMRTLVTWNSIIAGYVENGRAEDGLRLFRTMSETGVKPNALSLTSVLLGCSDLSALHLDKQVHQLVCKSLLSSDTMDGRNFVG

SEQ ID NO: 122736 - protein, 135 aa, Glycine max
  Coding DNA Sequence Number=SeqID_31051
  Subcellular localization annotation: CTP_CleavageSite=61; ConfidenceScore=5.57e-01
MASKEKKRSSLASLSPASRFNFFFFLGVLLLLLQSSSIICFFNLLLVRRRDSIFFTALGVSASWRFNSFIVLRISSSRFCVGLWVWFFFTFLLHLQHSASSSRYVFSFALLLLPPLLSSMAETAIGKLMGCLRIT

SEQ ID NO: 122737 - protein, 75 aa, Glycine max
  Coding DNA Sequence Number=SeqID_31052
MKRMKGFKCWLWRVLPVTTEQLPSAVLDHNSKLNNIPTLPLLLGAPATSPINQPRKEENGCRKTRSTTTHYSKKV

SEQ ID NO: 122738 - protein, 271 aa, Glycine max
  Coding DNA Sequence Number=SeqID_31053
  Gene Ontology: Mol. function=helicase activity; Biological process =viral genome replication
  Homolog annotation: Hit_ID=Q2A9I1; Match level="QueryCoverage=98%, HitCoverage=21%, E-value=8e-53, Identity=36%"; Hit description =Putative uncharacterized protein
MFQPQTVLDSNGYPVYHRRNDDRTISKNGVIIDNRYIVPYNAKLLKKYQTHINIEWCNQNTSITYLFKYINKGYDRVTVVFVYDANGGALENPITQNDEIKEYADCRYISPCEATWRIFCFPIHARKPAVEKLHFHLLRQHSVIYEDDDDIDDILSKPSISDSKFLAWMNNNKYFSEGPTSFEDIRPVENVLYPTYREACFTVGFLKDDREFVEAIKEAKDWGTTNYLRKLFVLMLLIGAITKLEELWNQTWNWLAEDIAYHYKKTTLNTD

SEQ ID NO: 122739 - protein, 88 aa, Glycine max
  Coding DNA Sequence Number=SeqID_31054
MKGSYPPSVSNSFRASKLMINELVLEIQEFRERLLDLGIEDGDVDLNASPQALDRLLGCFLAFKVKPCCKIKSSILDSTDPTELEFVS

SEQ ID NO: 122740 - protein, 328 aa, Glycine max
  Coding DNA Sequence Number=SeqID_31055
  Homolog annotation: Hit_ID=Q5XM22; Match level="QueryCoverage=33%, HitCoverage=76%, E-value=6e-39, Identity=64%"; Hit description =Resistance-like protein HAAS-2
LTITLDDVSSLLHLPITGALHSFHALSMEEARFLLTELLEARRWIVAARVYLLHLVGCTLFANTSATYVHVVHLDAFRDLAQSGGYAWGVAALVHMYDQLDEACRTTTRQLAGYLTLLQCWIYEHFPSVHQCVTDDTYQETSPRASRWLTSKTHMKGIIGAPYRARCDGLTVTDEISSFQGQLRWGPMVVTVRPERVFAEHLLLAGQLCLVPGQVYADYMEWFFRISHTFMIPTQACDQPRDAPAADPEDYIQSPSPQVPIAFDPPPHVDGYNGYEAIAQRLERVLKLRIVTAGTELYDIMQDCLTIARGGPSADGTVRARQRRRTDH

SEQ ID NO: 122741 - protein, 112 aa, Glycine max
  Coding DNA Sequence Number=SeqID_31056
MDIIKSIRGHHTCLALVLRQDHRQLDKRVIAQIIQSIVKTNSIISIKTLMAEIKMFMNYTPSYKKTWLAKQKSVGDDSWKLGRIICQVAKTFESFAILYSRDCDGCPNRIRV

SEQ ID NO: 122742 - protein, 134 aa, Glycine max
  Coding DNA Sequence Number=SeqID_31057
  Homolog annotation: Hit_ID=Q8S5P6; Match level="QueryCoverage=39%, HitCoverage=7%, E-value=1e-07, Identity=38%"; Hit description =Putative transposase
MPYFGVIEEIWELNYVKFTVCVFKNLKQLAYKNKPFITTEQAKQMFYIQDPYDERNTVTPPSSLPSESALSPSTLRRTGQATRLRSLSVRPVGLERPLVHVDPNIGKATGLCKKKLRTYLGVIARDKVDVTYIN

SEQ ID NO: 122743 - protein, 132 aa, Glycine max
  Coding DNA Sequence Number=SeqID_31058
MTRGNLGDLQPFDPKIDRTFHRLVRHSVHFEHSEYSVAGDSEHFDFEHSTTNFHTENMAQPPPRERTLREMVAPDFTYESLCIQYPDEDVPYVLKIGLIHLLPKFHGLAGEDPHKHLKEFHIVYSTMKPPDV

SEQ ID NO: 122744 - protein, 170 aa, Glycine max
  Coding DNA Sequence Number=SeqID_31059
MELILTELNIWSKLRLQDLIKVFLWLQDWFCMLSQQLSSALMCWVVGRHVAFMQYMRLIVRQWHYIENCQVVVRRTYIIPQEDPEVAKFREQGLKFLPEMEFLFKGTIATGFAAYAPSEDSRQYEGFNTRTEETNDNIDDNTDMEVNEPEIDTTTQNTSSAKENGQRKRG

SEQ ID NO: 122745 - protein, 210 aa, Glycine max
  Coding DNA Sequence Number=SeqID_31060
  Gene Ontology: Mol. function=nucleotide binding; Cellular component =cytoskeleton; Biological process=cell division
  Homolog annotation: Hit_ID=A7PCD2; Match level="QueryCoverage=75%, HitCoverage=25%, E-value=7e-59, Identity=72%"; Hit description =Chromosome chr2 scaffold_11, whole genome shotgun sequence
  Pfam annotation: Domain name=GED; Domain location=112-203; Score =68.3; E_value=2.6e-17; Accession=PF02212.9; Description=Dynamin GTPase effector domain
MEGIIDDTQPTLTFECLATNICYLWKVHFVLKELVRKSIAETQELKRFPTLQAEIAEAANEGLERFHDDGKKTTLRLVEMESSYITVDFFGKLPQEVDKGKNSASSLLDDQYAKGHFQRIGSNVSSYVGMVSQTLRNTIPKAVVHCQVMEAKRSLLDRFYAQLGKKEERQLAWMLGEDSVLRERRLKQFFGRDKMNLELIYEGPLLMGKE

SEQ ID NO: 122746 - protein, 62 aa, Glycine max
  Coding DNA Sequence Number=SeqID_31061
MSPLGLAGHANVGSPAIGACETNSWNDTPYLQNLILKRVRKTLKFAEERGRKTLKFAQEERL

SEQ ID NO: 122747 - protein, 75 aa, Glycine max
  Coding DNA Sequence Number=SeqID_31062
  Subcellular localization annotation: CTP_CleavageSite=38; ConfidenceScore=5.28e-01
MKKYRCCSSPPPSTPQSLWRWGFLGNAQHDTRAKRACPARSSGHTISRRMRTLARDNCLPMWLLVLSGLACTERS

SEQ ID NO: 122748 - protein, 137 aa, Glycine max
  Coding DNA Sequence Number=SeqID_31063
  Gene Ontology: Mol. function=microtubule motor activity; Cellular component=microtubule associated complex; Biological process =microtubule-based movement
  Homolog annotation: Hit_ID=A7PGT4; Match level="QueryCoverage=33%, HitCoverage=4%, E-value=3e-13, Identity=80%"; Hit description =Chromosome chr17 scaffold_16, whole genome shotgun sequence
MAVRSKTMAWRLEAFLVPRLGHHEMYLGLTETTQTYVSFGTPLISLLLPTHRICVVTQEIERRMSTQAKHLRTQNNLFKAREEKYQSRIRVLKALSSGTIDESEGEKIKEKVKKDKSINVYFNGLLGKRLQLEQLVA

SEQ ID NO: 122749 - protein, 653 aa, Glycine max
  Coding DNA Sequence Number=SeqID_31064
  Gene Ontology: Mol. function=nucleoside-triphosphatase activity; Cellular component=mitochondrial matrix; Biological process=ATP -dependent proteolysis
  Homolog annotation: Hit_ID=A5BU86; Match level="QueryCoverage=97%, HitCoverage=66%, E-value=0.0, Identity=74%"; Hit description=Lon protease homolog
  Pfam annotation: Domain name=AAA; Domain location=412-649; Score =125.2; E_value=1.9e-34; Accession=PF00004.20; Description=ATPase family associated with various cellular activities (AAA)
  Pfam annotation: Domain name=AAA_3; Domain location=412-550; Score= -13.9; E_value=0.011; Accession=PF07726.2; Description=ATPase family associated with various
  Pfam annotation: Domain name=AAA_5; Domain location=412-602; Score =1.4; E_value=0.0022; Accession=PF07728.5; Description=ATPase family associated with various
  Pfam module annotation: Pfam domain module=AAA::AAA_3::AAA_5; Domain location=412-649::412-550::412-602
MAESVELPSRLAILPFRNKVLLPGAIIRIRCTSPTSVKLVEQELWQREEKGLIGILPVRDAAEIKPVGPTVSEGADSTNQNSKVQSGSSDSHKLDTKKQNDVHWHNRHSSREYLLCHFENLRSTARPLHLSRGVEKPSGRVTYTVVLEGLCRFSVQELSMRGIYHTARITSLEMTKTELEQVEQDPDFIMLSRQFKATAMELISVLELKQKTGGRTKVLLDNVPVHKLADIFVASFEISFEEQLSMLDLIDPKVRLSKATELVDRHLQSIRVAEKITQKVEGQLSKSQKEFLLRQQMRAIKEELGDNDDDEDDLAALERKMQSAGMPQNIWKHGHRELRRLKKMQPQQPGYNSSRVYLELLADLPWQKASEEIDLDLRAARKRLDSDHYGLVKVKQRIIEYLALKPDARGPVLCFVGPPGVGKTSLASSIAAALGRKFVRISLGGVKDEADIRGHRRTYVGSMPGRLIDGLKRVAVCNPVMLLDEVDKTGSDIRGDPASALLEVLDPEQNKSFNDQYPLFFKMCSLNLLFSPVGCDDIYFAICLFDDLIVKDKLILILVDFFYYLNVPFDLSKVVFVATANRLQPIPPPLRDRMEVIELPGYTPEEKLQIAMRHLIPRVLDQHGLSSEFLQIPEVLNVFLYKNSLETGKVSAP

SEQ ID NO: 122750 - protein, 211 aa, Glycine max
  Coding DNA Sequence Number=SeqID_31065
DSLDEQASQGSFVPHGRQDILTAAIGRPEHPGRVRAVGVGVTIKQYFGSASRTSRSSSSMPLEDLEQLTQQIRDQLEESITEKVTRKMMESFSQMQSQFQSQMQSQGIALPPEPEVGPSGPRVSTKESCVAPSGNNPGMGDSDKCGLYIEENPSRLVALGRLYEGSTTVHNIPLLHGQVKVGVEEVKDTEAMSQNKAQPYSGCLIKTSRCI

SEQ ID NO: 122751 - protein, 31 aa, Glycine max
  Coding DNA Sequence Number=SeqID_31066
NTRIPFQYSCMEWRVSKAQWKLASQQIACLT

SEQ ID NO: 122752 - protein, 111 aa, Glycine max
  Coding DNA Sequence Number=SeqID_31067
  Subcellular localization annotation: CTP_CleavageSite=63; ConfidenceScore=5.41e-01
MGAKLEHMNPQKPIPQKPVAASLSPPVPQHPLAVPPPATPSLSYPASSKGGTPSLSLIPPAPRAGHSLSLLSLPIPPTAMAAPLPLSPSQPLSRHWHWRFKLPASVNGGTH

SEQ ID NO: 122753 - protein, 421 aa, Glycine max
  Coding DNA Sequence Number=SeqID_31068
  Gene Ontology: Mol. function=iron-sulfur cluster binding; Biological process=electron transport
  Homolog annotation: Hit_ID=A7PCG6; Match level="QueryCoverage=76%, HitCoverage=76%, E-value=3e-68, Identity=45%"; Hit description =Chromosome chr2 scaffold_11, whole genome shotgun sequence
  Subcellular localization annotation: CTP_CleavageSite=24; ConfidenceScore=5.09e-01
MATPNNSNINNATAKPGTLGVGVGAPMNVARVAVLEIKTPVISTSWLWFVAILDIAGNCGQMQLQLWSRCGCGKPQNLDIAAEVVYSYIVHLAYNWKEVLKANSTFPDKASSSGASPLDQQSLDPHPPQSTASPGAAVKLCLGDLLVMGSNPETASLHMQGSAGRVASLRQLSNSFAQFNNLHLSLRSKKPLTRKDAASINEWRFAKIKEYKERNVEVENEAFDRYMQNVDLLEEVLAVKSLDANVPSALESNATPMESNEAMIPGIKLQLRSNSMRSDGLRMRIQQIVNEGLKKLEKSAVDGDINESIDGESNEASKRGKGIERLSAISDLMDKINKARTEEDLKPCLEMKTQLFNLDEGSSAKDLQDNEMHANETAESDVVQTEGLDYSLPKFVTITEIDLEVLHTIDKHFSTQDIEQL

SEQ ID NO: 122754 - protein, 162 aa, Glycine max
  Coding DNA Sequence Number=SeqID_31069
  Homolog annotation: Hit_ID=A5BSZ8; Match level="QueryCoverage=79%, HitCoverage=14%, E-value=1e-08, Identity=30%"; Hit description =Putative uncharacterized protein
MTVANSIKKTLPEIESAKKFMGLVGECSQTANKSLTGTLMSTLTNMKFDGSFQEETELKNQGSHSVHYVSHQGNQEVEKKFMKKHDKGKGSLKINDDSLQIQKKRFLTIQTISPNEKFIFIGNKVKAPVEAVRGGNESSSLSRAFGSAYVRLDSARLVYYKG

SEQ ID NO: 122755 - protein, 423 aa, Glycine max
  Coding DNA Sequence Number=SeqID_31070
  Homolog annotation: Hit_ID=A7UQU7; Match level="QueryCoverage=30%, HitCoverage=22%, E-value=6e-11, Identity=33%"; Hit description=IMP dehydrogenase/GMP reductase, putative
MVLALSCVLITVLGLFKSASGHGPFKCFMVLALSCVLINEPMVDAAAQDTGAETDAQDTGAETDGDESVGFPGGPKDPSVLTEYADHVAGSIWSGQKRSELKLCSHGRKVHKLGRPVPVIEDMVSITLDDIVSLLHLPIIGAFHDFQPLRTDEVVVLLVELLMVLAEVVLAERGQYGVPYAFHDLTLVGRYAWGAAGLVHMYDQLNDASLSTSQQLVGYITLLQIYEHFSSVAECNADPDYDEVSPCACRCIATKKTVKKVSTATYRQRLDRLRIPNVCWMSYAKHRPVQDFHPISCFSGQLPWGPVVVRYRPERCVPDYMDWFFVISYPFMTVPQTVPPRDAYATQPSHIPHEVALASTHADPDANEPGHAVACHVIVEALEQHLNAPGTSTHEEVIQKCLRIAKGVTEDVRSRRRRRTDQQ

SEQ ID NO: 122756 - protein, 163 aa, Glycine max
  Coding DNA Sequence Number=SeqID_31071
  Gene Ontology: Mol. function=protein dimerization activity; Biological process=DNA integration
  Homolog annotation: Hit_ID=A3BRV8; Match level="QueryCoverage=92%, HitCoverage=20%, E-value=2e-23, Identity=39%"; Hit description =Putative uncharacterized protein
  Pfam annotation: Domain name=zf-C2HC_plant; Domain location=18-75; Score=4.6; E_value=0.012; Accession=PF07567.3; Description=Protein of unknown function, DUF1544
MSASSPSQAKEQDDDTKPLWTYVTKIKSVGGGGNYEIKCNICDFTFNGSYTRVRAHLLKMTGKGVRVCQKVTIDRLIDLKKINNEATLRVEKSKTKFVSLPPVSTQHQMDTNTLGVDPKKRKTSIVENAFNLQARETLDHEIARMFYSSGAAFSFSKHPHYRK

SEQ ID NO: 122757 - protein, 105 aa, Glycine max
  Coding DNA Sequence Number=SeqID_31072
  Gene Ontology: Mol. function=protein binding; Cellular component =cytoskeleton; Biological process=phagocytosis, engulfment
  Homolog annotation: Hit_ID=A9Y164; Match level="QueryCoverage=81%, HitCoverage=39%, E-value=2e-31, Identity=69%"; Hit description=Actin
MTQIMFETFNVPIIYVAIQVVLSLYASGRTTGYVLPRAILRLDLAGRDLTEYLVKILTERGYSFSTSAEKEIVRDMKEKLAYVAYEAPTPTRTSDTTRTQTRGHL

SEQ ID NO: 122758 - protein, 296 aa, Glycine max
  Coding DNA Sequence Number=SeqID_31073
  Gene Ontology: Mol. function=peptidase activity; Cellular component =proteinaceous extracellular matrix; Biological process=proteolysis
  Homolog annotation: Hit_ID=A7PK60; Match level="QueryCoverage=69%, HitCoverage=58%, E-value=7e-53, Identity=45%"; Hit description =Chromosome chr15 scaffold_19, whole genome shotgun sequence
  Pfam annotation: Domain name=MORN; Domain location=114-136; Score =24.1; E_value=0.0005; Accession=PF02493.11; Description=MORN repeat
  Pfam annotation: Domain name=MORN; Domain location=137-159; Score =36.2; E_value=1.2e-07; Accession=PF02493.11; Description=MORN repeat
  Pfam annotation: Domain name=MORN; Domain location=176-198; Score =23.3; E_value=0.0009; Accession=PF02493.11; Description=MORN repeat
  Pfam module annotation: Pfam domain module=MORN::MORN::MORN; Domain location=114-136::137-159::176-198
  Subcellular localization annotation: CTP_CleavageSite=53; ConfidenceScore=5.67e-01
MTFPLFPTPFGAKFPTSKLLPRFRFLLFLPLPSLYLLFSKPSPLDFFSVIAFSAVLFTSLNFALSFFTRLFPTKFSSSSSSPHPVVWSIGSNPKQVKNTNWGCWVQVYSKWDVYEGEFQKGKCWGSGVYHYNMHGRYEGDWVDGKYDGYGVETWARGSRYRGQYREVHTCIDGSRYVGEFKRGVKHGLGQYHFRQDAWFWSVSISEWSSNGILEDPKRHNSPTGSPCAVDHTKVSNAVQDAHSAAEKAYNMAKVDGGVNKVVAVANKAANTARVAALRGVSLEPLSVIELDGRLWN

SEQ ID NO: 122759 - protein, 76 aa, Glycine max
  Coding DNA Sequence Number=SeqID_31074
MDQWHLRHHAHQVYKQGLVQLRVTFCGCNPNMFQNMFRMGKQTENYTSDEQCRRIKVKNKYQKKFFLCFGNVGFIG

SEQ ID NO: 122760 - protein, 115 aa, Glycine max
  Coding DNA Sequence Number=SeqID_31075
  Homolog annotation: Hit_ID=A5BP71; Match level="QueryCoverage=65%, HitCoverage=19%, E-value=2e-11, Identity=45%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MVIIVNAEACGYVSLNYYQYINVVYTNEHILKAYSPQWWPLGNEVAIPPSNDAWTLIPDPTTIRAKGRPKSTRIRNKIDWVEPSDHRQKCSRCGAEGHNRRRCPMQSERGSCSNN

SEQ ID NO: 122761 - protein, 177 aa, Glycine max
  Coding DNA Sequence Number=SeqID_31076
MDMWPTTEFDEIQPPKYKKGPGTCHNTRRCPLPPLVVPEEQNEEHSEAAEGVVEGATQGAVARVQSRLINVVEGGTRGVAEVGIEGVAQGGNEGAPTRGTSVGVQAKQMNVVLGGNDGAHGKCVQQFGHYGHNTAVNEKVQKFVPKRKAPTTSKKLKGCQLPIVDKNIELGIGLTNT

SEQ ID NO: 122762 - protein, 356 aa, Glycine max
  Coding DNA Sequence Number=SeqID_31077
  Gene Ontology: Mol. function=phosphogluconate dehydrogenase (decarboxylating) activity; Cellular component=mitochondrion; Biological process=pentose-phosphate shunt
  Homolog annotation: Hit_ID=O22111; Match level="QueryCoverage=28%, HitCoverage=19%, E-value=5e-41, Identity=89%"; Hit description=6 -phosphogluconate dehydrogenase, decarboxylating
  Pfam annotation: Domain name=6PGD; Domain location=82-261; Score= -84.9; E_value=6.1e-11; Accession=PF00393.10; Description=6 -phosphogluconate dehydrogenase, C-terminal domain
MEADVPNSHWEAMRNQCLDEAADSASTTAVSHRHMSFELDYSDLEDANVVSFEVMRKNPFWVYDREALRLFSKFNKGRLQLGHILLGNVDVLMAAHLGVVFMPQGLRHFHRIDTFDPGGYLRDGGKWTVQQAAELSIVAPTIEASLDARFLSGLKEERVEAAKVSKSGGIGVIVTDQPVDKQKLIDDVRKAFHAAKICSYAQGMNLICAKSIEKGWDLKLVLLIFDIILLASNYDDAICYVETMNLDGETNLKLKQAPKATSKLQEDSNFQNFRAVIKCEDPNAGIAYGRGVTEVERALSRRHESHPGQELKKISESKSSIKGFNFMDERVVVATYPSARGRRVTRGCVFQERNTR

SEQ ID NO: 122763 - protein, 99 aa, Glycine max
  Coding DNA Sequence Number=SeqID_31078
MRVPNDCSFDSLKNRMHNTLQLINDQLVDEIYYRQPFIDAELLCTINRTPDGILNLLQSTIIPTHDAIMYYNEKWNIPHQGGFLGYSFTGTNPIRFDIP

SEQ ID NO: 122764 - protein, 83 aa, Glycine max
  Coding DNA Sequence Number=SeqID_31079
  Gene Ontology: Mol. function=calcium ion binding; Cellular component =plasma membrane; Biological process=abscisic acid mediated signaling
  Homolog annotation: Hit_ID=Q9LTB8; Match level="QueryCoverage=90%, HitCoverage=35%, E-value=1e-27, Identity=78%"; Hit description =Calcineurin B-like protein 9
MGCFHSKSARQFPAQENTVNLAAETAFTVSEVEALFELFRSISSSVVDDGLISKEEFQLAIFKNKKKDNLFANRVLLYTFLSS

SEQ ID NO: 122765 - protein, 215 aa, Glycine max
  Coding DNA Sequence Number=SeqID_31080
MNLEISSPPSDSTQAPEVPTSNVPLSHVSTSEVPQEDETTRRHVKRESTQCWTVEAIDVEETIKKIKVKVRGVNSLPRELRIIVNFDDQGQAIGEAQALLAGFLGTLAADCKLFPMDYDRWSRPSGVPKAYFDDCFETILKPRFYFKINEVGAKWYCKLSIGRKWAANRQSLWNEFNDPTKTRDEIIKNVPIGIDKDQWARFVHYRHKPSTLLII

SEQ ID NO: 122766 - protein, 239 aa, Glycine max
  Coding DNA Sequence Number=SeqID_31081
MKWQTRDIVEDHLLYKPFPQNYVIWDLHGEKQALESSQVEDVFQDSGVQPQNPMEMMINDQFLNIMPKVKRFRNPQKSAPQPQCHGPLTQAPTHSVPTMNLEISSPPSDSTQAPEVPTSNVPLSHVSTSEVPQEDETTRRHVKRESTQCWTVEAIDVEETIKKIKVKVRGVNSLPRELRIIVNFDDQGQAIGEAQALLAGFLGTLAADCKLFPMDYDRWSRPSGVPKAYFDDCFETILK

SEQ ID NO: 122767 - protein, 85 aa, Glycine max
  Coding DNA Sequence Number=SeqID_31082
  Gene Ontology: Mol. function=protein serine/threonine kinase activity; Biological process=protein amino acid phosphorylation
  Homolog annotation: Hit_ID=Q39868; Match level="QueryCoverage=100%, HitCoverage=19%, E-value=2e-24, Identity=70%"; Hit description =Protein kinase
MEERYEPLKELGAGNFGVARLAKDKKTGELVAVKYIERGKKLISAFSTRSLLSELKGLAQIDENVQREIINHRSLRHPNIIRFKE

SEQ ID NO: 122768 - protein, 405 aa, Glycine max
  Coding DNA Sequence Number=SeqID_31083
  Gene Ontology: Mol. function=inositol or phosphatidylinositol phosphatase activity; Cellular component=intracellular; Biological process=abscisic acid mediated signaling
  Homolog annotation: Hit_ID=A7PCE3; Match level="QueryCoverage=100%, HitCoverage=62%, E-value=4e-92, Identity=46%"; Hit description =Chromosome chr2 scaffold_11, whole genome shotgun sequence
MKTRRGKRSEAFWPSLVMKKWLNIKPKVYDFSEDEVDTETESEDDGHGKPVFLNDVQLNLTSYTLYVDFYGANAPCKGYKTRHKRGKSETLRVQYINTKEVRVTIGTWNVAGRAPSKDLDIEDWLCTNEPADIYIIGFQEVVPLSAGNVLGAEDNTPIRKWEAIIRRTLNKSSEPESKHKSYSAPHSPVLRTSASADVLADSVDVNSLDMMNEEYLGTFDSDDLEQEEVKSTSGIGKNLQLRKRHDIDLQTILDWPERPLDATPHTDSSPKLRRVLSSSDRTGFSWTDNASKYAGVMKRSHHSSGNLGLLWKEQKVMPEEVIDTIDDLSDVLLDEEDDDYFEVPNDKEVNGIGMVKSHRKYLRIVSKQMVGIYVSAWVQRRLRRHINNLKVSPVGVGLMGYMGNK

SEQ ID NO: 122769 - protein, 60 aa, Glycine max
  Coding DNA Sequence Number=SeqID_31084
MEKRQQRGLFTVPGLLLAFAHMFFRALSPDSVDNRITAFDWHDRFPDWKAGSERNAINVS

SEQ ID NO: 122770 - protein, 230 aa, Glycine max
  Coding DNA Sequence Number=SeqID_31085
  Gene Ontology: Mol. function=phosphoprotein phosphatase activity
  Homolog annotation: Hit_ID=A5APQ3; Match level="QueryCoverage=45%, HitCoverage=7%, E-value=8e-18, Identity=45%"; Hit description =Putative uncharacterized protein
  Pfam annotation: Domain name=DUF1723; Domain location=2-37; Score =20.6; E_value=0.0019; Accession=PF08330.1; Description=Protein of unknown function (DUF1723)
METETHTFHLPVGECTIALEDVVLQLGIRVNSRPITGATYYDWEEKCEQYLTVVPPKGEAIVGFAIKLNWGSACLATLYKELCRATNLDAKTMGGCASLLQSWAWYRMPFIAARVNRTPSYSLVTSGGVLSFIGTPQGDVIGYRMRLDHMTAKQNPTQFQAKEEKVKAADDSLSETDWLSEIHSLSEASSSLSGWETLEEDKLEICTPSAQPACPVRTLFLLALSAPMLA

SEQ ID NO: 122771 - protein, 176 aa, Glycine max
  Coding DNA Sequence Number=SeqID_31086
MGRFWANRWAIRPYLKKKQAFSLLHFSLPGKLPNFLTSLFHDELGGGGLLLHEPSPPALGPICIREDAGKNGESLVTVAPSGRPIWGSSGTSGRTCSERFLEEGFFRKYWPSGKLPEHLFRKVSGRSGSFGNHFFRKISGRRVLSDDLSVIPEALSGRPLLLESFWKNYFFRKLFF

SEQ ID NO: 122772 - protein, 165 aa, Glycine max
  Coding DNA Sequence Number=SeqID_31087
MGVIHPEKDACMFRLQSNKQHTLRLMIRSDINPKHYVGVNSLPHLESQGVAAYQLNQPMALFKNSLLLVLALSGYRGTLGVSFQREEVSHDMFQRVQLELEGHKDKIVSTASLWSALLMVFSRELLLMIWKKIGSFIVGWMVKGEGKRKKVACSIASANKTNICQ

SEQ ID NO: 122773 - protein, 123 aa, Glycine max
  Coding DNA Sequence Number=SeqID_31088
MSTLNSSPCIEPHTTTSCRPTQIDMTSQHINSGRYTIFNSKLIEHVSHDTDDELDITQGDIVIDYSFDDIATEDFAHTDYDDNLEAPYDNENTGFYIHCANYVVLSFIMFDNVIPCQNFCIYM

SEQ ID NO: 122774 - protein, 129 aa, Glycine max
  Coding DNA Sequence Number=SeqID_31089
MPTKQVTYRNDKVVLVKVYVEKPRKKSSSSIQHHHLHYHIHHTIRQEVVHGSGSKGSYGRRAGLLMYSHLLRESARGASSTPSFSKWVANNNFQPPTQITPSNKKKPEYREKSTCFGSLKLLIPRFLRS

SEQ ID NO: 122775 - protein, 144 aa, Glycine max
  Coding DNA Sequence Number=SeqID_31090
  Gene Ontology: Mol. function=RNA-directed DNA polymerase activity; Cellular component=chromatin; Biological process=chromatin assembly or disassembly
  Homolog annotation: Hit_ID=A5B2I6; Match level="QueryCoverage=72%, HitCoverage=5%, E-value=1e-11, Identity=29%"; Hit description =Putative uncharacterized protein
MIQRLVAAWEKKSPTTNVHTANTSEGNENTAAHDKNWLRNLEMPIFNGEDPMGWLTKIERYLRMCTIREEDKMEAVMVAMDGKALGWFQWFQGYSLGNPFQVLLALEQEETMQGFIGQFEKCVGMVKGLEEPFLVEVLLNGLKE

SEQ ID NO: 122776 - protein, 164 aa, Glycine max
  Coding DNA Sequence Number=SeqID_31091
PYHGNDASFGVGAAKRPRIEGGESELVAGEEAIGAVDSSVEEFMALIGVAVRDEEGNASMGLLSAMLEAVVATSMVSSEPLREWRINGDRRKARVLTGWHWAGLIGLRPSHILTVVIGPNQIAIAPTTIQNSKFTLTHNIRWNYDSAALEGCKNNIQQNQDFIV

SEQ ID NO: 122777 - protein, 251 aa, Glycine max
  Coding DNA Sequence Number=SeqID_31092
  Gene Ontology: Cellular component=extracellular region; Biological process=sexual reproduction
  Homolog annotation: Hit_ID=O23547; Match level="QueryCoverage=89%, HitCoverage=90%, E-value=4e-83, Identity=60%"; Hit description =Expansin-like B1 precursor
  Pfam annotation: Domain name=DPBB_1; Domain location=62-140; Score =53.3; E_value=8.5e-13; Accession=PF03330.9; Description=Rare lipoprotein A (RlpA)-like double-psi be
  Pfam annotation: Domain name=Pollen_allerg_1; Domain location=152 -235; Score=33.5; E_value=7.6e-07; Accession=PF01357.12; Description =Pollen allergen
  Pfam module annotation: Pfam domain module=DPBB_1::Pollen_allerg_1; Domain location=62-140::152-235
MELSFKHHFGLACVLLLLAALCSSQDSFTDSRATYYGSPDCYGNPRGACGFGEYGRTVNDGSVAGVSRLWRNGSGCGACYQARCKIPQYCDENGAYVVVTDYGEGDRTDFIMSPRAFSRLGGNADASAELFKYGVVDIEYRRVPCSYTGYNVVFKVHEHSRNPDYFAVVVLYVDGTYDVTAVELFQEDCQEWKPMRRAFGAMFDYSSPPRGEIYLRFQVSGRAGLYWVQSKNAISSDWKAGATYDTNVQLN

SEQ ID NO: 122778 - protein, 84 aa, Glycine max
  Coding DNA Sequence Number=SeqID_31093
  Subcellular localization annotation: CTP_CleavageSite=58; ConfidenceScore=5.21e-01
MHLRDQGSLLNNKEKNKMKDCKNTSGEDVSFTSRISQSLTNSSQALKSAPASSSGLCRSSHSKISQNSWNLDLSLFRNPRHAKL

SEQ ID NO: 122779 - protein, 371 aa, Glycine max
  Coding DNA Sequence Number=SeqID_31094
  Homolog annotation: Hit_ID=Q9AVH2; Match level="QueryCoverage=48%, HitCoverage=75%, E-value=5e-63, Identity=61%"; Hit description =Putative senescence-associated protein
MTEGCGEGFLPCKPFPVMLFSLWGNFFEAKKQMMADAKFAGLLGLGKPLVEILPPGQLRGFCPLLAWLGSAVLGYGPVLSFGLVGPLLPPVISFVARILPTLACAPLAKSVPRDESKRQGLNLSGSWQQGHSATYNTPSRIKSSAKDLPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQANSPPDNVFRPDRPGEADLGSKKRGSAPLPIHGI

SEQ ID NO: 122780 - protein, 48 aa, Glycine max; identical to SEQ ID NO: 114156
  Coding DNA Sequence Number=SeqID_31095

SEQ ID NO: 122781 - protein, 279 aa, Glycine max
  Coding DNA Sequence Number=SeqID_31096
  Gene Ontology: Mol. function=sequence-specific DNA binding; Cellular component=intracellular; Biological process=regulation of transcription, DNA-dependent
  Homolog annotation: Hit_ID=A6T7U5; Match level="QueryCoverage=98%, HitCoverage=100%, E-value=1e-148, Identity=94%"; Hit description =Negative transcriptional regulator of cel operon
  Pfam annotation: Domain name=Cupin_2; Domain location=26-95; Score =33.5; E_value=7.5e-07; Accession=PF07883.2; Description=Cupin domain
  Pfam annotation: Domain name=HTH_AraC; Domain location=176-223; Score= 10.2; E_value=0.2; Accession=PF00165.14; Description=Bacterial regulatory helix-turn-helix proteins, araC family
  Pfam annotation: Domain name=HTH_AraC; Domain location=229-273; Score= 52.9; E_value=1.1e-12; Accession=PF00165.14; Description=Bacterial regulatory helix-turn-helix proteins, araC family
  Pfam module annotation: Pfam domain module=Cupin_2::HTH_AraC::HTH _AraC; Domain location=26-95::176-223::229-273
MRQPKMMTTEISTAREQQLFNGKNFHVVIYNKTESVSGLHQHDYYEFTIVLTGRYYQEINGKRVLLERGDFVFIPMGSHHQSFYEFGATRILNVGISRRFFEKHYLPLLPFGLVASQVYAVQSAFLSYIESVIASLNFRETEFDEFIELVSFYTINRLRHYREEPVEDVIPHWLKNTVEDMHDKNKFGESALENMVQLSGKTQEYLTRATQRYYGKTPMQIINDIRINFAKKQLEITNYSVTDIAYESGYSSPSLFIKTFKRLTSFTPSSYRKQLTNIN

SEQ ID NO: 122782 - protein, 86 aa, Glycine max
  Coding DNA Sequence Number=SeqID_31097
MVGYTPSSFADLVFAGKRIEAGLKRGKFDHPTLMSEKVGANEEDENEGETLAMATIPTQSNFPSSQQCHYSANNSPSHPIIHKAHP

SEQ ID NO: 122783 - protein, 239 aa, Glycine max
  Coding DNA Sequence Number=SeqID_31098
  Homolog annotation: Hit_ID=Q2HW90; Match level="QueryCoverage=35%, HitCoverage=17%, E-value=3e-09, Identity=38%"; Hit description =Putative uncharacterized protein
MGSVLIPAVNQPTEGPCRLLKNVRWGISLPLDIVSKKGTNSPDPRILSMGTNQTDKRFYQVKVKSPDTTSIKELGRLMEPLQMQAFRKTYGKILELTIAEVPIEAIASLTQYYDQPLRCFTFGDFQLVPTIEEFEEILGCPLGGKKTISFLRVSPLFEQNCDRGQRFSKRFGPCKTNLKRHSGPTTEVPRRQGEGYGKSRRLGPVYGCVSIANLWGRPLSKRGWFGGPSRHRRFPCIPP

SEQ ID NO: 122784 - protein, 90 aa, Glycine max
  Coding DNA Sequence Number=SeqID_31099
MNPRSPQETAVATYPSAGGRRVTRGMRVPRKEYARSRHQRLFEENVGKTGKDEIYELFSEGFGSCIYARGRVFPFAPTYSSIWDEKIRPT

SEQ ID NO: 122785 - protein, 81 aa, Glycine max
  Coding DNA Sequence Number=SeqID_31100
RIQGTNCLRILCPNTLEGTSFVVQVEGTSTWVVILRTREGTSTWLFKENKGGCIPCGSLACKRFYKVERNLKNHWLLGDWM

SEQ ID NO: 122786 - protein, 79 aa, Glycine max
  Coding DNA Sequence Number=SeqID_31101
  Homolog annotation: Hit_ID=A5BXM1; Match level="QueryCoverage=56%, HitCoverage=3%, E-value=1e-08, Identity=68%"; Hit description =Putative uncharacterized protein
MTRGNPSDLQPFDPEIDRTFHRLVRHIVHPGHSVHSVEEDGAKPVRQPQRRLNLVILDVVKKEMTKLLQAGIIYPIFDS

SEQ ID NO: 122787 - protein, 53 aa, Glycine max
  Coding DNA Sequence Number=SeqID_31102
  Subcellular localization annotation: CTP_CleavageSite=18; ConfidenceScore=5.14e-01
MAEPSRNRNGSSSTTTAVGQRRHGTSGDPPAPPNRCFSSQWLLTLFSSNEQHQ

SEQ ID NO: 122788 - protein, 185 aa, Glycine max
  Coding DNA Sequence Number=SeqID_31103
MDNEEGVQEQMKADLSSLKDQMASITEAMLKLQKTIEDNATATASNAAREAESVLQPAINLGRDRNTMVFGRRYSPQAYPYGLPPDFTPRAAPEDLSQAPTFEGQLPPYADYPLQEDDEGDAHLGPLLPLKDPAPHELPQPNIVCHVPSSPIPVKESVPFAEDKRKIDSLEERLRAVEGLSNYPF

SEQ ID NO: 122789 - protein, 82 aa, Glycine max
  Coding DNA Sequence Number=SeqID_31104
  Homolog annotation: Hit_ID=Q2HW78; Match level="QueryCoverage=97%, HitCoverage=15%, E-value=2e-08, Identity=38%"; Hit description=RNA -directed DNA polymerase
MGCLEEHKVPYATFMLQGEAENWWKFVRPTFVAPGGGNMFVGEYTAKFNELLQYWPQYQDARNEEDLCAQFENGLRLEIQTG

SEQ ID NO: 122790 - protein, 164 aa, Glycine max
  Coding DNA Sequence Number=SeqID_31105
MFLCDDDNNNDGDNVSNSDKDKDISGGHDDSDNDNNNIRGGGKSGISGSGGVIEVVLTLVVVMVITKIVLVVVVVVVTLMKVVLLVAVMMTLMVVWWLCGGCDDIGGGCGSGDTNSDGGGSNADGDGNVGSDDNGVDGCSGDNDNVCGDSDDRGSSDDNKKYYC

SEQ ID NO: 122791 - protein, 385 aa, Glycine max
  Coding DNA Sequence Number=SeqID_31106
  Gene Ontology: Mol. function=oxidoreductase activity; Biological process=metabolic process
  Homolog annotation: Hit_ID=A4BL70; Match level="QueryCoverage=92%, HitCoverage=65%, E-value=2e-37, Identity=31%"; Hit description =Putative uncharacterized protein
  Pfam annotation: Domain name=Aldedh; Domain location=1-347; Score= -290.8; E_value=0.016; Accession=PF00171.13; Description=Aldehyde dehydrogenase family
ERKDKLMYADQKSRIRVKGAPKQINPMEKPAGIIAVLGAGNYSSALEVLKAIFFENCAVVHKPHHLNEETDRIWAKIMQPLIDRRVLSFCDADRGQDLTVDPRLSRIYFTGGTATAEAIMSATETPLISECGGNNPCIIVPGDRPWTKKEIEHQAVQIATMAKFNGGANCGRPQTLVTSKHWPQRKEFLDALRVAISDTTPAMGMYYPGADKVVDGFRQAYPDAEVLSPEGGKYPHTDVILLTDVEPGGYATSHEAFSLVLAEVPLDLPANAAHFLPGAVKFANTQLLGTLASAILIDEDSRKAHQKLLEQAVSDLEYGAVAINSMPSFIFLNPYLTWGGNEAGKTFVSGRGNFGNLLNYENVEKSIMEAKFMSPGAHALHQQAS

SEQ ID NO: 122792 - protein, 148 aa, Glycine max
  Coding DNA Sequence Number=SeqID_31107
  Homolog annotation: Hit_ID=Q84VH5; Match level="QueryCoverage=78%, HitCoverage=20%, E-value=3e-11, Identity=41%"; Hit description =Envelope-like protein
MRSPLFTGQSKEEFQQRKRKSTATGGDPCTNWVPTRTCSTVAYIARRSRISDEEPSCQHLSWNIWIAKVKHSEKGNYPLPSQLESLLPIPDGQSLRGHMSQTLSQEEERTAASGAVSKDALIAELKDTCKVLEEIKATTEKKMELESA

SEQ ID NO: 122793 - protein, 71 aa, Glycine max
  Coding DNA Sequence Number=SeqID_31108
EEEPVLQPALNPGRDRNTAVFGRRYSPQAYPYGLPSDLTPHATPEDLSQAPTFEGQLVDAIGFDVLMMIMM

SEQ ID NO: 122794 - protein, 94 aa, Glycine max
  Coding DNA Sequence Number=SeqID_31109
MGDVEEVQEQMKVDMEAMKEKMATMMEAMMSMKKIMEANAVKWWLDRNIEMAITEATGLQMRTRVKMKGRKESLFPARATHKGCESPLIQPGCS

SEQ ID NO: 122795 - protein, 79 aa, Glycine max
  Coding DNA Sequence Number=SeqID_31110
MEKDKAPEWKRMKAQVEKDEGSKAETLSRLLITYQGNPCGIYPDLFSFIGSDVIQISVACIKRSAPTQVRIIWYQSFGS

SEQ ID NO: 122796 - protein, 93 aa, Glycine max
  Coding DNA Sequence Number=SeqID_31111
MGAKHLTRTKEWSHVIKQRMTKLGLCLSSGPPPLDDKRVRITIRMTKLGLCLSSGPTTLDDKRVRITIRYLRVSWVQNDQTWSLLVIGTDDSG

SEQ ID NO: 122797 - protein, 306 aa, Glycine max
  Coding DNA Sequence Number=SeqID_31112
  Homolog annotation: Hit_ID=Q6WAY4; Match level="QueryCoverage=55%, HitCoverage=30%, E-value=4e-20, Identity=33%"; Hit description =Putative uncharacterized protein
MGQLQRQAFRKAYGKIWDLARVEVSMEPIASLSQYYDQPLRCFTFEDFQLVPIVKEFEEILGCPLGGRKPYLFSGFYPSTTRVAKVVKISAQELDRVKQNRNGVVGVPRKCLEERAKALANQGEWAFFYDILALLIFGVVLFPNMEGLVDLAAIDVFLAFHHGKESPVVAILAMYDTKEESGFYLHAKDVPMRGVPSDESITPFIARGFSDHNARDRELRGSSNGIIGGYHKWLRVRTQGLDWLPNLKTVRDDEVKASEESDEVQALKAELERAWVVEEKFKSIAIKAAIVSSSSEEVKDHHGSKA

SEQ ID NO: 122798 - protein, 36 aa, Glycine max
  Coding DNA Sequence Number=SeqID_31113
MAGGLGLQKKKNKWGFKGNGSKTEKQEKEKIKIKEK

SEQ ID NO: 122799 - protein, 148 aa, Glycine max
  Coding DNA Sequence Number=SeqID_31114
  Homolog annotation: Hit_ID=Q51617; Match level="QueryCoverage=25%, HitCoverage=55%, E-value=3e-12, Identity=89%"; Hit description =Putative uncharacterized protein
MTVKTSDTCSSRRRSQLVCKRMPGADKPVRARQRVVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPIHHQYDE

SEQ ID NO: 122800 - protein, 296 aa, Glycine max
  Coding DNA Sequence Number=SeqID_31115
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=100%, E-value=1e-146, Identity=83%"; Hit description =Apocytochrome f precursor
  Pfam annotation: Domain name=Apocytochr_F_C; Domain location=202-296; Score=187.7; E_value=3e-53; Accession=PF01333.10; Description =Apocytochrome F, C-terminal
MQTRNAFSCIKEGITRSISISIMIYIIIRAPISNAYPIFAQQGYENPREATGRIVCANCHLANKPVDIEVPQAVLPDTVFEAVVRIPYDMQVKQVLANGKKGALNVGAVLILPEGFELAPPDRISPEIKEKIGNLSFQNYRPTKKNILVVGPVPGQKYKEITFPILSPDPTTKRDVHFLKYPIYVGGNRGRGQIYLDGSKSNNNVYNATAAGMCIDIIPPGPELLVSEGESIRLDQPLTSNPNVGGFGQADADIVLQDPLRVQGLLYYFGSIILAQIFTVLRKKQFEKVQLSEMNF

SEQ ID NO: 122801 - protein, 75 aa, Glycine max
  Coding DNA Sequence Number=SeqID_31116
MITKDDDKGDDKKLKGQSKNEFKMFKIESRILQESRIKIQEIKVQDSRIKIKIQESREGLIKISMKSFSQKLSST

SEQ ID NO: 122802 - protein, 304 aa, Glycine max
  Coding DNA Sequence Number=SeqID_31117
  Gene Ontology: Mol. function=DNA topoisomerase (ATP-hydrolyzing) activity; Cellular component=chromosome; Biological process=DNA topological change
  Homolog annotation: Hit_ID=Q8YEQ5; Match level="QueryCoverage=100%, HitCoverage=37%, E-value=1e-147, Identity=86%"; Hit description=DNA GYRASE SUBUNIT B
  Pfam annotation: Domain name=DNA_gyraseB_C; Domain location=227-293; Score=131.9; E_value=1.8e-36; Accession=PF00986.12; Description=DNA gyrase B subunit, carboxyl terminus
MTDADVDGAHIRTLLLTFFFRQMPELIERGHIYIAQPPLYKVSRGKSSQYIKNEAAFEDFLIETGLEEATLEMASGEVRAGPDLRSVVEDARTMRQLLGGLHTRYDRRVVEQAAIAGLLNPDASKDNATAQASADIVAKRLDMISEETERGWTAYVTEDGGYRFERMVRGVKDIAVLDMALLGSADARQIDRVAARLSEVFAEPPVLRRKDKVETLSGPMALLDAIFATGRKGLTLQRYKGLGEMNAEQLWETTLDPSNRSLLRVKAEQGDVADGIFEQLMGDEVEPRRDFIQTNALSVANLDV

SEQ ID NO: 122803 - protein, 157 aa, Glycine max
  Coding DNA Sequence Number=SeqID_31118
TYQGNPCGVYPDLSSFIGSGVYPDLSSLTGSGVYPDLSSFTGSGVYHGGDEYHQLDGAQRLLVDAMNAQMQRLLDRTTEENAKRNIDGNRGNPCGVYPDLSSFIGSGVYPDLSSLTGSGVYPDLSSFTGSGVYHDLSSFTGSGVIQTFVACIKRSAP

SEQ ID NO: 122804 - protein, 54 aa, Glycine max
  Coding DNA Sequence Number=SeqID_31119
MTLLLSNILPSDRNANLPLRKYQLVCVVPTWVSYPNFVRGPLLDDMRPFFGPCE

SEQ ID NO: 122805 - protein, 187 aa, Glycine max
  Coding DNA Sequence Number=SeqID_31120
RAPGSQPIKEQSPQRKEACVAAGQLWILSGIWKFASSNRLPRIVMAAQLIHDRVVMECLEGVWETLEGNERCRFRVTIQLTATSLVHPEVPARTLQQPVEWILPTPTPYRLVEPVQVIEVSSSEEDPEEDLEELPPKPTVDDLDLPEDDEDPLPDVDFPEDVLSASEADSTEESGPGGTANSDDSSS

SEQ ID NO: 122806 - protein, 62 aa, Glycine max
  Coding DNA Sequence Number=SeqID_31121
MWSSHVWKHRRTFFADIITSIDTGLFIALLSLPIHCSMTDYLIKCGGKWDKWPILLEGFLFG

SEQ ID NO: 122807 - protein, 32 aa, Glycine max; identical to SEQ ID NO: 98113
  Coding DNA Sequence Number=SeqID_31122

SEQ ID NO: 122808 - protein, 93 aa, Glycine max
  Coding DNA Sequence Number=SeqID_31123
SAEVDVSLSELNALSECHPLRKASTRLADRRNLEGNLPCRHALNASSAHLASRLSPSRLSASLALRKNSLTRAKRENGAKHDVEVSEPLLSLE

SEQ ID NO: 122809 - protein, 351 aa, Glycine max
  Coding DNA Sequence Number=SeqID_31124
  Homolog annotation: Hit_ID=A5BSR3; Match level="QueryCoverage=29%, HitCoverage=33%, E-value=3e-09, Identity=37%"; Hit description =Putative uncharacterized protein
MALTKKTGEMTTEAAKEIAEKIDSFEEQATQGSFVPHGRQDVLAAAIGRPEHPGRVRAAGAGVTIKQYFGLAPRTSRSASSLPPDELQQLTQQIRDQLEESITEKVTRQVMASFSHLQSQMQSQGVVVPPEPVVGLGPSGPRVSTKGSCVDPSGNDPETGDSDRCGLYIEADPARLVTIGRVYEGSTVVHNTPLLPGQVKVSVEEVEMQMLQFLYPLMRFLSGAGTSHLPCLGDTSGQVFITAAVTLAKSPPKSDPEVDDPLYLMTLTIPELFLKPYQVRWDATVFGVFNPDFPLYIKHEDLSDIAHGGQCLSILVLQLWILHLTETCMRVGNSDIYGFLEPQFIQRSGQS

SEQ ID NO: 122810 - protein, 142 aa, Glycine max
  Coding DNA Sequence Number=SeqID_31125
MANNIINSRDNGGTTLEISSIEIKMDHPQGHNNKGLKSTESAIKNLEVQVWQLAKQLADRSSSSFIDNTEKNPKDECKVVMTRSRMAIKGDDSEAGKKMEEHKQQLSSKPTLEPVSDVVELEEINEENEDDKEEETPIKEKE

SEQ ID NO: 122811 - protein, 68 aa, Glycine max
  Coding DNA Sequence Number=SeqID_31126
MTTKGHLRVDWPSFKKRIERSKKKTFNDQKAKKVYITWKDNDMDSSEDSDNEVVNLSLMTKNYDSDEE

SEQ ID NO: 122812 - protein, 206 aa, Glycine max
  Coding DNA Sequence Number=SeqID_31127
MRALRLTDQKIAGTALDSQGERLALDDLMAYRDFCEGKRVPLHQEHSMGEPTLGYIENVRLVQDGSDVESWSVIGDVIVTQGSLPEGLNGFSISFTAPLVEVEHPEFLLYIPYPHYNDATFVAELASNPRMKIGKWIKKSAEATEVAIFGLSVSFLLAPVWDDLYKNDLSPRIKSFIAEGWPKLRSKGMTLEHVQQVIHSGRVVEL

SEQ ID NO: 122813 - protein, 82 aa, Glycine max
  Coding DNA Sequence Number=SeqID_31128
MLICGKRRKNRRKLVETKILSSGVVFTLEEGRQKRAFAPTYPPSKRKSDLRSSFLRVNHTISFYLKGDHLKALDLKNDPFIW

SEQ ID NO: 122814 - protein, 153 aa, Glycine max
  Coding DNA Sequence Number=SeqID_31129
MDNEEGMQEQMKADMSALKDQMAFITKAMLKIQKLIEDNATAAASNTAREAEPVLQPAMNLGRDGSATGFNRRYCPQAYPYGLPPDFTPRIAPDDLSQAPTFEGQLLLHADYPLQEDDEGDAHLGPLLPPREPAPHELPQPNIIRHAPSQSVP

SEQ ID NO: 122815 - protein, 85 aa, Glycine max
  Coding DNA Sequence Number=SeqID_31130
MEATSEIVIDHLQSVEILTMYGNQHHYSKVLFKTDNNELVQQIFSWSDDKGEVLEPTKSSVIMPRTTQVKPQRTLFSKIESKSRF

SEQ ID NO: 122816 - protein, 224 aa, Glycine max
  Coding DNA Sequence Number=SeqID_31131
  Gene Ontology: Mol. function=gluconolactonase activity; Cellular component=cytoplasm; Biological process=regulation of transcription, DNA-dependent
  Homolog annotation: Hit_ID=A6TCK6; Match level="QueryCoverage=86%, HitCoverage=66%, E-value=1e-101, Identity=87%"; Hit description =Putative cytoplasmic protein
  Pfam annotation: Domain name=SGL; Domain location=1-198; Score=210.0; E_value=5.7e-60; Accession=PF08450.3; Description=SMP-30Gluconolaconas eLRE-like region
MLCSAREGRFIVALRSGIWLCDARGLLQRKICDNPSNPDLARFNDGGTDRDGRFYAGTFWGPGDYNGALLVRIDNDLTPNVVQCDIHGANGLAFSDDKRWMYTSDTPNAVIYRTPLDEQGEPGKREVLRRFHPGEGIPDGAAVDEEGCYWSAMFDGWRIARFSPNGEQLEEYRVPVRCPTMVCFGGADMKTLYITTTREIWTPTKWRNIRFPAPSSPCRLRWQG

SEQ ID NO: 122817 - protein, 45 aa, Glycine max
  Coding DNA Sequence Number=SeqID_31132
NQEQVKSSRIKKNSRLKKKAYNQESRFKIQDLKNQDQDSRLKIQE

SEQ ID NO: 122818 - protein, 185 aa, Glycine max
  Coding DNA Sequence Number=SeqID_31133
  Homolog annotation: Hit_ID=Q5NRP4; Match level="QueryCoverage=50%, HitCoverage=6%, E-value=4e-08, Identity=36%"; Hit description =Putative gag-pol polyprotein, identical
  Pfam annotation: Domain name=zf-CCHC; Domain location=92-109; Score =22.8; E_value=0.00053; Accession=PF00098.14; Description=Zinc knuckle
KRKGKKASEANINLSYFHGKDNVEANLVWEIRVEQQLKKKSTSKSYGSHSYPKKDQGQGILGVTPSKPKDGKGNTIEKQAPKASMQEKTSSIKCFKCLGRGHMTSQCPTTKTMIMRGQDIYSSQDEATTSPSYSESEEAKREESSEEIYPQEEGQPLVVKEKCKKTLASIATPLGLEVIPQGPIR

SEQ ID NO: 122819 - protein, 25 aa, Glycine max
  Coding DNA Sequence Number=SeqID_31134
MELTLPNFVWGPLLDDMRPFFGPCE

SEQ ID NO: 122820 - protein, 110 aa, Glycine max
  Coding DNA Sequence Number=SeqID_31135
  Homolog annotation: Hit_ID=A2Q1D6; Match level="QueryCoverage=94%, HitCoverage=23%, E-value=7e-19, Identity=40%"; Hit description =Ovarian tumour, otubain, related
MTKSMVKPRNILLTLKEHNANSCTTIKQIYNARSAFRSSIRGIDIEMQHLMKLLEHNTYKTNRYRLSLLDFVGVTPTGMTFSADFAYVECERANNVVWALQRFRGLFFKA

SEQ ID NO: 122821 - protein, 128 aa, Glycine max
  Coding DNA Sequence Number=SeqID_31136
  Homolog annotation: Hit_ID=A5C8M0; Match level="QueryCoverage=92%, HitCoverage=12%, E-value=2e-09, Identity=31%"; Hit description =Putative uncharacterized protein
LANNQDQPWSRILVSKYGGWKELICGGRRNFTSQWWQDLKSIFQQHHNECLTDNLKWRVGRGSNINFWKHKWMEDNCTLQGKYPQLYLISKQQNSSINYMGDFVEGRWEWKLSWRRTSKCTLISGQPI

SEQ ID NO: 122822 - protein, 42 aa, Glycine max
  Coding DNA Sequence Number=SeqID_31137
MSIWKCSIGVIRLKAQVEKDEGLSGEGQSPRVEKDEGPSGER

SEQ ID NO: 122823 - protein, 68 aa, Glycine max
  Coding DNA Sequence Number=SeqID_31138
MNESAIHWALKKGENGEFHYAITTHGSKLEGGGHMNENAIHGAPKRLRMENYTKQSLSIGPNSKVEDT

SEQ ID NO: 122824 - protein, 67 aa, Glycine max
  Coding DNA Sequence Number=SeqID_31139
MGVQIAPRPIWALQKKIYAEALPKRFRNVFSEESRKGLNRSSTFFIRSSSFFDLQRAKINSPSQARP

SEQ ID NO: 122825 - protein, 161 aa, Glycine max
  Coding DNA Sequence Number=SeqID_31140
MEVQLSKKPSELRKDLRNVDQGEVSKPLASLHTYYGPAFEMLARIREDFQLALPREPIEAIEAKIGCSARKSTGTIPFRSEPLWGEGYGKSRSSWVPFMDVLALLIFGVVLFPNVDGLVDLAAIDAFLAYHHSKESPVVGFTPVPARHEASMSAPEPSLVY

SEQ ID NO: 122826 - protein, 85 aa, Glycine max
  Coding DNA Sequence Number=SeqID_31141
MSLATLFGKLQEHEMELMRLHQHEENDIKRKGIALIASSSFIQEESDKEDLTEIEEDDDDFRFFVKRRMEKFDKRNLKEKKEKKA

SEQ ID NO: 122827 - protein, 75 aa, Glycine max
  Coding DNA Sequence Number=SeqID_31142
MPFLSLIFIFSLLLSKTLSFSRSPQNLSQKNDDPGLIHRWIVAKFEYHVRNPISRIFTVGNCKIMSELRGKPFAL

SEQ ID NO: 122828 - protein, 101 aa, Glycine max
  Coding DNA Sequence Number=SeqID_31143
  Homolog annotation: Hit_ID=Q51617; Match level="QueryCoverage=38%, HitCoverage=56%, E-value=5e-13, Identity=92%"; Hit description =Putative uncharacterized protein
MTVQTSDTCSSRRRSQLVCKRMPGADKPVRARQRVLAGVRGWLNYAASEQIVLRVHHMRLRNCWEGRSVRALFAITPAGERGMCCKAIKLGYARVFPVTTL

SEQ ID NO: 122829 - protein, 97 aa, Glycine max
  Coding DNA Sequence Number=SeqID_31144
  Homolog annotation: Hit_ID=Q2AA10; Match level="QueryCoverage=79%, HitCoverage=20%, E-value=2e-10, Identity=42%"; Hit description =Putative uncharacterized protein
MPLSMCRRLGELEIMPTRMTLQLADRSIRRPYGVIEDVLVSCVVDMGKKKLEMGIEDQKVIFELFDEERKLLDQNVCLEVKESEEKVLKERTKLDPG

SEQ ID NO: 122830 - protein, 136 aa, Glycine max
  Coding DNA Sequence Number=SeqID_31145
  Homolog annotation: Hit_ID=Q51617; Match level="QueryCoverage=29%, HitCoverage=57%, E-value=3e-13, Identity=87%"; Hit description =Putative uncharacterized protein
  Subcellular localization annotation: CTP_CleavageSite=77; ConfidenceScore=5.09e-01
MTVKTSDTCSSRRRSQLVCKRMPGADKPVRARQRLLTGIGPGLTMRHQSRLCVRRKYRIRRHSPFRLRNCWEGRSVRASSLLRQLAKGGCAARRLSWVTPGFSQSRRCKTTASAKLACLQVDSRGSPVFTMSIGLK

SEQ ID NO: 122831 - protein, 81 aa, Glycine max
  Coding DNA Sequence Number=SeqID_31146
  Homolog annotation: Hit_ID=UPI0000ECBAF8; Match level="QueryCoverage =50%, HitCoverage=48%, E-value=1e-16, Identity=100%"; Hit description= UPI0000ECBAF8 related cluster
MESPSFLGALFFYPRSSKEMFHMSGDGSCMQAWHWPSFYNVVTGKTLALPNLIALQHIPLSPAGVIAKRPAPIALPNSCAA

SEQ ID NO: 122832 - protein, 96 aa, Glycine max
  Coding DNA Sequence Number=SeqID_31147
EAAAREKCGIIDVAIVKEFYANLYNMEDKSPRQVRVRGHLVKFDEDTLNTFLKTPVIIQEGETLSAYSRFALWRPDPQELAAKLCIPGRGFELNVD

SEQ ID NO: 122833 - protein, 246 aa, Glycine max
  Coding DNA Sequence Number=SeqID_31148
  Gene Ontology: Mol. function=hydrolase activity, acting on glycosyl bonds; Cellular component=cytoplasm; Biological process=metabolic process
  Homolog annotation: Hit_ID=A0KDF5; Match level="QueryCoverage=49%, HitCoverage=65%, E-value=2e-31, Identity=58%"; Hit description =Intracellular protease, PfpI family
  Pfam annotation: Domain name=DJ-1_PfpI; Domain location=157-246; Score=-9.7; E_value=0.018; Accession=PF01965.15; Description=DJ -1PfpI family
QVVLHPAPDAGQLQAERAQALVFVGVAQPCPGGVVAILLAATRIASGRLQMAMRQWADPDIFVRRRDRQGADARQFGRAGDAPAMRIQVMEGRAVDPHPGIAGPGVVHIDQRVIGAALGRRGAATLQDFNVAILVMDGFEEVELTDPRDALRAQGARTVIVSARHGDVQGMRHHDKGERAQVDLTFAQARAEADRFDAVLLPGGVVNADEIRLHPDARELVRALHEAGKPVAVICHGAWLLISEGL

SEQ ID NO: 122834 - protein, 266 aa, Glycine max
  Coding DNA Sequence Number=SeqID_31149
  Homolog annotation: Hit_ID=A5BPP1; Match level="QueryCoverage=71%, HitCoverage=10%, E-value=3e-21, Identity=37%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARDVYAHFHAIKRNGGYTGEPDSPLNKTGLKQLNDLYIPGEQENLPKFARRGLNFFETREESNEQNSGSNNTLSESKRVTKDETVILALKKAIAKLEDEKEAGLLQYQQSLEKMSNLELEYRARIRNHGHSCFLRETCRASCINESANARGEAVCVLGALPLPRSLTRCARSFGCGERYQLTQR

SEQ ID NO: 122835 - protein, 98 aa, Glycine max
  Coding DNA Sequence Number=SeqID_31150
MGEKTGAEVKENDVNGKKNQEKGKKIMVQNKEMENQEKEKEGEKEIENEKNEKEEKKRFQRRVEVERLWTKVWKYHILWKLEITMPFGEALQQMLWRP

SEQ ID NO: 122836 - protein, 155 aa, Glycine max
  Coding DNA Sequence Number=SeqID_31151
  Homolog annotation: Hit_ID=UPI00016621D1; Match level="QueryCoverage =94%, HitCoverage=42%, E-value=5e-12, Identity=36%"; Hit description =UPI00016621D1 related cluster
MRGTVHEPQVNLGADQNTLTFRGLHVLTFRGLHVLTIRGLHVLTIRGLHVLTFRGLHVLAVRGLQVLTIRGLHVLTFSGLHVLPVKGLHVLTFRGLHVLAFRGLHVLAFRGQHILAIRGLHVPTFKGLHALTFRGQHVLAIIGLHSLAFQKATRP

SEQ ID NO: 122837 - protein, 151 aa, Glycine max
  Coding DNA Sequence Number=SeqID_31152
  Homolog annotation: Hit_ID=UPI0000ECBAF8; Match level="QueryCoverage =27%, HitCoverage=48%, E-value=1e-16, Identity=100%"; Hit description= UPI0000ECBAF8 related cluster
  Subcellular localization annotation: CTP_CleavageSite=67; ConfidenceScore=5.06e-01
NAAFLRFLALCWPFAHMFFPALSPDSVDNRITAFEKRKSAQYANRLSPRVGRFINAAGTTGFPTGKRAVSATQLIYDHDYEFELGTHEKALVSDERRSGMQAWHWPSFYNVVTGKTLALPNLIALQHIPLSPAGVIAKRPAPIALPNSCAA

SEQ ID NO: 122838 - protein, 100 aa, Glycine max
  Coding DNA Sequence Number=SeqID_31153
MTSKIILMMPKNNESSKFQESRFKNNQDQDSRFKAYIYLGCYTENKRGYISCGSVQVEHTSTWLFKENKGRYIPCGSLLVKDFTRLLEISRTGGCFGDWM

SEQ ID NO: 122839 - protein, 195 aa, Glycine max
  Coding DNA Sequence Number=SeqID_31154
MPGADKPVRARQRVFDGFRVWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPSYRGFSPDLLMYPFTIAWEVSSMAMVVLVLVLLPAVDVVRPTLHHHVLMQSHVAIVPRDLRQRQYIPCEPSEKKQ

SEQ ID NO: 122840 - protein, 47 aa, Glycine max
  Coding DNA Sequence Number=SeqID_31155
MGDLEEVQEQMKADILPPNYTPPAIHEDVGHIPPLILEGEPPRHPDE

SEQ ID NO: 122841 - protein, 89 aa, Glycine max
  Coding DNA Sequence Number=SeqID_31156
  Subcellular localization annotation: CTP_CleavageSite=42; ConfidenceScore=5.25e-01
MTAWSGIYSTWFASRRPTTGGSLSQQSQGFAPFACPTPDQFRAKVAWPGDWPEAQAEEALAEAPSDAEEACMDEEMTDLLGFLGGSGAT

SEQ ID NO: 122842 - protein, 169 aa, Glycine max
  Coding DNA Sequence Number=SeqID_31157
  Homolog annotation: Hit_ID=Q2HSV3; Match level="QueryCoverage=78%, HitCoverage=20%, E-value=2e-13, Identity=34%"; Hit description=IMP dehydrogenase/GMP reductase, putative
MTYRQRLDRLRILDVCWMSHAKHRPVQDFHPISCFSGQIRWGPVVVRYRPKRVMRQFGYVQCIPAHPVHSWVSYDDMGDTWTHYSDHLAIAGDLCVVPGQCAPNYIDWFFVISHPFMTAPLTNPPRDAYATQPSHIPHEATPASTHADLDADEPRHAVEACHAIVDALE

SEQ ID NO: 122843 - protein, 37 aa, Glycine max
  Coding DNA Sequence Number=SeqID_31158
MHGVRIMVMTRGLGRALGQVTSRGVGRGEHDDSDDAP

SEQ ID NO: 122844 - protein, 177 aa, Glycine max
  Coding DNA Sequence Number=SeqID_31159
  Homolog annotation: Hit_ID=A5AWV0; Match level="QueryCoverage=75%, HitCoverage=9%, E-value=1e-09, Identity=29%"; Hit description =Putative uncharacterized protein
HLTETSMRAGNSYIYGFLEPQSIQRSGQSQFESESYIKTWMQSSKHDVYLGAYLNGGHWQMVVIVPKEHLVVWFCSLHNRPDNYLKGIINSALKGFDDAPQPKSKAPARWIVVKTKGSTECGYYVMHWMSTIILGSFRNNWEAYFNDPRPLEPERLKVLWMQWAQYYLRVRDQTPRI

SEQ ID NO: 122845 - protein, 93 aa, Glycine max
  Coding DNA Sequence Number=SeqID_31160
MAMIFQHGLTAIAEARSDASASGRHAACYAGVPSAWRLPDDCLQNELRSWTRRPDVVFENREHLQEDEASFDGRAEGLVPVTTLVGAEGDLHG

SEQ ID NO: 122846 - protein, 53 aa, Glycine max
  Coding DNA Sequence Number=SeqID_31161
MQTSQGGDLSPEPWLGDFRKIGPRMQEKALGFLSYPNFVRGPLLDDMRPLFGP

SEQ ID NO: 122847 - protein, 128 aa, Glycine max
  Coding DNA Sequence Number=SeqID_31162
MEGLVDLAVIDAFLAFHHGKESPIVAILAMYDTFDRRCEKSGARIVCCTPALYVWLVSHLFLQEGRPVYPLQGHRSCVEKRKGELGPTLGYPMRGVPSDESITPFIARGFSDHNARVLQGVRKAWDAA

SEQ ID NO: 122848 - protein, 212 aa, Glycine max
  Coding DNA Sequence Number=SeqID_31163
  Homolog annotation: Hit_ID=A4DID9; Match level="QueryCoverage=25%, HitCoverage=49%, E-value=4e-19, Identity=80%"; Hit description =Putative uncharacterized protein
EPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPDREGRTSGVPVIVPTVNAGASGSTAETAMGSLPQRGWSERSFGNS

SEQ ID NO: 122849 - protein, 456 aa, Glycine max
  Coding DNA Sequence Number=SeqID_31164
  Homolog annotation: Hit_ID=Q6WAY6; Match level="QueryCoverage=65%, HitCoverage=50%, E-value=5e-31, Identity=31%"; Hit description =Putative uncharacterized protein
MVPTIEEFEEILGCPLGGRKLYLFSGFLPSLSKVAAVIGDSVKELDRTKQTRNGIVGLPRKYLEDKARDMASQEKWGPFADVLALLIFGVVLFPNIDGLVDLAAIDAFLAYHHSKESPVVAILADLFDTFDRRCEKNSARVVCCLPALCVWLTSHLFRQDTRHPCPLQSYRSCAEKGRVVWDQHLAGIGGSTINWFPRWKEGKEGVLFSCGDYPNVPLIGTRGCINYNPALAIRQLGYPMRGAPTEESLSPFLVRNLCAQSLNAIQRVHNAWRSPLRKDKELRGIRNGVIGGYHGWLRIHTRGLDWLSKLKVINEEKFEAPEEDEEVRALKLELGKARLAKEKFKSAATHIRKECTELQEENAATARALEQETKRARKEEYGREKFRGALWGSNNELKLRREERDRSRVHGMILKEELVACARSKRSLAQHLEATRAKHASYHRAIQGRIEPVHGP

SEQ ID NO: 122850 - protein, 107 aa, Glycine max
  Coding DNA Sequence Number=SeqID_31165
  Homolog annotation: Hit_ID=Q1RSH0; Match level="QueryCoverage=69%, HitCoverage=36%, E-value=5e-08, Identity=39%"; Hit description=H+ -transporting two-sector ATPase, alpha/beta subunit, central region, related
MMGNFTATGWEWNFKWRRQLFDDEMEMAVKFLQDLEDISIHPDREDKWIWKEDASGVYSAGSEYKKLMSAQTDEIRMVFLLSYGRSRLLAKLRSSRGDYSGIDYQQK

SEQ ID NO: 122851 - protein, 238 aa, Glycine max
  Coding DNA Sequence Number=SeqID_31166
  Gene Ontology: Mol. function=binding
  Homolog annotation: Hit_ID=A4CRK1; Match level="QueryCoverage=42%, HitCoverage=45%, E-value=9e-12, Identity=41%"; Hit description =Putative uncharacterized protein
MARIKRVIMHLNDVERQPGVIKQMQVPEGFRLGGWVYVLSNPSMPRMFKIGMTTNNPKARAKEISSATGVPTPFQIEASFHCDNPAKSEAAIHKALSEWRVSESREFFSLDLEEILYCCEEHCQGRADMAVEDMAFEYNIICFEKLTELNVSALFDELGLTTFGSKLAIAERLIRFGYEITYNRLIQNNLSLVLIDEKAIPIMSAEQQQFEEEERQVAEYYQKREEGGICGPYIPVDI

SEQ ID NO: 122852 - protein, 277 aa, Glycine max
  Coding DNA Sequence Number=SeqID_31167
  Homolog annotation: Hit_ID=A6TAY6; Match level="QueryCoverage=98%, HitCoverage=51%, E-value=2e-65, Identity=48%"; Hit description =Putative uncharacterized protein yoaD
MQNAQKVISTYRRKRILVCLAVAFLTLAVTLTIRFISQRSQNQQRIQTVTRNMVIAMDNILQPLAAKHATLLSMVGKPCQDVHLELRKTAATLQTVRSIILVQSGMAYCSSIFGPRHVAIHQLQPTLPAVNPLLAFSTDNSLLKGTPVLIQWYPSSVSGADGALLIINIELLGELILKEKSSLISDISLTVGNKSFLSDVGVVASDRLPGLPIIYRQSSSQFPFTINISGPGASAVALEELPAELPLALMFSLLMTGIAWLTTAGRMTFSREISGIL

SEQ ID NO: 122853 - protein, 132 aa, Glycine max
  Coding DNA Sequence Number=SeqID_31168
GHLVIVSGEEEILATLPVRYDIDGSPGDVGEWLRARNGFRQEQRQQNQPDKHQRKPWEVWGGPPCHISRSFISTGLGHESQVVAICEDDSPSGSDLVRPCPPGFRLGNWRVEERPNIYATSIMQPFVAFKLY

SEQ ID NO: 122854 - protein, 54 aa, Glycine max
  Coding DNA Sequence Number=SeqID_31169
MDPIKTAQNDAWTDSTLRCNVGTVLSLTRPPGCARNSPPPIGDQPGSPKVFPTR

SEQ ID NO: 122855 - protein, 202 aa, Glycine max
  Coding DNA Sequence Number=SeqID_31170
  Homolog annotation: Hit_ID=A4WAX4; Match level="QueryCoverage=99%, HitCoverage=60%, E-value=1e-88, Identity=79%"; Hit description =Putative oxidoreductase
MEQRRFSGKGHWYHETQSNHAQSDALPLVPEAANVDDRFLLDLALPDEIVAACTGWLAPARALCHQLFPLSLPVNRLRTLSAYDRLSTALTVAQACGVQRLCNHYAALLAPLPGPDSSRESNRRLAQITQYARQLASSPDVIDDKARNQLDEVGLSTYDIVVINQIIGLIGFQARVVAVFQALLGHPVRWLPGHHIQPNALP

SEQ ID NO: 122856 - protein, 113 aa, Glycine max
  Coding DNA Sequence Number=SeqID_31171
MVDTLPVFYYEKLVGYMSSSFADLVFAGERIEVGLKRRKFDYVSSTSANAKRIGATGAKRKEGDAHAVTSAPAWIKPPQTSHGTHQYVQHHPSFSAHAGNSSNLAPVQPKAPV

SEQ ID NO: 122857 - protein, 86 aa, Glycine max
  Coding DNA Sequence Number=SeqID_31172
MLFGSAYFHGHDLEKPRGGCIHSKVACCAICGGAHESGCCIPTEDHAHEVNYMGNQPRQILMQVDSQDFSRAKIITSSMDSASSSW

SEQ ID NO: 122858 - protein, 310 aa, Glycine max
  Coding DNA Sequence Number=SeqID_31173
  Homolog annotation: Hit_ID=Q84VH5; Match level="QueryCoverage=100%, HitCoverage=48%, E-value=1e-103, Identity=65%"; Hit description =Envelope-like protein
MATSPKETSASGSPSVPSSPHQEQPEFNIQPIQIIPGQAPVPEKLVPKRQQGVKISENPSLATSPREVDTEMDKKIRSIVSSILKNASVPDADEDVPTSSTPNVSVLMLIKMFQHLPLQMLKSSLHPAKRTQQRKRIKPQRRPLHQGHQNLLQEPIANKLAPGIAERLQSRKGKTPITRSGRIKTMAQKKSTPITPTTSRWSKVAIPSKKRKEISSSDSDDDVELDVPDIKRAKKSGKKVPGNVPDAPLDNISFHSIGNVERWKFVYQRRLALERELGRDALDCKEIMDLIKAAGLLKTVTKLGDCYESL

SEQ ID NO: 122859 - protein, 69 aa, Glycine max
  Coding DNA Sequence Number=SeqID_31174
MPLKTQIKEKGGSWYWISGCRNHMANYSALFSKALMSLSKKDSTGNGSVVESKGEGLLVIGAEAVYTHP

SEQ ID NO: 122860 - protein, 57 aa, Glycine max
  Coding DNA Sequence Number=SeqID_31175
MGVKYLKVVKRGSHAIKQWSPDEIRDDPSLKEHAQLILLPDSSSRLAEDYCAQRLAR

SEQ ID NO: 122861 - protein, 221 aa, Glycine max
  Coding DNA Sequence Number=SeqID_31176
  Gene Ontology: Mol. function=protein dimerization activity
  Homolog annotation: Hit_ID=A7QEL4; Match level="QueryCoverage=70%, HitCoverage=77%, E-value=8e-09, Identity=27%"; Hit description =Chromosome chr17 scaffold_85, whole genome shotgun sequence
  Pfam annotation: Domain name=zf-C2HC_plant; Domain location=42-96; Score=76.7; E_value=7.8e-20; Accession=PF07567.3; Description =Protein of unknown function, DUF1544
  Subcellular localization annotation: CTP_CleavageSite=59; ConfidenceScore=5.58e-01
MDMSRSGTRSNSSDANTGTTTSATTSLGSRPRSKNSLGNRTDIGWKHGTNVLGNGKKFKCNYCSKINNGGIFRFKHHFAGTRWDSEPCSSVPEEVKMFMMKFVAEVANASEKRRKLNNTHEEGVHTEGMETNTTQSGIEGKWMFAFKGRGKEKFVQASGEGVQATLNQLYKKGNKDKVDDQCNEFWYCHTLISSGDLCLVACNLCLLILRLIEAVPESNKH

SEQ ID NO: 122862 - protein, 143 aa, Glycine max
  Coding DNA Sequence Number=SeqID_31177
MTDFFGIDFYTPNSATSYLATLLQFDSPHSFGEQGQSSSTATTNIETTNIELQHHHDVEEPFILERRNPQRNRRPPPCGTGHRLGYFDEAKESRVKQSFKQRFKNQVSSFKFQDSRFKNQESGIIKIKIQDSRFKNQEKTQSR

SEQ ID NO: 122863 - protein, 114 aa, Glycine max
  Coding DNA Sequence Number=SeqID_31178
MKDKRDEEEKLENQKKKKDSKALSLKAKGKENEEKDSSKKTVKNENHFAIKGDIKRALLLKQSFYLLVSRETSLSTAIPLGLEVIPQVKELLDKGLVHKSLNPCALLVSQIGTL

SEQ ID NO: 122864 - protein, 98 aa, Glycine max
  Coding DNA Sequence Number=SeqID_31179
AKSLALLSLEDQAQFSLRVSMIWLSIGPSSTWRISWLKWPGKKSSLLLWGKVTLLQPRMMQSYPPRALDRRLQEDWAKDAREGPRVLMSLRVDFGPMG

SEQ ID NO: 122865 - protein, 102 aa, Glycine max
  Coding DNA Sequence Number=SeqID_31180
  Homolog annotation: Hit_ID=Q84VH6; Match level="QueryCoverage=24%, HitCoverage=1%, E-value=2e-07, Identity=92%"; Hit description=Gag -pol polyprotein
MEKEGGPVNRPPILDGSNYEYWKAKNGGLPHHWIAEPGKCCCLERMKLETREDLDLILSLLANTTIEDQEFVPAKNRTGATMSQHRSRHHGMQLLSDRLKKE

SEQ ID NO: 122866 - protein, 299 aa, Glycine max
  Coding DNA Sequence Number=SeqID_31181
KIKSLEVTSLRKLGQLMGQLQRQAFRKAYGLLASADLKEFEEILGCPLGGRKPYLFSGFYPSTTRVAKVVKTSAQELDRVKQNRNGVVGVPRKCLEERAKALANQVVLFPNMEGLVDLAAIDAFLAFHHGKESPVVAIFGHEGRIRILSSCEGCPMRGVPSDESITPFIARGFSDHNARDIKLRGSSNGIIGGYHKWLRVQTQGLDWLPNLKTVRDDEVKASEESDEVQALKAELERAWVVEEKFKVAIVSSSSEEVKGIITGQRHDLEGRAKGNMWAIIDKCKEKLNLAATHEQRLED

SEQ ID NO: 122867 - protein, 143 aa, Glycine max
  Coding DNA Sequence Number=SeqID_31182
  Subcellular localization annotation: CTP_CleavageSite=35; ConfidenceScore=5.51e-01
MVKVGTSYVPINVSFSPKSWPRASRYLFGAKVLPVASVSISCPLPVQLLTGVVRNGKKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 122868 - protein, 128 aa, Glycine max
  Coding DNA Sequence Number=SeqID_31183
  Homolog annotation: Hit_ID=Q2HW90; Match level="QueryCoverage=63%, HitCoverage=16%, E-value=9e-09, Identity=37%"; Hit description =Putative uncharacterized protein
MGTNQTGIRFYQVKIKGLDITSIKKLGRLRGPLQMQAFRKAYGKILDLTIAEISTEVIVSVTQYYDQPLRCFTFGDFQLVPTVEEFEEILGCPLGVSARGIGSCKAKSKRCSGPTTEVLRRQGKGYGE

SEQ ID NO: 122869 - protein, 96 aa, Glycine max
  Coding DNA Sequence Number=SeqID_31184
PESLVIAGQPYVGEFVPGPLYTPPVTLWELAMPEVVTLTARRGMPKAGLVTGVKSKERDGVSLAFGIAGPGGRPARRAISSVVERAPDNCVVVPGL

SEQ ID NO: 122870 - protein, 206 aa, Glycine max
  Coding DNA Sequence Number=SeqID_31185
  Homolog annotation: Hit_ID=A5C169; Match level="QueryCoverage=73%, HitCoverage=13%, E-value=4e-07, Identity=28%"; Hit description =Putative uncharacterized protein
MVIDQSLFYDFTKLPSEGVPFEGALIDEWKFDFSVHDARWLVCTNQADMTGRLLAGSLAFESRILHYLIVRILLPRSSNLAQVSEEDLIVMWAFHKGLQIDWAHLVRYHMHKALRLNAPLPYPHLVTLFLQHFNIPLDSEPYVPIKRSFLIGASVIASFGYIKEHDGSWVKKGARNIGEEGHEGEDSSLLSKILERFDGLQTFVGE

SEQ ID NO: 122871 - protein, 394 aa, Glycine max
  Coding DNA Sequence Number=SeqID_31186
KLSAFPNGNGRQFSGLSDSWSRDNTAGFHADFSDSYVNHLSDFVNCFTFNLHGATFLATDQFVTNGMQEWGRDKGDSTVIHQTDTHPAAADINNLRSEAGVGSGFILQETRVQPVSNVTFRHAVQTATFCHLHGRVVLRACNRFAFDNRFQQTVVNHVAIFTNWGCPGGVSFQTEAEVRAWFGADFSEGLEAANTAIKETGWLCVQLAAKLAESWQRQDFFRINMHIVILQQGRQRFGIGRIESGVNVVNTKAQLVAQHACGANVGGNHRFFDDAVSNASRLGHDIQHFAFLTENKTVIRTIFEHQGVGCTPFATLQANTVQQTNLRCNGIGFRFPAAGVFQPVRDIVIGQLGFGFDGGGKEFDIVFNRPIRGDGHAAGESRAHFIWAQRAEIV

SEQ ID NO: 122872 - protein, 121 aa, Glycine max
  Coding DNA Sequence Number=SeqID_31187
MAHNQGWEQELGLYNQYEEERTSNLERGQELQPYYQNVAERGSNLNKLLMQFMETAKSTQQALQSVEIQVGELADVVTQFMSRREKSFVEAEAQEKSPIKEHESREKDEEKDEEQAQQQWD

SEQ ID NO: 122873 - protein, 111 aa, Glycine max
  Coding DNA Sequence Number=SeqID_31188
  Subcellular localization annotation: CTP_CleavageSite=44; ConfidenceScore=5.59e-01
MATQLNQAQSQNSDKLPSQTVQNPKNVSVVTLRSGNQIQAPPPVAAPAPEPVKLPSTPDKEDEIVAQKRKLPNKNFHVGEPSSSNSDLPQPHIPLPFPPRAIPNKKMEEAE

SEQ ID NO: 122874 - protein, 191 aa, Glycine max
  Coding DNA Sequence Number=SeqID_31189
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=15%, E-value=3e-99, Identity=89%"; Hit description=NBS -LRR type disease resistance protein Rps1-k-1
MPRGMSKLNHLQHLDFFVVGKHEENGIKELGGLSNLRGQLEIRNLENVSQSDEALEARIIDKKHINDLWLEWSGCNNNSTNFQLEIDVLCKLQPHFNIESLQIEGYKGTRFPDWMGNSSYCNMTRLTLSDCDNCSMLPSLGQLPSLKVLEISGLNRLKTIDAGFYKNEDCRSGTPFPSLESLVIFEMPCWE

SEQ ID NO: 122875 - protein, 55 aa, Glycine max
  Coding DNA Sequence Number=SeqID_31190
MARSVFALCPYLGVVFTLQEGISTSYVDKSGAFAPTYPPLKRKSDLRSSFLCVKQ

SEQ ID NO: 122876 - protein, 82 aa, Glycine max
  Coding DNA Sequence Number=SeqID_31191
  Subcellular localization annotation: CTP_CleavageSite=37; ConfidenceScore=5.14e-01
MRNTIFTLSSSPNATQTLTPPSSPPMTFGGCHELPLLAAKPPHQEEHFNRSRILRILLKDSVEKIPPILHFKASLRVFLHFL

SEQ ID NO: 122877 - protein, 90 aa, Glycine max
  Coding DNA Sequence Number=SeqID_31192
MEWIKRMKKVVGRITPPELVSRTRWCSLINQFLESLKIKTQKHVEKCLALGQPRVTQSYPRRALDRRLQEDWAKDAREGPRVLMSLRVDF

SEQ ID NO: 122878 - protein, 43 aa, Glycine max
  Coding DNA Sequence Number=SeqID_31193
ESLPPVAYCSTPGLDQTYLHEVAKEKKHRLLTMLECDEHDARP

SEQ ID NO: 122879 - protein, 52 aa, Glycine max
  Coding DNA Sequence Number=SeqID_31194
MEEAEKEILETFRKVESTDVVIHLANRSVAYPAGFLEDVLVRVGELIFPVDF

SEQ ID NO: 122880 - protein, 163 aa, Glycine max
  Coding DNA Sequence Number=SeqID_31195
MGAKYLEVVKQRLHAINNDPRAKLGGLVICGRARPLPLAYIRLRLPLVFRPCRGWHLIPNTYNGRVLPSVGPLHGIFPWYCFITFVRDGCRRLFYEGLEALGPLSGSVPGEMDHQRLRLTWVSITRLHGYLPFILLCVTDFNMPPTYHSLQQLLNYWACFHIM

SEQ ID NO: 122881 - protein, 105 aa, Glycine max
  Coding DNA Sequence Number=SeqID_31196
MTATATKSISLKPLGRDDTVRRHLVEEIPIVVPRHAVKPLATVTLESTDQRNRSLDTHIVLARTHKSPYIAGKPTLSSLEPTEPPTLFAKSGSKKTQHTLLLLGC

SEQ ID NO: 122882 - protein, 245 aa, Glycine max
  Coding DNA Sequence Number=SeqID_31197
MYTGAGFARTLAGIRVRIMRTNMTTLTQIWMTLLLSNIQPSDHNSDLPLPKCQLVYAILTRMSIHVAQLIADAIYLFAGMAPTRHPLDPDKSNRDLGFPALITGLCQSFGVPVAPNKVRQAQGDASQGADTPPPHQAGPAGSFDTEQYLRHLVRQQAANHRAHVQTHNCLYQLSLSLQSQGFTSFPCPTPNQFRAEVAWPGDWPETRAGEAPAEAPAEAPDEADEAREDEEMTDLLDFLGGSGAT

SEQ ID NO: 122883 - protein, 161 aa, Glycine max
  Coding DNA Sequence Number=SeqID_31198
MDNEEGVQEQMKVDLSALKDQMASITEATSNTAKEAESVLQPAINLGRDRNTMSFNRRYSPQAYPYGLPPDFTPHTAPDDLSQAPTFEGQLPPHADYPLQEDDEGDAHLGPLLPLKEPGPHELPQTNIVCHVLSPSAPVKELVPFAKDQGKIDLLEERLRA

SEQ ID NO: 122884 - protein, 138 aa, Glycine max
  Coding DNA Sequence Number=SeqID_31199
  Homolog annotation: Hit_ID=A0ST23; Match level="QueryCoverage=23%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSSENFLIISTDLSEVGKPVVPAALMNRPTRGERRFAYWALFRFLAH

SEQ ID NO: 122885 - protein, 395 aa, Glycine max
  Coding DNA Sequence Number=SeqID_31200
  Homolog annotation: Hit_ID=Q84VI1; Match level="QueryCoverage=100%, HitCoverage=63%, E-value=1e-102, Identity=85%"; Hit description =Envelope-like protein
MATSPKETSAPGSPSAPSNQERPEFNIQPIQVIPGQAPVPEKLVPKRQQGVKISENPSPATSPREVDPEMDKKIRSIMFQHPPPRMFLCLMLIKMFQHPPLQMLKPSLHPVKRNQQKKKIKPQRRPLHQGHQNLLQVTSLTLKRKVTKQKREDPHQEVWTNQNYCPEEEHSNHSYHIQKEQGCNPLQEEERISSSDSDDDVELDVSTSKRAKKSGRKVPGNVRDAPLDNISFHSIGNVEKWKYVYQRRLAVERELGRDALDCKETMDLIKAAGLLKTVTKLGDCYEGLVREFIVNIPSDITNRKSDEYQKVFVRGKCVRFSPAVINKYLGRPTDGVVDIAVSEHQIAKEITAKQVQHWPKKGKLSAGKLSVKYAILHRIGAANWVPTNHTSTVAT

SEQ ID NO: 122886 - protein, 173 aa, Glycine max
  Coding DNA Sequence Number=SeqID_31201
  Homolog annotation: Hit_ID=Q5QJQ3; Match level="QueryCoverage=17%, HitCoverage=24%, E-value=3e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTP

SEQ ID NO: 122887 - protein, 59 aa, Glycine max
  Coding DNA Sequence Number=SeqID_31202
MRKRHASRREKGRTGGRSLWKNASNAAFLRFLAFCWPFAHMFFPALSPDSVDNRITAFE

SEQ ID NO: 122888 - protein, 89 aa, Glycine max
  Coding DNA Sequence Number=SeqID_31203
  Subcellular localization annotation: CTP_CleavageSite=32; ConfidenceScore=5.73e-01
MASPPASPPPPPPPPSHPLPPSAPSDASASPSAVKRTRKASRGRHLRELEGGPYCLEGPNLGGYSGCAQKGTGHPEAEHCPPRAVSWGL

SEQ ID NO: 122889 - protein, 107 aa, Glycine max
  Coding DNA Sequence Number=SeqID_31204
MATSLVHPEEPARTLQRTMEWILPTPTPYRLVEPVQVIEVTSSEEDLEEDPEELPPEPAVDALDFPEGDEDPLPDVDSPEDVMSASEADSMEESGPGGIATSGDSSS

SEQ ID NO: 122890 - protein, 124 aa, Glycine max
  Coding DNA Sequence Number=SeqID_31205
ESIDEEDPRPTSSNGACIKILFKGEGMMQSYLARALDRRLQEDWARDAREGLRVLMSLRAVASGGSNLARLGELGGKLLPYFAINRGRSEEEKGSAFLALLSLEIVEENYFREENPSRGASSST

SEQ ID NO: 122891 - protein, 47 aa, Glycine max
  Coding DNA Sequence Number=SeqID_31206
MWTTTGEELATQLAQASKVASSRSNSFLEEGLEGPSGPNCYLYPLYY

SEQ ID NO: 122892 - protein, 37 aa, Glycine max
  Coding DNA Sequence Number=SeqID_31207
MGVTIAPRPTWALQNIPPEEGGVKEKGVKPFWYFKIT

SEQ ID NO: 122893 - protein, 192 aa, Glycine max
  Coding DNA Sequence Number=SeqID_31208
  Gene Ontology: Mol. function=4-hydroxythreonine-4-phosphate dehydrogenase activity; Cellular component=cytoplasm; Biological process=pyridoxal phosphate biosynthetic process
  Homolog annotation: Hit_ID=A6T4I8; Match level="QueryCoverage=49%, HitCoverage=28%, E-value=9e-47, Identity=95%"; Hit description=4 -hydroxythreonine-4-phosphate dehydrogenase
  Pfam annotation: Domain name=PdxA; Domain location=1-100; Score= -26.0; E_value=1.8e-09; Accession=PF04166.3; Description=Pyridoxal phosphate biosynthetic protein PdxA
  Pfam annotation: Domain name=RrnaAD; Domain location=96-192; Score= -86.5; E_value=0.016; Accession=PF00398.11; Description=Ribosomal RNA adenine dimethylase
  Pfam module annotation: Pfam domain module=PdxA::RrnaAD; Domain location=1-100::96-192
GHMGTEEIDTIIPVLEEMRAKGMHLSGPLPADTLFQPKYLDNADAVLAMYHDQGLPVLKYQGFGRGVNITLGLPFIRTSVDHGTALDLAGQGKADGHLARKRFGQNFLNDQFVIESIVSAINPQKGQAMVEIGPGLAALTEPVGERLDALTVIELDRDLAARLQTHPFLGPKLTIYQQDAMTMNFGELSEKM

SEQ ID NO: 122894 - protein, 39 aa, Glycine max
  Coding DNA Sequence Number=SeqID_31209
MKILSSGVVFTLEKGRQKRGFCSYVPSFGEESIYVSRIL

SEQ ID NO: 122895 - protein, 229 aa, Glycine max
  Coding DNA Sequence Number=SeqID_31210
  Gene Ontology: Mol. function=aspartic-type endopeptidase activity; Biological process=proteolysis
  Homolog annotation: Hit_ID=Q9SJS1; Match level="QueryCoverage=41%, HitCoverage=13%, E-value=1e-08, Identity=38%"; Hit description =Putative Athila retroelement ORF1 protein
MHRSPTGDLLPLDLEIEATLRRNRAERRRKLLQDRTVASILEEETHFSDLLSPDSPSSRESATQLPEVITMVEEHDQRITLEDYSSSLVPQFFTSIACPEGQANNINYPHSLIHLIQGNLFQGLPNEDPYAHLATFIEICNTVKIVGVPDKAMRLSLFSFLIGRRSQEVASLIQSIEEVQRLVEKNSHSWVFRANPIEYVYRWAETTNQATARWFCRGKDKTEDPGRSN

SEQ ID NO: 122896 - protein, 179 aa, Glycine max
  Coding DNA Sequence Number=SeqID_31211
MQPDIRQRHQQEGHKHQVEKRMEIQIACPQQTKLHQKVEVPAGKAAPCSGWFNVARFYKQHSGRITDTTYGMACVVAKREKDQRTDYNQLNDIADIHSAFSALSVNKRRGSGTRRQTCPSCLALRIGFASLVIASGLAHCSGWSARICTSSALMALSSNQIIRFEKISPVGRGKMWLSA

SEQ ID NO: 122897 - protein, 227 aa, Glycine max
  Coding DNA Sequence Number=SeqID_31212
  Homolog annotation: Hit_ID=A5BAR8; Match level="QueryCoverage=69%, HitCoverage=43%, E-value=1e-20, Identity=39%"; Hit description =Putative uncharacterized protein
  Subcellular localization annotation: CTP_CleavageSite=37; ConfidenceScore=5.25e-01
MKPMQPQQKLRMTMSNWAHSNSMIGLKLLCVNSRGVRAFTTEAHEVVVWFGKSSCSYETYTTSTKVEDEGSVSKARENLNKHVQVANKHSYGQIHRDRYHHPSNFVMRSYKDKTGEDGSNQHRRSFSVGIKLLSGNKSSSSTSSVSGSTSFSFSNKSYGCQVRQLLKRCNNANSEIENTIQGAIAHCKKCQQMFSSKKTTSEVGIYSMSASRTSVCEHHERVELWRG

SEQ ID NO: 122898 - protein, 131 aa, Glycine max
  Coding DNA Sequence Number=SeqID_31213
MGEVEKVQEQMKADMEAMKEQMATIMEAMMSMKKIMEANAVAVAAISAVAKVNPTPPFGLNQMNHPTSDMVGKDLGSTGGPHYVQIQNKHAFPPYDLPPNYTPPNVAYTPSENVIEAVPESNKHENPVIRK

SEQ ID NO: 122899 - protein, 187 aa, Glycine max
  Coding DNA Sequence Number=SeqID_31214
MASRKRKAPALASQARYDRSRFTSQEAWDHYSDIVIGRKILPERNVMIYHTEFDEFKYELERRNWHKDLTNFMDESIDVAIVKEFYANLYDPKDKSPKQVRVRGHLIKFDEDALNTFLKTPVIIEEEESLSAYSRKNLTTLAQTWSVLSLSNLAPTSHTSDITLDKARFIYGIIQNMDMNLGYLILS

SEQ ID NO: 122900 - protein, 317 aa, Glycine max
  Coding DNA Sequence Number=SeqID_31215
  Gene Ontology: Mol. function=calcium ion binding; Cellular component =cell projection
  Homolog annotation: Hit_ID=UPI00006A2D9E; Match level="QueryCoverage =42%, HitCoverage=77%, E-value=1e-11, Identity=15%"; Hit description =UPI00006A2D9E related cluster
PRLQGLHVLAFRGLHVLAFRGLHVLAFRGLHVLALRRLHVLAFRGLHALAFTGLHVLAFRGLHTLALRGMHVLAFRGLHALAFKGLHTLAFKGLHVLASRGLHVLTFRGLHILAFRGLNVLAFRGLHVFAFRGLHVLAFRGLHILAFRGLHILAFRGLHALAFSGLHVLAFRGLHICAFRELKFLGHPSDLGGGPTVRAQPVEEAGIALTRHPVDPKKSNRVLGFPALIMGLCQFYRVPVAPSKVIRPPINRSFIKKYRAPRQAQGEAPQQPRDDQQWAIDTPPPPPKSTSAHLRRLECCLRHVADQQATKSKAKGK

SEQ ID NO: 122901 - protein, 134 aa, Glycine max
  Coding DNA Sequence Number=SeqID_31216
  Pfam annotation: Domain name=zf-CCHC; Domain location=63-80; Score =27.7; E_value=4.3e-05; Accession=PF00098.14; Description=Zinc knuckle
GIALKASSSIQEESDIEDSVDLDEDEDLSLFVKRFNKFIRIRGNQRRQNFKPKRRTEESFQVPKCFECNQPGHLRVDCPIFKKKIEKSEKKTIGDKKAKKAYITWDDNNLESSDDSEKEMINLCLMGKNYETTK

SEQ ID NO: 122902 - protein, 120 aa, Glycine max
  Coding DNA Sequence Number=SeqID_31217
LGRIDGDPVLRETRIWATWEYVSSVGGGQQGMMRKCRRVKLPAFVVDHRVVPGDMSRGSGDPWGRQASSWQSTDKRDKDHKARRLVVAGQLLKNEDSPAKMVSACVIDYTKGWVTGNRLP

SEQ ID NO: 122903 - protein, 163 aa, Glycine max
  Coding DNA Sequence Number=SeqID_31218
  Homolog annotation: Hit_ID=Q51617; Match level="QueryCoverage=25%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPSSLARLSTRLAPSPNPFTRAKRNGGTKRYITISEPI

SEQ ID NO: 122904 - protein, 319 aa, Glycine max
  Coding DNA Sequence Number=SeqID_31219
MAPRKLASKRSRKDKAAEGTSSAPEYDNHRFRSAEHQQRFEAIKGWSFLRERRVQLRDDEYTDFQEEIVRRRWASLVTPMAKFDPDIVLEFYANAWPTEEGVRDMRSWVRGQWIPFAGGGHHWLPELLLRSIIGRDRPRGMLYRPQTCRHLIKLAQLDNLIWSSIYGIWFASRRPTTGRILQSQGFTSFPCPTPDQFRAEVAWPGDWPEARSAEAPAEAPDEADEAHEDEEMTGTNVCYVLIDFCFVHTYHLSRYVSVATYPSAGGRRETRGMRVPRKEYARSRHQRLFEENVGKTGKDAIYELLSERFGSCIYARGRY

SEQ ID NO: 122905 - protein, 106 aa, Glycine max
  Coding DNA Sequence Number=SeqID_31220
MASVETSAMVRSQILPDNPQGGHISLDGFQRYHPLQQHIAAVGTTSNNMLSKRKTLDEGSLLSSKSETQHDHRFTSTPYVPMDLDIGPPFSTHRVYKKVLVFVCIK

SEQ ID NO: 122906 - protein, 62 aa, Glycine max
  Coding DNA Sequence Number=SeqID_31221
ALNLLHQWGPLLLEDQWQWNGEGVKVIGDAMDKSLKVGEDEWREKREGARNFMPQMRSELEV

SEQ ID NO: 122907 - protein, 73 aa, Glycine max
  Coding DNA Sequence Number=SeqID_31222
MDILTLGQVVCFPRRKTQHLSIKATKVSPAIPRQVNSIACGDHDNDLFCHFQGTKAFADAPDVFYAPSFDRFR

SEQ ID NO: 122908 - protein, 66 aa, Glycine max
  Coding DNA Sequence Number=SeqID_31223
MALRKLSAKRSRRGAAAEGTSAAPEFDSHRFRSAEHQQCFEAIKGWSFHRERHVQLRDDEYTDFQE

SEQ ID NO: 122909 - protein, 31 aa, Glycine max
  Coding DNA Sequence Number=SeqID_31224
GPPPKQQQTEEETKQTEEETKQTEEERKKAQ

SEQ ID NO: 122910 - protein, 220 aa, Glycine max
  Coding DNA Sequence Number=SeqID_31225
  Homolog annotation: Hit_ID=Q2HW90; Match level="QueryCoverage=89%, HitCoverage=39%, E-value=2e-25, Identity=34%"; Hit description =Putative uncharacterized protein
MGQPQRQAFHKAYGKIWDLAMAEVSTEAIASLAQYYDQPLRCFTFGDFQLSPTVEEFEEILGCPLGGRKPYLFSGFYPSLARISKIVQISTQELDRGMQVENGVVGVPRKCLEAKARVLEGKGEWAPFMDILALLIFGGVLFPNVDGLVDQAAIDAFLAFHDRKESPVVAILADLYDAFDRRCEKNSARIVCCTLALYVWLVLHLFRQEVRHACPLEGHR

SEQ ID NO: 122911 - protein, 247 aa, Glycine max
  Coding DNA Sequence Number=SeqID_31226
  Gene Ontology: Mol. function=motor activity; Cellular component=cell projection
  Homolog annotation: Hit_ID=UPI00016621D1; Match level="QueryCoverage =97%, HitCoverage=40%, E-value=1e-20, Identity=34%"; Hit description =UPI00016621D1 related cluster
LHALTFRGLHALAFRGLHTLTFRGLHVLAFRGLHVLAFRGLHILAIRGLHALAFRGLHVLTFRALHILAIRGLHALAFRGLHVLTFRGLHVLTFKGLHALAFRALHPLAVKGLHVLTVRGLHVLAFRGLHVLAVRGLHAHTFRGLHALTFRGLHAITFRGLHALTFRGLHVLTIRGLYVLTFIRLHTLAFVGLHVLTFRGLHTLTFIGLHTLTFRGLHVLAFRGLRVLTFRGLHVPAFRGLHALAKR

SEQ ID NO: 122912 - protein, 72 aa, Glycine max
  Coding DNA Sequence Number=SeqID_31227
MEKKTERRTRQREGDETYLGMVAKEKKQRLVTMLECDEHDAQMHTGTVNIGFLEKTDVNITNVNIGFLKTRC

SEQ ID NO: 122913 - protein, 116 aa, Glycine max
  Coding DNA Sequence Number=SeqID_31228
MGLNQFRFFNMVHDILVKVKLEVTRTSTVLNVLGSRRSSDRKMQGSCMSEHENKSPENDLFLVAHLGAQCPMCTVKKVIWTFQLPVTKEETNIQCMLEIKYGSDLIRTDFWSKNMG

SEQ ID NO: 122914 - protein, 161 aa, Glycine max
  Coding DNA Sequence Number=SeqID_31229
MSSIVCKDHAHKTPSGPEEVQQGPRVPALIMGLCQSYRVSVPPAGSCHHDIGIAPARYPMDPEKSNRVLGFPALIMGLFQFYGVPIAPSKVIRPPTNRAFIKKYCTPRQAQGETPQQPGDGRQWATDIPPPPSEPLSSSTKAGALPTTHGRLAGDQVQSQR

SEQ ID NO: 122915 - protein, 119 aa, Glycine max
  Coding DNA Sequence Number=SeqID_31230
MEREMITMIVDTLPVFYYEKMPGENGENEKEEGTHVVTVIPTWPNFPLTQQCHYSANIIQSHYPPPIHPQRPSLNQPQSLPTAHPMPNTTLNTNQDTNQGGSFPVKKAYRIHPNSGVLH

SEQ ID NO: 122916 - protein, 88 aa, Glycine max
  Coding DNA Sequence Number=SeqID_31231
MAYTHIPDSTSDSPQISASPYQLDFTFYASGSYNAQWNAPGLLHDKHTLRSSRILRKMEVDEPWLGLWLPLNYQVDMKASQHRTLELG

SEQ ID NO: 122917 - protein, 140 aa, Glycine max
  Coding DNA Sequence Number=SeqID_31232
MVSRGIFPFEKHIAAVGTTNNNMLSKRKTLDEGSLLSSKSETQHDHRFTSTPYVPMDPGIGPLFNSLPLWSRQLSKPTLRREGDAMAHECVIQGRKARGVATNVYSRCGLRTLFMKGSGVVFTHGEGISTPHVRHKGRQP

SEQ ID NO: 122918 - protein, 241 aa, Glycine max
  Coding DNA Sequence Number=SeqID_31233
  Pfam annotation: Domain name=Transposase_23; Domain location=169-233; Score=-11.4; E_value=0.021; Accession=PF03017.5; Description =TNP1ENSPM transposase
DSLEEQVMQGSFVPHGRQDILNTAIGRPDHGGRVRAAGSGVTITQYYRRASRTCNNSSTSISQQQLDEVVARLREDMTGQIREELRTQIKEELRTQLEEENKRSLEIMTMALKEAIKKELSHKGSPESLLIQPDIQQLGARVNTKGSNVVINVQPSREHGGDVIPMMGLYVQRKAGTLGLVAMGKIMEGDSVIHTMAYANDVVRVSVETVIDPEAEVPYATSEIQYVKQAVDTFVACPHTL

SEQ ID NO: 122919 - protein, 103 aa, Glycine max
  Coding DNA Sequence Number=SeqID_31234
  Subcellular localization annotation: CTP_CleavageSite=78; ConfidenceScore=5.09e-01
MQQGQADILIARFPDPTYGVKTLPRGFLVASLEDSFLSLLVDSTQASTMPKRRRLSMEFRKQASNSALGQTPTSLYERAESISGFTKERHLEFRPRQCDRGSV

SEQ ID NO: 122920 - protein, 105 aa, Glycine max
  Coding DNA Sequence Number=SeqID_31235
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=66%, E-value=9e-19, Identity=73%"; Hit description=LacZ protein
  Subcellular localization annotation: CTP_CleavageSite=31; ConfidenceScore=5.34e-01
AQYANRLSPRVGRFINAAGTTGFPTGKRAVSATQLMHASLALAVVLQRRDWENPGVTQLNRLAAHPPFASWRNSEEARNRSPFPTVAQPEWRMAPDAVFTPYASV

SEQ ID NO: 122921 - protein, 69 aa, Glycine max
  Coding DNA Sequence Number=SeqID_31236
MTCGDKLWSFRTPFAIQTQSCPMARIDKLWSFCACVNQEERIRQYQDDVGRSVLIIFKIFAGSAGGEID

SEQ ID NO: 122922 - protein, 26 aa, Glycine max
  Coding DNA Sequence Number=SeqID_31237
MATPMSIACYLDNDETGQSIDVKQYR

SEQ ID NO: 122923 - protein, 317 aa, Glycine max
  Coding DNA Sequence Number=SeqID_31238
MRGAPTEESMSPFLVRDFGAQNFKAIQAVHKAWETPLRKDQELRGIRNGIIGGYHEWLKVHIRGLDWLAKLKIVSEESFEAPEEDEEVQALKSELGKAKLAKEKFKLAATDIQKEYAGLREENATTAQALEQETKRARKEEYGRNKFRRALWGPKRSLSQRLCETETNTLAIIAKYQEELGLATAHEHRIADEYAQVYTEKEARGRVIDSLHQEATMWMDRFALTLNGSQELPRLLAKAKAMADTYSAPEEIHGLLGYWKNTITKRATRHPYRTRSKYRTMGDQEETQEQMKADMSALKEQMASMMEAMLGMRQGIL

SEQ ID NO: 122924 - protein, 210 aa, Glycine max
  Coding DNA Sequence Number=SeqID_31239
  Subcellular localization annotation: CTP_CleavageSite=56; ConfidenceScore=5.53e-01
LPSLGTDVWGVNTFPVRKYNSRTFHLKVRRSRLFRFFRRFPQINVGGDFARIPFVENASRESRVALPPKGCDSYEPEMGLGKDNGGITSLISAKGNHGKFGQEDEGRSPCHISRSFISAGLGDEGQVVAMCKDDALSGSDLVRPCPPDFRLGNWRVEERPGIYVTSIISNDESLEGTNTWETRPPTSSKKRVKQKMKRTRMWDFPKSWNG

SEQ ID NO: 122925 - protein, 17 aa, Glycine max
  Coding DNA Sequence Number=SeqID_31240
MKGRAERTLDKEEDEEH

SEQ ID NO: 122926 - protein, 432 aa, Glycine max
  Coding DNA Sequence Number=SeqID_31241
  Homolog annotation: Hit_ID=Q6WAY6; Match level="QueryCoverage=87%, HitCoverage=64%, E-value=1e-40, Identity=31%"; Hit description =Putative uncharacterized protein
MGSSQMPSLKKRFYQVKVKSLGTTSLKELGQLMGQLQRQAFRKAYGKIWDLAMVEVSTEAIASLAQYYDQPLRCFTFWDFQLSPMVEEFEEIPGCPLGGRKPYLFSGFYPSLARISKIVQISAQELDHRKQVENGVVGIPRKYLEAKSRILASKGEWAPFIDILALLIFGGVLFSNVEGLVDLAAIDAFLAYHNHKENPVVAMLADLYDTFDRRCEKSNTRIVCYTPALYVWLVSHLFCQEVRHACLLESHRSCTEKGGANWDQLLASKERASVNWFPRWKEGRTGVLISCGGFPNVPLMGTRGCISYNLVLAIRQLGYPMRGAPPGDELTPVISRGFNKTNVETLQKVRKAWEVLQEKDKEHRGSNNGPIGGYRKWLKAHMQGLDWLPSLRTAKREEVEAPEEDEEVQALRAEHEQAQTVKERFKTAALKI

SEQ ID NO: 122927 - protein, 479 aa, Glycine max
  Coding DNA Sequence Number=SeqID_31242
MGAKYLEVVKRGSHPNNGWSPDEIRGAYDHIGLCVSLDLGSRNNEATDNRKVSPYATGHSDDHNGLCVSLELGSRNEEATDNCKMSPYATGHSGETKLSRPKKADIRCLCHRTLGSLDSKKVRITVRCLRMPPDSWGADDHIGLCVSSDLESRNDKATDNRKVSPKGADNHIGLYVSSDLGSPNDELRITIRKSADDHIGLYASLDSGPPNEKVLITSRPKDADISRKGADDHIGLCVSSDLGSPNNESEDAHSSRKSADYHIGLYVSLDLGCPNDEVLITVRLGISEFCGADNRKVSMHASELLGYRIAKGRDADSCKVSLYATRLLGRWIANGETKWFRAKDADVFEKGADDHIGLCTSSDLGSRNDKATYNNNHIGLYVSSDLGSPNNVSQPEDADIFGKGADDHIGLYVSLDLGCPNDEAADDHIGLSVSSDLGSPNDEVRRKYSRPEAIDISRKRADDHIGLCVSSDSGSPNDE

SEQ ID NO: 122928 - protein, 70 aa, Glycine max
  Coding DNA Sequence Number=SeqID_31243
  Subcellular localization annotation: CTP_CleavageSite=45; ConfidenceScore=5.50e-01
MLVATLRVFLSWNTHPASHASPSRQRGHTVLNGMPQGSSMICTCCVQAVSSEKWRLRKPSRDYGYHLIIE

SEQ ID NO: 122929 - protein, 77 aa, Glycine max
  Coding DNA Sequence Number=SeqID_31244
MPPLMVIERKMFPHHPGGRGAADPDALHGLARSSAWSGSTSRVRAFSPLPILAAASYSNLLAKKQRSSPWNTSLPPR

SEQ ID NO: 122930 - protein, 80 aa, Glycine max
  Coding DNA Sequence Number=SeqID_31245
  Subcellular localization annotation: CTP_CleavageSite=49; ConfidenceScore=5.33e-01
MTSYGSELLLDSSSPSSGIFNHLSSFSIPLSFIFKKQRTPLMKKIQGLQAPHGATSVTTRSFWLCLNCLQHDRIGFSSLG

SEQ ID NO: 122931 - protein, 208 aa, Glycine max
  Coding DNA Sequence Number=SeqID_31246
  Gene Ontology: Mol. function=heat shock protein binding; Biological process=protein folding
  Homolog annotation: Hit_ID=O82368; Match level="QueryCoverage=70%, HitCoverage=47%, E-value=2e-26, Identity=44%"; Hit description =Uncharacterized protein At2g29880
MEDTNELLHLLVDAMNRGLRDVNGSLSKQNVERIILPQLNAKTKFPKTYSHYLSRMKWFRNQYNMMSTLMRNNSGFGWDPIGKTFTAHEDVWKDYLKSHPSHSKLRGKSMVDYEYLKIVVGGGVSSGNNSISVDPDDTDATTFEPENRTVGIEEFSYDPNSDTFITPNNYEPAYQSPSPNQPSPPSHPPLDSEVPIEKQKLSQAKEIR

SEQ ID NO: 122932 - protein, 42 aa, Glycine max
  Coding DNA Sequence Number=SeqID_31247
MTRGRPAGGQVRSQSHSRTHLVAHDPRYLNKTSTSSEGSKIP

SEQ ID NO: 122933 - protein, 33 aa, Glycine max
  Coding DNA Sequence Number=SeqID_31248
MDARDSSFTNRRFMQKPVPNAGRSLTVKVHTLT

SEQ ID NO: 122934 - protein, 81 aa, Glycine max
  Coding DNA Sequence Number=SeqID_31249
WANYASTAKRSFSVLSAIEESGRALASRLNARLALSPNPLTRAKHEGGAKNNVANLEAHHSAYFGKRALEAAREATFAEIP

SEQ ID NO: 122935 - protein, 76 aa, Glycine max
  Coding DNA Sequence Number=SeqID_31250
METMQKTLHGMQMGETAMECSVIRLIPPAPGNDINVYLSPLIEDLTNLWDEGVSMFDGFQNDDVVYDDIGPKIARK

SEQ ID NO: 122936 - protein, 170 aa, Glycine max
  Coding DNA Sequence Number=SeqID_31251
  Homolog annotation: Hit_ID=Q6WAY4; Match level="QueryCoverage=81%, HitCoverage=29%, E-value=8e-16, Identity=32%"; Hit description =Putative uncharacterized protein
MFGSKGESLWATQGEWAPVHGHPWHFLIFGVVLFPNVDGLVDRAAIDAFLAFYDRKDSPVAAILADLYDTFDQRYEKNNARIVCSNKEGVSVNWFPRWKEGRTGILISCGKFPNVSLMGTKGCINYNPVLAIRQLGYPMRGAPSEEGLIPFITRGFNRTNAGVLQRVHKA

SEQ ID NO: 122937 - protein, 147 aa, Glycine max
  Coding DNA Sequence Number=SeqID_31252
HNIPLLHDQVNVGVEEVKDAEALVPIPTHEVTLVGQTPNTFLAWPTHLMKRLSEQAIVSPAKPPESPNEEVDDPLYLMTLTIPQLFLKPLQVMWDATIFGPQSIQRSGQSQFESESYIKSWIQSSERDVYLGAYLNGLDNYLKGIIN

SEQ ID NO: 122938 - protein, 60 aa, Glycine max
  Coding DNA Sequence Number=SeqID_31253
  Subcellular localization annotation: CTP_CleavageSite=24; ConfidenceScore=5.70e-01
MTDPLLTNPPASTPSPSDASASPSAVKRTRKASRLRSLSTRPPGVERLVVHVDPVTGKAD

SEQ ID NO: 122939 - protein, 185 aa, Glycine max
  Coding DNA Sequence Number=SeqID_31254
  Homolog annotation: Hit_ID=UPI00006A2D9E; Match level="QueryCoverage =94%, HitCoverage=85%, E-value=5e-10, Identity=17%"; Hit description =UPI00006A2D9E related cluster
TTLLAIRGLHALAFRGLHALSEDYMTTGPRLQRATLSHLQRATVLAFRGLHVLAFQRATHPHLQRTTRPHHSKGSHSLAIRGLHVLAIRGLHALAFRGLHALTFRGLHFLAIRGLYALTIKGLHALAFKELHALTFRGLQVLTFRGLHALAFRGLHILSLSGLHALAFRGLHVLTFRGLHVLACR

SEQ ID NO: 122940 - protein, 134 aa, Glycine max
  Coding DNA Sequence Number=SeqID_31255
  Pfam annotation: Domain name=zf-CCHC; Domain location=63-80; Score =31.8; E_value=2.5e-06; Accession=PF00098.14; Description=Zinc knuckle
  Subcellular localization annotation: CTP_CleavageSite=43; ConfidenceScore=5.51e-01
MWFPGSFPFTSYPKFVNINQCTLRVRLIASEPPRRKQLVFNIRVRPRSNFNNGRKSQEDSQVLRCYKCNQIGHIKANCPSNEDWTEKSEKKRFDERRTKKAYIAWDDNDSSDGSEKEINLLTKDYESDENISQE

SEQ ID NO: 122941 - protein, 90 aa, Glycine max
  Coding DNA Sequence Number=SeqID_31256
  Subcellular localization annotation: CTP_CleavageSite=69; ConfidenceScore=5.40e-01
MAKIHHQAWPTKTYHPTKHTPPHTYSQNNSKAPKFLKGRAYKNKMPRSSPNMHVKQEVSTRVKPRLLCKQSMGQNTPNKIDDDGSNSHQG

SEQ ID NO: 122942 - protein, 140 aa, Glycine max
  Coding DNA Sequence Number=SeqID_31257
IQHSISRVSIYYGTQSDIRVKRYCRLNWLRGSTFNFERLDMLRDSIRHPSKKLLSFELGQRFNIQFRVSIYYGTQSDIRVKSYCRLNWLRASTFNFERLDMLRDSIRHPSKKLLSFEFAQRFNIQFRGSRYLTGLNQTSE

SEQ ID NO: 122943 - protein, 108 aa, Glycine max
  Coding DNA Sequence Number=SeqID_31258
MTLTIPELFLRPYQVTWDATVFGVFNPDFSLYIKHEDLSKIAHDGQCLSISVLQLWILMRAGNFDIYGFLEPQSIQRSGQSQFGSESYIKTWMQSSKRDVYLRAYLNG

SEQ ID NO: 122944 - protein, 151 aa, Glycine max
  Coding DNA Sequence Number=SeqID_31259
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLDPLGAFLCSIPGRECLANVFGHFVH

SEQ ID NO: 122945 - protein, 164 aa, Glycine max
  Coding DNA Sequence Number=SeqID_31260
  Homolog annotation: Hit_ID=A6FJQ2; Match level="QueryCoverage=23%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFQPDRCAFI

SEQ ID NO: 122946 - protein, 79 aa, Glycine max
  Coding DNA Sequence Number=SeqID_31261
MMNVLSVATLFCKISHAPHIFMIHVHRDSLGRNNQHENTEKGVEGRSPEYEEPRDLRSNPSKVERMMQSYPPRVLDRRL

SEQ ID NO: 122947 - protein, 233 aa, Glycine max
  Coding DNA Sequence Number=SeqID_31262
MLYFNGRVYEDNDGVIFEGSKKVIQIKRRISFNALKKKLEIRFLVSGKYVALQICDDEDVESMIKSFQQQQQMLVLELYVENIVGGSMFHAANSVTSCGHNVPHHESELPRNISNLHDDEDDDDDYLASNSYVEESFDEDDNVDGISDTDDEVTDIVEPVSIVHPTEGVPEIKNPFWNDALHYNNINWSHSDEEDICGLDMPTTFNVGQELYVGMDFDSKDAVKNALKQYVMK

SEQ ID NO: 122948 - protein, 114 aa, Glycine max
  Coding DNA Sequence Number=SeqID_31263
MRVHCNQASRRPSMTTDSPPLLMFSWTRNIRKKDKEKEQKGSQSKESTLIDWPNSLTIVPSGVANCLNLPFGGRATRGLTGASSKKGKCAESPPTFIQGKHRKTQEKTWSTNFK

SEQ ID NO: 122949 - protein, 71 aa, Glycine max
  Coding DNA Sequence Number=SeqID_31264
MMITQDDDKVQDKNQEEFKTQEESLETRIKTQGSRSQESGIKIQGSRSQESRSRFKAQDSRMKRRLNQDKY

SEQ ID NO: 122950 - protein, 223 aa, Glycine max
  Coding DNA Sequence Number=SeqID_31265
WLAKLKVVSEESFEAPKEDEEVQALKSELGKARLAKEKFKLAATHIRKECAGLREENATTARALEQETKRARKEEYGRNKFRGALWGSNSELKLRREERDQSRAHSMVLKEKLVACSRSKRSLSQCLCETETNMLAIIAKYQEELGLATAHGHRVANEYAQVYAEKEARGRVIDSLHQEATMWMDRFALTLNGSQELPRLLAKAKTMADTYSAPEEIHGLLDY

SEQ ID NO: 122951 - protein, 193 aa, Glycine max
  Coding DNA Sequence Number=SeqID_31266
  Homolog annotation: Hit_ID=A6FJQ2; Match level="QueryCoverage=19%, HitCoverage=84%, E-value=5e-11, Identity=92%"; Hit description=50S ribosomal protein L5
MRKEKIPHQAPFAIQAAQLLGRAIGAGLFAITPAGERGMCCKAIKLGNARVFPVTTLSTLEDPLHLCGTKSVATFSLQNGHNGGTYYAQERECLGNADVVDIKGNPYKYGLGNEPGMPGRRNVPSRFWADRVWPDRISQCFTSAGMVSEEEVAAIEEEFPQDPPSFVQPCHPDSQVGNWRVISQSEVYTVDSM

SEQ ID NO: 122952 - protein, 100 aa, Glycine max
  Coding DNA Sequence Number=SeqID_31267
  Homolog annotation: Hit_ID=A6N1F2; Match level="QueryCoverage=48%, HitCoverage=60%, E-value=2e-08, Identity=62%"; Hit description=Imp biosynthesis protein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAI

SEQ ID NO: 122953 - protein, 383 aa, Glycine max
  Coding DNA Sequence Number=SeqID_31268
  Homolog annotation: Hit_ID=Q6WAY6; Match level="QueryCoverage=96%, HitCoverage=63%, E-value=6e-23, Identity=26%"; Hit description =Putative uncharacterized protein
MPNQGDWVPFMDVLALLIFGVVLFPNVDVLVDLAAIDAFLAYHHSKESPVVAVLADLFDTFDRRCEKSSARIICCLPALCVWLVSHLFQQDTRHPCPLLSHRSCTEKRRIDWDQLLAGIGGRTISWFLRWKEGKEGVLFSCGRYPNIPLVGTRGCINYNPALAIRQLGYPMRGAPTEESMSPFLKDQELRGIRNGIIGGYHEWLKVHIRGLDWLAKLKVVSKESFEAPEEDEEVQALKSELGKAKLAKEKFKLAATHVRKECAGLREENAITARALEQETKRARKEEYGRNKFRGALWGSNSELKLRKEERDQSRAHSMVLKEELVACSRSKRSLSQRLCETETNMLAIIAKYQEELGLAAAHEHRIADEYAQVYAEKEARGR

SEQ ID NO: 122954 - protein, 50 aa, Glycine max
  Coding DNA Sequence Number=SeqID_31269
MEVEETQQRLWLPLQYQARMTFVDNWVVGKEKGCYWLSNDIIGLVGNLAV

SEQ ID NO: 122955 - protein, 98 aa, Glycine max
  Coding DNA Sequence Number=SeqID_31270
STLEDPLRHLVRQQAANHRAHVRTHDCLYQMSLSMQSQGFASFSCPTPDQFRAEVAWPGDWPEAQAGEAPPEAPGNGEEAHEDEEMADLLDFLGGSGD

SEQ ID NO: 122956 - protein, 313 aa, Glycine max
  Coding DNA Sequence Number=SeqID_31271
MAYSPNKIKNIDDSEETLKLAVRISDLWFIGTPNKSEQAEMVFVDSDCVLDDLPFRKYRFAIFADVVAGQFEPDLLVDVIGVVVVFRHVSGKGRRFLKFLDDHEGHDPITVLLTHGRIKEAQGSYPPSVSNSFKASKLIINQPVMEIQEFNERLVELGIEARSVFKSHSQGSSQLSGSIQLSSKESFFEKAEAKTIADINTISEDGDVDLNASPEALDKLLGYVLVFKIKVQPKFRNSVVLKCSTDSSLIDAVMDMLPDAEACFKELHKLSKFIQYLHKCYEFKYMAKDGTSKIWKYKSQIARQKIQKTCSSQ

SEQ ID NO: 122957 - protein, 95 aa, Glycine max
  Coding DNA Sequence Number=SeqID_31272
MGPTMKFESGNTRTCKRPRHASRKHIWTYQITQSMLGAPYPLGIGDKYVVQPWYKFLQESDFSHGDELSFYYRHDEKIWEVVIRHEIDWDDGDID

SEQ ID NO: 122958 - protein, 82 aa, Glycine max
  Coding DNA Sequence Number=SeqID_31273
  Homolog annotation: Hit_ID=A5AEB7; Match level="QueryCoverage=68%, HitCoverage=4%, E-value=8e-16, Identity=69%"; Hit description =Putative uncharacterized protein
MTYYFSWFTHMDHEVSSQTVNFPDIQCDVPKVKGDNYKIWKERILLQLGWMNIDYAIRKDEPPTIADESSPAAIALRPTGLT

SEQ ID NO: 122959 - protein, 372 aa, Glycine max
  Coding DNA Sequence Number=SeqID_31274
  Gene Ontology: Mol. function=protein serine/threonine kinase activity; Cellular component=cytoplasm; Biological process=protein amino acid phosphorylation
  Homolog annotation: Hit_ID=A7QHQ6; Match level="QueryCoverage=75%, HitCoverage=53%, E-value=1e-132, Identity=85%"; Hit description =Chromosome chr8 scaffold_99, whole genome shotgun sequence
  Pfam annotation: Domain name=Pkinase; Domain location=3-130; Score= -28.8; E_value=6.8e-07; Accession=PF00069.16; Description=Protein kinase domain
  Pfam annotation: Domain name=efhand; Domain location=177-205; Score =32.7; E_value=1.4e-06; Accession=PF00036.23; Description=EF hand
  Pfam annotation: Domain name=efhand; Domain location=213-241; Score =20.1; E_value=0.0082; Accession=PF00036.23; Description=EF hand
  Pfam annotation: Domain name=efhand; Domain location=249-277; Score =34.2; E_value=4.7e-07; Accession=PF00036.23; Description=EF hand
  Pfam module annotation: Pfam domain module=Pkinase::efhand::efhand::ef hand; Domain location=3-130::177-205::213-241::249-277
MVIGTGMSTNMNFHSSALLLPILIIVGERFSEIVGSPYYMAPEVLKRNYGPEIDIWSAGVILYILLCGVPPFWAESEQGVAQAILRGLIDFKREPWPSISESAKSLVRQMLEPDPKLRLTAKQVLEHPWLQNAKKAPNVPLGDVVKSRLKQFSMMNRFKRKALRVIADFLSNEEVEDIKDMFKKMDNDNDGIVSIEELKAGFRNFGSLLADSEVQLLIEAVDSNGKGTLDYGEFVAVSLHLRRMANDDHLHKAFSYFDKDGNGYIEPDELRNALMEDGADDCTDVANDIFLEVDTDKMGCFPLGAVRVTKDWCSQNMFIKVRISCTSNSALRFGHSILLPVVSSKVYSGMLTTSIICLSQHEPGRYAGSGSA

SEQ ID NO: 122960 - protein, 307 aa, Glycine max
  Coding DNA Sequence Number=SeqID_31275
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7Q0C8; Match level="QueryCoverage=86%, HitCoverage=54%, E-value=8e-71, Identity=49%"; Hit description =Chromosome chr7 scaffold_42, whole genome shotgun sequence
  Pfam annotation: Domain name=Glyco_hydro_1; Domain location=26-306; Score=38.0; E_value=1.4e-20; Accession=PF00232.9; Description =Glycosyl hydrolase family 1
MRLMLKVFAVIKLVLVIVHPSAHALSRDEFPPDFVFGASSSAYQVEGAANEDGRKPSIWDTFAHAGNGNMYEGDGDVACDQYHKYKEDVQLMVNMGLEAYRFSISWSRLIPDGRGQVNQKGEFNHMLHYIIGTYHKHLKMNMEDGRDFTTYADVCFREFGDRVQYWTTANEANIFAMEGYDLGEFAPNRCSPSVANCSRGNSSTEPYLVAHHMLLAHASAARLYRKKYQAMQHGLIGFNLLLFGLLPRTNSTEDVRATERFQDFTMGCLAELHFDFSTFHELSDEVVSNLNVLCTAMEYWILSHCNS

SEQ ID NO: 122961 - protein, 149 aa, Glycine max
  Coding DNA Sequence Number=SeqID_31276
MNREKKKNAKTHLHMYICTCVSIIRNILNVGRGLWLVLTLERKGSEREGFKEAAAMERSGNGLHSGMVVRGEGDGELVELEGGGVGFGGSFTDQIHKFGGQIYNVGDQIYGFSGVVSVVVELVWGEVGCAFLVSSERLVLLVVMVGMRR

SEQ ID NO: 122962 - protein, 382 aa, Glycine max
  Coding DNA Sequence Number=SeqID_31277
  Gene Ontology: Mol. function=oxidoreductase activity, acting on single donors with incorporation of molecular oxygen, incorporation of two atoms of oxygen; Cellular component=cytoplasm; Biological process=flavonoid biosynthetic process
  Homolog annotation: Hit_ID=A7QHQ7; Match level="QueryCoverage=98%, HitCoverage=98%, E-value=1e-134, Identity=62%"; Hit description =Chromosome chr8 scaffold_99, whole genome shotgun sequence
  Pfam annotation: Domain name=2OG-FeII_Oxy; Domain location=231-331; Score=154.9; E_value=2.1e-43; Accession=PF03171.11; Description=2OG -Fe(II) oxygenase superfamily
MSCQAWPEPIVRVQSLAESGLSSIPSRYIRPHSQRPSNTTSFPTPKPFQTDHHHGHDQKTSDHDHDHDHVNIPVIDLKHVFSEDPILREQVFGQVDQACREWGFFQVVNHGVSHELMKSSRELWREFFNQPLEMKEEYANSPTTYEGYGSRLGVQKGATLDWSDYFFLHYMPPSLRNQAKWPAFPESLRKVIAEYGEGVVKLGGRILKMMSINLGLKEDFLLNAFGGESEVGACLRVNFYPKCPQPDLTFGLSPHSDPGGMTILLPDDFVSGLQVRRGDEWITVKPVPNAFIINIGDQIQVLSNAIYKSVEHRVIVNSNKDRVSLALFYNPRSDLLIQPAKELVTEEKPALYSPMTYDEYRLYIRLNGPCGKAQVESLASQT

SEQ ID NO: 122963 - protein, 128 aa, Glycine max
  Coding DNA Sequence Number=SeqID_31278
MRIVSWHDQAEPGKGRTRKVRVKRGYWAWVGPRGKGQGRRRRVEGNERVRSRGGSGARCYCQGRRGRERCRVSEGCGGGDCRGRRGEGRIWGGSDTRRSVVKEDSRVEEKNASMVEAKGEEAKRRIRK

SEQ ID NO: 122964 - protein, 163 aa, Glycine max
  Coding DNA Sequence Number=SeqID_31279
  Gene Ontology: Mol. function=heat shock protein binding; Cellular component=cytoplasm; Biological process=response to stress
  Homolog annotation: Hit_ID=A7QHR0; Match level="QueryCoverage=88%, HitCoverage=42%, E-value=1e-69, Identity=87%"; Hit description =Chromosome chr8 scaffold_99, whole genome shotgun sequence
  Pfam annotation: Domain name=DnaJ_C; Domain location=38-160; Score =59.0; E_value=1.6e-14; Accession=PF01556.9; Description=DnaJ C terminal region
MAFHSQLKDNNAGPFSLRPSTVDEILTIEIKPGWKKGTKITFPEKGNEQRGVIPSDLVFIIDEKPHSLFKRDGNDLVVTQKISLVEALTGYTAQLTTLDGRSLTIPINSTISPTYEEVVKGEGMPIPKEPSKKGNLRIKFNIKFPSRLTSEQKSGIKRLLTSP

SEQ ID NO: 122965 - protein, 208 aa, Glycine max
  Coding DNA Sequence Number=SeqID_31280
MSLEITLGEWGCALGTSPAAGTPSKLGEFVLRCTAASIVRAVVAPPVIVTVVVLSLSITIVSALVALLCRILCEGTVWGIKDLSKTYGLLYGLSSCHHGQALHTERSVHSKCRWGRWNVLSYFNLAPTFHTFDLNVDQARLIYGLREKLAQCPYSLSDQLTLSVKKANEKAQGRAYHEHRAKRVIKPPLLLRPGLHVQREVSVKSKLP

SEQ ID NO: 122966 - protein, 74 aa, Glycine max
  Coding DNA Sequence Number=SeqID_31281
  Gene Ontology: Mol. function=protein dimerization activity
  Homolog annotation: Hit_ID=A5BUJ2; Match level="QueryCoverage=56%, HitCoverage=7%, E-value=1e-10, Identity=76%"; Hit description =Putative uncharacterized protein
  Pfam annotation: Domain name=hATC; Domain location=1-61; Score=9.6; E_ value=0.0033; Accession=PF05699.5; Description=hAT family dimerisation domain
MWWKFNGVKYPTLQAIAKDILAILVSTVASESAFSTGGSTSYKVVAESANVMNEMVSDDEGEMMGVAGVTNLEE

SEQ ID NO: 122967 - protein, 101 aa, Glycine max
  Coding DNA Sequence Number=SeqID_31282
  Gene Ontology: Mol. function=hydrolase activity, acting on ester bonds; Biological process=lipid metabolic process
  Homolog annotation: Hit_ID=Q9AYM5; Match level="QueryCoverage=34%, HitCoverage=13%, E-value=2e-09, Identity=80%"; Hit description =CPRD49 protein
MHIRIHKLLVLHQFSNEFLAALNPVQRNQEEPMNPVEIEYADALMELCEEMSIKAISLWSAIQTRDDWLDDSFTKNRAAVTFRCALDLCRAIPSLVTSFIS

SEQ ID NO: 122968 - protein, 255 aa, Glycine max
  Coding DNA Sequence Number=SeqID_31283
  Gene Ontology: Mol. function=hydrolase activity, acting on ester bonds; Biological process=lipid metabolic process
  Homolog annotation: Hit_ID=A7PP46; Match level="QueryCoverage=100%, HitCoverage=100%, E-value=4e-75, Identity=53%"; Hit description =Chromosome chr8 scaffold_23, whole genome shotgun sequence
  Pfam annotation: Domain name=Lipase_GDSL; Domain location=9-202; Score=64.4; E_value=3.8e-16; Accession=PF00657.13; Description=GDSL -like LipaseAcylhydrolase
MLGTSRPQFVLFGSSIVQYSYYEGWGATLSHLYARKDAKEQPSLVIVYFGGNDSTLPNPNGLGPHVPVEEYKENMRKIAIHMKKFLSSVCLKLDLMLMVAKFDTNPNDWQCLSEKTRTIFLTTPPINEAQIHNNSDPHGLLLRTNEACLIYAEACLEVCHEMNVKAIDLWSAIQKKDNWRDVCFIDGIHLSTEGSKIVTKEILKVLKEAEWEPSLYWRSMPSDFGEDSPYDPVGPDGKSTINLSNFAFPNNDQWD

SEQ ID NO: 122969 - protein, 134 aa, Glycine max
  Coding DNA Sequence Number=SeqID_31284
MGEQDSGEGDVEGLKQAEWNQAFTGNQCDVLENEKCIVKDVSNDIVVKDLCRYGFMSQEDIDACSQLELDMQAGDVRACDVVPLAWRGVVVVPVGESDDAGGIHDGLQSEKHDAVGGDRNRGTEIDEQSNDHLE

SEQ ID NO: 122970 - protein, 285 aa, Glycine max
  Coding DNA Sequence Number=SeqID_31285
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7Q0C4; Match level="QueryCoverage=76%, HitCoverage=42%, E-value=4e-58, Identity=51%"; Hit description =Chromosome chr7 scaffold_42, whole genome shotgun sequence
  Pfam annotation: Domain name=Glyco_hydro_1; Domain location=4-264; Score=-133.7; E_value=5.6e-12; Accession=PF00232.9; Description =Glycosyl hydrolase family 1
LKVGGLGDVAKAIGSTLLSDDNVRIWDVCSTSLGSPHPRYCPPEQRCLQTAHGLNYETSKMFMNPFIFGGYPDIMKKKAGSRLPFFTQKESNLVKGSIDFLGINFYYSLIVKNSPSRLQKENRDYIADISVEIDRFFPNGTSTDEVPITPKIFLAALDSLKNSYGDIPIYIHENGQQTPHNSSLDDWPRVKYLHEYIGSLADGLRSGLNVKGYFVWSFLDVLELLTGYESSFGLYYVDMNDPSLRRIPKVSAEWYSNFLKRKPIDPKISKEIEKNANVLSQYLTA

SEQ ID NO: 122971 - protein, 251 aa, Glycine max
  Coding DNA Sequence Number=SeqID_31286
  Gene Ontology: Mol. function=phosphoric monoester hydrolase activity; Cellular component=integral to membrane; Biological process =biological_process
  Homolog annotation: Hit_ID=A7QHP6; Match level="QueryCoverage=72%, HitCoverage=32%, E-value=1e-66, Identity=68%"; Hit description =Chromosome chr8 scaffold_99, whole genome shotgun sequence
  Pfam annotation: Domain name=Syja_N; Domain location=69-251; Score= -44.0; E_value=1.7e-08; Accession=PF02383.9; Description=SacI homology domain
MDIEPPSSSPERFKLYDELELLEFQDKFVIKSHQSPNHGFWINRLDGSINVFDDDGDTFSGSPLRTSTIYGVVGTIRLVVGTYAIVITSRKEVGSFLGFPVYRLMSMRLLACNEALRFSTAQEKKDETFFLTLLKVVESMPGLYYSYETDITLNLHRRSKLVEGWTSKPIWKQADPRFVWNKHLLEELIELKEQECGEEELTLKVLLYIIYYQLPEIPFYSFSAELAMFSTSILSVSEMRIGSVVKHAEGL

SEQ ID NO: 122972 - protein, 70 aa, Glycine max
  Coding DNA Sequence Number=SeqID_31287
  Gene Ontology: Mol. function=transferase activity; Biological process= DNA integration
  Homolog annotation: Hit_ID=A5BLF4; Match level="QueryCoverage=100%, HitCoverage=59%, E-value=2e-21, Identity=65%"; Hit description =Putative uncharacterized protein
MEAEFVSCFEATSHGHIDVKYLAIRERVKEKKVAIEHVNIELMIADPLTKCMPPKNFKDHVVRMRLGSMM

SEQ ID NO: 122973 - protein, 416 aa, Glycine max
  Coding DNA Sequence Number=SeqID_31288
  Homolog annotation: Hit_ID=A7PP47; Match level="QueryCoverage=79%, HitCoverage=69%, E-value=1e-122, Identity=67%"; Hit description =Chromosome chr8 scaffold_23, whole genome shotgun sequence
  Pfam annotation: Domain name=LMBR1; Domain location=3-391; Score =224.8; E_value=1.9e-64; Accession=PF04791.7; Description=LMBR1-like membrane protein
MGLLKAAVRDRCVAAGARRRRSCRCVAAGGRRGCVRVWGAGGTRLVQGRLAVGFSLRWKVVLNHRAVLEGLVGKVDFTIRHLSSSTTSFPSTWTFSSGQPCIGSDAHQCSAFSASPSSEKTWTMRTTFPEYVVALATIVGSVLFAIFGGVGIACLPLGLIFSFIRRPKAVITRSQYIKEATELGKKARELKKAAEALHQEERSGSKGRKFRKNVKEVEKELFQLEEDVKLLEEMYPQGEKAETTWALTVLGYLAKFVLGILGLIVSVAWVTHIIIYLLIDPPLSPFLNEVFIKLDDVWGLLGTAAFAFFCFYLLLAVIAGAMMLGLRLLKVLLFYLFSVIQFCSTAFAYYAQATAAQEIFGHTLESLRGIKYLYKYNVFQIAFVVLAGLTFVYYAAFSCFMLKAIEQADHHLSRII

SEQ ID NO: 122974 - protein, 91 aa, Glycine max
  Coding DNA Sequence Number=SeqID_31289
VVGNYEAEADLPTGLEDDRADIIEPEAVLASRRVIKHGERLKQWLIQWKGKTRQIAQGGGIDTTIGEELREPLVHEGNQGRWGRVYVRKGH

SEQ ID NO: 122975 - protein, 189 aa, Glycine max
  Coding DNA Sequence Number=SeqID_31290
  Homolog annotation: Hit_ID=A7PP47; Match level="QueryCoverage=62%, HitCoverage=23%, E-value=2e-58, Identity=90%"; Hit description =Chromosome chr8 scaffold_23, whole genome shotgun sequence
  Pfam annotation: Domain name=LMBR1; Domain location=11-189; Score= -160.8; E_value=0.048; Accession=PF04791.7; Description=LMBR1-like membrane protein
MGDFNLALVIVAVVVCVIVFLVNVYLLVNYQHPDDANQAYFPKFVVVLGLSVAAISILMLPADVANRQACRHAIYNGACSLTLPMKDLWLAVYILDAVLVFFVIPFAMFFYEGDQDKSVGKRIKSALMWMVTTAIVCALVLGILYGIVENWKWGPWVVRLDDGCFGCAGEGFRDFVNEAVLGAVVLDVG

SEQ ID NO: 122976 - protein, 125 aa, Glycine max
  Coding DNA Sequence Number=SeqID_31291
  Homolog annotation: Hit_ID=A7NYZ6; Match level="QueryCoverage=94%, HitCoverage=27%, E-value=1e-14, Identity=41%"; Hit description =Chromosome chr6 scaffold_3, whole genome shotgun sequence
  Subcellular localization annotation: CTP_CleavageSite=43; ConfidenceScore=5.03e-01
MKCFYFSNGEDEDFVGRGAVASLRGGSTSRVSWACSLSLMDTRSSSRSHSDSESTEFSDTVDFHHFLVQRYANDLCLFSFSDLKSITCAFSRALLVGEGGFGSVYRSFLDQNDIAIKQLKSGTVI

SEQ ID NO: 122977 - protein, 540 aa, Glycine max
  Coding DNA Sequence Number=SeqID_31292
  Gene Ontology: Mol. function=double-stranded RNA binding; Cellular component=intracellular
  Homolog annotation: Hit_ID=A7PP34; Match level="QueryCoverage=92%, HitCoverage=59%, E-value=1e-154, Identity=58%"; Hit description =Chromosome chr8 scaffold_23, whole genome shotgun sequence
  Pfam annotation: Domain name=dsrm; Domain location=379-442; Score =55.9; E_value=1.4e-13; Accession=PF00035.16; Description=Double -stranded RNA binding motif
MAERDYALEIWRLLDPGAHLIGLKQVLNRVICVKSGSRKSLLNVFQDGVCHPKMAMVIDDRSKVWVDKDQPRVHVVPAFTPYYAPQAEVQTANAVPVLCVARNVACNVRGCFFKEFDESLLQRIAEIFFEDDIGLLPHPPDVSNYLMSEDVPNGNANAPFSEGMNGAEVERRLSQPDDKFSVDLSTRPMTNSVEFRHETSQPTAEPGLLGPPVKHDGNSVDRDYDMRKGLLGMRHGPDIRGQISAEPPLILRPPNQASPSLMQPFGGGLVEDDIASRSQTNSWPSASVKESNVIKSDKHQAQQKPFSNSVIGSSPNVLLPQASQLKAEEATSVSDLQRQIVPSKSQLSSEDGISQNHASSNSKDFQHEAGKMNFLSPLSIQVLQEIGRRCNSKVEFKSILSTSKDLQFSVEVLFTGEKIGVGMGRTRKDAQQQAAENALRSLAEKYVAHVEPQCRAVDKDFDKLSLGCDNGFLWDVINPESSEPQPEDGVSRENASEEIGDAWIRGMWTRNSRWKWLYREITLFMELCSINVKAKSLNGE

SEQ ID NO: 122978 - protein, 194 aa, Glycine max
  Coding DNA Sequence Number=SeqID_31293
MKSDDEWITKKGDDIFDEDNVQVEQKQPLGESGSGSNIDLVGGSLTDLTLDAFDIDNLIFNDNVKDHFSTEEEIEDDRDEDDGSGCDIRDDFIRGLMLNLQSLHECTQNRESDNLTHGDEHSAHTLPERTQGKSHPRRTVNTLDDLSLSHMYRLAGQTTSRHPFVDRIMEAVIPLGWKPLNLEQYDEIIDSNEI

SEQ ID NO: 122979 - protein, 103 aa, Glycine max
  Coding DNA Sequence Number=SeqID_31294
MEWFFRISHPFMIPTQAGDQPRHAPAADPEEYMQPPIPQVPMAFDAPPHAVAITDRLERVLNLRMVTADTKLHDIMQDCLTVARGGASADGSVRARQRRRTEH

SEQ ID NO: 122980 - protein, 171 aa, Glycine max
  Coding DNA Sequence Number=SeqID_31295
MYDNLNDASKSTMRQLAGYITLLQCWIYEHFASVGSAVPAEDYDERRPSACRWTSGKALPISTWMQFGEYIEPVGQLCAVSGHCSPNYMGWFYMISHPFIRPAQPGDPPRVPLDDFVSIGDKLERLLNLRILTKGTETYTVVEECEGIAKSYIGHPTVGNRSRRRWRMDGH

SEQ ID NO: 122981 - protein, 69 aa, Glycine max
  Coding DNA Sequence Number=SeqID_31296
MDEDQWMYNSMMSEEVDMNVKNEEDAGVKVEHVDCSDAFNTSQLFASRDEVLQWTRSLAHDIGFVVVIM

SEQ ID NO: 122982 - protein, 458 aa, Glycine max
  Coding DNA Sequence Number=SeqID_31297
MPMPEAPVLITNDTEKSGKPRTGAWHRASFSLEKVVAASDPESPKKPRSCLTNCGGGHCCTAATFSSTAVVGKGLKGLTQVFQVIGEGPAINQNIIEEEDNEFPQGPVVNAEAPRAIPFLDKKNWGRERACIGTNDAILKHRVDLGFNFLFLEVGIAVGSDINGGGVREKVNGMIGGSGRGKVCWRLKEGGKEVDDGEHSGVGGLGGRGLRAHPDVEKFIGTACLEEMPELGSADGPIGLRRRCRPRTKGGHAKRLDEVFLHKVVCAASVNQNDDTVVRNPAMKCWVVFRAGSGRSLGQRGLYKGLGCGATMAPREFFVTMKAQPSLATAGNFLWGQAMDGVRVGAVEKRLELFKDLFLLKTGQAGGMDQNPLGPHMVIAQIGPLWLAGSQTRSTIDGYEPSTRTTQESGRPCKRMRWVVGGYGFKVHDTVDEVIELLCEDEMTRSKLGDSFFYSIHI

SEQ ID NO: 122983 - protein, 454 aa, Glycine max
  Coding DNA Sequence Number=SeqID_31298
  Gene Ontology: Mol. function=phosphoinositide phospholipase C activity; Biological process=intracellular signaling cascade
  Homolog annotation: Hit_ID=A7UQU7; Match level="QueryCoverage=70%, HitCoverage=61%, E-value=2e-40, Identity=31%"; Hit description=IMP dehydrogenase/GMP reductase, putative
  Pfam annotation: Domain name=DUF1723; Domain location=94-143; Score =49.5; E_value=1.1e-11; Accession=PF08330.1; Description=Protein of unknown function (DUF1723)
MEAPTAVENIPMDTGTKAAEDEHEGFLGGPSEQSVLTLYADHIACSVWMREQRPELKLSSHWRKVHSLGRPAPAIEGLVAGTGLSPLIACSVDTGDRGLLSAFVERWHRETSSFHLLVGELTITLDNVSSLLHLPVIGDLHAFEPLHVDDASLLGLRQPSVADRTYACNGYVIYMSADARQSATNVHVVYLEALRDLSMTERYARGVAALVHMYDQLNNASMSHNRQLGGYITLLQCWIYEHFPSVADSTADQEYDEDSPRSCRWIATKKTVKSIRTPAYRDRLDRLRIPDVCWIPYGEHREVRDFHVRSCYSGLLRWGPVAIYYRPERIVWQFGYTQIIPDPSVDSWVSYDDIHDRWMHYEDHIVPACEAPQTGIPHVPEPGASSTSAEEPRHAVKVCDDIAERLEHHLSLGVVMPGSSTHEVIEEFLRLARSVTQDHLVYVRCRRRRRTDQA

SEQ ID NO: 122984 - protein, 114 aa, Glycine max
  Coding DNA Sequence Number=SeqID_31299
MMIETERNMMQFRGTEKRLETARLAERVFLGPFAASSFFFFFFAAIAAIVAVFRRKVWVFAFVVVLRVCASFRVSASSSRNRCREVSGSFTDHLIRKHFPDQVDLEDVYGSSDP

SEQ ID NO: 122985 - protein, 72 aa, Glycine max
  Coding DNA Sequence Number=SeqID_31300
  Gene Ontology: Mol. function=nucleoside-triphosphatase activity; Cellular component=integral to membrane; Biological process=transport
  Homolog annotation: Hit_ID=A7PQG8; Match level="QueryCoverage=65%, HitCoverage=3%, E-value=8e-15, Identity=80%"; Hit description =Chromosome chr6 scaffold_25, whole genome shotgun sequence
MEEAGRCKLTAFVAGVTVPFASIAIQMFIEEVIELVELNPLKHEIVGLPGVNGLSTEQRKRLTISVELVANP

SEQ ID NO: 122986 - protein, 42 aa, Glycine max
  Coding DNA Sequence Number=SeqID_31301
MFVYDAPTSVSLSSVASISKSNGAKSPAKVLPRIQEASYYRV

SEQ ID NO: 122987 - protein, 99 aa, Glycine max
  Coding DNA Sequence Number=SeqID_31302
MALIISTLSNYSNRLRMMQNQELKNRHFLSQLSSHSHRQGYRYRESTQTPFDLDNLIFVEPNDDAQSEEDLDDDDGDGDDDESDDIHEDDPIRGLNMLL

SEQ ID NO: 122988 - protein, 75 aa, Glycine max
  Coding DNA Sequence Number=SeqID_31303
MEAFMAQVAWPGVQYSPLGGGEAFIAQEPQPQPEATPETTLWTSPATTPVLEVSEEEDGVADTDYATDMAAAQST

SEQ ID NO: 122989 - protein, 237 aa, Glycine max
  Coding DNA Sequence Number=SeqID_31304
MFDEFLQELQRLRWDQVLTRLPEKWIDVALVKEFYSNLYDPEDHSPKFWSVRGQVVRFDAETINDFLDTPVILAEGEDYPAYSQYLSTPPDHDAILSALCTPGGRFVLNVDSAPWKLLRKDLMTLAQTWSVLSYFNLALTFHTSDINISQIAQSITSRLGFPALITTLCEIQGVVSDTLIFESLSPVINLAYIKKNCWNPADPSITFQGTRRTRTRASASASEAPLPSQHPSQPFSQ

SEQ ID NO: 122990 - protein, 192 aa, Glycine max
  Coding DNA Sequence Number=SeqID_31305
  Gene Ontology: Mol. function=tRNA-pseudouridine synthase activity; Cellular component=ribonucleoprotein complex; Biological process =ribosome biogenesis and assembly
  Homolog annotation: Hit_ID=A7PNL4; Match level="QueryCoverage=48%, HitCoverage=16%, E-value=6e-37, Identity=76%"; Hit description =Chromosome chr8 scaffold_23, whole genome shotgun sequence
MAPRSSAPSKPSLASTYVKTMCVHLCLLLGVGSHMQELRRVRSGIMGEKDNMVTIHDHGGAEWVYDNYRDGTYLRRVVMPLEILLTNYKRFFVKDSSVDAICYGAKLYEGLTIVHNIPLRHNQVKVGVKEVRDADALISVLTQEVQLVGQILNTFVVWLTHLVKRLSEQGVVGPKKPAHALDVNCNFRKFQE

SEQ ID NO: 122991 - protein, 143 aa, Glycine max
  Coding DNA Sequence Number=SeqID_31306
MRLAKRHWWLSECDSLALFQTEKELCLARQLAMPNFYYRWEIGLNASVALSHYWNAESLKQHWLSEFIPKMQKTKINFMNSLSAQGVLSVFIPKPKNSKKRMNSLSSTGSLSEFIAIPKMEACEPQLLKPPNKLSSLRLSLEL

SEQ ID NO: 122992 - protein, 28 aa, Glycine max
  Coding DNA Sequence Number=SeqID_31307
MVGFLKVIDGYEEAMVQVAKWHGEMGTQ

SEQ ID NO: 122993 - protein, 213 aa, Glycine max
  Coding DNA Sequence Number=SeqID_31308
MKKVVGGWLSYKGGHSWMMVANGWLLRGNIVREVGKAKTSMGDLHKSPMRNVKQGEMGHDGSNWISTSRSRPKYKSLPFVLFMRVLESIEGCCGEGTMEKQLGQPHKSQTQLTRHAGPHLHALQEWGDPFKGAHMTSLMTQSSDSTLKHSTGLFLNPDLPLLQKLWNVIARKFDGSAIGMALKITRKDPIGAFWQCIGGVNGRGRKVATKRSW

SEQ ID NO: 122994 - protein, 64 aa, Glycine max
  Coding DNA Sequence Number=SeqID_31309
  Homolog annotation: Hit_ID=A5C5Y2; Match level="QueryCoverage=98%, HitCoverage=5%, E-value=8e-18, Identity=57%"; Hit description =Putative uncharacterized protein
MDETDAIVMSWLWNSMVLEVSDACMFMKTAKDVWDNCKQNYSKVGDAVEIYEIKMKIATTKQGD

SEQ ID NO: 122995 - protein, 72 aa, Glycine max
  Coding DNA Sequence Number=SeqID_31310
MARKGDFSPYPTLTYPISLEEGMMQSYPLRALDRRLQEDWARDVREGPRILMSLRVDFGPWAKYESTYLCTY

SEQ ID NO: 122996 - protein, 165 aa, Glycine max
  Coding DNA Sequence Number=SeqID_31311
MASSFDSREKDHFFNTDEEVQESAQDCKKCKKGVCSGMQSNFVCSHIIGANPCNFLECFQISFHWLQVRHPCTCSIISCQPLCQTFDGMKKQAAITCWHVLSSLRKPGDHAIICKLAYDKGIFKWFNCQGRKGRLYSVACSPTDTIEVSMDSEDFPNADADSKSK

SEQ ID NO: 122997 - protein, 117 aa, Glycine max
  Coding DNA Sequence Number=SeqID_31312
MAVPAALDKVELYEKLNPHRLDRLEVRKLKPLQWNRILDFILKPIGFKMKSNMVSEQALTLGPRLRFRCDKHPPFVVHAPSPISVGREGGVLGKYPSPTSAASILGVQLIYLLGNFT

SEQ ID NO: 122998 - protein, 98 aa, Glycine max
  Coding DNA Sequence Number=SeqID_31313
  Homolog annotation: Hit_ID=A5C944; Match level="QueryCoverage=47%, HitCoverage=5%, E-value=6e-10, Identity=55%"; Hit description =Putative uncharacterized protein
MYPHDEMSIVLDDTNNFNKRVTWMLFMTIVRNKEKNQQVASSVGTSRSRKMGTTKYDIEKFSGENDFGLWRIKMEAILIQHGCAEALKGEERMSESLG

SEQ ID NO: 122999 - protein, 947 aa, Glycine max
  Coding DNA Sequence Number=SeqID_31314
  Gene Ontology: Cellular component=integral to membrane; Biological process=vesicle-mediated transport
  Homolog annotation: Hit_ID=A7QHQ0; Match level="QueryCoverage=98%, HitCoverage=83%, E-value=0.0, Identity=51%"; Hit description =Chromosome chr8 scaffold_99, whole genome shotgun sequence
  Pfam annotation: Domain name=WD40; Domain location=341-379; Score =7.2; E_value=4.1; Accession=PF00400.23; Description=WD domain, G -beta repeat
  Pfam annotation: Domain name=WD40; Domain location=444-503; Score =5.6; E_value=6.5; Accession=PF00400.23; Description=WD domain, G -beta repeat
  Pfam annotation: Domain name=WD40; Domain location=58-96; Score=19.1; E_value=0.017; Accession=PF00400.23; Description=WD domain, G-beta repeat
  Pfam module annotation: Pfam domain module=WD40::WD40::WD40; Domain location=341-379::444-503::58-96
MGEHIPRQQILLIAFEDGLLILWDVSESRIVFLGGGKDLQLKDEDGNSSSETGTNPPADIVEQNLGDKEITALCWASSTGSILAVGYLDGDILLWNLSSATASKGQQTSKNVVKLQLSTAERRLPVIVLQWSNSHKSQSDSFGQLFVYGGDEIGSEEVLTVLTLEWSSGMESVKCTNRADLTLSGSFADLILLPSPGTMGLSSKDELFVLANPGQLHLYDNDSLSALTSQLTRTPSVSALEFPVLVPISDPCLTVAILIRLPSNSNSSKNFTEVASALRTGSRHGSAPSNWPLTGGVPSLSSTAKGAVVERVYFVGYSNGSVLVCDATHAVLSYICYIEGEVNGIKVAGSDAQVTKLDFCSVSLLLAVGNECGLVRIYDLKSHSGGRNFHFFTETKSEVLDTPEGKGSYCSAVFSVLDSPVQALSFANSGTKLAIGFSSGSVVLFLIDGVPSSSSPITSLVWKQEAYFQSEVNSLKPSETDSGNSLEEILFVLSRDGKINIVDGDSGKIICSRPLQASTSFTKNTKHILRLIAVSMSLEILTDFCTPEGSISASEASNDKLQEETVKNTADASPDEEEEPLSTRVNSSEAGLSSSESSHSGDLLLDPLVLLCCENSLRLFSAKSLIQGHKRPIKKVKHSKSCYWTTIFKKDGKVYGLLSLLQTGTFEIRSLPDLELVAESSLLSILRWNYKVNMDKTMCSDDYGEIVLANSSELAFMSLLAGKDEFSNLEHLPCLHDKVLAAAADAAFKFSSNQKKKQLNCLAQTVVPGILGGIVKGFKGGKTTPTDVTKIPTSNFGHLEDIFFKPPLPDSPTTVAIPDKKEAELDIDDIEIDEPHQPIPKASTSSPDVKNKQKDKLQDREKLFEGGTNNDDLKPRLRKPEEIMATYRKTEDAASVAAQARNKLMERHEKLERISQRTAELQSGAENFASLANELVKTMERRKWWQI

SEQ ID NO: 123000 - protein, 29 aa, Glycine max
  Coding DNA Sequence Number=SeqID_31315
MYLPAGAGIKFPVPKLKAAANTIDNVYNN

SEQ ID NO: 123001 - protein, 85 aa, Glycine max
  Coding DNA Sequence Number=SeqID_31316
MAAQLIHDRVVMECLEGAWETLEGNESTSGGTRTHASAACGVDTTYTYSISTSGASSSDRGRAALEGQRIVSSPGGTTNSDDSSS

SEQ ID NO: 123002 - protein, 112 aa, Glycine max
  Coding DNA Sequence Number=SeqID_31317
  Homolog annotation: Hit_ID=A0PAV3; Match level="QueryCoverage=25%, HitCoverage=14%, E-value=6e-07, Identity=89%"; Hit description =Restriction endonuclease
GTSYVPINVSFSPKVGPGLPGINRDTRIYLFCEVIFRHSGFCFYQLSPPVQLLTGVVRNGKSTAGHQRWQAAQLLGRAIGAGLFAITPAGERGMCCKAIKLGNARVFPVTTL

SEQ ID NO: 123003 - protein, 59 aa, Glycine max
  Coding DNA Sequence Number=SeqID_31318
STAPIHLGSVRRGIMVLDLEILTHLLHDFVVQIGGIVSDNLPGQCWTSGLRYLKKGGLN

SEQ ID NO: 123004 - protein, 59 aa, Glycine max
  Coding DNA Sequence Number=SeqID_31319
KLGVSVFSSLFMWGGISLVENGNLKGRDTKNGFSFAGSHLPCRGNPNLDIWGKTNLGVK

SEQ ID NO: 123005 - protein, 75 aa, Glycine max
  Coding DNA Sequence Number=SeqID_31320
MGSFNGDFPPWRCSGRQRKGGERRRHPLRNKPWKKELHHQDEPWIRSLERMLQWRKRKRERKREGGARSFLEKLS

SEQ ID NO: 123006 - protein, 42 aa, Glycine max
  Coding DNA Sequence Number=SeqID_31321
MAEYKACTLGIQATIDFKVKLLKENGRPGIISGYPTKPTSGN

SEQ ID NO: 123007 - protein, 58 aa, Glycine max
  Coding DNA Sequence Number=SeqID_31322
MTNANCPQESLHSVSNGNLSWVCDNQEGLGFEYTSQPTAYETSRPGLLSGPHVPTNVT

SEQ ID NO: 123008 - protein, 66 aa, Glycine max
  Coding DNA Sequence Number=SeqID_31323
MATIAVSSRYGSKSALDTGIGWSSSLEVRNDIVGFGGKLGRIGMAVTAWIHFDPFTGEDQIRKALR

SEQ ID NO: 123009 - protein, 102 aa, Glycine max
  Coding DNA Sequence Number=SeqID_31324
MATMMEAMMSMKKIMEANAVAVATTSTVAKVNPMPPSGLNKMNHPTSAMVGKDLGSTGGPHYAQIQNKHAFLPYGMPPNYTPPNVAYTPNENVDNSTPILVE

SEQ ID NO: 123010 - protein, 47 aa, Glycine max
  Coding DNA Sequence Number=SeqID_31325
WHLQSSFYLLHSTAIYLQEAKDSIDEEDPRPTSSTWSYIMWYQSIFI

SEQ ID NO: 123011 - protein, 99 aa, Glycine max
  Coding DNA Sequence Number=SeqID_31326
MRLHCYQASQRPSMTTDRPHLPMSHIDSGIGSNISMCVQRCRCHVWMEQQIFLTTNVIDRQTHTKHNNIAKVIHKYGQNKDKREKGNMNEEEVTINIAH

SEQ ID NO: 123012 - protein, 77 aa, Glycine max
  Coding DNA Sequence Number=SeqID_31327
  Homolog annotation: Hit_ID=A6FJQ2; Match level="QueryCoverage=49%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVDSRGSPVLESLTLKGLTCITAID

SEQ ID NO: 123013 - protein, 299 aa, Glycine max
  Coding DNA Sequence Number=SeqID_31328
MAKFDPDIVLEFYANAWPTEEGVRDMRSWVRGQWIPFDADAISQFLGYPLVLEEGQECEYGQRRNRSDGFDEEAIAQLLCIPGQDFARTAAGRRVRIMRTNMTTLTQIWMTLLLSNILPSDHNSDLPLPKCQLVYAILTRMSIHVAQLIADAIYLFVGMAPTRHPMDPNKSNRALGFPALIIGLSQSFGVPVAPTKRPVQGDAPQAAGAPPPPHQGGPAGSFDMEQYLRHLVRQQAANHRAHVQTHDCLYQLSLSMQSQGFTSFSCPTPDQFRAEVAWPGDWPEAQAGEAPPEAPDDGE

SEQ ID NO: 123014 - protein, 329 aa, Glycine max
  Coding DNA Sequence Number=SeqID_31329
  Homolog annotation: Hit_ID=A1FVW5; Match level="QueryCoverage=35%, HitCoverage=40%, E-value=4e-42, Identity=73%"; Hit description =Putative uncharacterized protein
MDQLAFVAGARALSDAMQPHLSVRFEHVVRADGDEYTLIEGGQGSAPALHLQWRAAAGWEDEAWREGIGGRQALLRFLTCQDEAIARTCDGRWASTCIALPVDVDSLQPCSWKASVQPACRRWTWRCTRGWPSGCQGITDGQSTTHLRLEPCHRRNTSEGYIPPYRWWTASLPSKDGTPFAVLRGDNKPRPAARQRQRPAGAGLTGGCAGGSGEQSAIHTGIRPTPFRADAAAPAARPALDPAAPRTVAALADAGDGQRCARCGLRELVGRCAPRTIATAGPSLRGPCRTYALHHPQLPSRPLRAGVGRTAALPDAVSKAEQLALVPAS

SEQ ID NO: 123015 - protein, 112 aa, Glycine max
  Coding DNA Sequence Number=SeqID_31330
  Subcellular localization annotation: CTP_CleavageSite=58; ConfidenceScore=5.40e-01
MDKSSTTTTPVPPFQNAAGPSKPYVPPPIQQQQSQQRQQATEALPQPSLEELNPKNVSAITLGSGNQIQVPPPVAAPAPEPVKLHSTPEKEDEIDIGNGVNSTSFFAGKLPP

SEQ ID NO: 123016 - protein, 151 aa, Glycine max
  Coding DNA Sequence Number=SeqID_31331
  Gene Ontology: Mol. function=nucleoside-triphosphatase activity; Cellular component=chloroplast
  Homolog annotation: Hit_ID=Q2PMM5; Match level="QueryCoverage=84%, HitCoverage=6%, E-value=6e-63, Identity=79%"; Hit description =Protein ycf2
MESIPNIYTMVPYLDRIYYGDFVRFPLCLPQWNLISEIWNLISEIPGNCLHNLLLSEEIIHRNNELLLISTHLRSLNVQEFFYSILFLLLVAGYLVRTHLLFVSRVYSELQTEFEKNLFLVALEQLGDSLEEIRSFAFGGNMLWGGGPTYG

SEQ ID NO: 123017 - protein, 101 aa, Glycine max
  Coding DNA Sequence Number=SeqID_31332
  Subcellular localization annotation: CTP_CleavageSite=27; ConfidenceScore=5.31e-01
MYTGSATNWAYIQSPSNLRFLRFLSIVVKSFTSQRSTRDVPSRILFEKTKWMYPPYELIHKRCTLSCSQYNNPQVDVPFTCTTKDVPFNVLGQRILRRLVL

SEQ ID NO: 123018 - protein, 465 aa, Glycine max
  Coding DNA Sequence Number=SeqID_31333
  Homolog annotation: Hit_ID=A2E5Y7; Match level="QueryCoverage=89%, HitCoverage=32%, E-value=4e-11, Identity=22%"; Hit description =Putative uncharacterized protein
MEIDVFFVREKILAKQLTIVHVPALDQWADILTKSLSTSRFEVLRGKLNNSTSSSSDTVFAETGKWRVQEETCQLTEENKQKLESQPAIQNEETTFIKHPYSDGETAEINPTNDTEEQEDFPVSLAKEKLGIEDDGKFNQEEAKAIVEATKEEVQPNLPTPAIVQCDPDQIIQQQTLHNDESEAIDNAKSFIPKNKLERMSIVVEDTNQPEAMANVSTVKEEQADPHAKLCYDVDEQKTVDSHSVDNLESKGASVSEDKALQILPRTTSVCIEEVVKNIQEIHTEAELAVTDTKERQISENESEAKKEVSEYMLKRAFDLHRVACQTSAENEPKAEFLSEEQSYETIVTKHPNFERQTKEMNPTNETKEHEKVPASQTGEKLEIIDDRNFIQEGENEMEKQLKGSVLEDEVQTTLPTSTIVKGETIEGIVQEQTLEEEESVAIDNNSGRPENELEQMANVVEVSQ

SEQ ID NO: 123019 - protein, 20 aa, Glycine max
  Coding DNA Sequence Number=SeqID_31334
MTKDNDWYLKALHWGNERQH

SEQ ID NO: 123020 - protein, 117 aa, Glycine max
  Coding DNA Sequence Number=SeqID_31335
  Subcellular localization annotation: CTP_CleavageSite=9; ConfidenceScore=5.20e-01
MDTSEPYTRAMKGTMQKPHGGPLGTSTLTFRGLHALTFTGLHTLTFRRLHALTFRGLHVLAFRGIHTLAFRGLHVLVFRRLPALAFRGLHVLVFRGLLTLAFRGLHALALEDYTSSP

SEQ ID NO: 123021 - protein, 60 aa, Glycine max
  Coding DNA Sequence Number=SeqID_31336
MATEYRWKKDNWRRHFKEKMSQEEAHHQRKPWIRALSPLIQDQVQDSPLSVLTCHEACKA

SEQ ID NO: 123022 - protein, 15 aa, Glycine max
  Coding DNA Sequence Number=SeqID_31337
MIKASRVRPIPENAM

SEQ ID NO: 123023 - protein, 65 aa, Glycine max
  Coding DNA Sequence Number=SeqID_31338
  Homolog annotation: Hit_ID=A6FJQ2; Match level="QueryCoverage=58%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLLLTAVIEL

SEQ ID NO: 123024 - protein, 89 aa, Glycine max
  Coding DNA Sequence Number=SeqID_31339
MLWKLGRVDGDPVLRETRIRATWEYVSSVEGGQQGMVGLYVICGCGELFCTIARPPPSTTCDGVVPGDMSRGSGDLGDVRWGVIAQNQA

SEQ ID NO: 123025 - protein, 130 aa, Glycine max
  Coding DNA Sequence Number=SeqID_31340
MGSSGFDPIPFRSVLLIEFCKGSGLSSVNLEVFLMAALSLMLSTLTLLRLVYNGFQSKKQVEKRLVTVNPKGFLAKRRKALVYAHPAERRLSGRTRRQLPMPSRQNEKAMEGPKGTIFIVKKLSFLASSA

SEQ ID NO: 123026 - protein, 254 aa, Glycine max
  Coding DNA Sequence Number=SeqID_31341
RLPSKCWPRAHAIRPWPRHLRPIAGNCRRRWPKPCSRWRNASGGAPCLQRHCRRRQGLGDLRHAGRPWPGAGHAAARVVAGQCADLAARTVPDGAGPTQPDPVPSRYPALLRGVFRVGRAVAACLAAGVAGQHRGPGGLFVLGVAALGLQPGMELAGAGIHRSVAMAGRGPQPAVQRLPSAAAVAVLLPAGDAAGTPATVAAAGPARAAGAGPAADRGWTWRAAACAGNALAGVAGNAADAAGTGLRTHGCGRG

SEQ ID NO: 123027 - protein, 128 aa, Glycine max
  Coding DNA Sequence Number=SeqID_31342
MLSSNAEDSVRKKGFYKSWSSTTSATATNNVSEISVHEAKPAEKESLLVESNDDDDDDDTEIEDQDVEGGRTVAQNNDRGKGPPVIGGESSKIDGDEGPDVDKKADEFIAKRIESIKRSRRSARNSSR

SEQ ID NO: 123028 - protein, 91 aa, Glycine max
  Coding DNA Sequence Number=SeqID_31343
MLAIISKYQEELNLATAHEHKVADEYARVYMEKEARGRVIDLLHQEATIWMDRFALTLNGSQELSWLLAKAKAMADTYSAPEEIHRLLSYY

SEQ ID NO: 123029 - protein, 106 aa, Glycine max
  Coding DNA Sequence Number=SeqID_31344
MDNEEGVQEQMKADLSALKDQMASISEVMLKLQKTIEDKATATASSTVREAEPVLQPTLNPAPRPIWALQKVPPEGGCFWRKQPCSPGRAELAWASWAASISPILL

SEQ ID NO: 123030 - protein, 172 aa, Glycine max
  Coding DNA Sequence Number=SeqID_31345
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARFSQSRRCKTTASAKLACLQVDSRGSHCFIGLSPSLLTFRLIYFYKMVYSIIGFPGTELEFVIMVIAVSCVKLLSAHNSTQHTSRKHKV

SEQ ID NO: 123031 - protein, 93 aa, Glycine max
  Coding DNA Sequence Number=SeqID_31346
  Homolog annotation: Hit_ID=A6FJQ2; Match level="QueryCoverage=40%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGSSPSFLSKAHLGGEAPSSMAYSLVDGASSHLFSFVFRCISMVENHH

SEQ ID NO: 123032 - protein, 80 aa, Glycine max
  Coding DNA Sequence Number=SeqID_31347
MSQRALRGRARRGSWVCFPKEERCAESPPTFICGKRRKNRRKPVEIKILSSGVVFTFEKGRQKRGSCSYVPSIKEEIRPT

SEQ ID NO: 123033 - protein, 71 aa, Glycine max
  Coding DNA Sequence Number=SeqID_31348
MSVKNLVGSLGVHDKTNHRLASQVTLTRMLQPYGINIGLKEHSNRVTPKAYTPKSPSGPLPPDSGPTQKIF

SEQ ID NO: 123034 - protein, 70 aa, Glycine max
  Coding DNA Sequence Number=SeqID_31349
DHEQLDLVLRLPLALDLVAYWSAMWWRCVYCPLPAIPMLLWCFALRLPGDAVLLDESSISRGPDALAGGY

SEQ ID NO: 123035 - protein, 158 aa, Glycine max
  Coding DNA Sequence Number=SeqID_31350
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLEHVTGIVFGNVIDFTENGAASVVVVLEGRETCRASCINESANARGEAVCVLGALPLPRSLTRCARSFGCGERYQLTQR

SEQ ID NO: 123036 - protein, 191 aa, Glycine max
  Coding DNA Sequence Number=SeqID_31351
  Homolog annotation: Hit_ID=Q0ZCD0; Match level="QueryCoverage=96%, HitCoverage=16%, E-value=2e-08, Identity=26%"; Hit description =Integrase
MERSMIDAASGGALGDMTPAEARNLIEKMASNSQQFSARNDAIVIRGVHEVATNPSASSETKKLEGKLDALVNLVTQLALNQKSVPIARVCGLCSSANHHTDLCPSMQQPGAIEQPEAYAANIYNRPPQPQQQNQPQQSNYDLSSNRYNPGWRNHPNLRWSSPQQQQQQPAPSFQNAAGPSRPYIPPPIQQ

SEQ ID NO: 123037 - protein, 358 aa, Glycine max
  Coding DNA Sequence Number=SeqID_31352
  Gene Ontology: Mol. function=nucleoside-triphosphatase activity; Cellular component=plasma membrane; Biological process=DNA recombination
  Homolog annotation: Hit_ID=Q48ID9; Match level="QueryCoverage=43%, HitCoverage=29%, E-value=1e-64, Identity=80%"; Hit description=ABC transporter, ATP-binding protein
  Pfam annotation: Domain name=ABC_tran; Domain location=223-324; Score= -44.7; E_value=0.0035; Accession=PF00005.18; Description=ABC transporter
  Pfam annotation: Domain name=Phage_integrase; Domain location=24-185; Score=17.5; E_value=5.6e-05; Accession=PF00589.13; Description=Phage integrase family
  Pfam module annotation: Pfam domain module=ABC_tran::Phage_integrase; Domain location=223-324::24-185
TQAEAIQLPARLRKEVDPFTLEQANLIIAELYKHPHWPGQIYAAFSEFMYFTGLRLSEGLALTWDAVDTTKKTAHGLARLGVCQAVRRATQAGQRAFHRIAVRLPAWKEWGVRQADVGPAPSVAPVLKGLGIKYRTPYNCRHTYATICLMSGLNPAFIAQQLGHSVQMLLSTYARWIHSSNDWQELEKLQIGPELLLDLHRNITMQFGSKPLFENVSVKFNNGNRYGLIGANGCGKSTFMKILGGDLEPSGGQVMLEPNTRLGKLRQDQFAYEEFTVIDTVIMGHGQLWKVKAERDRIYSLPEMTEEDGMAVAELETEFAEMDGYTAESRAALRPDERGGSGLEAACPAGPGAVLGPG

SEQ ID NO: 123038 - protein, 216 aa, Glycine max
  Coding DNA Sequence Number=SeqID_31353
  Homolog annotation: Hit_ID=Q9LW80; Match level="QueryCoverage=85%, HitCoverage=98%, E-value=2e-14, Identity=30%"; Hit description =Arabidopsis thaliana genomic DNA, chromosome 3, P1 clone: MSL1
  Subcellular localization annotation: CTP_CleavageSite=61; ConfidenceScore=5.08e-01
MLLRETIRKTRVLFHKTLRSFKSVIFGGYQKLPRSLSFNPFVGRSGNARTYTSEQFYNEFYDMLQSDLNRIKRSDSNSMSRSREHAIGDAVNTEILRKQSSQKSIAEEGVVVEEKKNKGSCEMGKKECLNNSKSMNEGVHDLAEKMKELEMMDTGDVEHELDIEEALHYYSRLKSPVYLDIVDKFFMDMHSEFSVQESSISVKRSKSKGRPDSIRL

SEQ ID NO: 123039 - protein, 99 aa, Glycine max
  Coding DNA Sequence Number=SeqID_31354
  Subcellular localization annotation: CTP_CleavageSite=12; ConfidenceScore=5.04e-01
QLSGPCLAKPPIASRKRKSIGSRPTAQYDTRRFSSLDAWTRYTDNFLGRNILPERKVEIYHSELDEFKAELERRNFHKRLTNLVDGSIDLALVKEFYAN

SEQ ID NO: 123040 - protein, 139 aa, Glycine max
  Coding DNA Sequence Number=SeqID_31355
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLEAGTELEFVIMVIAVSFGKPVVPAALMNRPTRGERRFAYWALFRFLAH

SEQ ID NO: 123041 - protein, 170 aa, Glycine max
  Coding DNA Sequence Number=SeqID_31356
  Gene Ontology: Mol. function=chlorophyll binding; Cellular component =integral to membrane; Biological process=photosynthetic electron transport
  Homolog annotation: Hit_ID=Q2MI75; Match level="QueryCoverage=98%, HitCoverage=42%, E-value=1e-76, Identity=70%"; Hit description =Photosystem II P680 chlorophyll A apoprotein
  Pfam annotation: Domain name=PSII; Domain location=1-170; Score= -105.5; E_value=9.4e-07; Accession=PF00421.10; Description =Photosystem II protein
QQTPIELFGPTRYQWDQGYFQQEIYRRVGAGLAENQSSMDNGDGIAVGWLGHPVFRDKEGHELFVRRMPTFFETFPVVLVDGDGIVRADVPFRRAESKYSVEQVGVIVEFYGGELNGVSYSDPATVKKYARRAQLVRGVGLLLDIASFALLFLFGHIWHGARTLFRDVFA

SEQ ID NO: 123042 - protein, 180 aa, Glycine max
  Coding DNA Sequence Number=SeqID_31357
MGEAEEVQEKMKAENGGHKRANGHNDEGHDEHEEDNGSQCGKDLGSTDDPMMCKFKTSTPSHHMACLPTIHHPMWHTLSMKISITPLRYSLRTNPPHQAHISQTMGKTHEIPHHNLADFEPWLEYATEGQAVGGIPFENTLESPQFRPQPQPLHFCGGKSPSCYGRKGKDGSSKGKAQGH

SEQ ID NO: 123043 - protein, 295 aa, Glycine max
  Coding DNA Sequence Number=SeqID_31358
MNSVITVLYFNGMVYEDNDGVIFEGSKNVIQIKRGISFNALKKKIGDKVNLQNNEIISAISCRFLVSGKYIALQICDDEDVETMLESFKQQDQMSVLELYIEKDVAGGSMFHSANSLTSCGNYLSNDETQPTTNMSNLHIDEDDDDDDDDYVVSNSYVEESLDEDDSLDGISDTDDEVTDIPQPVRIVHPAEGAQRIENPFWNDALHYNNINWSYPDEEDICGLEMPSTFNVGQELYVGMEFDSKDAVKNAVKQYVMKVHQSFKVVESKTNKYVVCCVNKNAECPCPFYMRANYI

SEQ ID NO: 123044 - protein, 97 aa, Glycine max
  Coding DNA Sequence Number=SeqID_31359
MVEETSIESDVSSIGASEWRRKRERRCHFKEKMSLEEAHHHRRSWIRAWRKKEMNEGRGREEHEILCSKRALKSEFNIQMIKPTNPRSIPRFSTKCA

SEQ ID NO: 123045 - protein, 77 aa, Glycine max
  Coding DNA Sequence Number=SeqID_31360
MNKDGVNSKANAVKRVEDEDDLFLATNDEVAKTKWRSEMFDTLKTDGEFAYFKLGNGGKMKVEGIRSVRIKLHDGAI

SEQ ID NO: 123046 - protein, 104 aa, Glycine max
  Coding DNA Sequence Number=SeqID_31361
MTGPLDESISCFLIRVDPWVLVPITLRGLHVLAIRGLHAFASRGLPVLALRGLHALTLGLHALTFRGLHVLALRGLHALTFRGLHVLALRGLHALTLGTSYPHQ

SEQ ID NO: 123047 - protein, 55 aa, Glycine max
  Coding DNA Sequence Number=SeqID_31362
MAAEWRMKRERRRHFKEKMSLEEAHHHRRPWSMVRTENPFPGHLPMREYSSSPTQ

SEQ ID NO: 123048 - protein, 205 aa, Glycine max
  Coding DNA Sequence Number=SeqID_31363
MVLKEELIACSMSKRSLSQHLCETETNMLAIIAKYQEELGLATAHEHRIADEYAQVYAEKEARGRVIDSLHQEATMWMDRFALTLNGSQELPRLLAKAKAMADTYSAPEEIHGLLGYWKNTITKRAARYPYRTRSKSRTMGDQEEMQEQMKADMSALKEQMASMMEAMLGMKQLVEKNAATAAAVSSAAEADPTPWQLRTILPQT

SEQ ID NO: 123049 - protein, 171 aa, Glycine max
  Coding DNA Sequence Number=SeqID_31364
MGDPISRLSFPENTETFSSLTSYPELRRSEFLIGGYVGARASLLSTTPPFVVMTQELVARGDTLRLSAPFCHPEPAGPMTSRDQAAGPMTSRDQVWSFCTHDTQRYLMVIRTLLSSRGGGPDDKQRPSGGPDDKQRPSLVILHPDYAEIPYGYSHPFCHPEAAGPMTSRDQ

SEQ ID NO: 123050 - protein, 16 aa, Glycine max
  Coding DNA Sequence Number=SeqID_31365
MVGISSVGRAEGLKIL

SEQ ID NO: 123051 - protein, 157 aa, Glycine max
  Coding DNA Sequence Number=SeqID_31366
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=3e-20, Identity=30%"; Hit description= UPI00006A17C9 related cluster
  Subcellular localization annotation: CTP_CleavageSite=66; ConfidenceScore=5.65e-01
MCSHLKAGTCISLKVRTSSPLKVKTCSPLKASMCNPLKARTQSPLKARTCSPLKTRACHPLKARVRSPLKARTCSPLKARACSPLKARTCNPLKARTCSPLKARACSPLKARACSPLKARACSPLKGRTCSPLKARTCSPLKVRTCSPLKVRACSPL

SEQ ID NO: 123052 - protein, 273 aa, Glycine max
  Coding DNA Sequence Number=SeqID_31367
  Homolog annotation: Hit_ID=A8GKW5; Match level="QueryCoverage=100%, HitCoverage=100%, E-value=1e-148, Identity=91%"; Hit description=Myo- inositol catabolism IolB domain protein
  Pfam annotation: Domain name=IolB; Domain location=20-266; Score =529.7; E_value=3.2e-156; Accession=PF06845.3; Description=Myo -inositol catabolism protein IolB
MSSLLAKCQTPNAEGRIQHVTPENAGWRYVGFDVYRLAAGQSLQLECGDKELCLVLVAGIASVATLRAEYPHIGKRMSPFERTPPYAVYVPHHDRIDVRAETDLELAVCSAPGSGHLPSRLITPADIGVERRGKGRNQRLVHNILPDSEPADSLLVVEVYTDEGNTSSYPSHKHDREDSPDETYLEETYYHRIQPEQGFCMQRVYTDDRTLDECMPVYNRDVVKVPRGYHPVATLAGYDNYYLNVMAGPVRQWKFTWEKDHAWINGDGYPAAQ

SEQ ID NO: 123053 - protein, 79 aa, Glycine max
  Coding DNA Sequence Number=SeqID_31368
MESLPLIVFGSPKTKSMDKSIQGYSGIGNGGIALGIPPTSHAFLMQSYPPRILDRRLQEAWARATKEGPRVLMNLRVDF

SEQ ID NO: 123054 - protein, 27 aa, Glycine max
  Coding DNA Sequence Number=SeqID_31369
MHIVVVLRNGCNWGWGHDRLIVAPSLR

SEQ ID NO: 123055 - protein, 92 aa, Glycine max
  Coding DNA Sequence Number=SeqID_31370
MWSHLKERKCSPLKARTLSQLTLRREGDARAHRSVFQERKMRGVATNVYSRKTSEKLESCGLRTLSVKGPGVVFTHGEGISTPRVRHKGRQP

SEQ ID NO: 123056 - protein, 151 aa, Glycine max
  Coding DNA Sequence Number=SeqID_31371
MTQELVARGDTLRLSAPRHSVTPSVIDEQRPMWSSAPFPEMSASSSGDFFKSHKLSRTTHSRVRWHAETNYGHSAPFCHPEAAGPMTCGDKLWSFRTPFAIQTQSCSDGTQRQIMVILHPSSIAADMPVDTRRFTSSSALTRSVILNFESR

SEQ ID NO: 123057 - protein, 114 aa, Glycine max
  Coding DNA Sequence Number=SeqID_31372
MVYGINLKILMSHNNSFQNCPMYGVACQCYDSTSDSPPLSASPYQLALTLYASGSYNAQWNAPGLLHDKHTLRSSRILRKMEVEEPWLGLFAAKFLFVGVFLVCAKGGLRRGIL

SEQ ID NO: 123058 - protein, 73 aa, Glycine max
  Coding DNA Sequence Number=SeqID_31373
MDPFMVTSKGNEVLDKGILSPLICLKYFSRDMSSLKDDANFKFHPNCAGLSISSDKSVIYSAGIRPHELSHIQ

SEQ ID NO: 123059 - protein, 145 aa, Glycine max
  Coding DNA Sequence Number=SeqID_31374
  Pfam annotation: Domain name=zf-CCHC; Domain location=38-55; Score =11.8; E_value=0.025; Accession=PF00098.14; Description=Zinc knuckle
DQAHGILGVAPSRPKEDKGKTIEKYTPKTSSQERTSNIKCFKSLGRGHIASKCPTKKTMIMRGQDIYSSQEETTSCPSSSGSEDEVRGEESSEEVYPHEEGDLLMVRRLLEAKARLTGALSKGGKMRGVTTNVYLWKTSGKPKET

SEQ ID NO: 123060 - protein, 104 aa, Glycine max
  Coding DNA Sequence Number=SeqID_31375
MGSFTDSAWEWNLSWRRPLFDNEVASTVGFLEDISHTALQQHAADSWVWKPESNGYYSSRSAYILLQRNSEEGNMDDIFKDLWKPMIPAKASIFAGRVTPAAVL

SEQ ID NO: 123061 - protein, 151 aa, Glycine max
  Coding DNA Sequence Number=SeqID_31376
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGQGSKKSKVVSQWGLLSWEPDLDIWGTELEFVIMVIAVSFGKPVVPAALMNRPTRGERRFAYWALFRFLAH

SEQ ID NO: 123062 - protein, 123 aa, Glycine max
  Coding DNA Sequence Number=SeqID_31377
MCISTKSIKFRKGISIKDTKGMYLDSLESSEENFFRGKHPCRGASVTLSRLFRERFREDSSPFFIVLRHSSLFFGLQPTTPFRVFQHFPRINVGGDSAHFCFLDDTPVSPASPSRRRVGCDNW

SEQ ID NO: 123063 - protein, 87 aa, Glycine max
  Coding DNA Sequence Number=SeqID_31378
  Homolog annotation: Hit_ID=A6FJQ2; Match level="QueryCoverage=43%, HitCoverage=84%, E-value=3e-11, Identity=92%"; Hit description=50S ribosomal protein L5
MPGADKPVRARQRVFDGCRGWLNYAASEQIMRKEKIPHQAPFAIQAAQLLGRAIGAGLFAITPAGERGMCCKAIKLGNARVFPVTTL

SEQ ID NO: 123064 - protein, 61 aa, Glycine max
  Coding DNA Sequence Number=SeqID_31379
MRKSGGKGQTTHTPQGMIIWFLLKQNVEGKIDEECLWKPKNLVRTSSLALSDLRHLMETPS

SEQ ID NO: 123065 - protein, 173 aa, Glycine max
  Coding DNA Sequence Number=SeqID_31380
  Subcellular localization annotation: CTP_CleavageSite=75; ConfidenceScore=5.19e-01
LLANNQTTATSGGLFAGSRATNSASEGHHFKNSVARPTYLALLILLPVAAASGDKSCLTGATLPEGRKTYRYPVSARVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 123066 - protein, 119 aa, Glycine max
  Coding DNA Sequence Number=SeqID_31381
MTPAEARNLIEKIASNSQQFSARSDAIVIRGVHEVATNSSGETKKLEGKLDALVNLVTQLAMNKISAPVAKICGLCSSADHHTNLYPSVQQYEAIKQPEAYAANIYNRPPQPQQQNQPQ

SEQ ID NO: 123067 - protein, 67 aa, Glycine max
  Coding DNA Sequence Number=SeqID_31382
MARTHIPVEAEIFTRDSPQISASPHQLDLAPYALRSYSAQWNAPGLLHDKHALRSSRILGKMEVEET

SEQ ID NO: 123068 - protein, 107 aa, Glycine max
  Coding DNA Sequence Number=SeqID_31383
  Subcellular localization annotation: CTP_CleavageSite=39; ConfidenceScore=5.18e-01
VSRTFPLDLMMKFVQFQLSLAHQWAKRASTDKRSFSALSATEESGRASISRPHAKCEISALSAGVVFSQAQRTTGAKLKSTYAAKHKGGAKCNVANSSLFKACLVQN

SEQ ID NO: 123069 - protein, 112 aa, Glycine max
  Coding DNA Sequence Number=SeqID_31384
MVEPSKKRKGSLSRSQRHSEVQDTPFPPPHYCHQKNNVHAFYSNLEIQESTLISEVYGIKMVIGQSHFYDLTQLSSDGVPFEGALDDDWKFDFSVHDARQLVCTNQSGYDRK

SEQ ID NO: 123070 - protein, 143 aa, Glycine max
  Coding DNA Sequence Number=SeqID_31385
MDNEEGVQEQMKADLSALKDQMASIMEAMLKLQKTIEDNATAAASNTAREAEPGRDEGDAHLGPPTSLKEPFPHELPQPNIVRHVSSPSALVKELVPFAKDMGKIDLLEERLRAVEGLGNYPFSDLADLCLVPDIIIPPSLKY

SEQ ID NO: 123071 - protein, 98 aa, Glycine max
  Coding DNA Sequence Number=SeqID_31386
MLYREEKKNLNEANRHLHWRFTLCLQPAPSQLHSCTARLCLSTLQRQPASQTSGFQNQAQTRQHGWRVQASMDSPVTLTFSLPRGRCSANSPLPMAVC

SEQ ID NO: 123072 - protein, 285 aa, Glycine max
  Coding DNA Sequence Number=SeqID_31387
MAKFDPEVVLEFYDNAWPTEEGVRDMRSWLRGQWIPFDANALSQFLGDPLVLEEGQECEFSQRRNRADGFDEEAIAQMLCTPGQDFAWITAGRRVRIMRTSMTTLTQTWMTLLLSNVLPSDHNSDLPLPKCQLVYAILTRMSVHVAQVIADAIYLFAGMPPTRHSLDSDKSNRALGFPALITGLCQSFGVPVTPSKVIRPPITRAFIEKYCMPRQAQGDAPQAADAPPPPHQADPARSLGIERYLQHLVRQQAVNHRGRCKYMSVSTSSASVSKGRVSLLLHALL

SEQ ID NO: 123073 - protein, 43 aa, Glycine max
  Coding DNA Sequence Number=SeqID_31388
MEAQSLLRLFGVWEFYRSSQRKNWRSLKESLETLLSLSEDTDP

SEQ ID NO: 123074 - protein, 68 aa, Glycine max
  Coding DNA Sequence Number=SeqID_31389
  Homolog annotation: Hit_ID=A2Q2F9; Match level="QueryCoverage=86%, HitCoverage=8%, E-value=1e-12, Identity=61%"; Hit description =Prefoldin
LKSFCMEGERERMSEQIMVLENKLLEALDWKFMHETDLKKNSDLMIEDVHNDGNLISKQVFRLAVTFQ

SEQ ID NO: 123075 - protein, 68 aa, Glycine max
  Coding DNA Sequence Number=SeqID_31390
MVVSFFLTHLLLEVASPLSLPFSIPLPLIFQEAKESIDEEDPRPTSSNGAYIMWYQEHLHLGSIIFHS

SEQ ID NO: 123076 - protein, 256 aa, Glycine max
  Coding DNA Sequence Number=SeqID_31391
  Homolog annotation: Hit_ID=A7QZ64; Match level="QueryCoverage=98%, HitCoverage=71%, E-value=1e-86, Identity=58%"; Hit description =Chromosome undetermined scaffold_265, whole genome shotgun sequence
  Pfam annotation: Domain name=DUF821; Domain location=1-250; Score =228.1; E_value=2e-65; Accession=PF05686.3; Description=Arabidopsis thaliana protein of unknown function (DUF821)
AEINIKPWHILLGELKEGTTRIPWLNREPYAHNKATYIASFLTNENFVSGLVSRITRGVQQIRLAKYKVYIEGSAWSVSQKYILSCDSTTLLVKPKYYDFFTRGLIPVHHHWPIKDDEKCRSIKFAVDWGNNHKQRAHQIGKVASDFIQEEVKMDYVYDYMFHLLNSYAKLFRYKPSISVNATELCVESMVCGAEGSVKKFMMESLVKVPANTDPCTMPAPFDPPTLYATSQRKESSIQQVESWEKSYWDNQTITS

SEQ ID NO: 123077 - protein, 86 aa, Glycine max
  Coding DNA Sequence Number=SeqID_31392
MKKEITSWQLANAKLAGVGGRLKNNGMCSGLVPYLHCSSVVPELASLFLLILFMYMCELKLSAEDQKGLKRKIITTIKTKRVVKPK

SEQ ID NO: 123078 - protein, 172 aa, Glycine max; identical to SEQ ID NO: 121414
  Coding DNA Sequence Number=SeqID_31393
  Homolog annotation: Hit_ID=A6FJQ2; Match level="QueryCoverage=22%, HitCoverage=84%, E-value=3e-11, Identity=92%"; Hit description=50S ribosomal protein L5

SEQ ID NO: 123079 - protein, 188 aa, Glycine max
  Coding DNA Sequence Number=SeqID_31394
MNQQAEQEWSGCIQIAARPSLVGNTQQQAPNARDQNNMKSNGSLRPVGAPHMGSNRHLESGVGPGAPCTPVHAVNPRRSPDQQLTPRLRESACISSTTEQCDVLARLSATVDRGIVQLVVHMHQRSYYLGVPPGLTEQIECNPEDEEDMHEPQLSNNLPDIGARRYHIPIAGVRTVHDTALSQPWQPL

SEQ ID NO: 123080 - protein, 176 aa, Glycine max
  Coding DNA Sequence Number=SeqID_31395
FMNDWSTSIGFSPVYGFLEPQSIRCIKDTREECQKYIETWVKESHREIYLGPYFNQAHWQLLVLCPRENIIVWLCSIRRKPDVHIKFAVNKKYAVISKARTMHLHLHLNGLRLSHVQQGGYECGYYVMHWMWCIVSAGLKNELHNYFSDGTALDTDTMTTIHKKWAAYFLEVGKWM

SEQ ID NO: 123081 - protein, 231 aa, Glycine max
  Coding DNA Sequence Number=SeqID_31396
ALAGQNKWLLFIDILARLIFGVVLFPNVDGLVDLAEIDAFLAFHHNKESPVVAILTDIYDTFDQRGAPSVESLTPFITRGFSDPNARVLQRVRKAWEVVERKDRELRGSSNRTIGGYHRWLRAYTQGLDWLPKLRAAKEEEVEAPKEREEVQALKAELEKAQAIKEKFKTTAVKIRRENDELRDINTATAKALEQEPKRAWKEEHSRNKFRGALWGSNNELKLQREERNQS

SEQ ID NO: 123082 - protein, 338 aa, Glycine max
  Coding DNA Sequence Number=SeqID_31397
  Homolog annotation: Hit_ID=A7ZM93; Match level="QueryCoverage=69%, HitCoverage=99%, E-value=6e-53, Identity=50%"; Hit description =Putative uncharacterized protein
VFDNAGATARFARDAGVAPVQDQPVVAIDLEFSGHHLQQLLFHLIDVLAWREVSAVAHPEDVGVHGDGRPAEGGIEHHVGGLAADARQRFQRGAIFRHFAAVQLQQHAAGFDHVFGLAVEQANGLDVLLDAIDPQRQHGGGGVGDRIKLGGRLVDADVGGLCGQQYRDQQFKRRGVHQLGGRVRVVVAQPGQNFQSLLLVHQAFSARPCSSSGSTATARALRAFIFSSIRYLTASSSPRPIKAPGGNMASRNGLSKCTTSMRSDLAQPPSSWSAPSNSVPLPNSSRIEPSVTITPVAPRPIARPSSAERPTGFRAATASARPTTMQLVTINGIKIPSD

SEQ ID NO: 123083 - protein, 75 aa, Glycine max
  Coding DNA Sequence Number=SeqID_31398
MQNSRVTLRAESQHFASVNDANPYVASIPYFGFIDEIWELNYVKFTNKLDKYFTCKTLVMTGGAWFCRAKQLVSL

SEQ ID NO: 123084 - protein, 48 aa, Glycine max
  Coding DNA Sequence Number=SeqID_31399
  Subcellular localization annotation: CTP_CleavageSite=30; ConfidenceScore=5.13e-01
MKKSKPKRFRNVSVGDFAKIVNRSSTFVVRSSSFFGLQPISKKPKINM

SEQ ID NO: 123085 - protein, 216 aa, Glycine max
  Coding DNA Sequence Number=SeqID_31400
  Gene Ontology: Mol. function=methyltransferase activity; Biological process=metabolic process
  Homolog annotation: Hit_ID=Q0WVD6; Match level="QueryCoverage=37%, HitCoverage=13%, E-value=1e-26, Identity=72%"; Hit description =Probable protein arginine N-methyltransferase 3
MTVKTSDTCSSRRRSQLVCKRMPGADKPVRARQRMRKEKIPHQAPFAIQAAQLLGRAIGAGLFAITPAGERGMCCKAIKLGNARSFDLATMKPNEVDFTATATLELKPSYSGTCCWCYGVVLWFDTGFTSRFCQETPAVLSTSPYMPRTHWSQTILTFREPIAMGFGKGNGTELEFVIMVIAVSFGKPVVPAALMNRPTRGERRFAYWALFRFLAH

SEQ ID NO: 123086 - protein, 91 aa, Glycine max
  Coding DNA Sequence Number=SeqID_31401
YTMNSVITVLYFNEKENILPCKFVMTKTLKRCWKVLNNKNKYDGDDDDDYLVSNSYVEESLDEDDSVDDIFDIDDEVTDMIQPVRIVHAAE

SEQ ID NO: 123087 - protein, 139 aa, Glycine max
  Coding DNA Sequence Number=SeqID_31402
  Gene Ontology: Biological process=transposition, DNA-mediated
  Homolog annotation: Hit_ID=Q1J7G7; Match level="QueryCoverage=23%, HitCoverage=47%, E-value=3e-10, Identity=90%"; Hit description =Transposase
MVKVGTSYVPINVSFSPKVGPGLPGINRDTRIYLFCEVIFRHRYLFGAKVRRWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 123088 - protein, 26 aa, Glycine max
  Coding DNA Sequence Number=SeqID_31403
LQAQQTEQNTFKENLIHLEEIFVYAV

SEQ ID NO: 123089 - protein, 73 aa, Glycine max
  Coding DNA Sequence Number=SeqID_31404
MSYQARHSGEGCAKRQHHSVLKSLEVRLVQVVALSLNHSLKIFGVAESAKRHYRTKPQMLTGSYNFKLGLARG

SEQ ID NO: 123090 - protein, 60 aa, Glycine max
  Coding DNA Sequence Number=SeqID_31405
MSELPSKRETRTGDDGGEYHQLNGSQRLLLDVMTTKMQLLLNRNNEELYGRIKGLERQMN

SEQ ID NO: 123091 - protein, 83 aa, Glycine max
  Coding DNA Sequence Number=SeqID_31406
IGWSVPSRHRDRARKTPSGPEEVQQGLGVSSSDYEPLSVLQSACRPQQGHQAPINRAFIEKYCAPSVAYDTWPTNRRPSPKPK

SEQ ID NO: 123092 - protein, 474 aa, Glycine max
  Coding DNA Sequence Number=SeqID_31407
  Homolog annotation: Hit_ID=Q2HW90; Match level="QueryCoverage=66%, HitCoverage=66%, E-value=9e-25, Identity=28%"; Hit description =Putative uncharacterized protein
MASQEEWVPFADILALLIFRVVLFPNVDGLVDLTAIDAFLAYHHRKESPVVAILADLFDTFDRRCEKNSARIVCCLPALCVWLVSHLFQQDIRHSWPLQSYRLCVEKKRLDWDQYLVGIGGSTINWFPRGKEGNEGVLFSCGDYPNVPLIGTRGCINYNPALAIRQLGYPMRGAPTEESLSPFLVRDFGTQSLKVVQRVHKAWKSPLRKDKELRGIRNGIIGGYHEWLRVHTRGLDWLSKLKIINEENFEAPEENEEVQALKAELGKARLAKEKFKLVATDIRKECVELREENAATARALEQETKRAHKEEHGRDKFRGALWGSNSELKLRREERDQSRVHGMVLKEELAACSRSKRSLAQHLEAMEQSMLAITGQYKEELNQSMTHEQKLVEDFAQAYTEKEARGRVIDALHQEATMWMDRFASSLNGSQDLPRLLAKAKAIAEVCSAPEEIHGLINYCQHMIDLMAHIIRNR

SEQ ID NO: 123093 - protein, 78 aa, Glycine max
  Coding DNA Sequence Number=SeqID_31408
MAASDFPRVFSPFAIMLHSFLLELFFHLFFFTDFIFTGFRLSDPNFVWGLSYPNFVREPLLDDVRPFFGPREVLATHH

SEQ ID NO: 123094 - protein, 453 aa, Glycine max
  Coding DNA Sequence Number=SeqID_31409
  Homolog annotation: Hit_ID=Q2HVW1; Match level="QueryCoverage=28%, HitCoverage=53%, E-value=4e-09, Identity=31%"; Hit description =Putative uncharacterized protein
  Subcellular localization annotation: CTP_CleavageSite=44; ConfidenceScore=5.47e-01
MKVHIKQKPMGAKTGKDGPPCTNEASRKGVVGTSTTKSYAEAVMALGRKSNSSTKEVNQFGNNTSTCSTFSLAISVEDKARYQNAWVGRLKNIAIFERLEEEMVWNVGSGISASYMGDDMAILFGLSEKKAADIIRQEKEQSSSLFYSLTKWSPQLRAETRLVWLRVWGIPLLAWKTDFMRRMVAAVGDFVDVDDDVEHMQRLDRARILVRTPRPPLIQHVAHVLIDGVRHRIDIVEENGGGELGDTRHGRNLWSSSEEVPSDVADDDMDSVISWPSGTFPPRDAGISAGDTTADCRDARSSPLPVGCSRDVDPAVNDLPDRVLTTLSPSGSVVSPSRKLFELAIAPQPTHPATIHEYVADPVLECQNLPHLSNTVSTSSPKAFSDGPFEEGDIPSPGRILKNNSHINGSHTPPFESFDKQTHHLNGPCTPVAQQTVSHSPHQKQQMLSSGLQ

SEQ ID NO: 123095 - protein, 68 aa, Glycine max
  Coding DNA Sequence Number=SeqID_31410
  Homolog annotation: Hit_ID=A6FJQ2; Match level="QueryCoverage=55%, HitCoverage=84%, E-value=3e-11, Identity=92%"; Hit description=50S ribosomal protein L5
MQFPGDGHSLSMRKEKIPHQAPFAIQAAQLLGRAIGAGLFAITPAGERGMCCKAIKLGNARVFPVTTL

SEQ ID NO: 123096 - protein, 113 aa, Glycine max
  Coding DNA Sequence Number=SeqID_31411
GIDWDSTKYMIIVENEIAWNEYVKSHEEVKRFRFKVIPNWDDIVDLCAKDRATGLGAENALDADDIMSKETNEEEKEGMISSMKEVAESLKEFVEVTKKKMEIKEAQEVVHEV

SEQ ID NO: 123097 - protein, 148 aa, Glycine max
  Coding DNA Sequence Number=SeqID_31412
MISLKAGDALSLVVPIAALLLPKRMISLEAGTNENNDGSDDEHKEDEVNIATTVAASIATKRDSTHPLGFNQEGHLVSDVVGQGDEATSNAYGPYYVQVQNKSSFPLYGLPPNCTPLTVVYALSENIGYTTEGPAFSNVLVPNAPRDP

SEQ ID NO: 123098 - protein, 80 aa, Glycine max
  Coding DNA Sequence Number=SeqID_31413
  Subcellular localization annotation: CTP_CleavageSite=56; ConfidenceScore=5.69e-01
MSSTLKMRTRSPLKVRACSPLKARSCSPLEVRACSPLLARTCSPFKVRACSPLTVRSSGKVRACNPLMVRTCSPLKAEDV

SEQ ID NO: 123099 - protein, 124 aa, Glycine max
  Coding DNA Sequence Number=SeqID_31414
MHENKWHGACLLFAPIREPIGQYLGVSNNYSPTIHNSHGCFLERSRQLLQRALRGRAKARLTGALSKGGKMRGVATNIYLWKTSEKPKVDKSGAFAPTYPPSKRNSDPLVLERCVNQVILLLEG

SEQ ID NO: 123100 - protein, 191 aa, Glycine max
  Coding DNA Sequence Number=SeqID_31415
MGSSSFNGSWATPDIGGGPTVRAQPEREAITQLLCIPGQDFTRACKETNIDDIATSQHLPSDRNANLPLQKYQLVCVVPTWGSHPRDTQWTRKSPTGPWGFQLWLRASISPTGCSYPPDKGSRLQDTQWTRRSPTGSWSCQALITGLCQFYRVPVTSSKGIMPPTNRAFIKKYCAPRQAQGETPQQHWDGR

SEQ ID NO: 123101 - protein, 223 aa, Glycine max
  Coding DNA Sequence Number=SeqID_31416
DGILYSEVQNIPIVIDQSLFFSLTKLSSQGVPFEGTLVDGWKFDYSSHYARRMVCNDQADMIGRLLAGSLTFDCRIMHYIIALRANAPLPYPHLVTLFLHHFNIPLGDEPFFKVKRSFSISAGAVTSFGYRKNVDGQWVHKHDLPPPILDERTPYPPPQRDDSTSLMTKVLTELSGLRAFVGERFNVMDTRLDAMDTRFDGMDTRITRLKDDMSFIRRCFNPL

SEQ ID NO: 123102 - protein, 46 aa, Glycine max
  Coding DNA Sequence Number=SeqID_31417
MELERLIKRLSDSGIDDAEEEEDAAEEEEDAAEDTESDDDDSEATP

SEQ ID NO: 123103 - protein, 62 aa, Glycine max
  Coding DNA Sequence Number=SeqID_31418
MTRAYFKLCMENVIMKLRCPKKHPFLVKHALEENTRIMYEQTKSMLNAYDDAMTHAKCEAGI

SEQ ID NO: 123104 - protein, 82 aa, Glycine max
  Coding DNA Sequence Number=SeqID_31419
  Gene Ontology: Mol. function=4 iron, 4 sulfur cluster binding; Cellular component=integral to membrane; Biological process=protein -chromophore linkage
  Homolog annotation: Hit_ID=Q70Y03; Match level="QueryCoverage=57%, HitCoverage=6%, E-value=3e-19, Identity=95%"; Hit description =Photosystem I P700 chlorophyll a apoprotein A1
MYFHGARFSNYEAWLSDPTHIRPSAQVVWPIVGQEILNGDVGGVGFRMEYKLPNPWCSPSIKGLGKTLFLWAGHHQSHIKYP

SEQ ID NO: 123105 - protein, 150 aa, Glycine max
  Coding DNA Sequence Number=SeqID_31420
MASRKRKSIATRPTSQYDTRRFSSLDVWTRCTDNVLGRNILPKRKVELYHTELDDFKAKLERCNFHKRLTNLVDGSIDLALVKEFYANLYSSEDRPSKQSKVRGHLVKIDADSLNTFLETPMVLAEAETLPAYSRYCMLVLSTTEFKKVG

SEQ ID NO: 123106 - protein, 96 aa, Glycine max
  Coding DNA Sequence Number=SeqID_31421
  Homolog annotation: Hit_ID=A5C549; Match level="QueryCoverage=80%, HitCoverage=15%, E-value=2e-10, Identity=39%"; Hit description =Putative uncharacterized protein
RFKKTFNGSQDHETAPIPLTGDQVFQRVQHLNVKNLFDSVIETFLNIQGKTKDGLNTRQDLVELGIRSQLLMRILKHAKYRLKAQVEKDEGPSGEG

SEQ ID NO: 123107 - protein, 121 aa, Glycine max
  Coding DNA Sequence Number=SeqID_31422
  Homolog annotation: Hit_ID=UPI0000ECBAF8; Match level="QueryCoverage =33%, HitCoverage=48%, E-value=1e-16, Identity=100%"; Hit description= UPI0000ECBAF8 related cluster
LLAKPICRLSEPSAERTTLVAEREEESGRRISWTPMLNWQRTESEEEVILRALDESVSDCEVLKSRPAGMQAWHWPSFYNVVTGKTLALPNLIALQHIPLSPAGVIAKRPAPIALPNSCAA

SEQ ID NO: 123108 - protein, 73 aa, Glycine max
  Coding DNA Sequence Number=SeqID_31423
MVSVDEVEDADAPVPVPTDEFSLVGQALHTFLAWPTHLGKLPGNHIINETSMRVGLHPQKETTPEYLAFHRFK

SEQ ID NO: 123109 - protein, 59 aa, Glycine max
  Coding DNA Sequence Number=SeqID_31424
MIMMTQDIYSSQAKITSSPSSSGSEDEVRVGESSEEVYPHEEGYLLIVRRLLEVVVAQD

SEQ ID NO: 123110 - protein, 131 aa, Glycine max
  Coding DNA Sequence Number=SeqID_31425
  Homolog annotation: Hit_ID=UPI0000ECBAF8; Match level="QueryCoverage =31%, HitCoverage=48%, E-value=1e-16, Identity=100%"; Hit description= UPI0000ECBAF8 related cluster
GGAYGKTPATRPFSGSWPFAGLLLTCSFLRYPLILWITVLPPLSELIPLAAAERPSAARNSYDHDYEFELGTLPPDFTGMQAWHWPSFYNVVTGKTLALPNLIALQHIPLSPAGVIAKRPAPIALPNSCAA

SEQ ID NO: 123111 - protein, 92 aa, Glycine max
  Coding DNA Sequence Number=SeqID_31426
  Homolog annotation: Hit_ID=Q2HW90; Match level="QueryCoverage=68%, HitCoverage=13%, E-value=9e-09, Identity=42%"; Hit description =Putative uncharacterized protein
MGPLQRQAFRKVYGKILDLTAAEVFTEAVVSLAQYYDQSLRCFTFGDLQMVPTVEEFEEILGCPLGGRKPYLFFGCGRRFGKRVGSHEANSK

SEQ ID NO: 123112 - protein, 225 aa, Glycine max
  Coding DNA Sequence Number=SeqID_31427
MASNSQQFSARNDAIVIRGVHEVATNPSASSETKKLEGKLDALVNLVTQLALNQKFVPVARVCGLCSSADHHTDLCPSMQQPGAIEPPQPQQQNQPQQNNYDLSSNRYNPGWRNYPNLRWSSPQQQQQPAPSFQNAAGPSRPYIPPPIQQQQQPQKQPTVEAPPQASLEELVRQMTMQNMQFQQETRASIQSLTNQIGQLATQLNQQQSQNSDKLPSQAVQNPRN

SEQ ID NO: 123113 - protein, 270 aa, Glycine max
  Coding DNA Sequence Number=SeqID_31428
  Homolog annotation: Hit_ID=Q6WAY6; Match level="QueryCoverage=85%, HitCoverage=50%, E-value=8e-20, Identity=29%"; Hit description =Putative uncharacterized protein
MGSSQKPSLKKRFYQVKIKSLEVTSLGELGQLMGQLQRVEVSMEPIASLSQYYDQPLRCFTFEDFQLVPTVKELEEILGCQLGGRKPYLFFGFYPSTIRVARPWKIKANGLSFIDILALLIFGVVLFPNMEGLVDLAVIDAFLAFHHGEESPVVAILAMDVKRAAQELFVVHWLSMCGWFHTLFSKKVGPSIRYKEGRIRILSSREGCPNVPLMETRGCINYNPVLAIRQLGYPMRGVPSDESITPFIARGFSDHNARVLQGVRKAWDAA

SEQ ID NO: 123114 - protein, 171 aa, Glycine max
  Coding DNA Sequence Number=SeqID_31429
MGELEEVQEKMKAEMEAMKEQMATMMEAIMSMKKIMEANAVIVAATSAVAKVNPMLPSGLKQMNHPTSNMHDFLPYGLPPNYTPPNVRTFPMRMSITPLPYSLRADKPKLIMHMSLKPWRRHMKFPTIIQPTPSLASDMPLKGKQLVIYPCKTLWRPSVSPITTPLAFHSD

SEQ ID NO: 123115 - protein, 74 aa, Glycine max
  Coding DNA Sequence Number=SeqID_31430
MEAPISRVKKISRRRRKHAYEEEEESMHSSRFIKKISNPCTCKSPAPMAISSLQIACTNGDFLLLHCHGRNGRN

SEQ ID NO: 123116 - protein, 212 aa, Glycine max
  Coding DNA Sequence Number=SeqID_31431
AFSEELAKRTYHTKRVHPLRMNTHPPVKILVANLAPAKPICYDSEDALCELHPAKRLMESRKRARTEDIPSSSNPFPSTASMEPDAQQAHSLIPISNSIVRPNEAAPLEPTPVQVDPEPADPQSPVVNPLSSPEREVVPPSPPLIIISDASSDEAVAPSDSPAGETADLPTSPVGGISDLSDPSSGEVIALIDSPVWTLLTLLIPDDTFRFL

SEQ ID NO: 123117 - protein, 81 aa, Glycine max
  Coding DNA Sequence Number=SeqID_31432
MKNERRTMKNGGKPLRNRPRKRLGSVTEAPRLEFSSRKQFFSLILREKREVVAAQLTQTSWVASIRRHCLLLEHPGRPKWA

SEQ ID NO: 123118 - protein, 187 aa, Glycine max
  Coding DNA Sequence Number=SeqID_31433
ALRRVRAAGAGVTIKQYFGSVPQASRSSSSLPLEELQQLTQQIRDQLEESITENVMRQLMASFSQIPRVRTKGSCVDPSGNNPETGDSDRCDLYIETDPACLVALGRVYEGSTFVHNTPLFPGQVKVGVEEVTDIDAPVPVPTDDAAVSPAKPPQKPDPEVDDLLYLMTLTIPVLFLRPYQLTWDAT

SEQ ID NO: 123119 - protein, 335 aa, Glycine max
  Coding DNA Sequence Number=SeqID_31434
AAPAECSGAYALRSPFLHDADDKGSSQPAERQSARSARYPHCQAGIFSLRKLIVNAFQLAEFFRTFRDVVQVFDATGSYSNAEDKQHTKPEHEFSADSDIFQKNTRGARVFCFRMVLILADSGAGESIDATCRFVKAPGFQAKGPIALRPGVAPEDIPLRLKFSGLRWLVRQPLSGAGGGNVFAVIKRLLFRPCHTVRTGKGQPVSQLCVSQRIASDINNVVLKSGLMKEDIGCQLPDVVGRGECQGIVPVAEGINRFIPGIDHAKIGFKQIAGKNTGRNNYPVSVALGAQQVAHFKLLIPHRLPTLFADNVIIHAKLPGKIAGDTRLQHGLSDS

SEQ ID NO: 123120 - protein, 211 aa, Glycine max
  Coding DNA Sequence Number=SeqID_31435
  Gene Ontology: Mol. function=signal transducer activity; Biological process=regulation of transcription, DNA-dependent
  Homolog annotation: Hit_ID=A7MJ29; Match level="QueryCoverage=89%, HitCoverage=22%, E-value=9e-36, Identity=37%"; Hit description =Putative uncharacterized protein
  Pfam annotation: Domain name=CHASE4; Domain location=1-157; Score =40.5; E_value=4.7e-09; Accession=PF05228.4; Description=CHASE4 domain
MRSHLKDNAEWGDVYKYLHQKIDLHWAWDKQNLGKSLYDNFGYEGVFVISAEGTTRYSVLDGKLKREELESWLDKPTKARLLHELSLKNGLPISMLTLIHSVPAIVSAEWITTGDDPSVQPSPGKPSVMVFIDKLTAKKLLTIGQDAGINNVRASLNKENAQANNQTAFTLRTQNGDVDIIWDSENPGQATFDNFDDGHPHAPYYAQGENA

SEQ ID NO: 123121 - protein, 372 aa, Glycine max
  Coding DNA Sequence Number=SeqID_31436
MKSPSSKIRAREGETRQGEVQISCYTHPKGVQPSYKKETRPLQKPLNKKPKGPARRNMAERNSEEHCGVVTMSSSSEERREIGHGSKRSLAQHLEATEQSMLAIIGQYKEELNQSMAHEQKLVEDFAQVYAEKEARGRVIDALHQEATMWMDRFALTLNGSQDLPRLLAKAKAMAEEQMKADLSALKDQMASISEVMLKLQKTIEDKATATASSTVREAEPVLQPALNPGLGRNTAVFGRTYSPQAYPYGLPPDFNPCATPEDLSQALTFEGQLPPYEDYPGQDDGEGDTHLGPLLHLKDPSPHELPQPNIVRHIPASPTPVKESVPFAEDKGKIEVLEERLRAVEGLGNHPFADLVDLYLVPNIVIPPKFN

SEQ ID NO: 123122 - protein, 78 aa, Glycine max
  Coding DNA Sequence Number=SeqID_31437
MASRKRKASASVAQARYDRSKFTSQDAWDRYADNILGRKILPERNGSIDVSIVKEFYATLYNPEDKSPKQGKAYQPTP

SEQ ID NO: 123123 - protein, 104 aa, Glycine max
  Coding DNA Sequence Number=SeqID_31438
MGVKYLEVGSKDKTLISFERNTIRPVNLLASATCKNLENDQHRTTNIILILPNSFLSVDTRAQNDHNLSLRAIGHDCLRMAKRAQNDHNLSLRAIGHDCLRMAK

SEQ ID NO: 123124 - protein, 302 aa, Glycine max
  Coding DNA Sequence Number=SeqID_31439
  Gene Ontology: Mol. function=hydrolase activity, acting on carbon -nitrogen (but not peptide) bonds; Cellular component=membrane; Biological process=phosphonate transport
  Homolog annotation: Hit_ID=A8G933; Match level="QueryCoverage=100%, HitCoverage=79%, E-value=1e-158, Identity=92%"; Hit description =Phosphonate metabolism protein PhnM
  Pfam annotation: Domain name=Amidohydro_3; Domain location=3-281; Score=-52.7; E_value=0.0004; Accession=PF07969.2; Description =Amidohydrolase family
MSSHDALMVANGITTVLDAVAIGDVRDGGHRLENLQKMIDAVIHSQRAGVNRAEHRLHLRCELPHESTLPLFEQLMDKPGVSLVSLMDHSPGQRQFASREKYREYYQGKYHLNDQQMSEYEEQQVALSARWAAPNREAIAAHCRARRISLASHDDATAAHVAESCALGSAIAEFPTTEAAARASHQQGLQVLMGAPNIVRGGSHSGNVAAHHLAALGVLDILSSDYYPASLLDAAFRLAADERNAYDLPQAVRMITRNPARALDLQDRGTIAEGLRADLVLARPHGEHVYVQNVWRQGRQVF

SEQ ID NO: 123125 - protein, 229 aa, Glycine max
  Coding DNA Sequence Number=SeqID_31440
  Gene Ontology: Mol. function=solute:hydrogen antiporter activity; Cellular component=integral to membrane; Biological process =regulation of pH
  Homolog annotation: Hit_ID=Q11NE2; Match level="QueryCoverage=77%, HitCoverage=33%, E-value=2e-64, Identity=69%"; Hit description =Sodium/hydrogen antiporter
MKFVRIPKSTSAVLEGESLLNDASSLIIVRFALVAIGTGQFIFQTAITDFFWMVIGGIGIGLLGGWLFIQAHKRLPMDAPSDIVFTLVESYLLYWVAEQAHSSGVLAVVAGGLFLSTRRLTFLSSASRIKGLSFWEALIFILNGIVFMIIGLALPEIVKGLRADGIPLRTAIFYGALVTAQCCSRKRFEPPENTWLTAVIRLDRNAGGGVISRCFIYSIDLTDRRSFST

SEQ ID NO: 123126 - protein, 88 aa, Glycine max
  Coding DNA Sequence Number=SeqID_31441
MGLAFSRIHKIQKKLNEVEDLASNRSLSDDEIKAKRELQQELWEASIAYESLLRQKSRGRQVETSTQIKNRRQVQALFRPRKLLKCGK

SEQ ID NO: 123127 - protein, 125 aa, Glycine max
  Coding DNA Sequence Number=SeqID_31442
  Gene Ontology: Mol. function=RNA-directed DNA polymerase activity; Biological process=RNA-dependent DNA replication
MVVLGNEDITSASSSSSSSSSSESESDCDVQPLCTNVASQRLIEKLALKTSPHPRPNKLQWLSENGELVVDRQSLWRLAISYLEGLGSMIGMLSAMVSQTNFHLYIKGKRLPLNLCLQVQFVRIK

SEQ ID NO: 123128 - protein, 52 aa, Glycine max
  Coding DNA Sequence Number=SeqID_31443
MMITKDDDEGDDQKFKDQSKNNSSESRTIQEFKIRIKKNSRLKKKIVVIDYQ

SEQ ID NO: 123129 - protein, 58 aa, Glycine max
  Coding DNA Sequence Number=SeqID_31444
  Subcellular localization annotation: CTP_CleavageSite=22; ConfidenceScore=5.05e-01
MMYPPMCLDKEFLAGKRKNQKNSQAVSPLNILARGRRKNQKNSQAVSPLNSSGKRKKE

SEQ ID NO: 123130 - protein, 74 aa, Glycine max
  Coding DNA Sequence Number=SeqID_31445
MAEIGKLDHLKERLRAIEGGGDYAFANLKELFLVPNIVTAPKFKVLDFDKYKGTTCPKELSKDVLSEDEGIRKR

SEQ ID NO: 123131 - protein, 136 aa, Glycine max
  Coding DNA Sequence Number=SeqID_31446
ALEQETKRARREEHGRNKFRGALWGSNNELKLRREERDQSRVDKTNMLAIISKYQEELSLATTHKHRVADEHAQVYTEKEARERVIDSLHQEATMRMDRFVLTLNRSQELPRLLAKAKAMADTYSAPKEIHGLLSY

SEQ ID NO: 123132 - protein, 83 aa, Glycine max
  Coding DNA Sequence Number=SeqID_31447
MECMSPLARLLGPLLTELSSRSIASLGRHKARHHNSLGMADSGQQMHRCHLQSPLAHLERLEHCLRPVVDQQATKSNAKVGYT

SEQ ID NO: 123133 - protein, 103 aa, Glycine max
  Coding DNA Sequence Number=SeqID_31448
VVAPLGSILSVEQFLERVAWPGAQPSLDRESEGPTAQVPQQAGEEQARPETAATPERSLEGTSEPHTPVANFLFPNCNYFLFIYVSRKFQWGFIGKRTGSSSI

SEQ ID NO: 123134 - protein, 100 aa, Glycine max
  Coding DNA Sequence Number=SeqID_31449
  Gene Ontology: Mol. function=aspartic-type endopeptidase activity; Biological process=DNA integration
  Homolog annotation: Hit_ID=A5B522; Match level="QueryCoverage=98%, HitCoverage=84%, E-value=1e-20, Identity=40%"; Hit description =Putative uncharacterized protein
MNQKKKFNKKEGVDNIDERYYRSLMGCLMYLTTTRPNILFAQKNKTGIFVDNQVVIAIANNPVCHGKTKHFNIKVYYLIKMQQSGEVNLICCKSKDELQF

SEQ ID NO: 123135 - protein, 85 aa, Glycine max
  Coding DNA Sequence Number=SeqID_31450
  Gene Ontology: Mol. function=aspartic-type endopeptidase activity; Biological process=DNA integration
  Homolog annotation: Hit_ID=A5BKX1; Match level="QueryCoverage=92%, HitCoverage=22%, E-value=1e-10, Identity=43%"; Hit description =Putative uncharacterized protein
MDKDTGLEDETKVEELEQSKAITTTLPKDLPTEWRTQKDLSLDNIIGEISKGVSTRSRLRILCNNMAFVSQIEPRNIDEALYDDH

SEQ ID NO: 123136 - protein, 236 aa, Glycine max
  Coding DNA Sequence Number=SeqID_31451
MERSMIDAASGGALGDMTPAEARNLIEKMASNSQQFSARNDVIFLRGVHEVATDSSSSTENKKLEGKLDALITIQIFVLLCSNLESMSNLKLMLQTFIIDPLNSKTNNNRIIMIFQATDTIQNVAGPSKPYVPSPMQQQQQQQRQQATEAPPQPSLEELVRQMTIQNMQFQQETRAFIQSLTNQMGQMATQMNQAQSQNSDKLSSQTVHNPKKCECHHLEVWQPNSSASTSSSTCT

SEQ ID NO: 123137 - protein, 101 aa, Glycine max
  Coding DNA Sequence Number=SeqID_31452
MRHRIPMIGGMMNVLSGATLFCKITYASNIFMIHIHRDSLGSDQRVLTNPKRIKVIPECPTPPSVEGRSPEFQEPLDLRSNPFQGGWNDAILPPPPPKGIG

SEQ ID NO: 123138 - protein, 138 aa, Glycine max
  Coding DNA Sequence Number=SeqID_31453
MTSRDQVWSFCTQDTRRYLTVIRTLLSSRGGGPDDKQRPSLVILHPRYAEIPYGYPHPFAFSRGGVVSDGKQRPSLVILHHMIRGDTLRLSAPLLSISDTGVRWQAETKFGHSAPNDTRRYLTVIRTPLLFSRGGVAR

SEQ ID NO: 123139 - protein, 157 aa, Glycine max
  Coding DNA Sequence Number=SeqID_31454
  Subcellular localization annotation: CTP_CleavageSite=66; ConfidenceScore=5.95e-01
MASPPASPPPPPPSLPSPPSPPSPPPPAPSDTSASPSAVKRTRKASCLQSLSTRPPGAKRPVVHVDPATGKADSPHRKKLRTYLGIVARDKVDVSYENWKEVLTAQKDLIWEDIQAEFDIPEASDSRTNRKLLQTVGEDGGSLNQNSRGNGPCSRSG

SEQ ID NO: 123140 - protein, 83 aa, Glycine max
  Coding DNA Sequence Number=SeqID_31455
MLGFTSDSPHVSASPHQLNFAPYASRSYSAQWNAPGLLHDKHMLHLSRILGKMEVEEPWLGLWLPLNYRVDMGASHHRTPELV

SEQ ID NO: 123141 - protein, 88 aa, Glycine max
  Coding DNA Sequence Number=SeqID_31456
  Homolog annotation: Hit_ID=Q2AA09; Match level="QueryCoverage=73%, HitCoverage=23%, E-value=5e-08, Identity=46%"; Hit description =Retrotransposon gag protein
  Pfam annotation: Domain name=Retrotrans_gag; Domain location=25-88; Score=-0.6; E_value=0.062; Accession=PF03732.8; Description =Retrotransposon gag protein
MDEEQPRRVTLEDYSSVPKDAIRLSLFSFSLSGEAKRWLHSFKGNNLKTRDKVVEKFLKKYFPESKTAEGKAAISSFHQFPPVMIMEG

SEQ ID NO: 123142 - protein, 135 aa, Glycine max
  Coding DNA Sequence Number=SeqID_31457
  Subcellular localization annotation: CTP_CleavageSite=56; ConfidenceScore=5.52e-01
MKCPSPPTRSSGPLLIGPLLRSIAPPSKRRARHHNSLGMASSENRRIVTTSRVHLSSSTKVEALPTIDGLPAGSQPPGQVRADVKEALLGSNLELATKKLRAKWSRKGIIEEGSSVAPQADTGLDKHRFQSVEHQ

SEQ ID NO: 123143 - protein, 62 aa, Glycine max
  Coding DNA Sequence Number=SeqID_31458
MEPFEGEGVQPSKGENVQPSKGEGVQPSKVEDIGDNSCNLFLSFENLFGNSLKVYVLFDLLT

SEQ ID NO: 123144 - protein, 163 aa, Glycine max
  Coding DNA Sequence Number=SeqID_31459
  Homolog annotation: Hit_ID=Q51617; Match level="QueryCoverage=25%, HitCoverage=59%, E-value=1e-14, Identity=95%"; Hit description =Putative uncharacterized protein
  Subcellular localization annotation: CTP_CleavageSite=36; ConfidenceScore=5.07e-01
MTVKTSDTCSSRRRSQLVCKRMPGADKPVRARQRVLAGVGAGLTMQKASEQISTESAPYFLRCEIPHRCVRRKYLRRHSGHSGCATVGRAIGAGYPSSLLRQLAESFMCCKAIKLGNAGFSQSRRCKTTQFKLACLQVLTLESSQVEILLELKGLHHHLAFLD

SEQ ID NO: 123145 - protein, 115 aa, Glycine max
  Coding DNA Sequence Number=SeqID_31460
  Homolog annotation: Hit_ID=B0HC01; Match level="QueryCoverage=28%, HitCoverage=70%, E-value=3e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTRLRRKWPQGSLPQRGPGRTRQPKELVPAKENIWKVSFTKGIL

SEQ ID NO: 123146 - protein, 87 aa, Glycine max
  Coding DNA Sequence Number=SeqID_31461
MVLAVLWLIPRSEWTTGDLGRITGMEFRLKSARHRVRGLQKVECGMDKEKKRSTRAPTKGQRDKEPPAAPPSFPGSLPVRTTRREGI

SEQ ID NO: 123147 - protein, 208 aa, Glycine max
  Coding DNA Sequence Number=SeqID_31462
  Gene Ontology: Mol. function=nucleoside-triphosphatase activity; Cellular component=plasma membrane; Biological process=transport
  Homolog annotation: Hit_ID=A4XVE9; Match level="QueryCoverage=68%, HitCoverage=63%, E-value=8e-50, Identity=73%"; Hit description=ABC transporter related
  Pfam annotation: Domain name=ABC_tran; Domain location=1-182; Score =84.2; E_value=4.1e-22; Accession=PF00005.18; Description=ABC transporter
SGKSTLLGLLAGLDIASSGKVLIDGSDIGPLDEDGRAAIRAKHMGFVFQSFQLLGSLTAFENVMLPLQLAGRSDASAIAMSALESVGLVARSTHYPKQLSGGEQQRVAIARAFAAKPSILFADEPTGNLDAATGEIRVLLFALILAVTATTSVSFFTDRIQSGMQTQGNVLLGGDLVVMSDHAMPASYLAEAQRRQFQTTQTLEFPSM

SEQ ID NO: 123148 - protein, 74 aa, Glycine max
  Coding DNA Sequence Number=SeqID_31463
  Subcellular localization annotation: CTP_CleavageSite=47; ConfidenceScore=5.32e-01
MGELSSLVTDVWGAKHLPLFAVNRGGSSRDFTWKRRLPTRFLSWNIRSSRESRVALPPKGRLRQLATIHWGLFL

SEQ ID NO: 123149 - protein, 67 aa, Glycine max
  Coding DNA Sequence Number=SeqID_31464
MMKVEKKLIHRTGQQQSPRTNTNGNDVDVAPEFSPLKTVHFGNPSQDTVDPRDGGFGGRLSRWKWEK

SEQ ID NO: 123150 - protein, 477 aa, Glycine max
  Coding DNA Sequence Number=SeqID_31465
  Homolog annotation: Hit_ID=Q84VH5; Match level="QueryCoverage=91%, HitCoverage=68%, E-value=0.0, Identity=73%"; Hit description =Envelope-like protein
VTVPDAEKDVPTSSTPNTEVLSSPSKEESTEEEDQATQETPAPRAPEPAPGDLIDLEEVESDEEPIANKLAPGIAERLQSRKGKTPIKRSGRIKTMAQKKSTPITPTSSRRSKVAIPSKKRKEISSSDSDDDVELDVSTSKRAKTSGKKVPGNVPDAPLDNISFHSIGNAERWKFVYQRRLALERELGRAALDCKEIMDLIKAAGLLKTVTKLGDCYESLVREFIVNIPSDITNRKSDEYQRVFVRGKCVRFSPAVINKYLGRPTDGVVDITVSEHQIAKEITAKQIQHWPKKGKLSAGKLSVKYAILHRIGAANWVPTNHTSTVATESFAVKLPIAFPTVLCSIMLSQHPNILNYTDSVMKRESPLSLHYKLFEGTHVPDIVSTSGKAAASGAVSKDALIAELKDTCKVLEATIKATTEKKMELERLVKRLSESGIDDGEAAEHEDEAAEEEEEAAEEEEDAAEDTESDDDFEASP

SEQ ID NO: 123151 - protein, 99 aa, Glycine max
  Coding DNA Sequence Number=SeqID_31466
MVTSLLQLDSMNLFVKARAWFNTITQGMAILITNTSTTFHRDKRLGNTHAMHGKFKKTIWIFRLPSTKDETHIQRMCDGMMQMRKSATGGFTQHDNILK

SEQ ID NO: 123152 - protein, 100 aa, Glycine max
  Coding DNA Sequence Number=SeqID_31467
MSNTLMMFVTHFFYGQWVEGIVTHTPAYMEWYRKNTTLFLFVEQQLHDPRTTITQNVARSGVEQTHFEIPHPQSMYSTPSPVHQTFGQLASQSPQPPMNG

SEQ ID NO: 123153 - protein, 171 aa, Glycine max
  Coding DNA Sequence Number=SeqID_31468
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPRSARPLRLIRTIVLSPT

SEQ ID NO: 123154 - protein, 68 aa, Glycine max
  Coding DNA Sequence Number=SeqID_31469
MASSSSCSSSIQTRSGPIDSDVLWMQPKHVSEHVWNGEPDRKLHIRRAVPTYHGEEQIPEEIVPLLRQ

SEQ ID NO: 123155 - protein, 241 aa, Glycine max
  Coding DNA Sequence Number=SeqID_31470
  Gene Ontology: Mol. function=protein dimerization activity
  Homolog annotation: Hit_ID=A5BG18; Match level="QueryCoverage=86%, HitCoverage=37%, E-value=1e-36, Identity=34%"; Hit description =Putative uncharacterized protein
  Pfam annotation: Domain name=hATC; Domain location=124-206; Score =9.3; E_value=0.0035; Accession=PF05699.5; Description=hAT family dimerisation domain
MLISIMKKFTNGRDLIRPGMTRFATTYLTLACLHELKASLMNMFIFEEWKTSKFGTSQEGRKVQNVALDSQFWKNITIYEPVWKIIYERWDHQLHRPLHAAAYYLNPHLHYEPTFRHDDPQLKEGGLFSMEKAKDSRKIMQPGEWWEMFSDGTPELRRFAIRVLSFTCSSSGCERNWSSFEMLKGKQNRKTIALPFDEIESDNEWITEEGYNDEDEQPQAEGHGDNVELVGDVGGSSNDPV

SEQ ID NO: 123156 - protein, 177 aa, Glycine max
  Coding DNA Sequence Number=SeqID_31471
  Pfam annotation: Domain name=Transposase_23; Domain location=49-119; Score=-2.1; E_value=0.002; Accession=PF03017.5; Description =TNP1ENSPM transposase
  Subcellular localization annotation: CTP_CleavageSite=32; ConfidenceScore=5.05e-01
MASFSHLQSQMQSQGLAMPPEPLVGPGPFCPRVSKKGSCVDPSGNDPETGDSDRCGFYIEADPTRLVAIGRVYEGSTVVHNTPLLLGQVKVSVEEVRDADAPIPVPTDEVSLVGQALHTFLAWPTHLVKSLSQQVVVSPPKPPPKPDPEVDDPLYLMTLTIPELFLRPYQVRWEGIL

SEQ ID NO: 123157 - protein, 181 aa, Glycine max
  Coding DNA Sequence Number=SeqID_31472
MGEVEKVQEQMKADMEAMKGQMATMMEAIISMKKIMEANAVIVAATSAIAKVNPMLPSGLKQMNHPTSNMVGKDLGSTDDPMMCKFKTSTPSRHMACLPNYTPPNVAYIPNEDVNNSTSILIKSQQPQSDHAHVSRPMEETHGMPHHNLADFEPCLGYATEGQAVGGNGKVGSSRGKAQGH

SEQ ID NO: 123158 - protein, 66 aa, Glycine max
  Coding DNA Sequence Number=SeqID_31473
MRAFAKRDTQWLSTRKNPEEDELSGSLSAPLQVIKRTASAYPLSERSALSHNPLMRTKRSRFALSA

SEQ ID NO: 123159 - protein, 51 aa, Glycine max
  Coding DNA Sequence Number=SeqID_31474
  Subcellular localization annotation: CTP_CleavageSite=35; ConfidenceScore=5.22e-01
MDRSTCISGFRLSTCFSCSADGLKRFFLALSRRVLRSAVSSLSQQIGLARR

SEQ ID NO: 123160 - protein, 102 aa, Glycine max
  Coding DNA Sequence Number=SeqID_31475
  Homolog annotation: Hit_ID=A5B612; Match level="QueryCoverage=73%, HitCoverage=25%, E-value=1e-08, Identity=37%"; Hit description =Putative uncharacterized protein
MASSDSLFPEGNSIHRPPIFNELGPHIPTIVDVSASTTTQKPRVKWTEEDRRKIQYDLKAKNIITSALGIDEYFRVSNCTNAKDMWDTLQLTHEGTTDDEPK

SEQ ID NO: 123161 - protein, 173 aa, Glycine max
  Coding DNA Sequence Number=SeqID_31476
  Homolog annotation: Hit_ID=A5BSR3; Match level="QueryCoverage=39%, HitCoverage=25%, E-value=5e-07, Identity=41%"; Hit description =Putative uncharacterized protein
  Subcellular localization annotation: CTP_CleavageSite=12; ConfidenceScore=5.08e-01
MSRTLSVRNTTLARKSGPSFARLAETLLGRMCARRHRPSRSRILPLLILSRGGYDYLEQKLLAEKTKKKLEEAAQSGSVDGFIDPPSPVRRHVKWKMARTKKTGEMTTEAAKEIAEKIDSFEEQATQGSFVPHGQHPGRVRTAGAGVTIKHTLDQLHGRPAALPPCLPKNCSS

SEQ ID NO: 123162 - protein, 83 aa, Glycine max
  Coding DNA Sequence Number=SeqID_31477
  Subcellular localization annotation: CTP_CleavageSite=56; ConfidenceScore=5.19e-01
MKFKNKDGNVWHHHRMMCTTISMTFLEKPSCFATSVGAHPLRAILTPVTFSVTHTSASARRSITVVIVQAGKLRHRQRPMCEP

SEQ ID NO: 123163 - protein, 88 aa, Glycine max
  Coding DNA Sequence Number=SeqID_31478
  Subcellular localization annotation: CTP_CleavageSite=59; ConfidenceScore=5.57e-01
MASSPVASRISSNSFTVGTSWKSSNVKHFRGWVIILGKGCNRYNVGRSSKVSPTAYGLLASNRDSLLDVCSKYRGDQDQIHPHCAGCI

SEQ ID NO: 123164 - protein, 54 aa, Glycine max
  Coding DNA Sequence Number=SeqID_31479
MASPMTCGGSLWLSAPFVNQGERAGMIEFDSMWKRRGSVGWDIDRSNDVPLERN

SEQ ID NO: 123165 - protein, 216 aa, Glycine max
  Coding DNA Sequence Number=SeqID_31480
MAPRKLSSKRSRKDKAAEGTSSAPEYDSHRFRSAEHQQRFEAIKGWSFLRERRVQLKDDEYTDFQEEIVRQRWASLVTPMAKFDPDIVLEFYANAWPTEEGVRDMRSWVRGQWIPFNADAISQFLGYPLMLEEGQECEYCQRRNRSDGFDEKAIAHLLRIPGHDFARAAAGRRVRIMRTNMTTLTQIWMTLLLSTSSPAIIIPTSPCRSISWCMPS

SEQ ID NO: 123166 - protein, 50 aa, Glycine max
  Coding DNA Sequence Number=SeqID_31481
STLEDPLLDARQWDPPSNKSIGFLFKNEILLELSSSPFGTISHPGYDEIG

SEQ ID NO: 123167 - protein, 232 aa, Glycine max
  Coding DNA Sequence Number=SeqID_31482
  Gene Ontology: Mol. function=aspartic-type endopeptidase activity; Biological process=proteolysis
  Homolog annotation: Hit_ID=A7QZD9; Match level="QueryCoverage=73%, HitCoverage=74%, E-value=1e-30, Identity=39%"; Hit description =Chromosome chr16 scaffold_271, whole genome shotgun sequence
  Pfam annotation: Domain name=MP; Domain location=66-232; Score=5.1; E_ value=7.8e-05; Accession=PF01107.9; Description=Viral movement protein (MP)
  Subcellular localization annotation: CTP_CleavageSite=32; ConfidenceScore=5.12e-01
MTAKILEDESNMSRLLRSFSRISFRLNSSSSSSSMNSTNNLLNEQDNQTHEVVPKHNHFDEEVRFEDKNQNMDDWNIPEIPQDKLYIPETNKDKHNFDYIIKTVENNIPLGQDIGEEFYLFSKNSIYEHSRKYKYLHIDCVQVAIKPLIDLGIDAAVLMCFRDIRHNKFEDSLIGTVETSLGQGPIYFNCYPKKTVSLMDRNILDSLFLNIHFHGLDMKEGSIPTTLIYRIQ

SEQ ID NO: 123168 - protein, 202 aa, Glycine max
  Coding DNA Sequence Number=SeqID_31483
MSSRKRNSGGSRPATQYDTRRFHSFEAWTRYTDNVVGRHILAERKVEIYHIELDEFKGELERCNFHKRLTNLADSSINLVLVKEFYANLYSPEGPSPKQVRIRGHLIRIDVDSLNEFLETLVVLAEGEYLPAYSRYCRMPTDTREIEAALCIPNRGFILNAEGHPGKILRKDLIILAQVWSVLSYSNLAPTSHTSDLTMDRA

SEQ ID NO: 123169 - protein, 18 aa, Glycine max
  Coding DNA Sequence Number=SeqID_31484
EELATQLAQASSARPDEP

SEQ ID NO: 123170 - protein, 27 aa, Glycine max
  Coding DNA Sequence Number=SeqID_31485
MEAPTTTHFKAAKRILRYIKVIAMSET

SEQ ID NO: 123171 - protein, 114 aa, Glycine max
  Coding DNA Sequence Number=SeqID_31486
MNLPNFTLFQKKVMTKIYLTISVQVNLLPQKIPRYAKFLKELCTNKRKLKGSERISMGRNVSALIGKSVPQIPEKCKDPGPLQSTDVVIHLANRSVAYPVGFIEDLSVCYEIPI

SEQ ID NO: 123172 - protein, 95 aa, Glycine max
  Coding DNA Sequence Number=SeqID_31487
  Subcellular localization annotation: CTP_CleavageSite=51; ConfidenceScore=5.42e-01
MKTTKTFKTVEIFAKSPTKTLRKRYGSASVWIFFTEPIFFTNFNMSRNFTNCATMLSFDFWHVTELHELPNDGCQVPRSGQTRVATQQRMVPGRN

SEQ ID NO: 123173 - protein, 84 aa, Glycine max
  Coding DNA Sequence Number=SeqID_31488
  Homolog annotation: Hit_ID=A6FJQ2; Match level="QueryCoverage=45%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGWCLASDVQQAGFVADLGAAFVDDWVFLASRVVGNEKD

SEQ ID NO: 123174 - protein, 181 aa, Glycine max
  Coding DNA Sequence Number=SeqID_31489
MGLGKDSHRNANVADIRGNPYKYGLGYEPGKPGRRNAPSRLQADRAWPDHVSQCFTSVGIMFEEEVAAIGEESPQDPPSFVRPCRPNSQVGNWRVISQSEVYTADSICKGRFFEDPNNEGLIIDFDREVSQTINEDEEEDVLSPELEREEEVKVGTGMTAPIAKVAIEILGLPRLSKNYEG

SEQ ID NO: 123175 - protein, 128 aa, Glycine max
  Coding DNA Sequence Number=SeqID_31490
MANGMWGNPGDLQPFDPKIDRTFHRLARHSVHPGHSVHFEHLDHFEHFVAGDSKYSDFEHSAINFHTENMTQPPPREKTLREMAAPDFTYESLCIQYPDEGVPYVLKTRLIHLLPKFHGLVGEDPHKH

SEQ ID NO: 123176 - protein, 163 aa, Glycine max
  Coding DNA Sequence Number=SeqID_31491
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
GETPGIFIVLSGFATSDLSVDFCDARQGGGAYGKTPATRPFYADTARRSRTTERSESVSEEAEERPIRKPPLPARNSYDHDYEFELGTQTSKENIVVSDDGKMSKGKRRKRMQAWHWPSFYNVVTGKTLALPNLIALQHIPLSPAGVIAKRPAPIALPNSCAA

SEQ ID NO: 123177 - protein, 115 aa, Glycine max
  Coding DNA Sequence Number=SeqID_31492
MSLKLPHYPKLVRVFYSNLRIQDSTLYSEVHGIPLVIDQSLFFSLTKLPSQDVPFEGTVVDDWKFDYSSHDAHGMVCNDQADMTGRLLVGSLTFDCRIMHYIIVRILLPRSSNLA

SEQ ID NO: 123178 - protein, 145 aa, Glycine max
  Coding DNA Sequence Number=SeqID_31493
  Subcellular localization annotation: CTP_CleavageSite=55; ConfidenceScore=5.62e-01
MATPPASPPPPTGASASPSTLKRTRKATRLRSLATRPPGAERPVVNVDPATGKADGSHKKKLRTYLGIVAHDKAEFEIPESSDSRTKKKIRQIFGERWRQFKSDMTRKWALAADKDETPHERMCEKRHRPLRSKTLPPHIVSWEL

SEQ ID NO: 123179 - protein, 126 aa, Glycine max
  Coding DNA Sequence Number=SeqID_31494
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=63%, HitCoverage=73%, E-value=2e-37, Identity=95%"; Hit description =Chromosome undetermined scaffold_79, whole genome shotgun sequence
  Pfam annotation: Domain name=Complex1_49kDa; Domain location=1-87; Score=-136.4; E_value=0.0021; Accession=PF00346.10; Description =Respiratory-chain NADH dehydrogenase,
MTTGSSVYSTSIHHFELYTEGFSVPAPSTYTAVEAPKGEFGVFLVSNGSNRPYRHKIRAPGSAHSQGLDSLSKHHMPADVVTIIVDEIGRVVSVGDGIARVYGLNKIQAGEMVEKRHTNYQPTFRE

SEQ ID NO: 123180 - protein, 80 aa, Glycine max
  Coding DNA Sequence Number=SeqID_31495
MTIHHHLYFWLEAIEKFHTFGPLPSFSLIMRKIPYEVLKSRCILFHRHTPLFQLEELSFLFFTSSGKYISRKVCLKENYK

SEQ ID NO: 123181 - protein, 113 aa, Glycine max
  Coding DNA Sequence Number=SeqID_31496
MVMELVMAYQNDNFLEENAVHEVASRNSSSWCRIPNNNFRQHLIRELGLAVPLEGEWALGLGFLGFRVFMGRREEREKSRNAELGAMVVQRRRWREGIVKGREGERKGEGEKE

SEQ ID NO: 123182 - protein, 66 aa, Glycine max
  Coding DNA Sequence Number=SeqID_31497
MSQHLCYIVVDSAYDRDKYASREFRCVWIPRATVPFRDLGNRNLNWNVTSRVGCRVQNAMSTLEPT

SEQ ID NO: 123183 - protein, 86 aa, Glycine max
  Coding DNA Sequence Number=SeqID_31498
MSEIEEVQERMKADMEAMKEKMATMMEAMMSMKKIIEVNAATVATTSTVAGVDPTPLFGLNQVNHPASYKVAQGGEALGSTGGPHF

SEQ ID NO: 123184 - protein, 44 aa, Glycine max
  Coding DNA Sequence Number=SeqID_31499
MEKKMKNKSMAAKWRRRKGDWRRHFKEKMSQEQAHHHRRSWIRA

SEQ ID NO: 123185 - protein, 45 aa, Glycine max
  Coding DNA Sequence Number=SeqID_31500
GGPVSDIGPLIEVHAMPINCSVENMVKAVAEECTQNGIEDMDVDG

SEQ ID NO: 123186 - protein, 60 aa, Glycine max
  Coding DNA Sequence Number=SeqID_31501
PFAKRKPRAKRIFCHALSGESLALSAQPLYLKLIWSAKLAKAKLSPFLFDLNLAKRWPSC

SEQ ID NO: 123187 - protein, 44 aa, Glycine max
  Coding DNA Sequence Number=SeqID_31502
EVTLPEKWVMDKTTPSVRMGHGYGHTICSLTHSNHRANQNKITS

SEQ ID NO: 123188 - protein, 197 aa, Glycine max
  Coding DNA Sequence Number=SeqID_31503
  Homolog annotation: Hit_ID=A5BZH4; Match level="QueryCoverage=42%, HitCoverage=13%, E-value=1e-08, Identity=41%"; Hit description =Putative uncharacterized protein
  Pfam annotation: Domain name=zf-CCHC; Domain location=132-149; Score =21.5; E_value=0.00084; Accession=PF00098.14; Description=Zinc knuckle
MKRKKHASYSIHDSCKSLSEELSDYYRGLHSSHTKHHSQRREKERKPQEAKINLPYFYGKDNVEANLDWEIRVEQQIKRKSTSKSYGSHSYPKKDQGQVILGVTPSKSNDDKGKTIEKQPLKASMQEKTSSMKCFKCLGRGHITSQCPTKKTMIMRGQDIYVEAMSSKIILMMPKNQELRKFQRIRSQKASRIKIQE

SEQ ID NO: 123189 - protein, 267 aa, Glycine max
  Coding DNA Sequence Number=SeqID_31504
  Homolog annotation: Hit_ID=Q6WAY6; Match level="QueryCoverage=44%, HitCoverage=20%, E-value=4e-12, Identity=34%"; Hit description =Putative uncharacterized protein
VDWDQHLTGIGGRTINWFPRWKEGKEGVLFSCGDYPNIPLIGTRGCINYNHALAIRQLGYPMRGAPTEESLSPFLVRDFGAQSFKVIQRVHKAWESPLRKDKELRGIRNGIIGGYHEWLKVCTRGLGWLSKLKIINEENFEALKEDEEVATDVQKECVGLREENAATARALEKETRGLARKSMAVTNFVELCGAATTNMLAIVCKYQEELNLATAHEHKVVDEYAQVYAEKEAKGRVIDSLHQEATMWMDRFALTLNGSQELPRLLA

SEQ ID NO: 123190 - protein, 104 aa, Glycine max
  Coding DNA Sequence Number=SeqID_31505
SEQESARGSFQGETPGIFIVLSGFATSDLSVDFCDARQGGGAYGKTPATRPFYADTARRSRTTERSESVSEEAEERPIRKPPLPAPDNNFTQGNSYDHDYEFEL

SEQ ID NO: 123191 - protein, 50 aa, Glycine max
  Coding DNA Sequence Number=SeqID_31506
MKSLRGKEIALVKVQWGTDEGDSTWELEDRMRELYPKVGIAGARYAGLTN

SEQ ID NO: 123192 - protein, 92 aa, Glycine max
  Coding DNA Sequence Number=SeqID_31507
  Homolog annotation: Hit_ID=Q4A3R5; Match level="QueryCoverage=69%, HitCoverage=82%, E-value=4e-08, Identity=50%"; Hit description =Capsule O-acetyl transferase
  Subcellular localization annotation: CTP_CleavageSite=23; ConfidenceScore=5.04e-01
MSLLLQSLPFGRNAFQGYFDDAKESRVKQSFKQRFKRIKSQVSRFKIQDSRFKIQESSFKNQESRIIKIKIQDSRFKTQDSRIKRRLNQDKY

SEQ ID NO: 123193 - protein, 109 aa, Glycine max
  Coding DNA Sequence Number=SeqID_31508
MDISKDTNIPVILGRPFMLIASCIVNMGKRKLELGFEDKKIDFDLFVENKRAPEHNVCLQVMEGGQEVLKGFNLLRKGLEKNSLFAKCKHHTKHISVHALSHESQVLSA

SEQ ID NO: 123194 - protein, 366 aa, Glycine max
  Coding DNA Sequence Number=SeqID_31509
  Gene Ontology: Mol. function=nucleotide binding; Cellular component =intrinsic to membrane; Biological process=defense response
  Homolog annotation: Hit_ID=Q2YE87; Match level="QueryCoverage=100%, HitCoverage=29%, E-value=1e-161, Identity=80%"; Hit description=NBS -LRR type disease resistance protein Rps1-k-2
  Pfam annotation: Domain name=NB-ARC; Domain location=144-366; Score =72.9; E_value=1.1e-18; Accession=PF00931.13; Description=NB-ARC domain
MAAALVGGAFLSAFLDVVFDRLASREFVHLILGNKLSKKLLQKLETTLRVVGAVLHDAEKKQITNTNVKHWLNDLKDAVYEADDLLDHVFTKAATQNKVRDLISRFSDRKIVSKLEDIVVTLESHLKLKESLDLKESAVENLSWKAPSTSVEDGSHIYGRQKDKEAIIKLLLEDNSDGSEVSVVPIVGMGGVGKTTLAQLVYNDENLVEIFDFKAWVCISKEFDVLKITKTMIEAITGEPCKLNDLNLLHLELMDKLKDKKFLIVLDDVWTEDYVDWSLIKKPFNRGIRRSKILLTTRSEKTASIVQTVHTYHLNQLSTDDCWSVFVNHACISSESNENTTTLEKIGKEIVKRCNGLPLAAQSLGG

SEQ ID NO: 123195 - protein, 76 aa, Glycine max
  Coding DNA Sequence Number=SeqID_31510
MGAKTVKEVWNTLQEEFQGSVKHMSKDCIGIKKIHLKMPPSQSLNFSPKTKKMEERKIMEKLPEEEKVLGISLRTK

SEQ ID NO: 123196 - protein, 176 aa, Glycine max
  Coding DNA Sequence Number=SeqID_31511
  Homolog annotation: Hit_ID=A2Q4P8; Match level="QueryCoverage=93%, HitCoverage=88%, E-value=5e-23, Identity=34%"; Hit description=IMP dehydrogenase/GMP reductase, related
  Pfam annotation: Domain name=DUF1723; Domain location=30-79; Score =53.3; E_value=8.6e-13; Accession=PF08330.1; Description=Protein of unknown function (DUF1723)
MAKFERSAPEIEGLVATSGLSLLITCSLDTSDRGLMSTFVERWHKETSTFHLPIGEQTITMDDVVSLLHLPIVGAFHSFEQLHVDDIVDMLVELLEVSAVEIVAARAYLLHLLGCTLFANKSVTHVHVVFLDALHDLTQSGTYSWSVAALVHMYDNLNEASKSTARQLVRYITLLQ

SEQ ID NO: 123197 - protein, 148 aa, Glycine max
  Coding DNA Sequence Number=SeqID_31512
MEPQIQGPNIMTSYSNMYKDNWTQSWPMGFEIYPEDHENPRAFFSSSSPILLEPLAHGSKKNPKGECKAVMIRSKTFVEAEDEDSVVPKKKVAEKKGIDDKKDDVRGESNQEKEKQIMVKKKKVNDQEKEKEAEKEKENKKIEKDEKK

SEQ ID NO: 123198 - protein, 153 aa, Glycine max
  Coding DNA Sequence Number=SeqID_31513
MATYLLNILPHKLLNYKSPLRVLYHKDPTYSHLQTYDFLDDGPNPYVVHHLVSQSTTPNAQTPGLVPFEPNSPNIATSPTIEPKKNIVNCTNCLATTSPPPSPAHSSHPSPHPRAVTCSQHGIVKPKKIFNLHTTVAKSPLPHNPMSALRDPN

SEQ ID NO: 123199 - protein, 51 aa, Glycine max
  Coding DNA Sequence Number=SeqID_31514
MAEINQGWKRMEDRIATDQAPPLPGAKQAENVAAGQPSILCVRSFFCYCLF

SEQ ID NO: 123200 - protein, 231 aa, Glycine max
  Coding DNA Sequence Number=SeqID_31515
MSVLELYVEKDVAGGSMFHAANSVTSCERNVSHHESELPRNISNLHVDEHDDDDDDYLASNSYVEESFDEDDSDDGISDTDNEVTDIVEPFSIVHPSEEIQNPFWNDAMHYNNINWSHPDEEDICGLDMPTTFNVGQELYVGMDFDSKDAVKNALKQYVMKMHQSFKGCEGDSGIGCCIPNCLNTLSGWCHSITWKQISGTTAYHARLPTKQTGGNSDITVDGYDSHTNCI

SEQ ID NO: 123201 - protein, 146 aa, Glycine max
  Coding DNA Sequence Number=SeqID_31516
MDFSLNSIKRFLLLKNCRNVPIAGERGRGSQVRFPKEERCAESPPTFICGKRRENRRKPVDKSGAFAPTYPPLERKSDLRSSFLCVNQAILFYLKGDHFKALDLKNDPFYLQNRGEACHPARPGKQGCFLQKQQPSGGRIWKVQVG

SEQ ID NO: 123202 - protein, 641 aa, Glycine max
  Coding DNA Sequence Number=SeqID_31517
  Gene Ontology: Mol. function=phosphotransferase activity, alcohol group as acceptor; Cellular component=cytoplasm; Biological process =protein modification process
  Homolog annotation: Hit_ID=A5B9G7; Match level="QueryCoverage=87%, HitCoverage=86%, E-value=0.0, Identity=70%"; Hit description =Putative uncharacterized protein
  Pfam annotation: Domain name=PI3_PI4_kinase; Domain location=181-439; Score=263.0; E_value=6.2e-76; Accession=PF00454.18; Description =Phosphatidylinositol 3- and 4-kinase
GVRHWYKAFSVVDNYLGGGKKRNLSSAVVVCRGCCSVDVSETRQPCADSDGCGSDKEQSPWERVSWEATSGAEARVRADGERLALNVPVDESYLTFGDMVFKNDLSAVRNDTPLLLTRGKNNLMPRSSSTPCLSPKGRDIDKSGPIEILGQSNRLDGIKHMIKDIMKAIKMGIEPIPVHSGLGGAYYFRNSKGESVAIVKPTDEEPFAPNNPKGFVGKALGQPGLKRSVRVGETGFREVAAYLLDYDHFANVPPTALVKITHSVFNVNDGVNGNNLWRKRLFSKIASFQQFIPHDFDASDHGTSSFPVASVHRIGILDIRILNTDRHAGNLLVRKLDGIGSFGQVELIPIDHGLCLPETLEDPYFEWIHWPQASIPFSEDELAYIEDLDPYRDCEMLRMELPMIREACLRVLVLCTIFLKEAAAYGLCLAEIGEMMTREFRRGEEEPSELEVVCLEARKIVAERDREELSPGAEMRDDEFLFDIDYYDEVGSDFTPKMAIDDPLTRATFQPALGNGHARNPLSKLDECIEEEEEEAEGESPKGFVTSSTEEKIPSVSELSVSLKNTMLDGKNQNQQKYGGKVDNGHFANTSSGHKSANEQLPPSISFVDVTEMTEDEWSNFLEKFQELLYPAFAKRKSITL

SEQ ID NO: 123203 - protein, 104 aa, Glycine max
  Coding DNA Sequence Number=SeqID_31518
MAYRRPYLHMRCFQWSQYVHSPYGKGTRGVQTMEIVRKGVQNVCKLLASPTFLCEVKGVSPERWPVVASMHYLCCKGSFLYMETANSFMEFSHDIIFLLVFQAL

SEQ ID NO: 123204 - protein, 164 aa, Glycine max
  Coding DNA Sequence Number=SeqID_31519
MKHTNYMNWMAKKFQDNEAYKHHPPELHKLFKPKDRPPSSTMSPVPHKLATGVSLRETYALSENHTLGEALSPLSELGESAKHLHAQRVICSLSEAFVSSRAKRAQLAQWIFTNFVESRTKAKNRARKPKTSAFKRILGLGAISRFLEVEETSPPLCNLLAMEG

SEQ ID NO: 123205 - protein, 191 aa, Glycine max
  Coding DNA Sequence Number=SeqID_31520
MDGHIDVALVKEFYLNLYDLEDKSPKQVRVKGKLIKFYATSLNAFLETPPLIQPGDQYPSYSIFCRMRTDPQELASKLCIPGHEFVLNAEGAPWELLRMDLTTLAQTWSVLSYSNLATTSHTFDLNMDRARLFHGLVMKMDMDARARGSEGPYSAAPSDPSPSTLTPSTLAPPLPSVPALAPFAPPSLVPA

SEQ ID NO: 123206 - protein, 487 aa, Glycine max
  Coding DNA Sequence Number=SeqID_31521
  Homolog annotation: Hit_ID=A2Q186; Match level="QueryCoverage=27%, HitCoverage=39%, E-value=3e-09, Identity=28%"; Hit description =Reverse transcriptase-beet retrotransposon, putative
MESSDNMLSWEDGVELVANKSPPVKEADKLGQSIVTSITKRVRHVGQGVINADGYSTLGIHTNGIYTLTEEGRSTLPAHQNRKEVEPYGGVYILGTEKEKGMGMERGINKVGDLVVCWYKNFRKPTRSLSASCKNRRFRRRLDLLWVKNELEKAGKLWDFACKLGVGEKEEEELGRSNGSQYRGNEIEEFNTFIDNMELFDTPLMGRRFTWVRAEGFMDFVKKKYASFEVQGCGAFAFKEKLKKLNVEIEKWGKEKFGDLKENMGMLVNCINNLDMKEAIKGLSLEVKNVIKDFYQEKFKKDGGMHVLLEGVRFKTVKEGDNGLLTQLFLEEEIKRAIWHCDGSKNLIEVVGKKDEEGHGGDRRRKLGKERVPERVGIDFGSPLWLALRLPGCSSSFSFCLSLSFSQTGPRFRDCNHIVEFIFVEFVSATYRLSSKKSRKGKSPGKGGNRFWKSIVVGFKTPREAIEVAVKVRCCLCSVCWLVISAD

SEQ ID NO: 123207 - protein, 180 aa, Glycine max
  Coding DNA Sequence Number=SeqID_31522
MGKHNNSGWEWYFNLRRPLFDSKIGMAITFLSEVEGKPVHNYGSDSWDWAADPSGIYSTNSVYSMFWEEATVDSLEECFEELWKIKIPSKIVVTRIEEGGVRFGFQNQQKRTQLANRDCHQTSNYKEPVPMTHDPQLPPNSHVLSKYHVSIRPTPFKKLAKPFKPQYLKLTGSTLWGQGL

SEQ ID NO: 123208 - protein, 130 aa, Glycine max
  Coding DNA Sequence Number=SeqID_31523
MGAVKEVQEQIKADMEAMKEQMATVMGAMMSMKKIMEVIAAAVAVISAIIEVDPTPPIWPQSNKLSDLGCDFKPCLGYATEGQAVGGIPMQNTLEGPQFHPQPQPLHSTASKIPPAMAADKISRGKAQSH

SEQ ID NO: 123209 - protein, 85 aa, Glycine max
  Coding DNA Sequence Number=SeqID_31524
MVGATKKIDSKDSMFCYKNMEGTMSRGKSEIEGFTTSTSMMTQEHKSSGTLWWHKGFDDAKRIYLMKAHIVSSQPTRSRKSQIRT

SEQ ID NO: 123210 - protein, 62 aa, Glycine max
  Coding DNA Sequence Number=SeqID_31525
MYKQNQKDFLRLIVRFGYKNSLVFLGFKGINEALGLNPELGLGLNPKLGLDLKRADNFILQN

SEQ ID NO: 123211 - protein, 53 aa, Glycine max
  Coding DNA Sequence Number=SeqID_31526
MDEDQWMYDNIRSEEVDMNEQNEDKVGVNEEHVDCFDMFNTSQVFATHDYILH

SEQ ID NO: 123212 - protein, 205 aa, Glycine max
  Coding DNA Sequence Number=SeqID_31527
  Homolog annotation: Hit_ID=Q6WAY6; Match level="QueryCoverage=60%, HitCoverage=22%, E-value=7e-08, Identity=28%"; Hit description =Putative uncharacterized protein
MVDVRVLIHAGLFHSSKHGIKSNTFVQEKVLSSQNQELRGHQFVRVGAVDGSTSTESLLQSLWCFIFEDFQLIPIVEEFEEILGCLLGGRKPYLFSGFYPSMVRVAKVVKISAQELDWVKQNRNGVVGVPKKCLEEKAKALASQGEWAPFIDILMLLIFGVVLFPNGEGLVDLAVIDAFLTFHHIKESPVLAILGRHVTHVRSEM

SEQ ID NO: 123213 - protein, 140 aa, Glycine max
  Coding DNA Sequence Number=SeqID_31528
MVSRYALNQIAAELELSFSDQGLSEPKVHITQEMEAIFKRFEDLDICGKVTLRSKLWELAYHDLTLMCAPPKKVKTKGGQKKWMTKQQRSTKCDPSYFEYLVALNSVQDSSSTLKRSGSSSEQTKQKRNIPMLDQFHPCL

SEQ ID NO: 123214 - protein, 86 aa, Glycine max
  Coding DNA Sequence Number=SeqID_31529
MVEREMIAMIVDTLPVFYYEKLVGYMPSSFADLVFAGERIEVGLKRGKFDYVSPTDTNNRKVGVAGAKRKEGDAHAITSTLAWPKP

SEQ ID NO: 123215 - protein, 76 aa, Glycine max
  Coding DNA Sequence Number=SeqID_31530
MGWNPGPADDACTSRKSHVAAPDPCGWLPTASTKRNTHRLSARKTLEEDEPYRLELEAGVDLRAWDELVSDCEILE

SEQ ID NO: 123216 - protein, 244 aa, Glycine max
  Coding DNA Sequence Number=SeqID_31531
PLVQQLIPYRQRFVKAWTNKVMHLGNTTTYRVESIHWTSKRLLRKVSPHVIGHSGHWIAKGDTKWSRPEDADISGKGADDHFGLYVSSDLGSPNEDADNRKVRLNALGGRCDIFGKGADDHIGVSACHWTLGSLDSKGETKWSRSEDADIFGKDGVDNRKVSVYATGLSGRWIAKGETKWSQPEDGDISEKGETKWSRLEDADISKKGADDHIGLCVSLDLVSLNYEVWITIRCLRMLPDFRVA

SEQ ID NO: 123217 - protein, 272 aa, Glycine max
  Coding DNA Sequence Number=SeqID_31532
  Subcellular localization annotation: CTP_CleavageSite=41; ConfidenceScore=5.44e-01
MAESSKKRKGTSSTTAAAGHRRHRPSEALTTPIHPSLSSPRSSTLFSSDDQRLRYNSQFSSRIILDPKYLDTKFFNDETFGCYQAEMTGRLLAGSLTFDCRIMHYIIVRILLPRSSNLAQASEEDLILMWAFLTGCQIDWAHLVRYRMHKALRANEPLPYPQLVTLFLHHFQIPLDDEPFVQVKRSFAIGAGAVTSFGYHKDRNGQWLKKDALQDERTLSPPPQRDDSSALLTEVLSELRGLCTYVGMDTRITQLEEDVTYLRQSFVLPPPS

SEQ ID NO: 123218 - protein, 339 aa, Glycine max
  Coding DNA Sequence Number=SeqID_31533
  Gene Ontology: Mol. function=RNA-directed DNA polymerase activity; Biological process=regulation of transcription, DNA-dependent
  Homolog annotation: Hit_ID=A7NWH9; Match level="QueryCoverage=58%, HitCoverage=16%, E-value=1e-29, Identity=36%"; Hit description =Chromosome chr5 scaffold_2, whole genome shotgun sequence
MQPRHYGSNLNQPKKISAAFDLAGYNYWDYIDAWTNVFWHQNSKFKNSWLIYFKNNTVYNFPNWFLQWWNYFGPIPQIFPEEVQQGFQQFSKLFNSKESRILADLKYFSSFALSWIFSWQYRYGKTENSKQYPPLQRHAFVKWWSQFDTSKAAPEQVKNWFQSNPEFLKPTDPETSLFLNQKSQLAAFLASSKSKESLAQNLKEVLQLLQQEEEEESPKKEAESSENNDDQEDDPFYQNEDDSFGGIPVELVEATKHFPPYELTNPAKKRTHEADFNILKGERFEQDEGLSTHVCHLRQSHELVEQFAALNGKLSGTNKGRKGFGVLPAMAVTTVAMTA

SEQ ID NO: 123219 - protein, 135 aa, Glycine max
  Coding DNA Sequence Number=SeqID_31534
  Subcellular localization annotation: CTP_CleavageSite=68; ConfidenceScore=5.84e-01
MTLSSWQNKLNRPMATPPASPPPLSPPSPSPATALASPSTLKRTRKATQLRSLATRPPGAERPMVHVNPATGKADGPHKKKLRTYLGIVAHDKAKFDIPEAYDCRTNKKDVREKAQAIQKQNTDPHVLSHGGYEY

SEQ ID NO: 123220 - protein, 515 aa, Glycine max
  Coding DNA Sequence Number=SeqID_31535
  Pfam annotation: Domain name=Transposase_23; Domain location=175-245; Score=-8.0; E_value=0.0088; Accession=PF03017.5; Description =TNP1ENSPM transposase
DPSWEDVREKAQAIQKQNTDPHVLSHGGYEYLEQKLMAEKIKKKLEELLSLEALRAWDDTEKIGQMTSEAAKEIAEKIASQGSFVPYGRQDLLTAAIGQPEHPGRVRAEPFFLHGSQRTGAADSTNKGLARGVDHIKSDSAADVILQPDPEVGPSAARVSTKGSYVDPSLTDPDTGDSDKCGLYIKENLSCLVALGRFYEGSTAVHNIPLLHGQVKVGVEEVKDAEALVPVPIDEVILVGQTLNTFLAWLTHLVKRLSDQPFAFETQKAYNTLTTAMTTVMVVVASTKMFGSPAIVVTTTRATSMTIAVDSIEEYRRISFYGDIVLDSSRGGVPAKGTPTLKGLRQPLMVVIKTIFGDNARMLNYPTRPSEGSIQLFGQVEYPSTSSGITFDVKLREIFRFSGVQVFGKGKYLGTFIRITYRVKLEYFSNDHLQCQGEGSNQVEYLSTSIRITYGVKVREILRYSAKPSTRVLLNGFPLVLRKNEGYYLVFDLAGYPYSIQAPQASRSVVNKKAF

SEQ ID NO: 123221 - protein, 68 aa, Glycine max
  Coding DNA Sequence Number=SeqID_31536
MVVERNIDNNDDNDNRIVTTMMVVKCDSNSNNDDINYEIVIVTVVVIMVTVATTGCGNGGIGVVIVVE

SEQ ID NO: 123222 - protein, 115 aa, Glycine max
  Coding DNA Sequence Number=SeqID_31537
MVQAYSSSSQVVKMISLPHALIVTQDASQWIPPEIGQVDGGKRVFSLVFLDPSSPRLASGSLGPPNSFMVKKPACLGKLFASARLGELQLPQSDPLPINRHPRGVLKGSKVHKWR

SEQ ID NO: 123223 - protein, 111 aa, Glycine max
  Coding DNA Sequence Number=SeqID_31538
MIQDKKDEEKSEERTQQQWEKCSQVEIQQESILQVNIPSHQLIVKEERHGEHDKSLSVILSLITSTSLAMIWKAFSGYMSFMESLAKRKKMQGRCVLCDLHATLKALDSSS

SEQ ID NO: 123224 - protein, 147 aa, Glycine max
  Coding DNA Sequence Number=SeqID_31539
MKGITGAPYRARCDALTITNVSWLSYTEHRGVRAFELISSFQGQLRWGPKMVTARLERVVSADYMEWFFRISHPFMIPTQAGDQPRDAPAVDPEEYIQPPSPPDDYDCYEAIAQRLERVLNLRMVTADTELYDIRRGASADGSVRAR

SEQ ID NO: 123225 - protein, 123 aa, Glycine max
  Coding DNA Sequence Number=SeqID_31540
MARTRGLGRAIGRVIGRDTQDDHDAVDVSERRRPTASALRQRVHQMTADAPDMAEDVPDMTEDVPDMADDAPKMTDDKRPDLKLVSHGRKVTLIGRIKSTDRLFTQRDQHLPPSGRRVDDHIG

SEQ ID NO: 123226 - protein, 196 aa, Glycine max
  Coding DNA Sequence Number=SeqID_31541
MTFLGETSSQTIVNSRLGFIFPNGSIIYNDSGVYFQSSTPVPIRVPNSYDIATLKTRIHITLNLTHEQFLDEIHYQQPVIETASMRSFNGNFPPWRCSGRQRRRGERRRHPLGNKPWKKELHHQDEPWIRSLEGCFNGGKERGRERERGEHEIEGIKEGEKWNFEVCLTRLSFIKVTISVTHASIYRLGSFLEKLS

SEQ ID NO: 123227 - protein, 116 aa, Glycine max
  Coding DNA Sequence Number=SeqID_31542
  Subcellular localization annotation: CTP_CleavageSite=66; ConfidenceScore=5.12e-01
MAPPLTSSPLSSAASPWWKSPLKDLIEAQRSSLHRSFTSKLPSIQEDCYLLTEKQSGSPKAHNTTQHSMGSPFSLEASFMMMNQVDSSSFDDDKDYDKKPKRMISRLSQQVQDQVS

SEQ ID NO: 123228 - protein, 95 aa, Glycine max
  Coding DNA Sequence Number=SeqID_31543
  Subcellular localization annotation: CTP_CleavageSite=36; ConfidenceScore=5.02e-01
MMITKDDDKGDDKKLKDQSKNNSSESKINQRTTQVNQRSIKNNSRVQDKNQEEFKTQEESLETRIKIQGSRSQESRSRFKTQDSRMKRRLNQDKY

SEQ ID NO: 123229 - protein, 31 aa, Glycine max
  Coding DNA Sequence Number=SeqID_31544
MTTISDYVATVVSNLPPQHQGLQRNSDHIAT

SEQ ID NO: 123230 - protein, 166 aa, Glycine max
  Coding DNA Sequence Number=SeqID_31545
  Gene Ontology: Mol. function=methyltransferase activity; Cellular component=nucleus; Biological process=positive regulation of cell proliferation
  Homolog annotation: Hit_ID=A7Q9B4; Match level="QueryCoverage=63%, HitCoverage=21%, E-value=1e-38, Identity=79%"; Hit description =Chromosome chr19 scaffold_66, whole genome shotgun sequence
  Pfam annotation: Domain name=Nol1_Nop2_Fmu; Domain location=9-166; Score=-91.0; E_value=0.035; Accession=PF01189.8; Description =NOL1NOP2sun family
MFPTKSLNFSSAFIQTRRWDLADVLINRGVNLDPLSKWSTVGLVVYDSQVPIGATPEYMAGFYTLQSASSFLPFMALAPQEKERVVDMAFYFAEEVYALCRAAPGGKTTYIAALMMNTGAWHPSLGNLGNSGTCRKSKENIDAQSVRFRDTPEIKWKHRCTISEVP

SEQ ID NO: 123231 - protein, 47 aa, Glycine max
  Coding DNA Sequence Number=SeqID_31546
MQYSYAVKISSRKEEDRYVEAGEIKDKGNEEFMNVGKAEASGHVTPR

SEQ ID NO: 123232 - protein, 100 aa, Glycine max
  Coding DNA Sequence Number=SeqID_31547
MGVREDARMVGSETMTVETEENETECESDLQRHEEWSGLESGREELRRRRIHHGSHKVRLYNSLVSQPTLRRECGQKAKGAFSKKENTWESPPTFIQEKR

SEQ ID NO: 123233 - protein, 33 aa, Glycine max
  Coding DNA Sequence Number=SeqID_31548
MTIDTLEPYIGAMRDTMHEPQANLGPDPKFLPD

SEQ ID NO: 123234 - protein, 66 aa, Glycine max
  Coding DNA Sequence Number=SeqID_31549
MICPLQCHEEMHDVIKEQARGLSTTMHYQKRKTLDEASLLSSESETQHDHRSISTPYGSHRPRYRA

SEQ ID NO: 123235 - protein, 51 aa, Glycine max
  Coding DNA Sequence Number=SeqID_31550
MVLERAWYERVALDQIMTRKKEMRGSAAAANGDEEARKNGKVRGKRMIEWK

SEQ ID NO: 123236 - protein, 52 aa, Glycine max
  Coding DNA Sequence Number=SeqID_31551
NSGRSSYGPHIYFAPPSMQKTQGGRSTDNWHLCWFGPSIRITRSWSGKTYKF

SEQ ID NO: 123237 - protein, 58 aa, Glycine max
  Coding DNA Sequence Number=SeqID_31552
MSLEEAHHHRRPWIRAWRKKEMNEGRGREEHEILCSKKALKSKPTNPRSIPRFSTKCA

SEQ ID NO: 123238 - protein, 376 aa, Glycine max
  Coding DNA Sequence Number=SeqID_31553
  Gene Ontology: Mol. function=unfolded protein binding; Cellular component=mitochondrion; Biological process=protein folding
  Homolog annotation: Hit_ID=A7PNA3; Match level="QueryCoverage=73%, HitCoverage=34%, E-value=1e-103, Identity=73%"; Hit description =Chromosome chr1 scaffold_22, whole genome shotgun sequence
  Pfam annotation: Domain name=HATPase_c; Domain location=103-294; Score=31.9; E_value=2.3e-06; Accession=PF02518.17; Description =Histidine kinase-, DNA gyrase B-, and HSP90-like ATPase
  Subcellular localization annotation: CTP_CleavageSite=67; ConfidenceScore=5.72e-01
MAPVPSRTVATASLASLLPSSPFARASLLRSAFLPPQIGRDRKCFSPAAGLRWTQRRQGRRDGLAVRCEAAVAEKDEATGEKFEYQAEVSRLLDLIVHSLYSHKEVFLRELVSNASDALDKLRFLSVTEPSLLGDAGDLEIHIKSDPDNGTITITDTGIGMTKEELIDCLGTIAQSGTSKFLKALKENKDLGADNGLIGQFGVGFYSAFLVAGRVVVSTKSPRSDKQYMWEAEADSSSYVIKEETDPEKFLRRVKAPKFFFTGQEDDKYEFSEPSRIQGLVKNYSQFVSFPIYTWQEKSRTVEKKDRTRVLPSQFVAVAAAVRCSPAWCVVPSLTSGETVRELALVHGAVVAGACCSCSRWSSGVRVLCAAHLILI

SEQ ID NO: 123239 - protein, 402 aa, Glycine max
  Coding DNA Sequence Number=SeqID_31554
  Homolog annotation: Hit_ID=A2Q4S5; Match level="QueryCoverage=48%, HitCoverage=34%, E-value=9e-15, Identity=28%"; Hit description=IMP dehydrogenase/GMP reductase, putative
  Pfam annotation: Domain name=DUF1723; Domain location=92-141; Score =51.3; E_value=3.3e-12; Accession=PF08330.1; Description=Protein of unknown function (DUF1723)
MASADVEDTGADIPAYTSAQAAEDEHEGFLGGPSDPSVLTQYADHVACSERPELKLSSHGRKVHSLSRLVPAIEGLVAGTGQSPLIACSVDTGDRRLLSSFVERWHREMSSFHLPVGKVTITLDDISSLLHLPVVGNLHAFQPLHVDDVVQMLVDLLMVSAKAVRAETGQCRGPYICLQWVRDIYERRCQAGHWTAAARAYLLHLLGCTLFANKSATNAHVVDCNEEDCEEHTYTGIQGAPGLTSDSGCRLDPIWGAPTGSCGNLDTPRPFLIRLSIHGCRMMIYTTGQCANDYMDWFFRISHPFMTPGQASDPLPNGHAPQPRVVPQALQTDNPHVSESGAPSTSARSAVEEPRHTVKVCHGIAERLERHLSLGVVTLGSSTHEVIKECLRMARSVTQDQL

SEQ ID NO: 123240 - protein, 53 aa, Glycine max
  Coding DNA Sequence Number=SeqID_31555
MVVMVAVIDDHGGGYGDNHDSCGGNDHDSGGCGVNHGSCGRNDHDGGGHGDDS

SEQ ID NO: 123241 - protein, 704 aa, Glycine max
  Coding DNA Sequence Number=SeqID_31556
MARAFEDLCPFFNIQPSVLVFLFFFQIKLSGKIGWVSLNSVSKKLFEFDSNLRHFKDHFFKVLAIDVVVDGMPLILNRDEEPHILFYLQSDPTRVNKAILEQLLASLDAHDILSLPSTSDPFTALDGIMGDFAWRPLVKQVGPTGAIVPPSITASSAEDVGQLVGEVDLVIVVGEVTPNAHSSILVKRKMNDADMPPAPPTIEAPAAISTSATPTPSPPPAVVVQEITPAAIEVVVPAIQADFAVALLSTVATPLLSVGVVTTDAPTVLPLFSSITMVLPTAVLVAMASPSLSSCPYVPLDHLYTSSDADSLWGATYKPGQKTSVGFVLAFNKNLIWSTGDNELLHQKAMQKVASFEVECPKVANAIVAFAEVVMANHQQASKVGGALSKLLRTRLDGDDLFRCYKNLQAEKMGGKVDSMAIEKDGLAKRIAELEAWFRESESRLEESELWAAKERKANKELEEELILYKKEAIEQHEKGFQKVVRQTSIFVKDLDLGLLDPFKDVKEGVLLDEEEIDAEEEAADEGQGAAEQGDDACLVMRSECEMHLIEGLVLRTSGVIVCWVELGPLMVVVIVAATYNPAQIKVRNRKNYQGDVFFLGFVKPTELCRGLPRIDFGFCSPIRINVSVVLLHTWHSPWVAFTGGGLACSCIRTSYKVAGIGDLVVHRALAYLPLAIGGTHWRCGDMLLHICHLWKQSFMMNQQ

SEQ ID NO: 123242 - protein, 215 aa, Glycine max
  Coding DNA Sequence Number=SeqID_31557
MAPSLLSVFLLIKAKDDVSASTALGELTLTEGGHQVHVASGLDSLACKAEEQTDVRVDNVGETSLVDEDPEHHKVCIDDGDKHGVILVDGVDALEVFVRKGWVPVLVEVVAHIAVAGAFVWLGWLVPFVRLVQVGLGVGFALVALLCSLAYFISEYRHFFHLDVALCSLSTNLSRRKAGSMEFNATSGLRFLDLDYPRDLSSACRRLAKAAEVMR

SEQ ID NO: 123243 - protein, 108 aa, Glycine max
  Coding DNA Sequence Number=SeqID_31558
MLPFDFRCVTETYGLCINIFLVFRHVPEFHKLPNDGCQTPYKDQTKVACHQAKVPGRNLALGVPTLENIKIHHNVLAVIHTSYWRIHVGNFVEVMFGLSNGDIPRMID

SEQ ID NO: 123244 - protein, 42 aa, Glycine max
  Coding DNA Sequence Number=SeqID_31559
MVLIKNTACVVLVFLSAAWLSTARMNPKSVAVSEISYIKMLL

SEQ ID NO: 123245 - protein, 207 aa, Glycine max
  Coding DNA Sequence Number=SeqID_31560
MAHAFTVIIKYGCGQLTMVKAVTVSVDNDHGQANCYKGKELQIEDDDEVLPTKYVKARPDRLFIHELEDLKQKEFYLVFDCTFSLLVHLPHSKFNFTPQVQPIIEEVDYDVEVVLDPDAMAVSIYDPPSSRAYVKMIEAELQRRQEAFAQALKDHAHKITRWKLARPLMPSDTPAFSIDLSSDFDYFGDKYLRKLDEDIAKLNGEKK

SEQ ID NO: 123246 - protein, 72 aa, Glycine max
  Coding DNA Sequence Number=SeqID_31561
MCVWLCVCGSVLVCVSLWHKLDFEVSFRGKRQVVLTDTMCPFCCIMRRTLSTCSLTAVRPYLYGGSHYLGSE

SEQ ID NO: 123247 - protein, 173 aa, Glycine max
  Coding DNA Sequence Number=SeqID_31562
MEAMRENQLQPLILPKQTILSCKECWGNHHTSYCMEEVAKEAKFIREHTTKLEEVVINLSTTSYSNLENTMEVINSLKDQVKEASKKRHEVDDGVKEDIQEEDMVVEEIARETTKTKSQLTREAKQAITREKPYPRKPTKQDKERRYRSLIDLIKQLDVTIPFTDLIGITLKY

SEQ ID NO: 123248 - protein, 205 aa, Glycine max
  Coding DNA Sequence Number=SeqID_31563
MNLLSSAVHVSSVIKSGVSGDWEKKKEGVEMRVVITERAGRMKSVSYLCFPLISDERYLAPFVAQYVKSRDVPKIKRKQAYAIRENSVIFFLQKAVASGGSNLARLGELGGKILPYFAINKGNEGRRGLAVLALLILSKLLRKIVSVKKIQAETLPLQLGVIITTKHGSTFLSGSSKIVQLDNRMSFDALKQAIGNNISIPNGHV

SEQ ID NO: 123249 - protein, 51 aa, Glycine max
  Coding DNA Sequence Number=SeqID_31564
IVWSGDLLSPSAIKPYLGIIASEGMLCWPDRGHYCSFGLPLYQGHAIYGGE

SEQ ID NO: 123250 - protein, 192 aa, Glycine max
  Coding DNA Sequence Number=SeqID_31565
  Gene Ontology: Mol. function=nucleic acid binding
  Homolog annotation: Hit_ID=A5C528; Match level="QueryCoverage=40%, HitCoverage=14%, E-value=1e-10, Identity=44%"; Hit description =Putative uncharacterized protein
MEKSDRKTFNDKKAKKAYITWENNNMDSSGDSDNKVVNLSLKAKNYESEEERMLLTHDGDASKFTHISPKNSGHVTYGDNNKGRILGVGKIGTNPSTSIENVLLVGGLKPSLLSMMILDFFQPCKNPFTSKDPQGMYPPLFSLNLVDVPSTRTDPQEMYPLLFSVNNPSRCTLYLYHKGCTLQCVKTKFSGG

SEQ ID NO: 123251 - protein, 143 aa, Glycine max
  Coding DNA Sequence Number=SeqID_31566
MHYLALGDRVIDINSRKEKSPILLHLIEPLNSSGGFLRNPNEMLFILRYLVGSVFNSSLMMEFIGLLKELLGLDAFMDEEGSVTIVVDDEVGSSIEALVEGMLDAPLGNSSGGVVLGGEDVGGAPVDLGVGKVLATTRGFLHQ

SEQ ID NO: 123252 - protein, 54 aa, Glycine max
  Coding DNA Sequence Number=SeqID_31567
MAGTPHTQRISLHVIYCCSSVPTNEGSRSSQGYPTWSLHPSCVMTRLIAMISPL

SEQ ID NO: 123253 - protein, 163 aa, Glycine max
  Coding DNA Sequence Number=SeqID_31568
MKFKFKWYIYLGLTENKRGYISCGSVLVEGTSTRFKENKGGWVAQSTLPMSPMQRVSLETIASNIVARDHIAGHVWIGQSKDKLKLASHGGNVMPYPTHPTSMHECLRAYQPFLEVKRCWIVTASTTRSFLRLETSYLLRTKHTTLATPELEQTWHLIYRKGF

SEQ ID NO: 123254 - protein, 93 aa, Glycine max
  Coding DNA Sequence Number=SeqID_31569
MISPKYAGKFLFPQALGLVNSRAQGFKDNLICCFHLVVCLRVLDRSYEEFFVGLSLELGAVVSDNGIGRIVSAYEVFPVDGDQQELDLPKGSS

SEQ ID NO: 123255 - protein, 90 aa, Glycine max
  Coding DNA Sequence Number=SeqID_31570
  Subcellular localization annotation: CTP_CleavageSite=43; ConfidenceScore=5.37e-01
MACPLACVPKEPWWTSPNMRSASLAFTHRSKTMSWFLLYSMLSLKKKSAANLLNVLFSFSEASDGYSLLSMYHLMSKYHDLSSRSSSTKQ

SEQ ID NO: 123256 - protein, 171 aa, Glycine max
  Coding DNA Sequence Number=SeqID_31571
MAPKKLSTKRSRRDTHGEGSSAHAEFDSHRFRSAEHQQRFEAIKGWSFHRERHVQLREDEYPDFQEEIACRYWAPLVIPTAKFDPEIVIEFYANAWPTEEGVRDMRSWDFAWTAAGRRVRIMRTNMTTLTQIWMTLLLSNVLSSDHNSDLPLPKCQLVYAILTRMTAHVAQ

SEQ ID NO: 123257 - protein, 152 aa, Glycine max
  Coding DNA Sequence Number=SeqID_31572
  Subcellular localization annotation: CTP_CleavageSite=22; ConfidenceScore=5.13e-01
MLVLTSGMLRNFTDYATMLVLTSRMLRNFTDYATMLVLTFRMLRNFTDYTKMLVLRVPKGASKRRVLRVIGLECLWMTKVTIYCLHESSDLSSLDDKGANNHEVSPHAIGPSSHDSKIETFLRSQSEDADISGKGADDHIGLYVSMGSLAST

SEQ ID NO: 123258 - protein, 44 aa, Glycine max
  Coding DNA Sequence Number=SeqID_31573
AAEFGDEDDKLDTRPGSEDEGVKKEKFPRFKMPEDDADVRFDRG

SEQ ID NO: 123259 - protein, 87 aa, Glycine max
  Coding DNA Sequence Number=SeqID_31574
  Subcellular localization annotation: CTP_CleavageSite=68; ConfidenceScore=5.50e-01
MSYLTLTCTDNPINVWSSTFFTHMRMFTPINVVLNNSRDLDTRCKTPRSTLMMQRTVCHKINNRLPTRATEKVAQLLFRVPISFHQG

SEQ ID NO: 123260 - protein, 206 aa, Glycine max
  Coding DNA Sequence Number=SeqID_31575
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q08IT7; Match level="QueryCoverage=86%, HitCoverage=37%, E-value=8e-68, Identity=67%"; Hit description =Isoflavone conjugate-specific beta-glucosidase
  Pfam annotation: Domain name=Glyco_hydro_1; Domain location=41-206; Score=-150.8; E_value=4.1e-11; Accession=PF00232.9; Description =Glycosyl hydrolase family 1
MACNGLCILSLIALVLVISKSSVNCIETDAVEPIIDIASLNRNSFPPDFIFGAGSSSYQFEGAATEGGRGPSQDIYIYIYIYTSSERDWKREDVKTVKDMNLDSYRFSISWSRILPKGKLSGGINQEGIDYYNNLINELVANGIQPLVTLFHWDLPQSLENEYGGFLSPRIVKDFQDYAELCFKEFGDRVKYWVTLNEPWSYSQYG

SEQ ID NO: 123261 - protein, 141 aa, Glycine max
  Coding DNA Sequence Number=SeqID_31576
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q08IT7; Match level="QueryCoverage=100%, HitCoverage=33%, E-value=2e-69, Identity=75%"; Hit description =Isoflavone conjugate-specific beta-glucosidase
  Pfam annotation: Domain name=Glyco_hydro_1; Domain location=1-141; Score=-222.6; E_value=1.6e-07; Accession=PF00232.9; Description =Glycosyl hydrolase family 1
MMKDMNLDSYRFSISWPRILPSLEPYVTLFHWDLPQALEDEYGGFLSSHIVDDFRDYEDLCFKEFGDRVKFWVTLNQPWLFSQGGYATGPGRCTGPQCLGGDAGNEPYIVTHNQILAHAAAVHVYKTKYQAYQKVKIGITL

SEQ ID NO: 123262 - protein, 107 aa, Glycine max
  Coding DNA Sequence Number=SeqID_31577
MKLGLIQSKLGSSYRTFIILLDWIIVVCFLVCKEELLQDLEAAATTPKEEPRSSEASSSFPIARHSLIEPIEDTIMVEEPRRVTLEDYSSSNVPQIFTSIAQPKVQA

SEQ ID NO: 123263 - protein, 162 aa, Glycine max
  Coding DNA Sequence Number=SeqID_31578
  Homolog annotation: Hit_ID=A0ST23; Match level="QueryCoverage=27%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLDNDYANEELLWRHFKKWGDVRDVYIAKRLNKDGRRYRFMRFKGVSDAKGLEVRLGTELEFVIMVIAVSFGKPVVPAALMNRPTRGERRFAYWALFRFLAH

SEQ ID NO: 123264 - protein, 82 aa, Glycine max
  Coding DNA Sequence Number=SeqID_31579
MKNGGKPLRNRPRKRLGRVTEAPRLEFSSRKQFFSLILSDSQIPRGLNMGKEGGACHPARPGELGCFLQKALPSGGTSWKAQ

SEQ ID NO: 123265 - protein, 236 aa, Glycine max
  Coding DNA Sequence Number=SeqID_31580
MAPKKLSAKRSRRDATAEKTNAAPEFDSHHFMSAEHQQRFEAIKGWSFHTERRVQLRDDEYTDFQEEITRRHWTSLVNPMAKFDHEIVLEFYANAWPTEEGVRDMRSWVKGQWIPFDADALSQFLGDPLVLEEGQECEFSQRRNRADGFDEEVIAQLLCTTGQDFARTAARRRVRIMRTSMTTLTQMLMTLLLSNVLPSDHNSDLPLPKCQLVYAILTRMSVHVAQLIADAIYLFA

SEQ ID NO: 123266 - protein, 43 aa, Glycine max
  Coding DNA Sequence Number=SeqID_31581
MAEVNQGKTMTGHDWSRIVCLLLAGSSRQTLNHKGGGMINVSP

SEQ ID NO: 123267 - protein, 229 aa, Glycine max
  Coding DNA Sequence Number=SeqID_31582
  Homolog annotation: Hit_ID=Q5XM22; Match level="QueryCoverage=54%, HitCoverage=85%, E-value=6e-20, Identity=38%"; Hit description =Resistance-like protein HAAS-2
MDDAVQMLVDLLMVYAEAARAEIGQCRGSYICLEWVCDIYECRCRAGHWTAAACAYLLHLLCCTLFANKSATNVHLVFLEAHCDLSQTGRYAWGVAALVHMYDHLNDASISTNRQLGGYITLLQCWIYEHFPSVAESTADPEYDENSPRAWLLAVYYLPERVMRQFGYTQTILALPVDSWVSYDDIHDRWMHYLNHMVAPGEVCTVPGQCASDYIDWFFRISHPFMTPG

SEQ ID NO: 123268 - protein, 195 aa, Glycine max
  Coding DNA Sequence Number=SeqID_31583
  Gene Ontology: Mol. function=transcription regulator activity; Biological process=regulation of transcription, DNA-dependent
  Homolog annotation: Hit_ID=A1FT26; Match level="QueryCoverage=93%, HitCoverage=93%, E-value=4e-83, Identity=86%"; Hit description =Transcriptional regulator, TetR family
  Pfam annotation: Domain name=TetR_N; Domain location=12-58; Score =51.4; E_value=3.2e-12; Accession=PF00440.14; Description=Bacterial regulatory proteins, tetR f
MKESLSPKAQEILAHARSLLEPGGYNGFSYADVSARVNISKASIHHHFPSKADLVRTVVEIYRAEAREGLALLDRQLGDPLQELNAYVDYWSSCIAGGTSSFCICAMLAAEAPMIPAEIAEEVRGHFEDLSGWLAVTLEKGAAMGQLQLQGSAADEAKAFMSSVHGAMLAARGLGDAATFATLARLAIARVSAAA

SEQ ID NO: 123269 - protein, 206 aa, Glycine max
  Coding DNA Sequence Number=SeqID_31584
  Gene Ontology: Mol. function=protein transporter activity; Cellular component=cell outer membrane; Biological process=protein secretion
  Homolog annotation: Hit_ID=P34749; Match level="QueryCoverage=91%, HitCoverage=45%, E-value=3e-84, Identity=84%"; Hit description =Protein transport protein hofQ precursor
  Pfam annotation: Domain name=Secretin; Domain location=19-193; Score =96.2; E_value=1e-25; Accession=PF00263.12; Description=Bacterial type II and III secretion system protein
MDTLVRWATQMDIPVEQVELAAHIVTMTEKSLRELGVKWALADATDAGKVGQLTTLGSDLSVASATSHVGFNIGRINGRLLDLELSALEQKQQVDIIASPRLLASHMQPASIKQGSEIPYQVSSGESGATSVEFKEAVLGMEVTPVVLPGGRVRLKLHISENMPGQVLQQADGETLAIDKQEIETQVEMFDVGHELAYKEYRFELD

SEQ ID NO: 123270 - protein, 283 aa, Glycine max
  Coding DNA Sequence Number=SeqID_31585
  Gene Ontology: Mol. function=3-dehydroquinate synthase activity; Cellular component=cytoplasm; Biological process=aromatic amino acid family biosynthetic process
  Homolog annotation: Hit_ID=Q57IY8; Match level="QueryCoverage=100%, HitCoverage=78%, E-value=1e-121, Identity=79%"; Hit description=3 -dehydroquinate synthase
  Pfam annotation: Domain name=DHQ_synthase; Domain location=17-282; Score=500.6; E_value=1.9e-147; Accession=PF01761.11; Description=3 -dehydroquinate synthase
MERITVTLGERSYPITIAAGLFNDPASFLPLKAGDQAMLVTNETLAPLYLDRVRHLLELAGVKVDSVILPDGEQYKSLTVLDTVFTALLQKPHGRDTTLLALGGGVVGDLTGFAAASYQRGVRFIQIPTTLLSQVDSSVGGKTAVNHPLGKNMIGAFYQPASVVVDLDCLKTLPARELASGLAEVIKYGIILDGEFFNWLEENMDALLRLDEAALAYCIRRCCELKAEVVAADERETGLRALLNLGHTFGHAIEAEMGYGNWLHGEAVAAGMVMAARTSERLG

SEQ ID NO: 123271 - protein, 26 aa, Glycine max
  Coding DNA Sequence Number=SeqID_31586
MESPTAAIYPLAGGRRETHRLSKVHV

SEQ ID NO: 123272 - protein, 91 aa, Glycine max
  Coding DNA Sequence Number=SeqID_31587
IAPARHPVDPKKSNRVLGFPALITCLCQFYKVPVARSKFIRSPINRAFIKKYSAPRQAQGETPQHPRDGQQRATNALPPPLEFTSAHPQKG

SEQ ID NO: 123273 - protein, 151 aa, Glycine max
  Coding DNA Sequence Number=SeqID_31588
MQAFGSLAVRFVTTSCWNFPGVTHCNRLGYTYYPLSQLSVIPLEEARTESPPNRVAQPESVSEMAPKMRYFLLTHLCGISHRTMVHSQYNLRLCRIQLMPAPDRFPDRNSPGSERPERAINVSLAHSLGIPRLYTLCCAGLRMLTDGLSSG

SEQ ID NO: 123274 - protein, 371 aa, Glycine max
  Coding DNA Sequence Number=SeqID_31589
TRCAPVNQQHQPHQQRHDNAGGGAERPVTNIEELAFDYVTDQQAGFVQLLKAGVERQYHKWQQNIDQPEDHRFRGKHDAKRLVDDAEPQQKFIEPATRAEKNFQTINANQRVGPERHNQQKQHQRTQTRRQSGQAPGKRVAEQQAAQRGDAGHVERVQQHVGIQRIEEPAVVVQGEHHADKVRVVARQKAGGEDHQIRQQHEQRQPADDQRHNGFLQTITHPFHTAAPPPMVKIRIVLIKELADGEQLAVLQFDGGFQRHAFIVAFAHIADQVFAAAVVIDLLDAQIFRSQQHMQPIAGFDRERAVNITLAAFEASPYLRRVRAADHFRIKHIDFANEARHKQVRGLFVDLARRAVLLDAPVAHHHDAIGH

SEQ ID NO: 123275 - protein, 94 aa, Glycine max
  Coding DNA Sequence Number=SeqID_31590
MGVQIAPRPIWALQKIPPEGGCFWRKQPCSPGRAELAWASWAATTSPIFAINRGGRQEGRAEALPKRFRNVFREEFRKGFTVSTSSSSHRLDLT

SEQ ID NO: 123276 - protein, 321 aa, Glycine max
  Coding DNA Sequence Number=SeqID_31591
  Gene Ontology: Mol. function=unspecific monooxygenase activity
  Homolog annotation: Hit_ID=Q9AVH2; Match level="QueryCoverage=66%, HitCoverage=100%, E-value=1e-59, Identity=47%"; Hit description =Putative senescence-associated protein
PGRQNEREPTNGSLFWPNIVEEERDTGLIGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQARSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 123277 - protein, 200 aa, Glycine max
  Coding DNA Sequence Number=SeqID_31592
  Homolog annotation: Hit_ID=A5B939; Match level="QueryCoverage=32%, HitCoverage=52%, E-value=5e-19, Identity=62%"; Hit description =Putative uncharacterized protein
RGGRCKTQGASPGGAVVGADLGGTGEARLIALCARTPKGNRPAPPLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCETTAKGTGLAESAGKEDPVELDSSPTFGALPLFLDPRSASAGRSGRKTLS

SEQ ID NO: 123278 - protein, 193 aa, Glycine max
  Coding DNA Sequence Number=SeqID_31593
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLMLFKPAREMFIALQGMQAWHWPSFYNVVTGKTLALPNLIALQHIPLSPAGVIAKRPAPIALPNSCAA

SEQ ID NO: 123279 - protein, 41 aa, Glycine max
  Coding DNA Sequence Number=SeqID_31594
MARGTRHAYAQALNDVNTDDGLIFDTASAAAVDVRSIERAR

SEQ ID NO: 123280 - protein, 119 aa, Glycine max
  Coding DNA Sequence Number=SeqID_31595
MSVIGCTICGGAHESDHCIPFEEQTQEVSYIGNQQRQGYNQGGFLGFQQGPYNQQGQWGSHPGNQFNKDQGGSSNRPPQQGPNIFQRTTKMEETLAQFMQVTMSNHKSTESALKNLEIQ

SEQ ID NO: 123281 - protein, 255 aa, Glycine max
  Coding DNA Sequence Number=SeqID_31596
  Gene Ontology: Mol. function=phenylalanine-tRNA ligase activity; Cellular component=cytoplasm; Biological process=phenylalanyl-tRNA aminoacylation
  Homolog annotation: Hit_ID=Q5PH85; Match level="QueryCoverage=100%, HitCoverage=32%, E-value=1e-114, Identity=81%"; Hit description =Phenylalanyl-tRNA synthetase beta chain
  Pfam annotation: Domain name=FDX-ACB; Domain location=161-254; Score =164.8; E_value=2.2e-46; Accession=PF03147.5; Description=Ferredoxin -fold anticodon binding domain
MSAMRLSLWTGLLGAVVYNQNRQQSRVRLFESGLRFVPDTQADLGIRQDLMLAGVLSGNRYEEHWDLARQTVDFYDLKGDLESLLDLTGKLDAISFRAEANPALHPGQSAGIYLAGERIGFIGVVHPELERKLDLNGRTLVFELLWNKVADRVLPDAREISRFPANRRDIAVVVAENVPAADIIAECKKVGVNQVVGVNLFDVYRGKGVNEGEKSLAISLILQDTSRTLEEEEIAATVAKCVAALKERFQATLRD

SEQ ID NO: 123282 - protein, 670 aa, Glycine max
  Coding DNA Sequence Number=SeqID_31597
  Gene Ontology: Mol. function=transmembrane receptor activity; Cellular component=membrane; Biological process=signal transduction
  Homolog annotation: Hit_ID=A7MM72; Match level="QueryCoverage=77%, HitCoverage=92%, E-value=1e-152, Identity=56%"; Hit description =Putative uncharacterized protein
  Pfam annotation: Domain name=HAMP; Domain location=196-265; Score =61.0; E_value=4.1e-15; Accession=PF00672.16; Description=HAMP domain
  Pfam annotation: Domain name=MCPsignal; Domain location=296-518; Score=402.1; E_value=8.7e-118; Accession=PF00015.12; Description =Methyl-accepting chemotaxis protein (MCP) signaling domain
  Pfam annotation: Domain name=TarH; Domain location=44-183; Score =17.4; E_value=0.0016; Accession=PF02203.6; Description=Tar ligand binding domain homologue
  Pfam module annotation: Pfam domain module=HAMP::MCPsignal::TarH; Domain location=196-265::296-518::44-183
MLKRINVVTSLIAVLLVFGAMQLLSGGLFWSALQKDKEAFAVAQTSSNNVAAMSDAWIELNQTRTVLNRAMLRMQGSMASQTNGGQLNALIAQTEKQLDTAAGHYQHYYDLPATPGLPDALRDRLEADYAAFNNGLKAMLARLKANDLQGMFDQNIEAKQVKMKATYEEWRSAQSALAAEGVAQNQRAFHTMMWLLAIVAVMVIAVIVACWFGLRTVLIQPLHQLLGHIRHIAAGDLTQTITVEGRNEMSQLASSLHEMQQSLVHTVGNVRDGSDAIFTGASEISAGNNDLSARTEQQAASLEQTAASMEQLTATVKQNAENARQASQLALSASETARKGGDVVEGVVRTMHDIAGSSKKIADITSVIDGIAFQTNILALNAAVEAARAGEQGRGFAVVAGEVRNLAQRSAQAAKEIKGLIDDSVSRVNAGSQLVGTAGDTMQDIVGAVTRVTDIMGEIASASDEQSRGIDQVGQAVTEMDRVTQQNASLVEESAAAAASLEEQASRLSQSVAVFRIPRASAAVVVRSPVATTPPAVRKAAAAPRERVAWRALHRFAAGLTPFTSHKDPRLRADNTSDPPINEVFMFSRVRVVSGLLCVLALFALLQLFSGGMFFSTVKADKDNFAYNQRLSTLQRAMGTSWFRWYRRVYAEPCRYPLSADSQQPAPVPR

SEQ ID NO: 123283 - protein, 261 aa, Glycine max
  Coding DNA Sequence Number=SeqID_31598
  Gene Ontology: Mol. function=hydrogen ion transmembrane transporter activity; Cellular component=flagellin-based flagellum; Biological process=ciliary or flagellar motility
  Homolog annotation: Hit_ID=P55891; Match level="QueryCoverage=100%, HitCoverage=88%, E-value=1e-115, Identity=80%"; Hit description =Chemotaxis protein motA
  Pfam annotation: Domain name=MotA_ExbB; Domain location=105-218; Score=-42.4; E_value=0.055; Accession=PF01618.7; Description =MotATolQExbB proton channel family
MMVGGHLGALYQPSELLIIGGAGIGAFLVGNNGKSIKKTLKALPLLMRGSKYNKAVYMDLMALLYRLMAKSRQQGMLSLERDIEDPSQSEIFANYPRILSDKPLVDFITDYLRLMVSGNMNAFEIEALMDEEIETYEHECEVPAQSLAAVGDGLPAFGIVAAVMGVVHALASADRPAAELGALIAHAMVGTFLGILLAYGFISPLASVLRQKCAETTKMMQCVKVTLLSSLNGYAPQIAVEFGRKTLYSTERPSFTELEEH

SEQ ID NO: 123284 - protein, 373 aa, Glycine max
  Coding DNA Sequence Number=SeqID_31599
  Gene Ontology: Mol. function=phosphotransferase activity, alcohol group as acceptor; Cellular component=intracellular; Biological process=carbohydrate metabolic process
  Homolog annotation: Hit_ID=A6T9Y8; Match level="QueryCoverage=98%, HitCoverage=98%, E-value=1e-157, Identity=73%"; Hit description =Anhydro-N-acetylmuramic acid kinase
  Pfam annotation: Domain name=UPF0075; Domain location=4-367; Score =796.9; E_value=1.2e-236; Accession=PF03702.5; Description =Uncharacterised protein family (UPF0075)
MKSGRYIGVMSGTSLDGVDVVLAAIDQHMVAQQASYCHPIPLALRQQVLEICQGQTLTLSQLGQLDTRLGQLFAEAVLTLMQQQALEASDIMAIGCHGQTVWHEPQSAAPNTLQIGDNNQIAAATGVTVVGDFRRRDMALGGQGAPLVPAFHQALLMDSVERRMVLNIGGIANLSLLIPGQPVRGFDTGPGNMLMDAWIWRHKGLPFDKDAGWARSGQVVPALLEQMLGDPWFALPPPKSTGREYFNLGWVEQQLQRFPALAPQDVLATLCELTALTIAHQVQLNDGCDRLLVCGGGSRNPLLMARLAAHLSGTEVGTTDQAGISGDDMEALAFAWLAFRTLSGLPGNLPAVTGAREMSVLGAIYPANPYAIR

SEQ ID NO: 123285 - protein, 167 aa, Glycine max
  Coding DNA Sequence Number=SeqID_31600
  Gene Ontology: Mol. function=superoxide dismutase activity; Cellular component=periplasmic space; Biological process=superoxide metabolic process
  Homolog annotation: Hit_ID=A8GDX1; Match level="QueryCoverage=99%, HitCoverage=95%, E-value=7e-59, Identity=65%"; Hit description =Superoxide dismutase precursor
  Pfam annotation: Domain name=Sod_Cu; Domain location=19-167; Score =110.2; E_value=6.3e-30; Accession=PF00080.11; Description=Copperzinc superoxide dismutase (SODC)
MAVLTLVCAAGAHAASEDVTLHQVTEQGIGESIGKVTISETPYGLQFAPALSGLKPGIHGFHVHAKGSCEPGESAGKIVAAGAAGGHLDPHDSGKHLGPYADGHLGDLPALYVTDDGKASYPVVAPRLKSLSEIKGKALMVHVGGDNHADHPQPLGGGGARLACGVI

SEQ ID NO: 123286 - protein, 134 aa, Glycine max
  Coding DNA Sequence Number=SeqID_31601
  Homolog annotation: Hit_ID=Q6D630; Match level="QueryCoverage=97%, HitCoverage=98%, E-value=3e-40, Identity=55%"; Hit description =Putative uncharacterized protein
MTLSVSAWLQHKIDEYKFSVRDITVDFYLAQAMLNRTDCSIEQLRRFNDTCLDMAEICQLNGDDHSYLHAMGKLHHRLVQEMGNADRDRLFRIQAYQLARLSLTRLCHQLALSGDWDQATRLQSDFVRHAGWIF

SEQ ID NO: 123287 - protein, 143 aa, Glycine max
  Coding DNA Sequence Number=SeqID_31602
  Gene Ontology: Mol. function=iron-sulfur cluster binding; Biological process=electron transport
  Homolog annotation: Hit_ID=A6TAG5; Match level="QueryCoverage=97%, HitCoverage=13%, E-value=2e-69, Identity=90%"; Hit description =Putative oxidase
MSGCLACKACSTQCPIKIDVPEFRSRFLQLYHSRYLRPVRDHLVATVESYAPLMAQAPKTFNFFINQPWMRKLSEKHIGMVDLPLLSVPSLKQQLAGHRSANTTLEDLEAMSVEQRAKRVLVVQDPFTSYYEAQLVADFRPAD

SEQ ID NO: 123288 - protein, 229 aa, Glycine max
  Coding DNA Sequence Number=SeqID_31603
MLRHQLIQPRAQRGHLLRNQRRIVAGKLDNIQAEHLFAWHIGDQLADRMPDNILARQVQHFGIHCLHRQGLRLDHKRCIAQCGIERIVLNVHQPAHLGNGCDIQPGFGDKGQRAFGAAQQARQVESLQIITEHMAQVITGEEAVQFGEFCQNQFTLLAAAVKHCFIDAPFSGRRRGQLFRQRGRHGARIKNFAAQQHGTQAFDVIGGFAIHQRSLTGGIGIDHAAQRGA

SEQ ID NO: 123289 - protein, 358 aa, Glycine max
  Coding DNA Sequence Number=SeqID_31604
  Gene Ontology: Cellular component=integral to membrane
  Homolog annotation: Hit_ID=A7MP07; Match level="QueryCoverage=95%, HitCoverage=91%, E-value=1e-122, Identity=62%"; Hit description =Putative uncharacterized protein
  Pfam annotation: Domain name=UPF0118; Domain location=2-333; Score =179.9; E_value=6.6e-51; Accession=PF01594.7; Description=Domain of unknown function DUF20
MLFSLMFILLMIIACLWVVQPFILGFAWASMVVIATWPLMIRLQQLLWGRRSLAVIAMTILLLLLFIIPIALLVSSLIDNSAPVIAWATQRHLVLPDLAWLRDIPYAGRKLYSSYHKLIDGGGAAIMSQVQPYIGRTTGFFVAQAGHFGRFMLHLALMLLFSVLLYWRGEQVGLGIRHFAYRMGGRRGDAAVLLAGQAIRAVALGVVVTALVQGVLGGIGLAISGIPYATLLTVLMILTCLVQLGPLIVLVPAIIWLYWSGDTTWGTVLLVWSCVVGTLDNVLRPMLIRMGADLPMILILSGVIGGLIAFGMIGLFIGPVVLAVSYRLVSVWMHEAPAPDDDPETAIEALAEHEEPQP

SEQ ID NO: 123290 - protein, 309 aa, Glycine max
  Coding DNA Sequence Number=SeqID_31605
  Gene Ontology: Mol. function=transferase activity, transferring phosphorus-containing groups; Biological process=phosphorylation
  Homolog annotation: Hit_ID=P23538; Match level="QueryCoverage=98%, HitCoverage=38%, E-value=1e-148, Identity=87%"; Hit description =Phosphoenolpyruvate synthase
  Pfam annotation: Domain name=PPDK_N; Domain location=9-309; Score =386.0; E_value=5.9e-113; Accession=PF01326.10; Description=Pyruvate phosphate dikinase, PEPpyru
MSNQDQQSLVLWYNQLGMHDVDRVGGKNASLGEMITNLSSLGVSVPNGYATTSYAFNQFLDQSGLNQRIYALLDNTDIDDVAALAQAGKQIRQWVVDTPFQPELEAAIRSAYEQLSADDAEASFAVRSSATAEDMPDASFAGQQETFLNVQGFDAVLVAVKHVFASLFNDRAISYRVHQGYDHRGVALSAGVQRMVRSDLASSGVMFTIDTESGFDQVVFITSAFGLGEMVVQGAVNPDEFYVHKPTLAANRPAIVRRTLGSKKIRMVYADSQEHGEQVRIEDVEQEQRDRFSLTDDEVQALARPGGAD

SEQ ID NO: 123291 - protein, 371 aa, Glycine max
  Coding DNA Sequence Number=SeqID_31606
  Gene Ontology: Mol. function=3-deoxy-7-phosphoheptulonate synthase activity; Cellular component=cytosol; Biological process=aromatic amino acid family biosynthetic process
  Homolog annotation: Hit_ID=O54459; Match level="QueryCoverage=93%, HitCoverage=99%, E-value=1e-161, Identity=81%"; Hit description =Phospho-2-dehydro-3-deoxyheptonate aldolase, Trp-sensitive
  Pfam annotation: Domain name=DAHP_synth_1; Domain location=47-361; Score=570.8; E_value=1.4e-168; Accession=PF00793.11; Description =DAHP synthetase I family
MVYCDHHHFPVFHRCEEQILRIPMNKTDELRTARIGTLLTPAALAQQHPISAAIAANVTAARQRIARILTGEDPRLLVIIGPCSLHDPKAALEYAERLNLLREQHKGRLEIVMRAYFEKPRTVVGWKGLISDPDLDGSFDVNRGIAIARQLLLDINAIGMPTATEFLDMVIGQFIADLISWGAIGARTTESQIHREMASALSCPVGFKNGTDGNVQIAVDAIRAARVSHMFLSPDKTGQMTIYQTSGNPHGHVILRGGRQPNYHAEDVAAAAANLRDFNLPEQLVIDFSHGNCLKQHRRQRDVAQDVAAQIRAGSRAVAGVMIESFLQEGNQKVVSGQPLTYGQSITDPCLGWDDSAEVLALLAAAVDSRF

SEQ ID NO: 123292 - protein, 138 aa, Glycine max
  Coding DNA Sequence Number=SeqID_31607
MGRVEEVQEQMEVDMEAMKEKMATMMKAMVSMKKIMEVNMVAIAAISTILEAKSWQVWVAPIVCKFKTSTPSRHMACLPIIHHPMWRTLPVKMSITPLPYPLRANNPKTDHALLNRGGYTRNSPPQSSRLRALPRICH

SEQ ID NO: 123293 - protein, 90 aa, Glycine max
  Coding DNA Sequence Number=SeqID_31608
  Gene Ontology: Mol. function=RNA-directed DNA polymerase activity; Biological process=RNA-dependent DNA replication
  Homolog annotation: Hit_ID=Q1AKH8; Match level="QueryCoverage=47%, HitCoverage=10%, E-value=2e-09, Identity=76%"; Hit description =Reverse transcriptase family member
MERRQTIRSRGRPKKTIREVIEKDLELNDLDRSMEGVRDMRSWVRGQWIPFDADAIGQLLGYPLVLEEGQECEYGQRRNRSDGFDEEAIA

SEQ ID NO: 123294 - protein, 77 aa, Glycine max
  Coding DNA Sequence Number=SeqID_31609
MIWVPKGSSVNTNMQGPNKIWVPKSKTLMIMQAESDSVRKQLLLKLSGNAYLLALVILCEPKATSSFGTSQKMSYRT

SEQ ID NO: 123295 - protein, 74 aa, Glycine max
  Coding DNA Sequence Number=SeqID_31610
MSKEKLTQLIEIKDKAGSLLRGPRSKWQMLNFFAITSTGQKVLLKLSISESEASWQFPMFIVGLVDHIKQAIKA

SEQ ID NO: 123296 - protein, 100 aa, Glycine max
  Coding DNA Sequence Number=SeqID_31611
MDDALLQPKTRYQEITLYRLKVQSINNSFSLNWVQGINHSSMWLAFWLSGYHNQTWPSSSSIHRPLPLQKEKVGLLAKPPVQGTPPHSWSAAGQSSATSG

SEQ ID NO: 123297 - protein, 41 aa, Glycine max
  Coding DNA Sequence Number=SeqID_31612
MAPLQDTGLPCSNVFCLSSAGKGRRSVGRDPILHLHLSLST

SEQ ID NO: 123298 - protein, 172 aa, Glycine max
  Coding DNA Sequence Number=SeqID_31613
TVVFDDKQKTKFGHSAHMIRRDTLRLSAPLCHSDTVVFDGKQRPKTKFGHSAHMIRGDTLRLSAPPLPFRHSRVRWQAETKFGHSAHMIRGDTLRLSAPPLPFRHSRVRWQAETKSGHSAHMIRGDTLRLSAPLCHSDTVVFDGKQRPRADTVFCTFCSSGDNKVIYMWKFH

SEQ ID NO: 123299 - protein, 67 aa, Glycine max
  Coding DNA Sequence Number=SeqID_31614
  Homolog annotation: Hit_ID=A6FJQ2; Match level="QueryCoverage=56%, HitCoverage=84%, E-value=3e-11, Identity=92%"; Hit description=50S ribosomal protein L5
MQLRDGHSLSMRKEKIPHQAPFAIQAAQLLGRAIGAGLFAITPAGERGMCCKAIKLGNARVFPVTTL

SEQ ID NO: 123300 - protein, 161 aa, Glycine max
  Coding DNA Sequence Number=SeqID_31615
  Subcellular localization annotation: CTP_CleavageSite=51; ConfidenceScore=5.62e-01
MATPPASPPPPLAPPPADADASPSTLKRTRKATRLRSLATRPPGAERPVVNVDPATGKADGPHKKKLRTYLGIVARDKVDVTYDTWKEAEFQIPEASHSRTKKKILQIVGERWRQFKSDLTRKWALVVDKDGADDIVCEKYGISKEKWTQFCQTRRDPSWE

SEQ ID NO: 123301 - protein, 158 aa, Glycine max
  Coding DNA Sequence Number=SeqID_31616
ETKFGHSAPMIRGDTLWLFAPFCHPEAAGPMTSRDQVWSFCTLVSSRGGGPDDTRKYPSVFCTFCSSGNNKSFTCGNFMVARDSRQPRGAKLVSYTDFRGPLLDDMRPFFGPCEERQVTVVTRDSRQSRGAKLVSYKLHPISRGPLLDDVRPFFGPCE

SEQ ID NO: 123302 - protein, 105 aa, Glycine max
  Coding DNA Sequence Number=SeqID_31617
GLHVLALRGLHVLTIRGLHALTSRGLHVLALRGLHALTLGTSYPHRHRTTRPRLERRHVLNFRGLHALTFRGLLSSHSVGLPYPHLRYNLPLTVLKCLTETCTPG

SEQ ID NO: 123303 - protein, 238 aa, Glycine max
  Coding DNA Sequence Number=SeqID_31618
  Homolog annotation: Hit_ID=Q2HW90; Match level="QueryCoverage=32%, HitCoverage=17%, E-value=2e-08, Identity=34%"; Hit description =Putative uncharacterized protein
IATVVKDQQRFGPHKQTRNGIAGLPQRYLEDKARGMANQGDWVPFMDVLALLIFGVVLFPNVDVSIVILCTFPYCAFFTLSSAQWVPCPLILLGTRQNNGEIPGPLSSKQLGYPMRGATDGKKACLLYLSQGIQRRTRIPRHLESIGVRNPEMKAFRKTYEKILDLTIAEVSIEAIASLTQYYDQPLRCFTFGDFQLVPTIEEFEEILGCPLGGRKPYLFFGCLPSLSRIATVVKIQQ

SEQ ID NO: 123304 - protein, 72 aa, Glycine max
  Coding DNA Sequence Number=SeqID_31619
MSALKEQMASMMDAMLGMRQLMENSAATAAAVSSATEADPTLPATAHHPIPSVVGQERSILGHISNPHLGYN

SEQ ID NO: 123305 - protein, 81 aa, Glycine max
  Coding DNA Sequence Number=SeqID_31620
  Subcellular localization annotation: CTP_CleavageSite=51; ConfidenceScore=5.22e-01
MRIGRRPGRPQGVRVGRFINAAGTTGFPTGKRAVSATQLIRPRRARLLPPEATAFWRNILEGPSGPDCYVGSPGTELEFAL

SEQ ID NO: 123306 - protein, 138 aa, Glycine max
  Coding DNA Sequence Number=SeqID_31621
MHRSHTGNLVPLDLEIEATLQRNRAERRRKLLQDRTVASILEETHFSDLLSPDPPSSRESATQLPKAITMAEEHDQGITLEDYSSSSVPQFFTSIACPEVQANNINYPHSLIHLIQGNLFQGLPNEDPYAHLATFIKI

SEQ ID NO: 123307 - protein, 119 aa, Glycine max
  Coding DNA Sequence Number=SeqID_31622
  Homolog annotation: Hit_ID=A5B939; Match level="QueryCoverage=27%, HitCoverage=21%, E-value=4e-07, Identity=78%"; Hit description =Putative uncharacterized protein
MGYSILLDGGSPSDSALCAYSERESGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 123308 - protein, 84 aa, Glycine max
  Coding DNA Sequence Number=SeqID_31623
VRQEAATPERSPQISPNPSSPMVDQSSLQQPADLPTPVHEMPADPSTPVLGLTTTPSATPVLHLTDEEDTQDEDTQSQDLSQEF

SEQ ID NO: 123309 - protein, 255 aa, Glycine max
  Coding DNA Sequence Number=SeqID_31624
  Homolog annotation: Hit_ID=Q6WAY6; Match level="QueryCoverage=76%, HitCoverage=31%, E-value=2e-26, Identity=38%"; Hit description =Putative uncharacterized protein
MGNKSNRQEVLPSQGCPLGGRKPYLSSGCLPSLSRIATVVKDSARGLDRIKQTRNGIAGLPQKYLEDKARGMANQGDWVPFMDVLALLIFGVVLFPNVDGLVDLAAIDAFLAYHHSKESPVVAVLADLFDTFDRRCEKSSAQIICCLPALCVWLVSHLFQQDTRHPCPLLSHRSCTEKRRIDWDQLLAGIGGRTISWFPRWKEGKEGVLFSCGRYPNIPLVGTRGCINYNPALAIRQLGYPMRGASTEESMSPFL

SEQ ID NO: 123310 - protein, 156 aa, Glycine max
  Coding DNA Sequence Number=SeqID_31625
LHVLALRGLHALILGTSYPHPLRGLHVLALRGLHVLAIRGLHALTIRGLHVLSLRGLHALTLVTLTVRGLHVLALRGLHVLTIRGLHALTSRGLHVLALRGLHALTLGTSYPHRQRTTRPRLERTTRPHHQRAARPHLQRTISPRLERATRPHLGY

SEQ ID NO: 123311 - protein, 144 aa, Glycine max
  Coding DNA Sequence Number=SeqID_31626
MVAHDSDESQEMSDHSLARRTNNGGKRYSNCGNSRKNRNNIGGRDNSGVGKGGSGAGGKGGGGSNCGGGQQQPQNNLWPAGQPNYQQPPRQQPDILGSKPQQANTTTTPTPTDIEAAMHTLDITSPDPKWYMDIGATSHITSTS

SEQ ID NO: 123312 - protein, 88 aa, Glycine max
  Coding DNA Sequence Number=SeqID_31627
MASMMDAMLGMKQLMESNTTIVAAVSLAVEADPTLLTAAHHPIPNMVGQERSTPGHISNPHPGYNQGTYPYCLPPNYTPPAIHDDVGH

SEQ ID NO: 123313 - protein, 91 aa, Glycine max
  Coding DNA Sequence Number=SeqID_31628
GEFDLRTNPSHEGENDEDMTKSKGKDPLEGLGGPMTRARARKAKEALQQVLSILFEYKPKFQGEKSKVGPIGNLGISLLGDQMVADLLAVG

SEQ ID NO: 123314 - protein, 17 aa, Glycine max
  Coding DNA Sequence Number=SeqID_31629
MWDKGTETTNSNNSPTW

SEQ ID NO: 123315 - protein, 327 aa, Glycine max
  Coding DNA Sequence Number=SeqID_31630
MLAIIAKYQEELGLATAHEHRIADEYAQVYAEKEARGRVIDSLHQEATMWMDRFALTLNGSQELPRLLAKAKAMADTYSAPEEIHGLLGKNTITKRAARDPYRTRSKSRTMGDQEETQEQMKADMSALKEQMASMMEAMLGMKQLMEKSATTAATVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPATEERRKLDLLEERLRAVEGFGDYPFADMTDLCLVPDVVIPPKFK

SEQ ID NO: 123316 - protein, 130 aa, Glycine max
  Coding DNA Sequence Number=SeqID_31631
  Subcellular localization annotation: CTP_CleavageSite=75; ConfidenceScore=5.04e-01
MGNQNRQGFHAGGFSGYQQGGNFNQNQGQGWRSHPENQFNKDQGGPSNRPRNQGPSLYERTTKLEETLAQFMQVSMSNHKSTESAIKNLEIQVGQLAKQIAKNSSRGFGANTEKNPKEEFKVVITRRGIL

SEQ ID NO: 123317 - protein, 99 aa, Glycine max
  Coding DNA Sequence Number=SeqID_31632
IQLGLLISYEKVKNRNYNLDKSKAKIKSAQRKDKECREEEDKHKIYIGLATTRAYIQSPSNHRSLRFLFNLVKSFTSKDPQGIYPPLFSLNNQVDVHST

SEQ ID NO: 123318 - protein, 82 aa, Glycine max
  Coding DNA Sequence Number=SeqID_31633
MWAIIDECKEKLNLAATHEQRLEDEYAKISAESEARERSQELPRLLAKAKAMADTYSAPRRSTDSQLCQHMIDLMDHMIRNR

SEQ ID NO: 123319 - protein, 148 aa, Glycine max
  Coding DNA Sequence Number=SeqID_31634
  Homolog annotation: Hit_ID=A0ST23; Match level="QueryCoverage=21%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPVELRDAAVHGYRARIRNHVGKPVVPAALMNRPTRGERRFAYWALFRFLAH

SEQ ID NO: 123320 - protein, 70 aa, Glycine max
  Coding DNA Sequence Number=SeqID_31635
MVIRTFRQPGANEPVDVQRLTSSSAPFVIHGQRVRWQAKIPYGFYSRRPKTFKPDDAPDSSLLGGDDQVR

SEQ ID NO: 123321 - protein, 101 aa, Glycine max
  Coding DNA Sequence Number=SeqID_31636
  Homolog annotation: Hit_ID=Q0JZD5; Match level="QueryCoverage=99%, HitCoverage=6%, E-value=4e-18, Identity=50%"; Hit description=RHS family protein
FRAAKRDAGVPMSQASTKVEKVNLTDGDGHNILGKDYQPIKTREYTFNRYGKDDVVIQDHWPGHIYGPEGTLGNQGPHVNIRPINDTRNGKVSGTLEHYPF

SEQ ID NO: 123322 - protein, 126 aa, Glycine max
  Coding DNA Sequence Number=SeqID_31637
MVMGDFISRLSFPACLHFSEENTETFSSLTSYPELRRSEFLIGGYVGARASLLSTIPPFVAMTQELVARGDTLRLSAPRHSVTPSVMTSRGQYGHLRPFRRVSGHFPMEILTVIRTLFVSQVSRGT

SEQ ID NO: 123323 - protein, 87 aa, Glycine max
  Coding DNA Sequence Number=SeqID_31638
MICHEFFIHTFKIRSSFFFIIEILIPGDRCRTGCHDITLQNMQIICRIVYPVRCNLTYIWGLPSQGGNPLSIVLVQGLTAPVYNLLT

SEQ ID NO: 123324 - protein, 201 aa, Glycine max
  Coding DNA Sequence Number=SeqID_31639
MGLIIPQDYAEEVANRSIEGQRALRLTPKTFDQNPQKLFLNREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLDENYNLHPFEFNHSYFCTIGFVTWWEKYYSGRSVGDTTIMISRLESGFTQPTVENIRSNLQAR

SEQ ID NO: 123325 - protein, 72 aa, Glycine max
  Coding DNA Sequence Number=SeqID_31640
  Homolog annotation: Hit_ID=Q8DEV3; Match level="QueryCoverage=56%, HitCoverage=93%, E-value=1e-07, Identity=70%"; Hit description =Putative uncharacterized protein
GKEAPSVKVACLAQEVGTVENKVANGLTKPMMLSWSFRMISHTGTETRPGLPRGAAVGNLGQWAKARSSNIA

SEQ ID NO: 123326 - protein, 80 aa, Glycine max
  Coding DNA Sequence Number=SeqID_31641
MASMDTSAMAFDLDLVEPLAVGIKKNPYAMPMQKTQCGNVHSMTIFTEHKQKGIIPFEEHIAAVGTTSNNKFSKRKALDE

SEQ ID NO: 123327 - protein, 284 aa, Glycine max
  Coding DNA Sequence Number=SeqID_31642
MVYADGVVRVRVEKVIVGVAEVPLSTYKIQYVRKALNTFIAWPTPLVNLVSDEDSVITPNKVTQAVEGVNDVAIHDPLRISMSGVIAWVMYRCMDSLSLNPYTMQRTDVGNVKTILKNGLRNRTDRAHWQLVVLRLTNNVVVWFCSLHKRITFKAEAMSIGAHLCKCLETCGVEQEATIEDNEIDGQTLAHGNKHRHEHGGHHHGIDRHGASYPCFEYDNCVNVSSQRSTSFHFGYLIHLCLGSLMQFYPARALDRRLQEDWVRDAREGPRVLMSLRVDFGPMG

SEQ ID NO: 123328 - protein, 76 aa, Glycine max
  Coding DNA Sequence Number=SeqID_31643
MRSFNGDFPPWRCSGRQRRRGERRCHPPGNKSWKNDLHHQDEPWIRSLERMLQWRKRVRERERGEHEIEGRKRERS

SEQ ID NO: 123329 - protein, 155 aa, Glycine max
  Coding DNA Sequence Number=SeqID_31644
  Subcellular localization annotation: CTP_CleavageSite=39; ConfidenceScore=5.08e-01
MVQPKPSTGLKGKSLQHALTFIPPRIQKSKAWVPRPKSCANTIETFHRAYGGRTFGYQQQGDRGNVACPIISEHNLGLRPSPTTPQFNESKHKFAQHCLTKLGKSSRNQRIVHLLVWSGKDTKMEAKSTQWWPRVRKTSNPVRAAFLGEGEKFLG

SEQ ID NO: 123330 - protein, 189 aa, Glycine max
  Coding DNA Sequence Number=SeqID_31645
  Homolog annotation: Hit_ID=Q6WAY6; Match level="QueryCoverage=62%, HitCoverage=20%, E-value=6e-13, Identity=33%"; Hit description =Putative uncharacterized protein
DWDQHLAGIGGSAINWFPRWKEGKEGVLFSCGDYPNVPLLGTRGCINYNPALAIRQLGYPMRGAPTEESLSPLLVRDLGAQSLKVIQRVHKAWRSPLRKDKELRGIRNGVIGGYHGWLRVHTRGLDWLSKLKVINEENFKAPEEDEEVQALKLELGKARLAKDKFKSAATHIRKECTSYKRKRGHCKSP

SEQ ID NO: 123331 - protein, 153 aa, Glycine max
  Coding DNA Sequence Number=SeqID_31646
MSVKNLGRRLGVHDKTNHTLASQVTLTRLKGALKLGDPQGLHFEESVRFISSPLNGLSINSSPLNGLNINSSPLKGLSINSSPLKGLSINSSPLKGLSMNSSPLKGSYSRVIVQFIVHNSMHTTSQSRAYSVHHIHSISSQWYNLNLTHYYTS

SEQ ID NO: 123332 - protein, 52 aa, Glycine max
  Coding DNA Sequence Number=SeqID_31647
IVDPEKVKAILDDAILPRKGPITRTMSKRLQEDWVRAAEEGPRVLMNLRVDF

SEQ ID NO: 123333 - protein, 152 aa, Glycine max
  Coding DNA Sequence Number=SeqID_31648
  Homolog annotation: Hit_ID=A5AGG9; Match level="QueryCoverage=59%, HitCoverage=9%, E-value=7e-12, Identity=43%"; Hit description =Putative uncharacterized protein
MGLNGEYNLKELMTLVSLGAARTRSDPKLRPTTRHIVSILGAKLWTFIDNAVSILDGNEKLIKGKNMDSREDWRETNTCSLSLVKTTEGLGIQRKVAQTPMKMKLVKLLFQATICSNKPFWKQQKHNMQNNQSRQNEEGRISKQKHTKNTLK

SEQ ID NO: 123334 - protein, 304 aa, Glycine max
  Coding DNA Sequence Number=SeqID_31649
MTQELVARGDTLRLSAPRHSVTLSVIDEQRPVWSFAPFPEMSASSGGDFFKSHKLSRTTSCDMHPLSSKAAGPMTCGDKFGHSAPLAIQTQLCPMARRDKIWSFCTLLSSRGGGPDDMQRQNLVIPHPFSIQTQSCPMARRDKIWSFCTLLSSRGGGPDDMRRQNLVIPHPFAIQTQSCPMARRDKIWSFCTLLSSRGGRPDDMRRQNMVIPHPFAIQTQSCPMARRDKIWSFCTLLSSRGGGPDDMRRQNMVIPHPFAIQTQLCPMARRDKLWSFCTLHQSRSTSPLTRGDLHHLPHSQDLSY

SEQ ID NO: 123335 - protein, 78 aa, Glycine max
  Coding DNA Sequence Number=SeqID_31650
MVEMHKRQSIHVAPNKMVEDARTVLGNQYVGLRTQVWRMHERQSIHGAPNKIVEDARTALVNNSWGSGLNGGGCMNDN

SEQ ID NO: 123336 - protein, 59 aa, Glycine max
  Coding DNA Sequence Number=SeqID_31651
MSGFTSDSPQILASPHQLDFAPYASGPYNAQWNAPGLSMIAHVAFESFPQKMEVEKPSR

SEQ ID NO: 123337 - protein, 77 aa, Glycine max
  Coding DNA Sequence Number=SeqID_31652
MPLLRACEARLMSALSKGGKMRGVSTNVYLWKTSEKPKDTGQNENSKFGSCDHFKVLDLKNDPFSCDFFVDELDFAG

SEQ ID NO: 123338 - protein, 73 aa, Glycine max
  Coding DNA Sequence Number=SeqID_31653
MPPFALKTQNQIIVACMAIHNFIQRNDKSDGEFDSLDEDNEYIDSDEDESEVRQHGRNRMLKVLYKWNNLENL

SEQ ID NO: 123339 - protein, 83 aa, Glycine max
  Coding DNA Sequence Number=SeqID_31654
MEAMKEKMTTMMEALMSMRKMMEVNMAAVVAASTATEVDPTHPSGLNQVNPPILDMVGQGGEALGSTSGPHFVQVQSKHSGIL

SEQ ID NO: 123340 - protein, 172 aa, Glycine max
  Coding DNA Sequence Number=SeqID_31655
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
VSYEKAHASRREKGGQVSGKRRVGTGERTRELPGGNAGIFIVLSGFATSDLSVDFCDARQGGGAYGKTPATRPFYGSWPFAGLLLTCSFLRYPLILWITVLPPLSELIPLAAAERPSAASMQAWHWPSFYNVVTGKTLALPNLIALQHIPLSPAGVIAKRPAPIALPNSCAA

SEQ ID NO: 123341 - protein, 48 aa, Glycine max
  Coding DNA Sequence Number=SeqID_31656
VLGEKNYFREENLSRGASVTFPWVIKRRFSTVLCHSSFVLHYSSIFNR

SEQ ID NO: 123342 - protein, 128 aa, Glycine max
  Coding DNA Sequence Number=SeqID_31657
MVIFNHGDVVEDKGEEVRGDVMHYGISHGRMSFTTKRVPWIRSLERKLQWRKIMRERENGQNPRPKRRKTYSNIYKDKWTQPWPMDSEIYPEVHENPRAFFSSSSPILLEPPTHGSGDWSLHREDCIK

SEQ ID NO: 123343 - protein, 133 aa, Glycine max
  Coding DNA Sequence Number=SeqID_31658
  Gene Ontology: Mol. function=formylmethanofuran-tetrahydromethanopteri n N-formyltransferase activity; Cellular component=cytoplasm; Biological process=one-carbon compound metabolic process
  Homolog annotation: Hit_ID=Q1H0Q5; Match level="QueryCoverage=52%, HitCoverage=23%, E-value=1e-27, Identity=82%"; Hit description =Formylmethanofuran--tetrahydromethanopterin formyltransferase
  Pfam annotation: Domain name=FTR; Domain location=1-97; Score=57.9; E_ value=3.6e-14; Accession=PF01913.9; Description=Formylmethanofuran- -tetrahydromethanopterin formyltransferase, distal lobe
MTGFATSVIGCGVEAGIERELSEDETPDGRPGVSVLMFAMGSKVLMQQLETRMGQCILTCPTAAAFAGIESDDMISLGIQTNPGCEWQAQTLLAYPSHGWRIFDRRNHGDGARHWWRQFPGIRGQSGTSADRV

SEQ ID NO: 123344 - protein, 115 aa, Glycine max
  Coding DNA Sequence Number=SeqID_31659
  Pfam annotation: Domain name=zf-CCHC; Domain location=94-111; Score =20.6; E_value=0.0012; Accession=PF00098.14; Description=Zinc knuckle
MSLATLFGKLQEHEIELQRLNQDEENDKKKKGIALKASSSIQEESDIEDSNDLNEDEDLSLFVKRFNKFIRMRGNQRRQNFKSKRRTEESSQIPKCFECNQPGHLRADFQSLRRK

SEQ ID NO: 123345 - protein, 143 aa, Glycine max
  Coding DNA Sequence Number=SeqID_31660
  Homolog annotation: Hit_ID=Q69L69; Match level="QueryCoverage=28%, HitCoverage=5%, E-value=5e-08, Identity=57%"; Hit description =Calcineurin-like phosphoesterase-like protein
MTSSSSSSSHINIKSGPIDADVLWMQPKHVSEHVWNGKKIGNYISDELSLRIKGKNKFQSKFFLFFNNLVISVDGLPLIGPTNLDSADLCEELLGVRPQEDCGTYAWGAAVLAFLYKEMCSATDYKTQSIGGMCILLQMWAWE

SEQ ID NO: 123346 - protein, 115 aa, Glycine max
  Coding DNA Sequence Number=SeqID_31661
MTGRLLARSLALESHILHYLIVRILLPRSSNLAQVSEEDLIVISFLIGAAVIASFGYRKEHDGSWVKKDAQPIDDEGHLPVGKDSSLLQRILDRFDGLQTYVGERFDALELQVDR

SEQ ID NO: 123347 - protein, 209 aa, Glycine max
  Coding DNA Sequence Number=SeqID_31662
  Homolog annotation: Hit_ID=A6N1H4; Match level="QueryCoverage=13%, HitCoverage=26%, E-value=9e-09, Identity=96%"; Hit description =Retrotransposon protein
MGDKLHRREGNSPDHQLRPLNDRSVIKEMNGAKRSAEAVGCKKESVGERSALEGRTRASSAGRSGSENVGLSNANVGENPMPRNPRVPPQGRPRRPKDGYRFKDARCPCFFRVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 123348 - protein, 173 aa, Glycine max
  Coding DNA Sequence Number=SeqID_31663
  Homolog annotation: Hit_ID=A7R5Q5; Match level="QueryCoverage=57%, HitCoverage=20%, E-value=5e-13, Identity=40%"; Hit description =Chromosome undetermined scaffold_1022, whole genome shotgun sequence
MTRGNPGDLQPFDPEIDRTFHRLVRHSVHPDHFEHYEHSMHSEHFVAGDSEHSDFEHSAANFHIENMAQTLPRERTLREMAAPDFTYESLCIQYPDEDVPYVLKTGLIHLLPKFHGLVGEDPHKHLKEFDIVCSTMKSPDVQEHHIFLKAFPHSLEGVAKYWLYYLAPRSITS

SEQ ID NO: 123349 - protein, 49 aa, Glycine max
  Coding DNA Sequence Number=SeqID_31664
MIVGAAANNLLDTSLSYSVGYMSTFHQLCSVWLIRTMMRYHHMHVGGLL

SEQ ID NO: 123350 - protein, 84 aa, Glycine max
  Coding DNA Sequence Number=SeqID_31665
  Homolog annotation: Hit_ID=A5BTR2; Match level="QueryCoverage=65%, HitCoverage=2%, E-value=1e-08, Identity=60%"; Hit description =Putative uncharacterized protein
MCVQQEERLVMEMCESASLTTACGKNKATKSQANKKGNGKIPPQADIKKVTKCFFLLILTPGGLILDLQSILQMYEKPKETSGK

SEQ ID NO: 123351 - protein, 101 aa, Glycine max
  Coding DNA Sequence Number=SeqID_31666
GLFPEEPWCLPTWMAKSYLHPDFLSVVSLVTIFQRNERGFEAFSPHGQDHLGLPSGVETKHERQKPIKVLKDGCKWGWGHDRPSLPFSVRNKQRMSLQGSP

SEQ ID NO: 123352 - protein, 103 aa, Glycine max
  Coding DNA Sequence Number=SeqID_31667
MGLSKDNHGNADVVDIRGNPYKYGLGYEPGKPGRRNAPSRLWADRAWPDHVSQCFTSAGIMVEEEGRFFEDPNNEGSIIDFDREVSQTINEEGEEDVLSPELE

SEQ ID NO: 123353 - protein, 126 aa, Glycine max
  Coding DNA Sequence Number=SeqID_31668
  Homolog annotation: Hit_ID=A5CBJ4; Match level="QueryCoverage=46%, HitCoverage=5%, E-value=2e-07, Identity=47%"; Hit description =Putative uncharacterized protein
MTRGNPSDLQPLVRHHFIPFEHPEHSVTGESVHSVIGDFEHPDFEHYNFEHFDYEHSENMAQPPPREDPHKHLKEFHIVYSTMKPPDVQEDHIFLKAFPHSLEGVAKDWLYYLAPRSITSWDDLKR

SEQ ID NO: 123354 - protein, 56 aa, Glycine max
  Coding DNA Sequence Number=SeqID_31669
MALIIKEASPVEFWGKSCTFRYPREKIREHKISFQGMPSMGTFPNLLNEGFMGILQ

SEQ ID NO: 123355 - protein, 100 aa, Glycine max
  Coding DNA Sequence Number=SeqID_31670
MEIFIQSIDPGAWNAIVKGPFIPSKEVNGAKVQRKYGKCLKSLMKPQRIFTHIVKHLLGLGKTFKDDELKNFGTKDHNDQGIQGLSINVNGSSLRKIACI

SEQ ID NO: 123356 - protein, 264 aa, Glycine max
  Coding DNA Sequence Number=SeqID_31671
  Gene Ontology: Mol. function=cytosol alanyl aminopeptidase activity; Cellular component=cytoplasm; Biological process=peptide metabolic process
  Homolog annotation: Hit_ID=A4W9D9; Match level="QueryCoverage=100%, HitCoverage=62%, E-value=1e-139, Identity=88%"; Hit description =Peptidase T
  Pfam annotation: Domain name=M20_dimer; Domain location=90-194; Score= 98.8; E_value=1.7e-26; Accession=PF07687.5; Description=Peptidase dimerisation domain
  Pfam annotation: Domain name=Peptidase_M20; Domain location=13-185; Score=-9.1; E_value=0.0059; Accession=PF01546.19; Description =Peptidase family M20M25M40
  Pfam module annotation: Pfam domain module=M20_dimer::Peptidase_M20; Domain location=90-194::13-185
MFPVLHQLLGQTLITTDGKTLLGADDKAGIAEIMTALATLQAKKIPHGDIRVAFTPDEEVGKGAKHFDVAAFDARWAYTVDGGGVGELEFENFNAASVTIKIVGNNVHPGTAKGVMVNALSLAARIHAEVPASEAPETTDGYEGFYHLTSIKGSVDRAEMHYILRDFDRKQFEARKRKMMEIAKKVGKGLHPDCYIELVIEDSYYNMHEKVIAHPHVVDIARQAMVDCDIEPQIKPIRGGTDGAQLSFMGLPCPNLFTGGYNYH

SEQ ID NO: 123357 - protein, 98 aa, Glycine max
  Coding DNA Sequence Number=SeqID_31672
  Homolog annotation: Hit_ID=A5B1P9; Match level="QueryCoverage=100%, HitCoverage=8%, E-value=5e-09, Identity=33%"; Hit description =Putative uncharacterized protein
MEESIHVVCDETNSIVQENSLENEDAGFQHKDFALEDKTKVEELEQCKEISTTPPKDLPREWRTQKDLSLDNIIGEISKGVSTRSRFRILYNSMAFVS

SEQ ID NO: 123358 - protein, 358 aa, Glycine max
  Coding DNA Sequence Number=SeqID_31673
  Homolog annotation: Hit_ID=A5ASR8; Match level="QueryCoverage=64%, HitCoverage=53%, E-value=5e-08, Identity=22%"; Hit description =Putative uncharacterized protein
  Subcellular localization annotation: CTP_CleavageSite=38; ConfidenceScore=5.65e-01
MAESSKKHKGSSASASASRAHRSGATSASTAPIPPSLSSSTLFSSEEQQKWYSNLFSSRSIIDPKFIDMEFFSDETFDCIQAFQNLGLIPFMSLQLPIYPELVKAFYCNLEIQDNTLISEVFVIKMVIDQSLFHDLTQLSSDGVPFEVGLHQQCGYDRTLLASSLAFESRILHYLIVRICFHDLPICPGSEEDLVIMWAFHTGRQLDWAHLVRYRMHKALRLNAPLPYPHLVTLFFRHFQIPLDSEPYVPIKRSFLIGAAMIASFGYRKEHDDSWVKKGAQPADEEGNLPVEDNSTLLRRLMDKFDGLQTFVGEKFDAMELQVDMRFDAMESRITKVEEDVSFIRTCFDPPPPPPSSS

SEQ ID NO: 123359 - protein, 57 aa, Glycine max
  Coding DNA Sequence Number=SeqID_31674
DSIENIIDVQADSNCGYRTIAALLGLGEESSSLVTMDKWMNITDMRYVIVSRYNVIA

SEQ ID NO: 123360 - protein, 40 aa, Glycine max
  Coding DNA Sequence Number=SeqID_31675
METSASYGRLPRRCPGSREIFFSKYSLKEVIPACDGPWSK

SEQ ID NO: 123361 - protein, 173 aa, Glycine max
  Coding DNA Sequence Number=SeqID_31676
PFHPGLFVGDAGGFQSPTREPLNVGGLVPPHCSLKSVVSDDACPGACFVQRDATTLNKRSTQALLCFDDHDNSSDRTAFVPATHHSNSALSTFDGRIVATMVVTVKKLVVGPWVGSIGPPPVCTGRLVPSAGDALLSLTGRVVPPDSDPIVLAFGIGVMINRDSRGHSYFIVR

SEQ ID NO: 123362 - protein, 199 aa, Glycine max
  Coding DNA Sequence Number=SeqID_31677
VSTEEVTDADAPVPVPTDEVSIVGQALHTFLAWSTHLVKFLSQLVRWDATVFGVFNPDFPLYIKHEDLSEIAHGGMQAGNSDIYGFLEPQSIQRSGQSQFESESYIKTLMQSSKHDIYLGAYLNGPDNYLKGIINSLNQRLLLGGLSLRQKGSTECGYYVMHWMSNIILGTFRNNWEAYFNDPRPLEPERLKALRIQWA

SEQ ID NO: 123363 - protein, 301 aa, Glycine max
  Coding DNA Sequence Number=SeqID_31678
  Homolog annotation: Hit_ID=Q652R5; Match level="QueryCoverage=29%, HitCoverage=36%, E-value=1e-16, Identity=53%"; Hit description =Putative uncharacterized protein P0603C10.50
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGLVGSVRARKGSSMGPELTGSHVIVVERGSSTILSRRVGHEPDFNHHEAGRRALGLMASGATCVQRLDGSRDSAIHTKYRIFATFFIDARAEISVAERRGGRAHGAPWSSPPSRREMNKQVRGGLLTTVAGSEPLTSPQSEHFTGPFN

SEQ ID NO: 123364 - protein, 119 aa, Glycine max
  Coding DNA Sequence Number=SeqID_31679
MKMNMNVGYLFSHQISLIAQHDTSRLGFSPLITTLCIARGVQSDSRSLESLSVAIKLAYIKKNYWNLDDPTITFRGPRKARGKISEAPSTSASEAPTPSSSTVPLSSSTQILVIPPAPT

SEQ ID NO: 123365 - protein, 116 aa, Glycine max
  Coding DNA Sequence Number=SeqID_31680
MNDEERLKIFTESPTETLWKRYGSTSAWIFFTETIFLSNFNKIGEELATQLAQASQVASSRSNRLLEEESGRPKWACARQSIHGSPKDWRMEDRRTALGNQFAGLQPRWWRTHEQC

SEQ ID NO: 123366 - protein, 83 aa, Glycine max
  Coding DNA Sequence Number=SeqID_31681
QPPITRAFIEKYCTPRQAQGDAPQAADSPPPPHQADPAGSLGMERYLQHLVRQQAANHRGQSSLGLRSHDPEIGPRPKQGRSP

SEQ ID NO: 123367 - protein, 56 aa, Glycine max
  Coding DNA Sequence Number=SeqID_31682
KVEEAKGGESSEEIYPQEEGQPLMVKEECKEGFGSQEIKSLCFVGAQNRYYKAPNP

SEQ ID NO: 123368 - protein, 150 aa, Glycine max
  Coding DNA Sequence Number=SeqID_31683
MALEWWPQMTHHPYAVVLGLWDLHLPCEEKEGAVEVDAGVGAADVEGSSTGLALALLVPWAVIRAGNPSLEVLDWAIEIIWLEIRAPMFMSMQETRPKISLALSTVRSEVCDVGARLEYERTLHTWAKVVKYFLRILPGWSSAFKINPQP

SEQ ID NO: 123369 - protein, 47 aa, Glycine max
  Coding DNA Sequence Number=SeqID_31684
  Homolog annotation: Hit_ID=A5BSK0; Match level="QueryCoverage=85%, HitCoverage=3%, E-value=2e-08, Identity=65%"; Hit description =Putative uncharacterized protein
MTAPIRQGLITLLQEYQEVFVWSYQDMPGLDSDIVQHKLPLNPRSSL

SEQ ID NO: 123370 - protein, 45 aa, Glycine max
  Coding DNA Sequence Number=SeqID_31685
MPEDPTTPVLTVDTSPPATPVLQLTDEEDVKHFYLSVKNGCMFSF

SEQ ID NO: 123371 - protein, 76 aa, Glycine max
  Coding DNA Sequence Number=SeqID_31686
MAAEWRRKRERRRHFKEKMSLEEAHNHKRPWIRAWRKKEMNEGRGREEHEILCSKRALKSKPTNPRSSPRFSTKCA

SEQ ID NO: 123372 - protein, 113 aa, Glycine max
  Coding DNA Sequence Number=SeqID_31687
MTKLGLCLSSGPPPLDDKRVRITIRMTKLGLCLSSGPPPLDDKRVRITIRMTKLGLCLSSGPPPLDDKRVRITIRYLRVSWVQNDQTWSLLVIGPAPLDDKRVRITVRFSASV

SEQ ID NO: 123373 - protein, 32 aa, Glycine max
  Coding DNA Sequence Number=SeqID_31688
EEGKQTGKGRKERRDLACNVGADGCVFNVCVC

SEQ ID NO: 123374 - protein, 259 aa, Glycine max
  Coding DNA Sequence Number=SeqID_31689
MEESMSPFLVRDFGTQNFKAIQRIPKAWETPLRKDKELRGIHNGIICGYHEWLKVHTRGLDWLAKLKVVSEESFEAPEEDEEVQALKSELGKAKLAKEKFKLAATRIRKECAGLREENATTARALEQEAKRARKEEYGRNKFRGALWGSNNELKLRREERDQSRAHSMVLKGELVACSRSKRSLSQRLYETETNMLAIIAKYQEELGLATAHEHRVADEYAQVYAEKEARGRVIDSLHQEATMWMDRFALTLNGSQELP

SEQ ID NO: 123375 - protein, 43 aa, Glycine max
  Coding DNA Sequence Number=SeqID_31690
MNRSDQPTTGFEEVRAITGFEEDIPVIQICHHEQVRTTTGFEE

SEQ ID NO: 123376 - protein, 67 aa, Glycine max
  Coding DNA Sequence Number=SeqID_31691
MIDLILALKIEICGLKIWWERKLQYGRQMNLGVQNPTPVDEARAEWSMAILTKCSRVLSLLSPKAPT

SEQ ID NO: 123377 - protein, 164 aa, Glycine max
  Coding DNA Sequence Number=SeqID_31692
MVNVPLKKKKKCRLARLGSHRFRSAVHQQRFEAIKGWSFLRERRVQLRDDEYTDFQEEIGRRRWASLVTPMAKFDPEIVLEFYANAWPTEEGVHDMRSWVRGQWIPFDADAIGQLLGYPLVLEEGQECEYGQRRNRSDGFDEEAIAQLLCIPGQDFARTAAGRR

SEQ ID NO: 123378 - protein, 35 aa, Glycine max
  Coding DNA Sequence Number=SeqID_31693
MGSQQSIYGTVARSTAGDLIPIDLEINANCRRRNQ

SEQ ID NO: 123379 - protein, 275 aa, Glycine max
  Coding DNA Sequence Number=SeqID_31694
MPNREEWVPFLDVLALLIFGIVLFPNVDDLVDLAAIDAFLAYHHSKESPVVAILAYLFDTFDQKCEKSSAWIICCLPALCVWGIRNGIIGGYHEWLKVCTGGLDWLSKLKIINEENFEVPEEDEEVRALKTELGKARLAKEKFKLVATHIRKECAELREENAATARALERETKRACKEEHGRDKFRGALWGSNNELKLRRGERDQSRAHSMVLKEELAACSRSKRSLSQRLCETETNMLPIVSKYQEELNLATAHEHKVADEYARVYTEKEARGR

SEQ ID NO: 123380 - protein, 55 aa, Glycine max
  Coding DNA Sequence Number=SeqID_31695
  Gene Ontology: Mol. function=RNA-directed DNA polymerase activity; Biological process=RNA-dependent DNA replication
  Homolog annotation: Hit_ID=A5C084; Match level="QueryCoverage=80%, HitCoverage=5%, E-value=6e-11, Identity=65%"; Hit description =Putative uncharacterized protein
RVAASSKKHKKAIGWTLADILGISPSTCMHRKLLEDGAKPMRQPQRRLNPIILDC

SEQ ID NO: 123381 - protein, 262 aa, Glycine max
  Coding DNA Sequence Number=SeqID_31696
MAPRKLASKRSRKDKAAEGTSSAPEYDSHRFRSAEHQQRFEAIKGWSFLRERRVQLRDDEYTDLQEEIVRRRWASLVTPMAKFNPAVVLEFYANAWPTKEGVRDMRSWVRGQWIPFDADAISQFLGYPLVLEEGQECEYGQRRNRSDGFDEEAIAQLLCIPGQDFARTVAGRRVRIMRTNMTTLTQIWMTLLLSNILPSDHNSDLPLPKCMAPTRHPMDPDKSNRALGFPALITGLYQSFGVPVAPTKVIQLPITRAFIEKC

SEQ ID NO: 123382 - protein, 241 aa, Glycine max
  Coding DNA Sequence Number=SeqID_31697
  Homolog annotation: Hit_ID=Q6WAY6; Match level="QueryCoverage=86%, HitCoverage=51%, E-value=2e-18, Identity=28%"; Hit description =Putative uncharacterized protein
MGTNQNGKRFYQVKVKGLDVTSLKELGRLMGPLQMQAFRKVYGKILDLTVAEVFTEAVVSLAQYYDQPLSKVAAVIGDSAKELDRTKQTRNGVVGLPRKYLEGKARDMASQEKWGPFVDVLALLIFGVVLFPNVDGLVDLAAIDAFLAYHHSKESPVVAILADLFDTFDRSTINWFPRWKEDKEGVLFSCGDYPNVPLIGTRGCINPALAIRQLGYPMRGAPTEESLSPFLVRDLGVQGLK

SEQ ID NO: 123383 - protein, 58 aa, Glycine max
  Coding DNA Sequence Number=SeqID_31698
MVIFHHGDAVEDKGEEVASLRSFLVKTSLRSFFEKTSLRSFLEKTSLRSFFEKTSLRI

SEQ ID NO: 123384 - protein, 136 aa, Glycine max
  Coding DNA Sequence Number=SeqID_31699
  Homolog annotation: Hit_ID=A7PHZ5; Match level="QueryCoverage=45%, HitCoverage=25%, E-value=8e-13, Identity=58%"; Hit description =Chromosome chr13 scaffold_17, whole genome shotgun sequence
MGSSLPKVMPLWWEFNSWVREDRVLHCRPMDNFLQHSSIAGSKVSNRRRKIWWIAATRRSSLVCYPVVPLGLEDLRHSLLYTTLLLDATIASAKEDITRRECELIHVNDLLSRVIKERHEAQAKCQKLMLEKLELQ

SEQ ID NO: 123385 - protein, 80 aa, Glycine max
  Coding DNA Sequence Number=SeqID_31700
KNKRLQREGFSSKLRHNIKIPNGDNALNWVSNVVFKFHNDLTVNEPEIVIFLRQVWCATGKRKGFERRMGKTKMRPKRGI

SEQ ID NO: 123386 - protein, 83 aa, Glycine max
  Coding DNA Sequence Number=SeqID_31701
MSIFTLGSKREENFRSKKKRRKISNQRESKKKRKGNSQSEGGRKKKKRKKIPNQRMGESKKEESSWSKKPEEMYREVFGPDNI

SEQ ID NO: 123387 - protein, 174 aa, Glycine max
  Coding DNA Sequence Number=SeqID_31702
MSASDHAILRDRTHQPTKKSLLQVVPSVVRLMKWANGPYNQQGQWRTHPGNQFNKDQSGPSNRPIQQGPNIFQRTTKLEETLTQFMQVTMSNHKSTESALKNLEVQVGQLAKQIVDKSSNNFVANTEQNPKEECKTVMTRSKRFVEVEDEDSVVHEKKIADKKSTNGKKNEVRG

SEQ ID NO: 123388 - protein, 126 aa, Glycine max
  Coding DNA Sequence Number=SeqID_31703
MTGRLLAGSLAFESRILHYLIVRILLLRSSNLAQVSEEDLIVMWAFHKGLKIDWAHFVRYRMHKALRLNAPLPYPHLVTLFLQQFNIPLDYEPYVPIKRSFLIGASVIASFGYQKEHDGSWVKKGA

SEQ ID NO: 123389 - protein, 93 aa, Glycine max
  Coding DNA Sequence Number=SeqID_31704
MVGYAPSSFADLVFVGERIEAGLERGKFDHPALMNEKTEANEEDENEGETLVVTVIPTPPNFPSAQQCHNLASISPSHYPSTNHPQRPSSNHP

SEQ ID NO: 123390 - protein, 43 aa, Glycine max
  Coding DNA Sequence Number=SeqID_31705
MDPPEDSENEEITFALWQKVMKVMKRMNVNESIRHAKEVHTHS

SEQ ID NO: 123391 - protein, 164 aa, Glycine max
  Coding DNA Sequence Number=SeqID_31706
MVGYTSSSFADLIIVDERIKVGLKRGKFNHPAWTNEKTGANEEGENEGETHVAIVIPTWPNFPPAKQCHYSANISPSHYPPPSHPQRPSLNQLQSLSTTLPITNTTFSTNQNTNEGRNFAVKKPIEFTLIPVSYDDLLPYPLHNSMVAITPTKVPQPPFLRGYD

SEQ ID NO: 123392 - protein, 51 aa, Glycine max
  Coding DNA Sequence Number=SeqID_31707
MSNEELKLQDPRCRIQCPDILPENTGVAVQCKIKVKCRNFSEEDRSPPGIL

SEQ ID NO: 123393 - protein, 103 aa, Glycine max
  Coding DNA Sequence Number=SeqID_31708
  Homolog annotation: Hit_ID=UPI0000ECBAF8; Match level="QueryCoverage =39%, HitCoverage=48%, E-value=1e-16, Identity=100%"; Hit description= UPI0000ECBAF8 related cluster
  Subcellular localization annotation: CTP_CleavageSite=50; ConfidenceScore=5.15e-01
MTMITNSSSVPSDMSETVFGYSTARGGKWCMLPKSLAASSLSLRLKWPSRGMQAWHWPSFYNVVTGKTLALPNLIALQHIPLSPAGVIAKRPAPIALPNSCAA

SEQ ID NO: 123394 - protein, 185 aa, Glycine max
  Coding DNA Sequence Number=SeqID_31709
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSARVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPQETPEAGMQAWHWPSFYNVVTGKTLALPNLIALQHIPLSPAGVIAKRPAPIALPNSCAA

SEQ ID NO: 123395 - protein, 23 aa, Glycine max
  Coding DNA Sequence Number=SeqID_31710
MEVEEPWLGWFFVIGSAVDRLCG

SEQ ID NO: 123396 - protein, 38 aa, Glycine max
  Coding DNA Sequence Number=SeqID_31711
WIPVRQKPQLHCPRPVMTHLDLYQGMLGDAILPRKGIG

SEQ ID NO: 123397 - protein, 204 aa, Glycine max
  Coding DNA Sequence Number=SeqID_31712
MVGPSVARVSTKENCVDPSGNDPDRGDSDKCRLYVKENPPRLVALRILYEGYTIVHDIPLLHDQVKVGVEEVRDTNALIPVPTEEGVVGLAKPANRLDHDVDDLLYLMTLTIPQIFLKSLQVMWDATVFGVFNDNFPLYIKHEYLSEIAHSGQCLNISVIQLWILHMTKTSMRAGNTNVYGFLEPQSIQRSGQSKFESKSYIKN

SEQ ID NO: 123398 - protein, 84 aa, Glycine max
  Coding DNA Sequence Number=SeqID_31713
  Homolog annotation: Hit_ID=B0HC01; Match level="QueryCoverage=35%, HitCoverage=63%, E-value=5e-09, Identity=100%"; Hit description =Putative uncharacterized protein
MENASNAAFYGLAFAGFCSHVLLRYPLILWITVLPPLSELIPLAAAERPSAARNSYDHDYEFELGTMTHWYVAQVFFSPKDITL

SEQ ID NO: 123399 - protein, 210 aa, Glycine max
  Coding DNA Sequence Number=SeqID_31714
  Homolog annotation: Hit_ID=A2Q217; Match level="QueryCoverage=30%, HitCoverage=5%, E-value=2e-10, Identity=57%"; Hit description=HMG-I and HMG-Y, DNA-binding; Bromodomain; Helicase, C-terminal
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPFSSQVPAGTAASSPRQVTVGPSKRHRVTNDAETDPCPSQKPSQSGSTTNGENTRFKGHLPQVPSSNS

SEQ ID NO: 123400 - protein, 88 aa, Glycine max
  Coding DNA Sequence Number=SeqID_31715
  Subcellular localization annotation: CTP_CleavageSite=40; ConfidenceScore=5.69e-01
MPASLSAARRSTALPSSNSAFSFSRLSDSPPGVRNRQEIRGTYLTARKWNQSRLLQDSFDLFETPILATSAEASSWLRKDPLEIPSDS

SEQ ID NO: 123401 - protein, 78 aa, Glycine max
  Coding DNA Sequence Number=SeqID_31716
GPVTRAMSKSLQEDWARAAEEGPRVLMNLRTHLLLEVGSPLSLPFSIPLPFIFQEAKESIDEEDPRPTSSNGAYINTH

SEQ ID NO: 123402 - protein, 74 aa, Glycine max
  Coding DNA Sequence Number=SeqID_31717
MPSLPLILAFSPSPPKTLSFSRRQPNLSQKNDDLILIHRWIILKLKHQVRNLTPSTITVGNSEIMSELREIHFT

SEQ ID NO: 123403 - protein, 217 aa, Glycine max
  Coding DNA Sequence Number=SeqID_31718
MKENHFATKVDIKIALLLKQSFYLLLSKEKSLSTAIPLELEVIPQVKELLDEGLVHKRLTPCALLAPKIGIMRHIIPMIGGMMNVLSGATLFCKIAQHLHDSQTWGLISDQGVPMDPKRIKVNPEWPTPSTSLVNLVWNHVPSWEDPKKRKFWDSKALAPKVKEKEKEGGHSSKKVVKKETHFATKRDIKRALLLKQSFYLLLSRETSLSIATIPLL

SEQ ID NO: 123404 - protein, 155 aa, Glycine max
  Coding DNA Sequence Number=SeqID_31719
  Gene Ontology: Mol. function=nucleic acid binding; Biological process= proteolysis
  Homolog annotation: Hit_ID=A5B3J2; Match level="QueryCoverage=96%, HitCoverage=37%, E-value=4e-14, Identity=30%"; Hit description =Putative uncharacterized protein
MQRRSTASDLIPIDLEINATCKRRNAERIRNFLQDLEAVTTPEEEPRSSEASSSFPIPGQSHIDLIEEVIMAEEPRRVTLEDYSSSNPYAHLATYIEICNTIRLAGVPEDAIRLSLFSFSLSGEAKRWLHSFKGNSLKTWDEVVEKFLKKYFLKV

SEQ ID NO: 123405 - protein, 48 aa, Glycine max
  Coding DNA Sequence Number=SeqID_31720
EGGGTDDSSECRPWGHPVECSCKPVPIPHGWSILAKQRDPDWSPFDFT

SEQ ID NO: 123406 - protein, 170 aa, Glycine max
  Coding DNA Sequence Number=SeqID_31721
  Pfam annotation: Domain name=G-patch; Domain location=1-42; Score =12.3; E_value=0.0062; Accession=PF01585.14; Description=G-patch domain
MVARVMLRNGFEPGMGLGKDCLENADVVDIKGNPYKYGLGYEPGMPGRRNVPSRFRADRVWPGRISQCFTSAGMVSEEEVIAIEEEFPQDPPSFVQPCHPDSQVGNWRVISQSEVYTADSICEGRFFEESNNEGLTIDFDHDISQTVNEEEEEDVLSPELRGWSLSKNVK

SEQ ID NO: 123407 - protein, 211 aa, Glycine max
  Coding DNA Sequence Number=SeqID_31722
  Gene Ontology: Mol. function=nucleotidyltransferase activity; Cellular component=cytoplasm; Biological process=Mo-molybdopterin cofactor biosynthetic process
  Homolog annotation: Hit_ID=A1ZUU3; Match level="QueryCoverage=91%, HitCoverage=98%, E-value=7e-43, Identity=46%"; Hit description =Molybdenum cofactor biosynthesis protein C
MIPDINRFPKLNGVVLIGGRSQRMGSPKEKIRWHGKEQRFYLADLLQNYCESVYISCRPEQVNEVTANEENTSSYACLSDRYVDIGPMGGILTALEFQPERAWLVMACDLPMLGPEAINHLIQKRDPRKIATAFASPGNNFPEPLFAIWEPHSLSILQQMFAQNKLSPRHVLVQHHALCIQAPDGQTLTNVNTPTEATLAKSMITGKAQGR

SEQ ID NO: 123408 - protein, 65 aa, Glycine max
  Coding DNA Sequence Number=SeqID_31723
MGDVEEVQEQMKADMVTLKDQMASMMEAVTTRLVTTRHHVGSAAPHQNLAPCTLPLSFCSHGQRS

SEQ ID NO: 123409 - protein, 125 aa, Glycine max
  Coding DNA Sequence Number=SeqID_31724
MASLSYYHEGSGSPTENLVPLDLEIEATLRRKRAERRRKLLQDKIIASILEEETHFSDSSSSDSLSSKESVTYLPKSVSMADEHQQRVTLEDYSSSSVAQFFTSIACYEVEARNINYPHSLIHFI

SEQ ID NO: 123410 - protein, 207 aa, Glycine max
  Coding DNA Sequence Number=SeqID_31725
  Homolog annotation: Hit_ID=A5C7Z4; Match level="QueryCoverage=38%, HitCoverage=28%, E-value=6e-08, Identity=37%"; Hit description =Putative uncharacterized protein
MQRLSFLVPTDEVTLVGQTLHTFLAWPTHLVKCLSEQTAVSPAKPPESPDEEVDDSLYLMTLTIPQLFLKPLQVMWDATIFRVFNQNFPLYIKHKDFSEIAHGGQCLSISVIQLWILGHWQMAVILPKENLVVWFCSLHNRPDNYLKGIINSALKGLDDTPQPKSKTAARWIVVKCNRQKGITECGYYVMHWMSTIILGSFKNNWET

SEQ ID NO: 123411 - protein, 232 aa, Glycine max
  Coding DNA Sequence Number=SeqID_31726
MAPKKLSTKRSRRDAAAEGSNATPEFDSHRFQSAEHQQRFEAIKGWSFHRERHVQLREDEYTDFQEEIAHRCWTSLVTPMAKFDPETVLEFYANTWPTEEGVRDMHSWVRGQSIPFDADALSQFLGDPLVLEEGQQCEFSQRRNRADGFNEEAIAQLLCTPGQDFARTAAGRRVQIMRTSMTTLTQTWITLLLSNVLPSDHNSDLPLPKYQLLYAILTWARYATNQAPSGPR

SEQ ID NO: 123412 - protein, 39 aa, Glycine max
  Coding DNA Sequence Number=SeqID_31727
MRSFNGDFHHGDAAEDKGEEDASMEEKKEGEKEIGGARN

SEQ ID NO: 123413 - protein, 122 aa, Glycine max
  Coding DNA Sequence Number=SeqID_31728
MSALADKDVTLKKVSIERYGLINTNYSIKATVKNNGTQSVNSVKINWNDGTTDHIATLSLPSPLATGQEKTITHTTAISYSTAVDKTLNVSVLQVNGSPDNNPDDNTLTTKFTTVSQNSPKR

SEQ ID NO: 123414 - protein, 96 aa, Glycine max
  Coding DNA Sequence Number=SeqID_31729
MEAMKEQMTTMMEAMMSMRKMMEVNMATVVAASTAIEVDSTHPSGLNQRKHSFPPYGLPSNYTPPNVAHTPDENVDNSAPILIESQQPLSYHAHAS

SEQ ID NO: 123415 - protein, 140 aa, Glycine max
  Coding DNA Sequence Number=SeqID_31730
MTLLFSNILPGDHNANLPLQMYRLGSRPQDAQWALRSPIGPWGFQLWLRASDQSYRVPVPPVRNRTHNDTQWTRRSPTGPWGFQLWLRASVVLQGARSPRQGHVIIGIVPARHPVDLKKSNRVLELSSSNYGSLSVLRST

SEQ ID NO: 123416 - protein, 183 aa, Glycine max
  Coding DNA Sequence Number=SeqID_31731
  Subcellular localization annotation: CTP_CleavageSite=58; ConfidenceScore=5.01e-01
MGVDFLTRLFIPYFIFTSTRGRARSSLLLTTINVLTPHDHGFLCGALRGNVTSPKTFEAFNVASPFLGTSLRGVFLYGHIFYYPRVLKVQPLKFHGLGPSLDKTLELVHKLPFIVGGNVPLPKGTLKIIPILYWRIPLNPSFPNKGSPPIEGIPLKAKGSQWNFSLFANMMASKELFNLHFLI

SEQ ID NO: 123417 - protein, 296 aa, Glycine max
  Coding DNA Sequence Number=SeqID_31732
MSSPPEAARLTSRTISPRLERATRPHLGTSYLSPSEDYTSSPSKGHGYTPSPSEDYTSSPLEDYTSSPSEDYMFPIFKGGHALTFRGLHVLAIIGLHSLAFERRHVLNFRGLHALAFRGLCVLTFRASSFLLTVPGPPPDIGGGPTVRAQPEREAITQLLCILGQDFTRACKETRIAPTRHPVDPKKSNRALGFPALVTGLYQSYRVPVPPRQGIAPARHSVDPKKSNRVLELSSSNYGSLSVQGRRNTTTALGWPVAGNRHTATTSRVNLSSSAKSLERCLRHMADQQATKSKAK

SEQ ID NO: 123418 - protein, 50 aa, Glycine max
  Coding DNA Sequence Number=SeqID_31733
MTKARQKGVRKGKEGDACHPARPGELGCFLQKQPPSGGTSWKAQVGLVAI

SEQ ID NO: 123419 - protein, 229 aa, Glycine max
  Coding DNA Sequence Number=SeqID_31734
  Gene Ontology: Mol. function=endopeptidase inhibitor activity
  Homolog annotation: Hit_ID=A1FZM0; Match level="QueryCoverage=41%, HitCoverage=5%, E-value=5e-32, Identity=76%"; Hit description=Alpha -2-macroglobulin-like precursor
IPRIAGGTGGIPARPRPTPRGRHSAADGQVPPAPGPSLPDRAAAAHPGRIAGPGGAGGDAGNRLRGPVPAGVRPLWSDDMSGPARRKRWGWAAAVLAGGLLLGLAGCRNDSGQLPKASGEAITTKAEQVKEFTLLRAYPDQKNDGLSLALEFSRPLVGTQDFDKLVRFEEKPGGFAGPAGRRWQPPGQGTEAEGVQRRAEAGGRLRLAGQRAAGQGQPWPAGGVGERAG

SEQ ID NO: 123420 - protein, 121 aa, Glycine max
  Coding DNA Sequence Number=SeqID_31735
MNAAKDDISLYVLSGFSSYRQQKVYTDNYSGIFARQRDSKVSMTDFVSAEDKQKVYMNNHSRISARQRDSKGAEYDVSLCVLLGFSSYRMQKVYTDNHSGISARQRDSKVSMTDLVSTEDD

SEQ ID NO: 123421 - protein, 20 aa, Glycine max
  Coding DNA Sequence Number=SeqID_31736
FNDPRPLEPERLKVMQIQWA

SEQ ID NO: 123422 - protein, 133 aa, Glycine max
  Coding DNA Sequence Number=SeqID_31737
  Gene Ontology: Mol. function=protein dimerization activity; Biological process=proteolysis
  Homolog annotation: Hit_ID=A1HNK0; Match level="QueryCoverage=90%, HitCoverage=32%, E-value=4e-20, Identity=44%"; Hit description =Amidohydrolase
  Subcellular localization annotation: CTP_CleavageSite=49; ConfidenceScore=5.07e-01
MTMITNSSSVPSIHLAPGLTWSVKATRFLCDAGVTNSVPDEARVVWDLRSQENAPMELLKEKVSQAIQHSVAALGATAEVVVQKEMPAAEIDADATALLSAAIVDVLGEQGLLAAKTTPGSEDFFYYPVKGIL

SEQ ID NO: 123423 - protein, 66 aa, Glycine max
  Coding DNA Sequence Number=SeqID_31738
MAFIPRGYNKMKPCKVSYQNIKQKMKFSNQELPVLTNEFHYPGREAVNDKFNRLIDKYLEYSKKYK

SEQ ID NO: 123424 - protein, 126 aa, Glycine max
  Coding DNA Sequence Number=SeqID_31739
RATRPRHQRTACPHLRRATAPSPLEDYTVLALQRAAPPHLQRTTRLHALTLERTTRPRQQRAARPHLQRTTPPRLERTTRPRHQRAARPYLQRTTRPCLERAARPHLQRTTRPRLRGLHARTWGTS

SEQ ID NO: 123425 - protein, 68 aa, Glycine max
  Coding DNA Sequence Number=SeqID_31740
MTLVSVCYHALSLRDSKRKLFTDNHSGISAMSRDSSVMYDKNLFAQEDDVNLRVSTGLLAAIDKGCRR

SEQ ID NO: 123426 - protein, 101 aa, Glycine max
  Coding DNA Sequence Number=SeqID_31741
SPVESPTVATCPIASERGRGSRVRFPKEERCAESPPTFICGKRRKNQRKPVKMKILSSGVVFTLEEGISISHVDKSGAFAPTYPPSKRKSDLRSSFLCVNQ

SEQ ID NO: 123427 - protein, 231 aa, Glycine max
  Coding DNA Sequence Number=SeqID_31742
  Homolog annotation: Hit_ID=Q6WAY6; Match level="QueryCoverage=91%, HitCoverage=34%, E-value=8e-25, Identity=35%"; Hit description =Putative uncharacterized protein
RGEWAPFIDILALLIFGGVLFPNVDGLVDLAAIDTFLAYHDRKESPIVTILADLYDTFNRRCEKSSTRIVCCTPALSVWLTSHLFRQEVRHPCPLESHYSCIEKRGANWDQLLASKEGAFVNWFPRWKEGRTGVLISCGGFPNVPLMGTKGCISYNLVLAIRQLGYPMRGAPLEEELTPIIARGFNKTNVEALQKVRKAWEIMQRKDKELRGNNNGPISGYRKLLKATGIL

SEQ ID NO: 123428 - protein, 122 aa, Glycine max
  Coding DNA Sequence Number=SeqID_31743
MSLSDIHLKSGAIEETAAFCDNLSPFAQFMGDPLVLEEGQECEFSQRRNRADGFDEEAIAQLLCIPGQDFARTATGRRVQIMRTSMPPTRHPLDPDKSNRALGFPALITGLCSCLQSGSAHD

SEQ ID NO: 123429 - protein, 32 aa, Glycine max
  Coding DNA Sequence Number=SeqID_31744
VDSRGSPTLVFAFYLALSLTDSKRMFIRITTG

SEQ ID NO: 123430 - protein, 234 aa, Glycine max
  Coding DNA Sequence Number=SeqID_31745
MQVQPEEEAIVQLLCIPGQDFTRAAAKRRVRIMCTNMTTLTQIWMTLLLRNIPPSDRNTDLPLRKYQLGSCPQGTQWTRRSLTGPWGFQLWLRASTSPIGCPSPQQGSCPQGTQWTRRSPTGPWGFQLWLRASANPIGCSCPQQGIAPARHPMDPEKSNRVLGYPAMITSLCQFYRVSVTPNKVIRPHINRAFIKKYCAPRQVEGETPQQPGDGQQQAKNAPTPPLEPLSSSTE

SEQ ID NO: 123431 - protein, 211 aa, Glycine max
  Coding DNA Sequence Number=SeqID_31746
  Homolog annotation: Hit_ID=Q84VH5; Match level="QueryCoverage=79%, HitCoverage=24%, E-value=4e-56, Identity=72%"; Hit description =Envelope-like protein
  Subcellular localization annotation: CTP_CleavageSite=42; ConfidenceScore=5.22e-01
VPTSSTPNVSVPDADTDVPTSSTPNVSVPDADKDVPTSSTPNAEVLSSPSEEESIEEQDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVPDIKRAKKSGKKDCFRKRTGKKCLGLQGDHGPHQGCWTDENCHQVGRLL

SEQ ID NO: 123432 - protein, 226 aa, Glycine max
  Coding DNA Sequence Number=SeqID_31747
  Gene Ontology: Mol. function=hydrolase activity; Cellular component =cytoplasm; Biological process=melatonin biosynthetic process
  Homolog annotation: Hit_ID=A8GD13; Match level="QueryCoverage=87%, HitCoverage=96%, E-value=1e-69, Identity=69%"; Hit description=Maf protein
  Pfam annotation: Domain name=Maf; Domain location=35-225; Score =236.5; E_value=5.8e-68; Accession=PF02545.5; Description=Maf-like protein
  Subcellular localization annotation: CTP_CleavageSite=59; ConfidenceScore=5.56e-01
MSVYSIFHPLVASSAAHSLKCLSSLRYHFCKKMMTPLVLASTSPFRQALLRKLGLPFITAAPESDETPLPGEAAPQLVQRLAIAKAQALAVRYPAHWIIGSDQVCVLDGRIAGKPHTAENACQQLALASGKAITFYTGLALIHPASAQQHVLCEPFTVHFRQLSAAEIARYVELEQPLQCAGSFKSEGLGICLFERLEGRDPNSLIGLPLIALNGLLRQAGINPLG

SEQ ID NO: 123433 - protein, 69 aa, Glycine max
  Coding DNA Sequence Number=SeqID_31748
MEVEEPWLGLWLPLNYRVDMGSSLAYDNGIWGFVVDLRMAFEDKWVVGKEEVCYWLSNDIVGLVGNLAV

SEQ ID NO: 123434 - protein, 129 aa, Glycine max
  Coding DNA Sequence Number=SeqID_31749
GLCQSFGVPVAPTKVIRPPITRAFIEKYCTQRQAQGDAPPATGAPPPPHQAGQARSFDMEQYLRHLSQGFASFSCPTPDQFRAEVAWPGDWPEAQAGEAPPEVPGDGEEAHEDEEMADLLDFLVGSGAT

SEQ ID NO: 123435 - protein, 472 aa, Glycine max
  Coding DNA Sequence Number=SeqID_31750
  Gene Ontology: Mol. function=aspartic-type endopeptidase activity; Biological process=proteolysis
  Homolog annotation: Hit_ID=A5C8I5; Match level="QueryCoverage=99%, HitCoverage=60%, E-value=2e-58, Identity=30%"; Hit description =Putative uncharacterized protein
MDKETLRKNFYSPENEPQRRWFFQQYKGTNRKQIQDKFYEFVERVKINVLFFDWFHAYAIRKDIDYPWKQDIIGNPTTNVITNWQVKDGELIQSELPPTTQYQLPNIKDSNNKPVMAIPFKTKDVNEEVTSRDIKSLMEQANYTNKYLQALGETIKTKVVPKQKSIEEASPSVPIEKPLFKPFKVSDKAKRKIRELRKTKSLIEGVGDNHSELLNKISSLLKVIPDTPQASENTSKMVTRSTSKLINVINEDSDQNLDNTTEIGSVSEKNINPLNSKHWKTPSKLYYQRPTAPDLLLEERGENNFKIFSANNIYEWNIDAQTEYNIMNTLQHMTMVATAYQTSHECSEETIIDILVAGFSGQLKGWWDNYLTNEEKSKIYSAVKTDLNGKVITNDDDKEIPDAVNTLIFTIAQHFIGDPSLWKDRSAELLSNLKCRTLADFRWYRDTFLTRVYTREDSQQPFWKGYWLSSLV

SEQ ID NO: 123436 - protein, 216 aa, Glycine max
  Coding DNA Sequence Number=SeqID_31751
  Gene Ontology: Mol. function=endonuclease activity
  Homolog annotation: Hit_ID=Q9AY32; Match level="QueryCoverage=27%, HitCoverage=90%, E-value=7e-25, Identity=96%"; Hit description=RRNA intron-encoded homing endonuclease
IDRLRALSDSMGGGAWPFLVGGAICLIIAIVGLQRGIPSKRESSARVDYVPALCTHRPSLLPIEWSGEVYTDCRDVERFAARDVVRESNLKSLIIYEELEKSDWVDDPAASVSHRPRLVLGKHKPRRFDSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 123437 - protein, 87 aa, Glycine max
  Coding DNA Sequence Number=SeqID_31752
DWNIVEASGNRLPACVIDYTEGWATGNRLPEMECLEGAWETLEGNTGCRVRGTIRFMATSLVHPDEPARTLQRTVEWTAPWMSFVYC

SEQ ID NO: 123438 - protein, 165 aa, Glycine max
  Coding DNA Sequence Number=SeqID_31753
FFKSQQVIQNYVGLSSSLVICTLIRRSNEPSLLSSTPAFVADDIRASLVILHLIPAEIPYETKFGHSAPMIRGDTLWLFAPFCHPEAAGPMTSRDQVWSFCTLVSSRGGGPDDTRRYLTVIRTLLSPFCHPEAAGPMTSRDQVWSFCTLVSSRGGGPDDTRKYPS

SEQ ID NO: 123439 - protein, 193 aa, Glycine max
  Coding DNA Sequence Number=SeqID_31754
PTFYHQQWAPEYPEFVNFRYDGTIYQIRLKQDRTKVYFAEGLKEFRKDLSIYESVIIKFLACNEKSMFDLYFVPSLECQTCGRPEVMSRQHIWTLEIAQSILGAPGPLRLPNCAITHVNACGQHMTILRRFGPPLQWNVVVVDGGVRRRYVVQPWYQFIADNDFSHGDEVSFYYRTIDKIWEIVIRQRKNWEY

SEQ ID NO: 123440 - protein, 151 aa, Glycine max
  Coding DNA Sequence Number=SeqID_31755
MVSPQGRNTWTVDDLVPYVEKITILSEEQERITESVSHGLATEHQFPAQQFHVLHSSVETQGIGRRRDAFEAEKYSPQMAERGHEMYYTPPTFSQYPTQMYQYPFKGQHTDTSASKHSFGGVAETHPNFSWPTMTPSQQHDVSIPTPNAPL

SEQ ID NO: 123441 - protein, 140 aa, Glycine max
  Coding DNA Sequence Number=SeqID_31756
ETKFGHSAPLYHPEAAGPMIRGDTLRLSAPFCHPEAAGPMTSRDQVWSFCTLVSSRGGGPDDTRRYLTVIRTLLSSRGGGPDDKQRPKAAGPMTSRDQVWSFCTLVSSRGGGPDDTRRYLTVIRTLLSSRGAGPDDKQRP

SEQ ID NO: 123442 - protein, 172 aa, Glycine max
  Coding DNA Sequence Number=SeqID_31757
MPISPYGSISWDHAHETPSGPREVQQGLGVSSSGYGSLSILLGARPPQQGVAPIRHPVDPKEPNRALGFPALVTGLCQSYRAPVPPASSCHRDIGIMPARLSVDPEKSNRVLGFPALIMGLCQFYGVPVTPSKVIKPPTNRAFIKKYCAPRQAQGETPQQPGDGRQQATGIL

SEQ ID NO: 123443 - protein, 34 aa, Glycine max
  Coding DNA Sequence Number=SeqID_31758
VEEKIHDFQKPLDLRSHPFQGGGNDAILTPKGIG

SEQ ID NO: 123444 - protein, 108 aa, Glycine max
  Coding DNA Sequence Number=SeqID_31759
MAILMDDKDFRSRGRLPCGRDSHLKGRCVGLQVSPYVVARGPQVYPSNLPNNWYQSRWFKLMTGSDECSGVARMASGQGNYRRWPWLYSWMIKTSARGGDYHVEETHT

SEQ ID NO: 123445 - protein, 92 aa, Glycine max
  Coding DNA Sequence Number=SeqID_31760
HSSEWLSGGENFWCEDPEGQHRLKRKLSCVVLDESLSDCELWRAKSSVGSSYGVLDGLRYGNLVVGMYVLMQFWSSLVQQEEFEDDTWLGLG

SEQ ID NO: 123446 - protein, 109 aa, Glycine max
  Coding DNA Sequence Number=SeqID_31761
VSTSDPFRSGQSQGDLVGCLFLIKLNFLCWKGVRTSLMLRLRLIENCCGETIAEAGLDPKPLTILGSRLGGSEKTKGDADYSIADSEEITDIVGTNLIFMTGPVIDLLL

SEQ ID NO: 123447 - protein, 119 aa, Glycine max
  Coding DNA Sequence Number=SeqID_31762
  Subcellular localization annotation: CTP_CleavageSite=61; ConfidenceScore=5.17e-01
IAPIRHPVGPKKSNRALGFLALVTGLCSPTGCPFPPARSRHHRDRACKTPSGPEEVQQGVPVTSSKGIRPPTNRAFIKKYCISREAQGETPQQPGDGQQRATDAPPSPLEFTSAHQQKG

SEQ ID NO: 123448 - protein, 108 aa, Glycine max
  Coding DNA Sequence Number=SeqID_31763
  Subcellular localization annotation: CTP_CleavageSite=61; ConfidenceScore=5.41e-01
MDLVSYAFYAPRVRQPKTTYPLAKSLFSVATCPFAGERRRGSRVRFPKEERCVELPPTFICGKRRKNRRKPVKMKILSSGVVFTFEEGRQKRGFCSYVPSIEEEIRPT

SEQ ID NO: 123449 - protein, 50 aa, Glycine max
  Coding DNA Sequence Number=SeqID_31764
MMAHHSSSYPWPPMVPFNFKKQRTPLMKKIQGLQTPHGATSCGIRAPSSR

SEQ ID NO: 123450 - protein, 85 aa, Glycine max
  Coding DNA Sequence Number=SeqID_31765
MKREKHDSYSSHDSCKSLSEELSDYYRGRHSSHTKHHSQRRERDRRPQEVNIKSVARATSLKGDIGLSNRLKQGLSESPERTTPN

SEQ ID NO: 123451 - protein, 85 aa, Glycine max
  Coding DNA Sequence Number=SeqID_31766
  Homolog annotation: Hit_ID=A6FJQ2; Match level="QueryCoverage=44%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARLWRLTQGHYYTEKENRDHKCFTWHIFNEVQLANVA

SEQ ID NO: 123452 - protein, 66 aa, Glycine max
  Coding DNA Sequence Number=SeqID_31767
MNLRGRQVDIADPLCPFWNNLDEDAAHLFFNCSKVLPLWWETVSWVKSVGAFPKDHFMHHSRSNAT

SEQ ID NO: 123453 - protein, 121 aa, Glycine max
  Coding DNA Sequence Number=SeqID_31768
  Subcellular localization annotation: CTP_CleavageSite=50; ConfidenceScore=5.86e-01
MGSPPASPPPPLPLSPPCPPPLPLSPPCPPPPPAPSDASTSPSAVKRTRKASRLRSLSTRPPGAERLVVHVDPATGKADGPHKKKLRTYLGIVARDKVDVTYENWKEVPTAQKDLIWEDIQ

SEQ ID NO: 123454 - protein, 168 aa, Glycine max
  Coding DNA Sequence Number=SeqID_31769
MEISSFHQFLDESLSEALDRFRGLLRKTPTHGYSESVQLNIFIDGLRPQSKQLLDASAGEALTETLNKLPQQLQAVGRCHICGGTHKSGLCMVQDDASNEVNYMGSHNHQGFHQRGPPRFYQNDNFLQDHDWRYYPSNNLNQGGSPYQHPSQGPSHQEKPTNIEEMPP

SEQ ID NO: 123455 - protein, 48 aa, Glycine max
  Coding DNA Sequence Number=SeqID_31770
MVRSRDKLTTKINQGQMQMEDRVTIDRSSSLPDAGQAENVVARQPSIL

SEQ ID NO: 123456 - protein, 218 aa, Glycine max
  Coding DNA Sequence Number=SeqID_31771
MGDQDETQEQIKVDMLALEEQMASMMEAMLGMRQLMENNVATAATVSSTAEADPTLLATAHHPLPNAVGQERSTLGHTSNPHLGYNQVAYPYGLPPNYTRPVMRDDAGHVLSPVLEGEPPQQSDEVHEDHREYAQGDVDFYPSVPVEGLTPNILPQPNLPAQPILLSTKGPPPAVEERRKLDLIEERLRAVEGFGDYPFADMADLCMVLDVVIPPKFK

SEQ ID NO: 123457 - protein, 177 aa, Glycine max
  Coding DNA Sequence Number=SeqID_31772
LAILSQEQERITEPVAHGPASERRFPPQEFHMLQSSVETRGFDRRREIVQAEDFSQHMEQRGHGMYYTPPTFAQYPSQMYQYPFEGHDTDMSASEHSFGGVAETQPHFSWPTMTPSQQHDAPMATPNAPLGQQWDVPGAIPPMGDLLGVDLRHEFSAEAEEQGRRQRARRNPDRQAR

SEQ ID NO: 123458 - protein, 144 aa, Glycine max
  Coding DNA Sequence Number=SeqID_31773
MPLNMNKPRLSKSISLSPMQFSFARAKRVYLAKRPERYEQNIHSRNILPEMNVDLYVTQYDEFRKELERRWWHKALTRQLDNHIDVAQVKEFYANLLSQPTLRREGNARAHGCVFHGRKMCGVATNVYLRKTSEKPEHVVYELQ

SEQ ID NO: 123459 - protein, 154 aa, Glycine max
  Coding DNA Sequence Number=SeqID_31774
MPEHNTPQATLDRREEAVQRLTQAQATLSQNHANLAQTQTSMTTKLDSVLKHLATLTIPSPIPLPPPHTISPPPPSPKPHMKLDVPHFDGQDPDYTRSSGERFRRFSLCRCRKLWLLQSFKRKNSKIVVGHLDHHLCTRPCIHHRFLLPALALP

SEQ ID NO: 123460 - protein, 240 aa, Glycine max
  Coding DNA Sequence Number=SeqID_31775
  Subcellular localization annotation: CTP_CleavageSite=31; ConfidenceScore=5.08e-01
MCKLIWVWVGLEASGGSVSGSMLGSDSRKPSSSSVNSSWDKRLMDTEGVGFEGVGTKGEGGDRRGVECLGTFIPEVRPDQFLAPTLMDEEPVPHDKFLRTNGIFVLRRGEASLRGLKETRPRGELPIAGHPLEPSKGTTIHIKRRNGETLMFRGGMVLKKLVDLEDPVERIGTQEREWQRKKRGNLVCSELGNGFLKPVGIGFGPSGFIHGNRTTRAPNLLRVEKIELASRANDLLEEKE

SEQ ID NO: 123461 - protein, 289 aa, Glycine max
  Coding DNA Sequence Number=SeqID_31776
  Gene Ontology: Mol. function=aspartic-type endopeptidase activity; Cellular component=small subunit processome; Biological process=DNA integration
  Homolog annotation: Hit_ID=A5CB76; Match level="QueryCoverage=50%, HitCoverage=51%, E-value=2e-25, Identity=39%"; Hit description =Putative uncharacterized protein
  Subcellular localization annotation: CTP_CleavageSite=60; ConfidenceScore=5.42e-01
METGNNKPEKGSLLVSFNLASEQVAAVRRRAARRRQLRRFSPARPGFGSPRKARSTPGTRAAVGRRTRPHAPPFLRAISGACCSRAAVPASGAVPSGPGSLAVTSWTCFRLQIPLPASRLLWFLGQGHHDHLEKTSDFVSDDKRAEWEKLDYQLCVVLWQSVEPDILEILRSFKSCRSFWKKAQEIFANDIQSLFDATMKVTALKQTGHDMIAHVGKARAAVEELRKFLVADSLEEVNRKLDKFYMVLILRSLHSDFDHVRDQSACWGPNSITGFSHHQTSPCASFIDG

SEQ ID NO: 123462 - protein, 605 aa, Glycine max
  Coding DNA Sequence Number=SeqID_31777
  Gene Ontology: Mol. function=heat shock protein binding; Cellular component=integral to membrane; Biological process=protein folding
  Homolog annotation: Hit_ID=A7QL00; Match level="QueryCoverage=62%, HitCoverage=66%, E-value=1e-130, Identity=63%"; Hit description =Chromosome chr8 scaffold_115, whole genome shotgun sequence
  Pfam annotation: Domain name=DnaJ; Domain location=52-117; Score =53.3; E_value=8.6e-13; Accession=PF00226.22; Description=DnaJ domain
MKKVPNAFVIHGVSGRGMFRTESKMEVGEVVVVPGSSGDLVEGGELIVYALQFFRFLGLIKMQVSGKFRRLFTSMYAWLSLQYHPDKNKSKGAQEKFSQINNAYEILSDEEKRKNYDMYGDEKGNPGFQGGHPGGQGGYTFTGGGPGQSHFNFKPGGDWQGMGGQGGSKSFSFSFGRGSGDSNPFGFGLDDLFGSFFGGGGGGSQFGGFGSSAKSQSGSKSSSKSLRAVNSQIYKKEIENAGMTWLLLSYMPSSMEIQYFESTIEEVASSLQGALKVGSINCEKEVSFCKELSIYPRRAPRLIVFSYKENEKGYLVEYRGNLAAKNLKAFCQEYLPRFSKRTDLNHLDQFSTTGKLPRVLLLSTKKDTPVIWRVLSGLYHKRITFIDAEVHDVSDPRVKTLGVDALPAIVGWLPNGEKRVLKTGISVKDLKSAVLDLSNILDSFEKVSKKESSGQAKEAQTDSDEGRVPLLSKSNIEALCGEKTPVCIIGAFSSSKAREKLESILSLVSQKSLSRQPNQGSSSSRDSISYALLDAAKQKSFLKAFDKTGYKSSNNLLIAYKPRRGKYSIFMGEMTIEEIENFISSVLSGDVPFREATRGKPVLEY

SEQ ID NO: 123463 - protein, 36 aa, Glycine max
  Coding DNA Sequence Number=SeqID_31778
MTRTKGKEPLEGLGGPMPRARTKKAKEALQQVLTMV

SEQ ID NO: 123464 - protein, 73 aa, Glycine max
  Coding DNA Sequence Number=SeqID_31779
MEAPKLIHYVVVKTRTKEVKKLELDLRTNDDNQHEVLHSHPPIHLLPRTQSSRSTQDPNTNSKPGVSYHIANY

SEQ ID NO: 123465 - protein, 180 aa, Glycine max
  Coding DNA Sequence Number=SeqID_31780
MEVDNGVCMWGRIFVQNATKPSRVEDLTGSRTMTNHHPMWHVLVQKTLNLGNLMLIDIPLMVQSLLKWTKRTNYYCLLLRAQMLCFKLSDTLKTLNDDNEINSKIDDDDDDMETNIINGDKKRRLINAAEVTTMATNHAVVSTIVAFEEKTQVSIVETTFIRGNELLKLELLGLGKIASS

SEQ ID NO: 123466 - protein, 125 aa, Glycine max
  Coding DNA Sequence Number=SeqID_31781
  Homolog annotation: Hit_ID=A7QVZ0; Match level="QueryCoverage=50%, HitCoverage=13%, E-value=3e-08, Identity=46%"; Hit description =Chromosome chr2 scaffold_196, whole genome shotgun sequence
MVSDTGSHLTWTQCFQCKSCYEQANARFNPLNSSTYEASDCLDDVCEDLISSGQGLSCQWRCKCPVIGIGGLSNVSLVLVAAHAVPQLVLATPNHVSPFSPQLVAAPPEPLMQLAAPCNFFQKGP

SEQ ID NO: 123467 - protein, 66 aa, Glycine max
  Coding DNA Sequence Number=SeqID_31782
MERLEAPCGDSTTSKGGSWRSPVVSGGGGGSWGCWGRPATLAQANLARLGELIQFKFYCFGKKIHI

SEQ ID NO: 123468 - protein, 120 aa, Glycine max
  Coding DNA Sequence Number=SeqID_31783
MFATTFNTPSSAYNLAPSSSCYRPSLPTQIRDMSHEDEDEGENNNNNNDDDDDGDGVDDDDNSGHHVPQQQRTITHHYPRTRGGRGRRPRGQQTQTNSIQQDERSRRISRRTRCGTSSHY

SEQ ID NO: 123469 - protein, 122 aa, Glycine max
  Coding DNA Sequence Number=SeqID_31784
MDAGCQSNCVGAHRIDVTSASIARLCGRKLRVMMVGVDLILIHAVRGLHTLSALQIHQLAKPNPLPSTTEGYILCGTSRGCIYLGCNTENKRGYISCGSVQVEGFYKVIGNLKNQWLLGDWT

SEQ ID NO: 123470 - protein, 176 aa, Glycine max
  Coding DNA Sequence Number=SeqID_31785
  Gene Ontology: Mol. function=transcription regulator activity; Cellular component=nucleus; Biological process=regulation of transcription
  Homolog annotation: Hit_ID=A7QKX7; Match level="QueryCoverage=38%, HitCoverage=45%, E-value=2e-24, Identity=83%"; Hit description =Chromosome chr8 scaffold_115, whole genome shotgun sequence
  Pfam annotation: Domain name=HLH; Domain location=46-93; Score=33.5; E_value=7.5e-07; Accession=PF00010.17; Description=Helix-loop-helix DNA-binding domain
  Subcellular localization annotation: CTP_CleavageSite=66; ConfidenceScore=5.28e-01
MECINNPTSCEGSSSSSKHPNKSNREKKGVRKSNKGGGGGVRLSTDPQSVAARERRHRISDRFKILQSMVPGGSKMDTVSMLECAIHYVKFLQTEILLHQALIDFVDVDHHESPLFLPAEYNNFPDEHSNISLQQNPSSVSVHSHHHQQSLPQLPLSQCYFQGEEDFNTFDAIMPP

SEQ ID NO: 123471 - protein, 133 aa, Glycine max
  Coding DNA Sequence Number=SeqID_31786
EVVEAEEFSQQMEQHGHGMYYTPPTFSQYPSQMYQYPFEGHDTDISASEHSFGGVAKTHPHFSWPTMTPSQQHDAPMATPNAPLAPQWNVPRTIPDMGDLLGVDLRHEFSTEAEQVEAGRHRSRRNPDRQARR

SEQ ID NO: 123472 - protein, 39 aa, Glycine max
  Coding DNA Sequence Number=SeqID_31787
MWKRLTLKGEMCWVTSVRSPYVVTRGPQVYPSNLPNNWY

SEQ ID NO: 123473 - protein, 182 aa, Glycine max
  Coding DNA Sequence Number=SeqID_31788
MVSRYALNEIAGEFECVPYASKNSSRCGCVMRTTYGLPCSYQGLCETEVTITEEMKTISKRFEQLDICGKVHLKTKLREIAYPDLNFMCPPPEKNPNRATGGGALESTRDATIANGERLRDYVEEGEALTDFSECRPWGSSGLSAPVSLCRSHMVGAFSQNSVTLTGLPMISLSESDLTYPL

SEQ ID NO: 123474 - protein, 280 aa, Glycine max
  Coding DNA Sequence Number=SeqID_31789
  Homolog annotation: Hit_ID=A5APQ3; Match level="QueryCoverage=51%, HitCoverage=7%, E-value=6e-18, Identity=40%"; Hit description =Putative uncharacterized protein
  Pfam annotation: Domain name=DUF1723; Domain location=1-50; Score =53.5; E_value=7.4e-13; Accession=PF08330.1; Description=Protein of unknown function (DUF1723)
MDDRGLMSTFVECWHKETNSFHLPVGEVTITLDDVASLLHLPIVKAFHSFKQLHVNDTVDILVELLEVSIVEARAETIQCHGSLFDYRGYETVTHVHVVFLDALRDLTQSGTYAWGAAALVHMYDNLNEASKSTARLLVGYITLLQHFPSVDSALAAEDYDERRSHAYRWTSGKALPVPMYRRRLDRLTPDVTIPPHPTVSLTSVEEINARWMQFSDYIAPIGQICVVPYQHVPQQPVATTTPNEVDVDDGYVAIAHKLERLLNLRILIEGTEAYTIAEE

SEQ ID NO: 123475 - protein, 217 aa, Glycine max
  Coding DNA Sequence Number=SeqID_31790
  Gene Ontology: Mol. function=phosphoprotein phosphatase activity
  Homolog annotation: Hit_ID=A7UQU7; Match level="QueryCoverage=65%, HitCoverage=23%, E-value=5e-23, Identity=39%"; Hit description=IMP dehydrogenase/GMP reductase, putative
ALRDLTLAGRYAWGVAGLVHMYNQLNDASLSTSRQLAGYITLLQCWIYEHFPSIAECNANLDYDEVSPRACWWIATKKTMKKVSAAMHKQRLDHLRILDVCWMPYSEHRPVQDFHPISCFSGQLCWGPVVVRYRPERVMRQFGYVQCIPAHPVHPWVSYDDVDDTWMHYSDHLAAAGDPCVMPGQCALDYIDWFFRISHPFMTAAQPSDPPTDAPAA

SEQ ID NO: 123476 - protein, 90 aa, Glycine max
  Coding DNA Sequence Number=SeqID_31791
MTATHDALLYYNGRWNMSRQDEFVGHSNYSEKVIKFKIIELKTDDDLLKVLVQSNYWKQFGPIEILTVFSKSVIKMEDNMSPSRHDSMQN

SEQ ID NO: 123477 - protein, 120 aa, Glycine max
  Coding DNA Sequence Number=SeqID_31792
ASDIDNDAPRPTASAHRQRQQVHIIEYPPTTTKDLNEEHKQPLVEEVWNGEEHLEMKLSSHERKMAKFGRSALEIEGLVAANGLSHLIACSLDMDDRGLMSAYMECWHKETNSFHLPIGE

SEQ ID NO: 123478 - protein, 279 aa, Glycine max
  Coding DNA Sequence Number=SeqID_31793
  Homolog annotation: Hit_ID=O65019; Match level="QueryCoverage=86%, HitCoverage=90%, E-value=9e-23, Identity=33%"; Hit description =Putative uncharacterized protein
  Subcellular localization annotation: CTP_CleavageSite=67; ConfidenceScore=5.09e-01
MEEGEKNLETMDFKRPRKLNFNAPLLSTKRLGFSGVADRSCLSNSLNSTVLNTSVPFSWEQAPGKPKTMERSDSIYDGDIDTPRLRPPPCLWHPLKEATKADNGALAFDQDDGCDADDDEDDDKQNDVFSDAVDVLSLSEASDIMQQSEAAHSDSKDGLRLKLSESNGGPSPTYMINRFLPDANALVASSSAHFSNDAKVCDNCSHEGYLKGSTRHSHATSPKGCGLEFLFSWLMKNKLCAIKSPVLPSFTNVQKHRYSSKHTKHRTSVHKPCTNVKDV

SEQ ID NO: 123479 - protein, 180 aa, Glycine max
  Coding DNA Sequence Number=SeqID_31794
  Gene Ontology: Mol. function=acyl-CoA binding; Biological process =lipid transport
  Homolog annotation: Hit_ID=A2Q340; Match level="QueryCoverage=51%, HitCoverage=14%, E-value=1e-40, Identity=87%"; Hit description=Acyl -coA-binding protein, ACBP; Serine/threonine protein phosphatase, BSU1
  Pfam annotation: Domain name=Kelch_1; Domain location=65-110; Score =14.7; E_value=0.053; Accession=PF01344.16; Description=Kelch motif
MRKEKIPHQAPFAIQAAQLLGRAIGAGLFAITPAGERGMCCKAIKLGNARMEWSRPTQLGEIPSPRAGHAGVTVGENWFIVSGGDNKSGVSETIVLNMSTLTWSVVTSVQGRVPVASEGLSLVVSSYDGEDILVSFGGVTTHYAHVIVSKSKGDLVSVLKAKKEVLESSLSKEKPSSRFL

SEQ ID NO: 123480 - protein, 70 aa, Glycine max
  Coding DNA Sequence Number=SeqID_31795
  Gene Ontology: Mol. function=acyl-CoA binding; Biological process =lipid transport
  Homolog annotation: Hit_ID=A2Q340; Match level="QueryCoverage=54%, HitCoverage=5%, E-value=2e-14, Identity=92%"; Hit description=Acyl -coA-binding protein, ACBP; Serine/threonine protein phosphatase, BSU1
MEWSRPTQLGEIPSPRAGHAGVTVGENWFIVSGGDNKSVGKPVVPAALMNRPTRGERRFAYWALFRFLAH

SEQ ID NO: 123481 - protein, 558 aa, Glycine max
  Coding DNA Sequence Number=SeqID_31796
  Gene Ontology: Mol. function=protein binding; Cellular component =endoplasmic reticulum; Biological process=regulation of transcription, DNA-dependent
  Homolog annotation: Hit_ID=A7QKV3; Match level="QueryCoverage=99%, HitCoverage=100%, E-value=1e-124, Identity=44%"; Hit description =Chromosome chr8 scaffold_115, whole genome shotgun sequence
  Pfam annotation: Domain name=GRAS; Domain location=164-470; Score =21.3; E_value=2.7e-09; Accession=PF03514.5; Description=GRAS family transcription factor
MMQSEDLQFQWPFFEDMNSTFDQGVESYGFTTMDDHVGNCEPYGFTMDDHVGNCEPYGFTMDDHVGDCGLSTLLSTPGDSTSEICSIPFPSSPMFSNDHIHIQYPINEETMDLPSLMELDDFYSILDTQIISIQGHGESEGSFFPSQNLSSEVENAWSPTPSVMSELSTNQTSPLTLPLENMEIEKQVSLPHLLKAYGEALEQGQKALEEVTLRRISQKASPLGESLERFAFYLSQGMTNHGDYLKGEAFKNFGITLRALYQGFPIGKIAHFAAVSTILEAMPQDYDVVHIVDFCIGHGVQWPPMIEAIAHMHKTLKLTTIKWGGEGSECVSSPCNFDETRRQLYEHAKSCGLKLKVEEKGVEELVTEIKKMNKKGGRREFLAFNCMIDLPHMGKVRSRKNALQFLRVAEELINTSGNRGIITFGDGGAFEKVKNNLNFWSFFYGHLVHYQILLESMESHFPTRFSEVRIAMEQLFLQPCISSLDWLQTWEEMKRGDHLEAETSLEGCQLSKNILMEIREVLRESEGSYQAKIEGQHDNELVLEYKGTQLLRFSTWKN

SEQ ID NO: 123482 - protein, 108 aa, Glycine max
  Coding DNA Sequence Number=SeqID_31797
MATPPGVAKEEEWYIVILKKVMIDCSMSIFQKIMCTQTFSSEEDALKNHDEYFQMRVDALRRKGLSPLQKCTTASILTYGSPELVKQLQWNAWSDLYQASAPYLGMNT

SEQ ID NO: 123483 - protein, 160 aa, Glycine max
  Coding DNA Sequence Number=SeqID_31798
MWDISYASVLMAGEVPVELRTLLEFGFELQLDEFFNRLWASIRSVVAHIYIENILPACLVDSQGSDWRPFVHAHDLSGTIRCEMRCGKNGFELVKHFPANQSKYKMSVELPWSMRTLDTMKLEITMETTIRSSWLIGLISLKSLSMKVIEGRLYGDGVST

SEQ ID NO: 123484 - protein, 132 aa, Glycine max
  Coding DNA Sequence Number=SeqID_31799
MISRTRFKNQEKFDFKIQEKMNSRFKKRNQEDFTREVFLKVITLPMVFLTRHEESIKGTSFVVQVEGTSTWVVVTENKRGYISCGSVQVEGTSTWLFKENKGGYIPYESLLVKDFTRLKRNLKDRRSLGDWM

SEQ ID NO: 123485 - protein, 528 aa, Glycine max
  Coding DNA Sequence Number=SeqID_31800
  Gene Ontology: Mol. function=translation repressor activity; Cellular component=nucleus; Biological process=negative regulation of transcription
  Homolog annotation: Hit_ID=A7P330; Match level="QueryCoverage=97%, HitCoverage=58%, E-value=1e-150, Identity=53%"; Hit description =Chromosome chr1 scaffold_5, whole genome shotgun sequence
  Pfam annotation: Domain name=GCFC; Domain location=4-509; Score =638.1; E_value=7.4e-189; Accession=PF07842.3; Description=GC-rich sequence DNA-binding factor-l
MGVAVALNIALESHERTMSSLSKTDENLSASFLKITALENSLVVADEKYRFMQKLRNYVSNMCDFLQHKAFYIEELEEQMKKLHEDRASAIFERRTTNNDDEMIEVEAAVKAVMSVLNKKGNNMEAAKSAAQEAFAAVRKQKDLPVKLDEFGRDLNLEKRMQMKVRAEAHQRKRSQAFNSNKLASMELDDPKIEGESSTDESDSESQAYQSQRDLVLQAADGIFSDASEEYGQLSFVKRRMEEWKREYSSSYKDAYMSLSLPLVFSPYVRLELLRWDPLHKGLDFQEMKWYKLLFTYGLPEDGKDFVHDDGDADLELVPNLVEKVALPILHYEISHCWDMLSQQETVNAIAATKLIVQHVSHESEALADLLVSIRTRLADAVANLTVPTWSPPVVAAVADAARVAAYRFGVSVRLLRNICSWKDVFSMPVLENLALDELLFGKVLPHLRIISENVQDAITRTERIIASLSGVWAGPSVIADRKILERRNAPESDTSHLARRLKKILVDLNEYDHARTMARTFHLKEAL

SEQ ID NO: 123486 - protein, 140 aa, Glycine max
  Coding DNA Sequence Number=SeqID_31801
MGIAVGMHIHRRGVHKKLDSMIGGLWWLELCDSNMEESACAICLDHSLKQISVDRVEVPVMGALQDVKINGEDMSMDMDGDIAAKVKTVELIAVTHRESKGGGGNKDEDKAWRGSRGANKPWEEVVELGSHDECPATSPR

SEQ ID NO: 123487 - protein, 228 aa, Glycine max
  Coding DNA Sequence Number=SeqID_31802
MRTKITPTLHKILGSCSLSQQRETQNDHTRVFGEFGEGLEVAAEDGVDEDASVLGGVAGRDVDDVGLDDDGVGGGTGVEDGDGAVVGEAVVATDHAEADDVALVVEDVEALGADGGRETGDHADLAEGPDIAVAEDDVAALDEVLVGLRVVEAPHDGPHGGDRGGNLLHHGGAALVRGHDMGVVPSHRVGNNRGRIVRGRLDIEQIKKGSRGRGPPLGLSKLYERLLE

SEQ ID NO: 123488 - protein, 87 aa, Glycine max
  Coding DNA Sequence Number=SeqID_31803
MVQVGDRLRRVCKYRRWPEWLMAQRALQVCPSNLPNTCDDEKPYNNFLWERGREKRDTTGKVTLVRLPSPILVTQILPSKLLTSKLI

SEQ ID NO: 123489 - protein, 175 aa, Glycine max
  Coding DNA Sequence Number=SeqID_31804
MKREEKSQRGRKERQASKPGDRKPRQKLEGKRVRRRSTVEGHNNLTGKAWAQMHMGEAMKVQQANKTHGRKQRQDTKPGGRRLRSKLEGTFTHAKIKYFKPPFDKLVGHELESRNIFACAKIRLRTTTLPHIYLHVKRSLRPLGYVSFLFKYWINDGKFYTKSTDSKSNERMQIS

SEQ ID NO: 123490 - protein, 108 aa, Glycine max
  Coding DNA Sequence Number=SeqID_31805
  Gene Ontology: Mol. function=protein binding; Cellular component =integral to membrane; Biological process=mRNA metabolic process
  Homolog annotation: Hit_ID=Q949R9; Match level="QueryCoverage=93%, HitCoverage=91%, E-value=2e-47, Identity=84%"; Hit description =Putative uncharacterized protein At5g20090
  Pfam annotation: Domain name=UPF0041; Domain location=1-107; Score =130.0; E_value=6.9e-36; Accession=PF03650.4; Description =Uncharacterised protein family (UPF0041)
MASNFRAFLNSPVGPKTTHFWGPIANWGFVAAGLIDMKKPPEMISGNMTAVMCVYSALFMRFAWMVQPRNYLLLACHASNEAVQIRQLTRWAKGNGYLSVKKEGASSK

SEQ ID NO: 123491 - protein, 502 aa, Glycine max
  Coding DNA Sequence Number=SeqID_31806
  Gene Ontology: Mol. function=transcription factor activity; Cellular component=nucleus; Biological process=regulation of transcription, DNA-dependent
  Homolog annotation: Hit_ID=Q8GZF2; Match level="QueryCoverage=23%, HitCoverage=35%, E-value=2e-30, Identity=58%"; Hit description =Dehydration responsive element binding protein
  Pfam annotation: Domain name=AP2; Domain location=74-132; Score=74.2; E_value=4.2e-19; Accession=PF00847.11; Description=AP2 domain
MKTNNNVSGERKSRKRRSGESDSVEDTLEKWKEYNRQQQLGSRENGVEVIHKVPAKGSRKGCMRGKGGPQNSDCKFRGVRQRIWGKWVAEIREPINGKLVGEKANRLWLGTFSTALEAALAYDEAAKAMYGPCARLNFPEPIDSNGSSSSSGSDKKSPSGSSENGGDVAIAEELEVNHRRCHEDRPRFSKVGVFEKAEEMPVLSVGCVADDSIEELKEISNGFEQCQTSEECKATSLNDVKSEVPRENEGIEKELEEVLKNSGIGGEGRHLQKEPMDIPMNTRSNFCSSSASSDAATILIKSEETRGESVETLNSYELSCSNHCLGYMHNNMLPDTNPRPNSETSIAKKHTDEHFDEMKTRLKGLECKLRAHSIHYKNQAPIVGDSNHPSMQGIHLFGGGTVGPIEGMSQVEALNNINTNRNSLPGFSSGHGRKLCDLSQQLHKLGGYLPEQWNSMQFPDLDAGHDYSFLNPDYDFGLYEEQNMFFSPPWLFNKICFCSLSL

SEQ ID NO: 123492 - protein, 141 aa, Glycine max
  Coding DNA Sequence Number=SeqID_31807
  Gene Ontology: Mol. function=oxidoreductase activity
  Homolog annotation: Hit_ID=Q10GW4; Match level="QueryCoverage=30%, HitCoverage=10%, E-value=2e-15, Identity=88%"; Hit description =Oxidoreductase, aldo/keto reductase family protein, expressed
MAIKAIQDAFEAIWNLVHPGDLISSLLSSTSATEWYIGVSNETSYGVVEFVHASKVEGLPKIVSIQNNYSLLVRCHFEEGINSKASIDTNIEVAMSTQPIRTTLERKLQGNIAIISKVEPKHIDEAMQDEKGVKVMQEELD

SEQ ID NO: 123493 - protein, 26 aa, Glycine max
  Coding DNA Sequence Number=SeqID_31808
MRKVVYGFQVTDEEVESLNKRPNRKL

SEQ ID NO: 123494 - protein, 50 aa, Glycine max
  Coding DNA Sequence Number=SeqID_31809
MWNQPFIGAVVVTLRPISVFFATTDSGLALYIVLIFVHFIRKATTVVAET

SEQ ID NO: 123495 - protein, 156 aa, Glycine max
  Coding DNA Sequence Number=SeqID_31810
  Gene Ontology: Biological process=response to biotic stimulus
  Homolog annotation: Hit_ID=A7P031; Match level="QueryCoverage=96%, HitCoverage=76%, E-value=2e-57, Identity=72%"; Hit description =Chromosome chr6 scaffold_3, whole genome shotgun sequence
  Pfam annotation: Domain name=Dirigent; Domain location=1-155; Score =176.9; E_value=5.1e-50; Accession=PF03018.5; Description=Dirigent -like protein
MLGLDEKQEKLSHFRFYWHDVVSGRNPSSIEVVPPPLKNSTTSFGSVNMIENPLTLEPQLNSKLVGKAQGFYASTSQSEITLLMAMNFAITEGKYNGSTITILGRNSVYDKEREMPVIGGSGLFRFARGYAQLRTHWFSPTTKDAIVEYNIYVLHY

SEQ ID NO: 123496 - protein, 285 aa, Glycine max
  Coding DNA Sequence Number=SeqID_31811
  Gene Ontology: Mol. function=chlorophyll synthase activity; Cellular component=integral to membrane; Biological process=bacteriochlorophyl l biosynthetic process
  Homolog annotation: Hit_ID=A7QHN8; Match level="QueryCoverage=94%, HitCoverage=75%, E-value=1e-114, Identity=74%"; Hit description =Chromosome chr8 scaffold_99, whole genome shotgun sequence
  Pfam annotation: Domain name=UbiA; Domain location=17-281; Score =192.8; E_value=8.5e-55; Accession=PF01040.9; Description=UbiA prenyltransferase family
MNKWKIRLQLTKPVTWPPLVWGVVCGAAASGNFHWNFEDVAKSIVCMMMSGPFLTGYTQTLNDWYDREIDAINEPYRPIPSGAISENEVITQIWVLLLGGLSLAGILDIWVGTIHNSLMVVFYQKLDCVKFYFLDLHCISEDLDWFLTDRWAGQALFGTLTPDIIVLTLLYSIAGLGIAIVNDFKSVEGDRALGLQSLPVAFGSETAKWICVGAIDITQLSVAGYLLGADKPFYALALLGLIIPQVFFQFKYFLKDPVKYDVKYQASAQPFLVLGLLVTALATSH

SEQ ID NO: 123497 - protein, 159 aa, Glycine max
  Coding DNA Sequence Number=SeqID_31812
MSLSLCFLRLNVPCSYALKRKEEKELQMSPALYDLNVLYFTFHKTSLSFDFTSLVFASFPFTGPKLAQASLWLSRAPKRLQGEVTSSLGLANYFRSKHELAWHAREAEGRFQGLVLDGIERIKREEEERRGNEAEALPNPDCDQSLHCSSFGVLCMIID

SEQ ID NO: 123498 - protein, 150 aa, Glycine max
  Coding DNA Sequence Number=SeqID_31813
MSVLELYIEKDVAGGSMFHSANSLTSCGNYVSNDYTQPPTNMSNLNLDEDDDHDDDNYLVSNSYVEELLDEDDSVDGISDTDNEVPEMIPPQIASVATMTGNPLVKLAVSKTCTDSPAWVASSGFYGFASGTGVFLVTWEMLSKLAIAND

SEQ ID NO: 123499 - protein, 126 aa, Glycine max
  Coding DNA Sequence Number=SeqID_31814
MANKVCTMRNVLARWYRGNCLFSGATLPSFPTLNSSDAVGMGTYKGTPMLKLELCPKSFSFLDAFEVHTCPTGVWLRPRGIWLKLKAMTEGYFNYYRPLTYKFKNVSVDVTYVVLTSMLVGSCGGC

SEQ ID NO: 123500 - protein, 95 aa, Glycine max
  Coding DNA Sequence Number=SeqID_31815
MKHPSDHMACFKMDKVEQEIDMVAKAMVMQNPLEKVLTNTLECLTTEEEKEVQSCLKELEGEQESFPERMKVEELKRDRPPEEAKVELKTLPKHL

SEQ ID NO: 123501 - protein, 172 aa, Glycine max
  Coding DNA Sequence Number=SeqID_31816
MPSTVCRDRARKTSSGPGEVQKGSGVSSSGYGPLSVLQGVCRPQQGHQTSHHHSPCQKVLRPQASVGRGTTTAWGQSTVGSRRTATTSKVHLSSSTKAGALPTTRGRPAGGQPSGQVRADVKEALLGGNLELATKKLPAKQSRKGTIEEGSSAAPQADTSFDKHQFQSAEHQ

SEQ ID NO: 123502 - protein, 152 aa, Glycine max
  Coding DNA Sequence Number=SeqID_31817
  Gene Ontology: Mol. function=identical protein binding; Cellular component=cellulose and pectin-containing cell wall; Biological process=negative regulation of catalytic activity
  Homolog annotation: Hit_ID=A7QJ28; Match level="QueryCoverage=61%, HitCoverage=13%, E-value=5e-31, Identity=69%"; Hit description =Chromosome chr2 scaffold_105, whole genome shotgun sequence
  Pfam annotation: Domain name=Subtilisin_N; Domain location=2-62; Score=52.5; E_value=1.4e-12; Accession=PF05922.7; Description =Subtilisin N-terminal Region
MYPHKMLSSLLGSKEVAKNLILYSYKHGFSGFAARLTKYQAEAIAKFPRVVSVIPNGIHKLHTTRSWDFMGIHHSTSKNSFSDNNLGEGTIIGVIDTENNIRGNGEIVEKEEHQHNILVRRSIDEEVSEPYPSSLISHTHSFYFSLKLDSTF

SEQ ID NO: 123503 - protein, 122 aa, Glycine max
  Coding DNA Sequence Number=SeqID_31818
MVVVDDDESLSDHVLGSVFEYERVLYLFRFLVEAIDIKKIIRQGTLESVTTYLIGLNPLLKLTGINSDIRFGIGKSKDNSMHVQQGNELAKVAVSGMGLEASTLLTVTDLKGLSAVFHVTFP

SEQ ID NO: 123504 - protein, 307 aa, Glycine max
  Coding DNA Sequence Number=SeqID_31819
MEGLANPYVTTKGCFVKFLQQNENEMRPGDDVKLVDVSRSALETRAKHPPVVGKGVGILEEDNAHGRARSICFQCEGNSKIWSGKVRRDTLDKYHVSEILQLGLGENTLRLAQQELSINGGKTSFIVAGKEFGEIPNINRAWRAKKQDPSHQATRQWWARKTIFHRYCIESPASVKQGGKLPLKRKGVRFLEEVGEFVEERDDGQGCRLKGWRGCTLGWKWAPEGRADVPVRALRLIWEKGWVQSLWEPLGDGVLSIGLLVGLRPPISSYDSCLKGNWGGDEPFRPTQPLKGAIEAEEPGPHDKVLG

SEQ ID NO: 123505 - protein, 203 aa, Glycine max
  Coding DNA Sequence Number=SeqID_31820
MEFANHVQEKHDDLVGGVMSESVQEWKSNNKVQGKVLPDQSTCRQRLKQSGRLPGFILHLLTNGALGHIPSNALSHLELSYPNFVWGLSFVDLSILASRFTVLNANYSTKQGTIRCYDQEDKRYQERRTIESFPSFGLPGPPNNFKAKGLARLGKLQPPQGGLLPINRHPRGVLKGFKVQKLRELREERNKRKRGRGATKSRP

SEQ ID NO: 123506 - protein, 74 aa, Glycine max
  Coding DNA Sequence Number=SeqID_31821
MCFNGGSCQYKFKSLTIKYSWSRSGNIPDFVQAKIMQQKAWKMIEELEQHAQCIINHSARGANLEASSSTHLMA

SEQ ID NO: 123507 - protein, 167 aa, Glycine max
  Coding DNA Sequence Number=SeqID_31822
  Gene Ontology: Mol. function=helicase activity
  Homolog annotation: Hit_ID=A2ZKB3; Match level="QueryCoverage=86%, HitCoverage=32%, E-value=1e-22, Identity=41%"; Hit description =Putative uncharacterized protein
MDTGKAYCIRLTPAVMMQRGKKYMEQLYFDVMTICGQLGFPDLFLTFTCNPNWPEIERNVKILNLRSDERPDMVTKVFKQKLDDLINDLKSRQVFGQILGSIVNVNNSDGTQTQIHDEIKNYLDCRYVSPCEACWKIFSFLQHGRKPTVERLYFHLEDEHPVYFKGK

SEQ ID NO: 123508 - protein, 73 aa, Glycine max
  Coding DNA Sequence Number=SeqID_31823
MAEITLHFQAKRREVLAAGVSLSEACALSEWHPLSETLSSLSVLGNPKRGSVRDARPQRAASSLSESFVPSRA

SEQ ID NO: 123509 - protein, 182 aa, Glycine max
  Coding DNA Sequence Number=SeqID_31824
QVKVSVEEVTDADAPVPVPTNEVSLVGQALHTFLTWSTHLVKSLSQQLCLWQNHLQSPIRRHLTETCMRAGNSDIYGFLEPQSIQRSGQSQFESESYIKTWMQSSKRDVYLGAYLNGPDNYLKGIINSALNGLDDAPQPKSKAPARWIVVKYFNDPRPLEPERLKALRIQWAQFYLRVRDQA

SEQ ID NO: 123510 - protein, 323 aa, Glycine max
  Coding DNA Sequence Number=SeqID_31825
MASRKRKSIGSRPTTQYDTRRFHSLDAWNRYTDNVLGRNILPERKLELYHIELDDIKTELERRNFHKCLTNLIDGSIDLALVKEFYAKLYSSKGPSPKQARVRGHLVKIDADSLNTFLETPVVLAEGESLPIYSRYCKLPTNYREIEAALCIPGRGFILNAEGHPGRILRNDLTTLAQVWSVISYSNLAPTSHTSDMTVDRARLIFGLVSRMDMNSNSSRLGFPALIIALYRARGVVSDSLTFECLSPIINLAYIRKNCWNPDDLTVSIRGARKARARPTELPSTSAALTPAAPSVPAQSDSQRFEAMLQSIHQGHIILLQSL

SEQ ID NO: 123511 - protein, 67 aa, Glycine max
  Coding DNA Sequence Number=SeqID_31826
  Pfam annotation: Domain name=zf-CCHC; Domain location=1-18; Score =8.7; E_value=0.073; Accession=PF00098.14; Description=Zinc knuckle
MECHHCGKYGHKQPKFTDLIIYMAITHDLKVSHTAATEDGIVKMRALKEKDGSQLEDQGKLVHVGYF

SEQ ID NO: 123512 - protein, 212 aa, Glycine max
  Coding DNA Sequence Number=SeqID_31827
  Homolog annotation: Hit_ID=Q2HW90; Match level="QueryCoverage=66%, HitCoverage=33%, E-value=4e-12, Identity=28%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKVVKISAQELDRVKQNRNGVVGVPRKFVLFPNMEGLVDLAAIDAFLAFHHGKESPVVAILAMYDTFDRGCPSIRYKVTARASKRERESRTSPIASQGQSSGRHLLRPRGDPRISQLLSAYDRLNGPYD

SEQ ID NO: 123513 - protein, 86 aa, Glycine max
  Coding DNA Sequence Number=SeqID_31828
  Homolog annotation: Hit_ID=UPI0000ECBAF8; Match level="QueryCoverage =47%, HitCoverage=48%, E-value=1e-16, Identity=100%"; Hit description= UPI0000ECBAF8 related cluster
GADTARRSRTTERSESVSEEAEERPIRKPPLPARMQAWHWPSFYNVVTGKTLALPNLIALQHIPLSPAGVIAKRPAPIALPNSCAA

SEQ ID NO: 123514 - protein, 59 aa, Glycine max
  Coding DNA Sequence Number=SeqID_31829
MLVTHVWAIQQASAKDPGRSVHSAPHDHKQHPTYERAQKLVPKTLEEKSACNRDKRISS

SEQ ID NO: 123515 - protein, 160 aa, Glycine max
  Coding DNA Sequence Number=SeqID_31830
AWQYIPEGFTAGGNNARVGGDARDGKNARQAFYFRHVGGIQMPITMLVFGRQLAVILTAIFGRGTFCVFAKETAEIVAVFIEPDVPGLLKKMGKIVGGNIKRLGNGISGETRPFWDLVWQPAAVVKGHYPGGAEAGNVPLIRSVRMCVISWYMRWEPGFA

SEQ ID NO: 123516 - protein, 87 aa, Glycine max
  Coding DNA Sequence Number=SeqID_31831
  Subcellular localization annotation: CTP_CleavageSite=42; ConfidenceScore=5.31e-01
MVILSLGGPIQAHNISRRSKMNSGSSREILNGDNFSLGGPIQANNISRRSKMNSRSSRETPNGCENKTTMDTLEPYTGAMKGTMHKP

SEQ ID NO: 123517 - protein, 128 aa, Glycine max
  Coding DNA Sequence Number=SeqID_31832
MLVSTRQRARFPWLTIGAGRQNGAEEDVSLRASTGSFAPRLTKGASNHKVTRMSPDFTGQDDKRVRTNKGCRRRCQSPRVNALVSPWLTKGEGRQKVKKTMLVSTPQRARFPWLTIGAGNHKVTPHVT

SEQ ID NO: 123518 - protein, 191 aa, Glycine max
  Coding DNA Sequence Number=SeqID_31833
MSHHSTSVNDEGTSHKDPLSRILDELSSLKLWKEKQERKEKGIKRVEEICQDERKKIREEERRKIMKEMKREKRASYNSHNSCKSLSEELRDYYEGRHRSHLRPHSHRREKERKPQEANIKLSYFHGKDNVEANLDWEIRVEQQLKKKSTSKSYGSHSYPKKDQGQGILGVTPSKPKDDKGKTIEKQDPKA

SEQ ID NO: 123519 - protein, 234 aa, Glycine max
  Coding DNA Sequence Number=SeqID_31834
EEEAQIGADRSSATSNKSEIYKEEARNAAQKHKPKRVKSVNVDAEAFAEALEHTKKRDTGHQSVSLENKTGDSTVLKIGDSAKVVIKQNMKGRKHKYGFNNNKREKTEKKRVVDDETGDKHELYEKITLDDVNQFSFIMIISISMNVVSFFFSDNFTSDLSSQRTNIGVHVYQRKSYIIGAHTGVAVNPFTFENTYRKFHIFKLPNFINEPKVRDRSYTGIGVIDTCKVLRFSP

SEQ ID NO: 123520 - protein, 174 aa, Glycine max
  Coding DNA Sequence Number=SeqID_31835
  Gene Ontology: Mol. function=peptidase activity
  Homolog annotation: Hit_ID=A5BP60; Match level="QueryCoverage=94%, HitCoverage=68%, E-value=2e-14, Identity=30%"; Hit description =Putative uncharacterized protein
MASTNFLFPEGNSINRLPIFNGEGYHYWKTRMQIFIEAINLNIWGAIEIGPYIPTTVERITIDGSTTSESITLEKPRDRWMNANESIQDMQKRFTHIVNHLAALRKEFQNEDLINKEHEMELLRLNQHEENDKKKKGISLKASSSIQEESDKEIDLDEDDDLSLFVKRFNKFLK

SEQ ID NO: 123521 - protein, 170 aa, Glycine max
  Coding DNA Sequence Number=SeqID_31836
MAEVSTEAIASLAQYYDQLLRCFTFGDFQLSPMVEEFEEILGCPLGGRKPYLFSGFYPSLARISKIVQISAQELDHRKGVLFPNVDGLVDLAAIDAFLAYHDRKESPVVAILDDLYDTFDRRCEKSSTRIVCCTPTLYHAKKECLSTGSLDGKKEEPGFLFRAEDFQMFP

SEQ ID NO: 123522 - protein, 104 aa, Glycine max
  Coding DNA Sequence Number=SeqID_31837
MTRRDKIWSFCTLVSSRGGGPDDKQRPMWSFCTLVSSRGGGPDDTRRYLTVIRTLLSSRGDGPDDKQRPMWSFCTLRQSRPTSPLTCGDLHHLPHLQDLSQGIL

SEQ ID NO: 123523 - protein, 83 aa, Glycine max
  Coding DNA Sequence Number=SeqID_31838
MYPKAHENPKAYLWISGPTYLESFIRCPCGVGLHHSLHLGKDLTSNPKVFHTLGSFPEHLKVRSENPFLGHLPMKEHGSSPCQ

SEQ ID NO: 123524 - protein, 28 aa, Glycine max
  Coding DNA Sequence Number=SeqID_31839
MAMVVGCNDSEGAIGEEEKETKRGKLWN

SEQ ID NO: 123525 - protein, 57 aa, Glycine max
  Coding DNA Sequence Number=SeqID_31840
MVAEWRRKRERRHHFKEKMSLEEAHYHRRPWIRAWRKKEMTEPINPRSIPRFSTKCA

SEQ ID NO: 123526 - protein, 223 aa, Glycine max
  Coding DNA Sequence Number=SeqID_31841
  Gene Ontology: Mol. function=motor activity; Cellular component=cell projection
  Homolog annotation: Hit_ID=UPI00016621D1; Match level="QueryCoverage =93%, HitCoverage=40%, E-value=2e-19, Identity=33%"; Hit description =UPI00016621D1 related cluster
GLHALTFRALHVLTSRGLHALTFRGLHLLTFRGLPVLTFRGLHALAFKGRHILNFSGLHALAFRGLHVFATRGLHILTLRGLHAFAFRGLHTLAFRGLHALTFKGRHILNIIGLHAYAFRGLHVLAITGLHVLTFRGLHALTFRGLHVLTFRGLHVLTFRELHALAFRGLHVLTSKGLHALTFRGLHVLAFRGLHVLTFRGLHVLSFRGLHVLAIRGLPAGIL

SEQ ID NO: 123527 - protein, 135 aa, Glycine max
  Coding DNA Sequence Number=SeqID_31842
MQSQGLALPLELKVGPSTTHVSTKGSCVDPSPTDPETGDSNKCGLYIEENPSRQVALGRFYEGSTVVHNIPLLHGQVKIGVEEVKDAKALVPVPTNETAVSPAKPPDRPNAEVDDPLYLMTLTIPRLFLKPLQVM

SEQ ID NO: 123528 - protein, 323 aa, Glycine max
  Coding DNA Sequence Number=SeqID_31843
VDSRGSPGGYSAEFEIPEASDSRMKKKLLQTVDERLRQFKLDLTRKWALVANQDGVDDTVCEKYDISKEKWAQFCQTRRDPSWEDVRKKALAIQKQNTAPHVLSREGYEYLEQKLLAEKTKKKLEEALMASSTLHPPEMTTEAAKEIAERSIPLRSRRHRDPSSPMDHPGRVRAAGAGVTIKQYFGSAPRTSHSSSSLPPEELQQLTQQIRDQLEESITEKVTRQLMASFSQMQSQIQSHMQSQGLALPPKPLVGPSGPHVSTKGSCVDPLGNDPETGDSNRCGLYIKANPNCLIALGRVYEGSTIVHNTPLLPGQVKVGVEE

SEQ ID NO: 123529 - protein, 337 aa, Glycine max
  Coding DNA Sequence Number=SeqID_31844
MAKFDPEIVLEFYANAWPTEEGVRDMRSWVRGQWIPFDADAISQLLGYPLVLEEGQECEYGQRRNRSDGFDEEAIAQLLCIPGQDFAQTAAGKRVRIMRTNMTTLTQIWMTLLLSNILPTDHNSDLPLPKCQLVYAILTRMSIHVAQLIADAIYIFAGMAPTRNPLDPDKSNRALGFPALITGLRQSFGVPVTPSKVIRPPITRAFIEKYYTQRQVQGVCTTGRGRAATFIRLAQPDCLIQSSICGIWFASRRPTHRAHVQTHDCLYQMSLSLQSQGFTSFPCPTPDQFRAEVAWPGDWPEAQAGEAPAEAPDEADEAREDEEMTDLLDFLGGSGAT

SEQ ID NO: 123530 - protein, 128 aa, Glycine max
  Coding DNA Sequence Number=SeqID_31845
  Homolog annotation: Hit_ID=Q5NRP4; Match level="QueryCoverage=33%, HitCoverage=2%, E-value=2e-08, Identity=58%"; Hit description =Putative gag-pol polyprotein, identical
  Pfam annotation: Domain name=Retrotrans_gag; Domain location=50-124; Score=3.9; E_value=0.022; Accession=PF03732.8; Description =Retrotransposon gag protein
MSLHSSSSVNGEGSTPTDPLNNILDELRSLKFWKEKQADLKEKEGSRHSSIVVKRRLLFLPLVEVKRSKGESKIHGDPPVEYWNDLKSALRKRHIPSYYERELIDKLQRLRQGSMSVEEYRHKWNYSF

SEQ ID NO: 123531 - protein, 93 aa, Glycine max
  Coding DNA Sequence Number=SeqID_31846
MDGIEELDHSRYQATQRPTQDQMNKIASSTGGERTWANLGLGCKPRPRSLLSLDYNESKAGRLSYLELGRIPVAVLRLERHKNSTGELSQKYP

SEQ ID NO: 123532 - protein, 89 aa, Glycine max
  Coding DNA Sequence Number=SeqID_31847
  Homolog annotation: Hit_ID=Q2QTD3; Match level="QueryCoverage=49%, HitCoverage=4%, E-value=4e-07, Identity=56%"; Hit description =Retrotransposon protein, putative, Ty3-gypsy subclass
MRRSIANVSPSETSNLLQKEVKFDFDDRCKETAFDCLKRAVTTTPIIHGPDWTAPFESNGVWSPCRSKLHDDESSMNQVVLMMTKSPKE

SEQ ID NO: 123533 - protein, 183 aa, Glycine max
  Coding DNA Sequence Number=SeqID_31848
  Pfam annotation: Domain name=Transposase_23; Domain location=5-75; Score=-2.1; E_value=0.002; Accession=PF03017.5; Description =TNP1ENSPM transposase
NDPETGDSDRCGFYIEADPTRLVAIGRVYEGSTVVHNTPLLLGQVKVSVEEVRDADAPIPVPTDEVSLVGQALHTFLAWPTHLVKSLSQQVVVSPPKPPPKPDPEVDDPLYLMTLTIPELFLRPYQVRWDATMFGVVNPDFPLYIKHEDLSEIAHGGQCLSISGLNDAPHPKSKAPARWIVIK

SEQ ID NO: 123534 - protein, 346 aa, Glycine max
  Coding DNA Sequence Number=SeqID_31849
  Subcellular localization annotation: CTP_CleavageSite=31; ConfidenceScore=5.02e-01
VDSRGSPGLSTHAGDDRAGENSRILMPLLPCAGAAPSRSRLPWPSRVQARPAARAPATPAASRRGRTAQTPRSGHPRRLRAGLPPSRARQAAGRRVARDVARERVRPREQHVQREQAAIGMPPQVFASVVDRGAAAHQRLDPFAQEGQELVRAASLAAQHHRIRLARALLEHGRRVVIGARHHVVARRHVVAHGHQHRRPARAQPQQVGIGQRGQRRVAVEHVQHRAAAGRRGLARHGDLDAVVALAIGRIEPVRFKAIDRRRPVRHGLADKLRAARDRRARIVRRRSLRLRTGAPENPAEQGGLAKAEQDTGDIGFSGLRVPQGTSPSAEWNTVRHAATAAPAAA

SEQ ID NO: 123535 - protein, 107 aa, Glycine max
  Coding DNA Sequence Number=SeqID_31850
  Subcellular localization annotation: CTP_CleavageSite=74; ConfidenceScore=5.02e-01
MVSRGIIPFKKHIATVGTTSNNMLSKRKTLDEGSLLSSKSETRHDHRFTSTPYVPMDPVPSGVANCRNLPFGGRAMQDSRVRLPRKEDVRSHHQRLFEENVGKTGKV

SEQ ID NO: 123536 - protein, 172 aa, Glycine max
  Coding DNA Sequence Number=SeqID_31851
  Homolog annotation: Hit_ID=Q949K7; Match level="QueryCoverage=38%, HitCoverage=77%, E-value=3e-08, Identity=44%"; Hit description =Putative gag polyprotein
YKGHLPQNHLRCMSKDGGIRKDEELLIHSFQESLTGVVVTWYTNLESSRVHSWENLMVAFVRRCRYNGFGYDATTKHTLLGLKRGTFSHLTGRNEKTYGGKEDWVRMKEKPMHVTAKFLIQHKSSHQPTMVISSANNKPSPYPPPNVVLHKGKSLNSEPQPLCLSTAFPMGN

SEQ ID NO: 123537 - protein, 116 aa, Glycine max
  Coding DNA Sequence Number=SeqID_31852
  Homolog annotation: Hit_ID=A0PAV3; Match level="QueryCoverage=32%, HitCoverage=17%, E-value=5e-07, Identity=76%"; Hit description =Restriction endonuclease
MVKVGTSYVPINVSFSPKVGPGLPGINRDTRIYLFCEVIFRHSGFCFYQLSLPVQLLTGVVRNGKSTAGHQRWQAAQLLGRAIGAGLFAITPAGERGMCCKAIKLGNARVFPVTTL

SEQ ID NO: 123538 - protein, 146 aa, Glycine max
  Coding DNA Sequence Number=SeqID_31853
MTGIRLFEFIDARFAWSAKGGENGTQLRNQTVIYVIIKKGEIVDAIGFDVFTEIVMIDGQLVGNAKAFKIKITGQDTLPYPHLITLFLRHFQIPLDDEPFVQVKRSFAIGAGAVTSFGYRKDRNGQWLKKDALPPQDERTPSLPST

SEQ ID NO: 123539 - protein, 172 aa, Glycine max
  Coding DNA Sequence Number=SeqID_31854
  Homolog annotation: Hit_ID=B0HC01; Match level="QueryCoverage=19%, HitCoverage=70%, E-value=4e-11, Identity=100%"; Hit description =Putative uncharacterized protein
MRKRTLPEGRKADRYPVSGRVGTGERTRELPGGNAGIFIVLSGFATSDLSVDFCDARQGGGAYGKTPATRPFYGSWPFAGLLLTCSFLRYPLILWITVLPPLSELIPLAAAERPSAARNSYDHDYEFELGTRDWPKAQAGEAPAGAPGDAEEARMDEEMTDLLGFLGGSGAM

SEQ ID NO: 123540 - protein, 67 aa, Glycine max
  Coding DNA Sequence Number=SeqID_31855
ANNILMAFNLATGACGSNDFQDYFDDAKESRVKQVPKSQESKSFKNQVSKNQDSRTIKFQESRFKNQ

SEQ ID NO: 123541 - protein, 153 aa, Glycine max
  Coding DNA Sequence Number=SeqID_31856
MVEEFEEILGCPLGGRKPYLFSGFYPSLARISKIVKILTQELDRGKQVENEVVGVPRKFSEAKAKVLASQDEWAPFMDTLPVFYYEKLVGYMPSSFADLVFAGERIEVGLKREKFDYVSPIGANNRRTGIAGAKKKERDAHTVTSHMHGPSHP

SEQ ID NO: 123542 - protein, 144 aa, Glycine max
  Coding DNA Sequence Number=SeqID_31857
  Homolog annotation: Hit_ID=A6FJQ2; Match level="QueryCoverage=26%, HitCoverage=84%, E-value=3e-11, Identity=92%"; Hit description=50S ribosomal protein L5
MTVKTSDTCSSGRRSQLVCKRMPGADKPVRARQRMRKEKIPHQAPFAIQAAQLLGRAIGAGLFAITPAGERGMCCKAIKLGNAREHIELKLASHGRKVEKFGRLAREIEGIAFHAFDALDVDQVMDLLVEGTELEFVIMVIAVS

SEQ ID NO: 123543 - protein, 25 aa, Glycine max
  Coding DNA Sequence Number=SeqID_31858
NDFSIFDLNLKTQKELVLQDRMKTH

SEQ ID NO: 123544 - protein, 132 aa, Glycine max
  Coding DNA Sequence Number=SeqID_31859
MKIVISIPLINCDFTEGGHYQDSYYFYSINKSDWRQELTMYNYHEKGRAPNLESVLADFMTYQASSKGDGYSMHQQETQFEKDYSLADYQWDSEWQPYYHNEAEGLSNLDDLLMQFKGTVDLMQQAFKRAET

SEQ ID NO: 123545 - protein, 110 aa, Glycine max
  Coding DNA Sequence Number=SeqID_31860
  Homolog annotation: Hit_ID=A6FJQ2; Match level="QueryCoverage=34%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVDSRGSPASMEGESLSFNEGKRCHPLGNKELHHQQNALDKKLREEAPMEKNNEREEA

SEQ ID NO: 123546 - protein, 109 aa, Glycine max
  Coding DNA Sequence Number=SeqID_31861
  Homolog annotation: Hit_ID=Q6L477; Match level="QueryCoverage=56%, HitCoverage=10%, E-value=2e-07, Identity=32%"; Hit description =Putative uncharacterized protein OSJNBa0009L15.8
PPGAERPVVRVDPATGKVDGPHRKKLRTYLGIVARDKVDVTYENWKEVPTAQKDLIWEDIHAEFEIPKASDSRTKRKLLQTVGERWRDPSWEPKLLAEKTKKKLEEVVQ

SEQ ID NO: 123547 - protein, 112 aa, Glycine max
  Coding DNA Sequence Number=SeqID_31862
GYNVQIHELHHKLYILQPAKWKNVKFMQNEAELATYLVFLLVSLVAWTTTCFVPTEHLVRNPSTEAEFPTWLAVSVENENPNLIFRFLSRLVWMCTSKDKKESSSDATRNPW

SEQ ID NO: 123548 - protein, 103 aa, Glycine max
  Coding DNA Sequence Number=SeqID_31863
MAYERGGDFLEDARKILNREAFPPGGSLVRSPVPAFRFTGVIPLLWPRLSHSTPDTQFREGSSLQAGLYARTPRSVRPLRLIRHAPVKAKLKGQVLVTALLQA

SEQ ID NO: 123549 - protein, 85 aa, Glycine max
  Coding DNA Sequence Number=SeqID_31864
  Gene Ontology: Mol. function=phosphoprotein phosphatase activity; Biological process=intracellular signaling cascade
  Homolog annotation: Hit_ID=A7PHV0; Match level="QueryCoverage=90%, HitCoverage=23%, E-value=3e-19, Identity=50%"; Hit description =Chromosome chr13 scaffold_17, whole genome shotgun sequence
MFVWEPYTATVISLLPPICVVRSVAWCAVVPLVCFQVIEWHQPDRVLRQFGMQQPIPESPAQPLNIHGITLKGKYDENWGNCSSQ

SEQ ID NO: 123550 - protein, 205 aa, Glycine max
  Coding DNA Sequence Number=SeqID_31865
  Homolog annotation: Hit_ID=Q6WAY3; Match level="QueryCoverage=94%, HitCoverage=9%, E-value=3e-07, Identity=24%"; Hit description =Gag/pol polyprotein
METCLGVEELLQRMIDQGRLEVGSEGKEEQHICMQSTDGSSVAKSKPLVICFTKSVASQKPGHPLVAKPVPFPYQSSHTVPWRYTPPREKEEEAIDDSSLSAKVTNITGLSGVTRSGRVFVPPDLPVQPADVKGKGKVVEEQDGEAPHASNKDIPAKGLPEKKDGKKEVSLEEASEFLRIIQQSKFKVIEQLNKTRPGSRCWSYL

SEQ ID NO: 123551 - protein, 145 aa, Glycine max
  Coding DNA Sequence Number=SeqID_31866
MNRKAGSKYYREIETMRRMRRRRTVETFARFLTENVTETFRKRLGLDFLHGNNFSKQIQQREKCLRGWTISFFPSSPIYSKIGEVVAAQLAQASSARPGEQGCFLQKQPPSGGIFWRAQMGLGAICTPIFTKYTPSAVFLVILFS

SEQ ID NO: 123552 - protein, 167 aa, Glycine max
  Coding DNA Sequence Number=SeqID_31867
  Gene Ontology: Mol. function=triacylglycerol lipase activity; Cellular component=monolayer-surrounded lipid storage body; Biological process=triacylglycerol catabolic process
  Homolog annotation: Hit_ID=A7PVQ6; Match level="QueryCoverage=53%, HitCoverage=10%, E-value=1e-41, Identity=91%"; Hit description =Chromosome chr8 scaffold_34, whole genome shotgun sequence
  Pfam annotation: Domain name=Patatin; Domain location=12-150; Score= -28.3; E_value=0.0024; Accession=PF01734.13; Description=Patatin-like phospholipase
MRKEKIPHQAPFAIQAAQLLGRAIGAGLFAITPAGERGMCCKAIKLVVKRVTTYGAVHEIRQLQMLLRHLTSNLTFQEAYDMTGRILGITVCSPRKHEPPRCLNYLTSPHVVIWSAVTASCAFPGLFEAQELMGTELEFVIMVIAVSCVKLLSAHNSTQHTSRKHKV

SEQ ID NO: 123553 - protein, 78 aa, Glycine max
  Coding DNA Sequence Number=SeqID_31868
MVLSFFLTHLLLELAYPIIFFSILLPFIFKKQRNPLMKNNQGLQAPHGATSCGIKNIFIQVKGKCLLFLYLFVLVNSL

SEQ ID NO: 123554 - protein, 96 aa, Glycine max
  Coding DNA Sequence Number=SeqID_31869
MAFLSQLKLRFRTDIMEKRKKFSSEASYSIFKELSSRFPLFPAALSLVRGGSKVECSGEGEVSGVKLCGGRCRQTRYADGVCASRTYGWLPDQVDP

SEQ ID NO: 123555 - protein, 66 aa, Glycine max
  Coding DNA Sequence Number=SeqID_31870
MKGRTSTSSFQMNTQGKHGAKLNINHSWCIKLTRQDFLEVSVFGEEAGCFGLFLFVHVGWDIASQE

SEQ ID NO: 123556 - protein, 96 aa, Glycine max
  Coding DNA Sequence Number=SeqID_31871
MAYTHIPDSTSDSPQISASPYQLDLAPYASEPYNAQRNAPGLLRDKHTLRSSRILGEMEVDEPWLGLWLPLNYQVVFVIGSAVDRLCGRFRDGLCG

SEQ ID NO: 123557 - protein, 99 aa, Glycine max
  Coding DNA Sequence Number=SeqID_31872
YVGVQIAPPLGLRPPQEIGVHGGSLNVSARWFKNKMTRLGDGRNALTFSPFAKIREKKFKSPEALPKRFRNVFREESRKGLNRSSTFFIRSSSFFDLQR

SEQ ID NO: 123558 - protein, 114 aa, Glycine max
  Coding DNA Sequence Number=SeqID_31873
  Homolog annotation: Hit_ID=Q3BKH8; Match level="QueryCoverage=43%, HitCoverage=65%, E-value=1e-12, Identity=72%"; Hit description =Putative uncharacterized protein
MFQEWAVAIKAVRELGSERRETVRSISGVGVRALRGPFPSTRGPGRTHLWCASYRAHGKRWVANAGRSKEVGDLMNSGEPTTEAPVNGGRNYNGPKVAKFLVGHYPFSLQLWTT

SEQ ID NO: 123559 - protein, 106 aa, Glycine max
  Coding DNA Sequence Number=SeqID_31874
FYQVKVKSLGITSLKELGQLMGQPQRQAFRKTYDKIWDLAMVEVSTEAIASLAQYYDQPLRCFTFGDFQLHPWSLAGEANGPVIMLGTLATCLIFGVNPLSFENVD

SEQ ID NO: 123560 - protein, 481 aa, Glycine max
  Coding DNA Sequence Number=SeqID_31875
  Gene Ontology: Mol. function=transferase activity; Cellular component= cytoplasm; Biological process=flavonoid biosynthetic process
  Homolog annotation: Hit_ID=A7QLD4; Match level="QueryCoverage=98%, HitCoverage=51%, E-value=3e-75, Identity=38%"; Hit description =Chromosome chr11 scaffold_118, whole genome shotgun sequence
  Pfam annotation: Domain name=Transferase; Domain location=1-475; Score=270.9; E_value=2.6e-78; Accession=PF02458.6; Description =Transferase family
MKTIVASYNITPNQPTPKDPLWLSDSDQIGVLGHVSILYIYRSAKEHNNNTVERMKNSLSKLLSYYYPVAGRLRLSKSGRMELDCNAKGVTLLEAETTNTFVDYGDDFSPSEFTDELIPKLDDTQQPIEEIPLLLVQLTRFHSGGDCEGLAIGVLLSHPLTDATGIIDFMNRWAKLSRGEELDPNEIPFLDRTLLKFPDILLEKPREVNTREISKLDTSTLQHIPTSKLLDQWKKPVVPQTPEDDGIDKPKKRSGAMLKLTSSQVERLKNKAMANNHQSSKQGSRPNYSRFEVVAAHIWRCASKALGDDLTQVRFSVNFRNRMNPPLPHNYFGNAVANVATPEGDIISNPLGFAAHKIREASHAVTDEFVKSQLNVSRLGQVQLDNIRAFFMRQGHRVNIPYALNHNVLFLTSFTNMPVYESDFGWGKPVHFGLASRSPADRAAILPSPDGDGVIVALFFQTALMQLFKNYFYEDMYLSLL

SEQ ID NO: 123561 - protein, 51 aa, Glycine max
  Coding DNA Sequence Number=SeqID_31876
THLLLEVASPLSLPSPFCYHSSSKKQRNPLMKKILGLQAPMELTSTKPLNY

SEQ ID NO: 123562 - protein, 180 aa, Glycine max
  Coding DNA Sequence Number=SeqID_31877
MGDQEETQEQMKVDMSALKEQMASMMEAMLGMRQLMEKNVATAAAVRRNTLGHNNNPHLGYNRAAYPYGLPPNYLPPVMQDDAGHISSPILEREPPQQPEEVHEDPQDYARRDVEFYPPIPEGSAPNTLPQPNLTAHPIVLSTEEPPPATEERRKLDLLEERLRAVEGFGDYPFADMTDL

SEQ ID NO: 123563 - protein, 101 aa, Glycine max
  Coding DNA Sequence Number=SeqID_31878
MDTPRNQLLSHVYPPKKMKSEYGIKDRKSKGERSGRVMHYCGKYSWDTLHNSPRVYRLFNSTWQPEQSMELNVVVDVVSSKKEEMWVQRRLFSLVSTSGTM

SEQ ID NO: 123564 - protein, 62 aa, Glycine max
  Coding DNA Sequence Number=SeqID_31879
YPRLQRTIRPHLQRATRPHLERTTRPRLERTTRPHYQRAARPHLQRTTCPRLERATRPHLGY

SEQ ID NO: 123565 - protein, 122 aa, Glycine max
  Coding DNA Sequence Number=SeqID_31880
MMLKDQVLLSFIQDKNPRKSRYMIKLISRILGRSFQTEEAKGLTKEFYPFKLRFALWIKRLRVLIVKREIHATQGRTGCILIVCSLSHARCPSFPSVKGALRYQIVAFRHDLVGGNLLGENF

SEQ ID NO: 123566 - protein, 254 aa, Glycine max
  Coding DNA Sequence Number=SeqID_31881
  Homolog annotation: Hit_ID=A5C169; Match level="QueryCoverage=68%, HitCoverage=15%, E-value=9e-07, Identity=26%"; Hit description =Putative uncharacterized protein
  Subcellular localization annotation: CTP_CleavageSite=38; ConfidenceScore=5.61e-01
MAESSKKRKVSSTSTAAHRTSRPGATGASQAPIPPSLSSSTLFSSYEQRIRNSSIFQSHQILDPKYLDLEFFDGETFDCYQVFQNTGLIPFMSLKLPYPELVRVFYSNLKIQDGTLIFEVHGIPMIIDESLFFSLTQLPSQGAPFEGTLVDQWKFDYSSHDARRMVCIDQADMANRLLVGSLTFDCRIMHYIIVRILMPCSSNLAQASEEDLILMWDFLTGHPIEWAHLIHYCMHKALRSSAPLPYPQLVTLFL

SEQ ID NO: 123567 - protein, 157 aa, Glycine max
  Coding DNA Sequence Number=SeqID_31882
MSWKRTHYFSMPTKKTMIMRGQDIYSSQDRATISPSSSESEEAKGEESSEEIYPQEEGQPLMVKDECKEVSVSSKRLVKMESHFAIKTNIKETSPLRQPPHLLLCKKTLVSTAIPLGFEVIAQVKELLYRGLVHKSLNPCALLVPKIGIINMKIHKK

SEQ ID NO: 123568 - protein, 155 aa, Glycine max
  Coding DNA Sequence Number=SeqID_31883
MDTLCSHRVLLDAIRDLTQSRTYAWGNTTLVHKHDNLNEASKSRTRLFAGYISLLQCWIYEHFSSIGSTIDADDYDERRPHACRWTSGKALPVSTYDYMEWFYMISHPFMTPAQPEDPPRVSSIQQYDTFVELDVTQQPVVAATPDELDVDVHHP

SEQ ID NO: 123569 - protein, 90 aa, Glycine max
  Coding DNA Sequence Number=SeqID_31884
  Homolog annotation: Hit_ID=A6H595; Match level="QueryCoverage=66%, HitCoverage=74%, E-value=2e-17, Identity=70%"; Hit description =Putative 23S ribosomal RNA
MGDKLHRREGNSPDHQLRPLNDRSVIKEVGVQRQPGELYKCRAARRSSRECCTLDGESPVAESITSLRSDPSSMGHVESRVNQQGPTLQG

SEQ ID NO: 123570 - protein, 72 aa, Glycine max
  Coding DNA Sequence Number=SeqID_31885
MPIGWTSQKSGANTEEEEPTDLSSNPLQGGGDDAILPRKGPVTRAMNKRLQEDWARAAEEGPRVFMNLMVDF

SEQ ID NO: 123571 - protein, 62 aa, Glycine max
  Coding DNA Sequence Number=SeqID_31886
MGLKAETDQGKMVTRPQFATRCRFLLSGSGLRPKLYSEKIGHATLPPFPCYSILNMRPPSAR

SEQ ID NO: 123572 - protein, 95 aa, Glycine max
  Coding DNA Sequence Number=SeqID_31887
MLKNGRESSRNYSRNVTETLRKRLGLDFLHGNNFPQQFRENEKCQEGRTPSPFTPPPIYSKIGEELATQLGQASSARPGEQGCFLQKQQPSGGRI

SEQ ID NO: 123573 - protein, 21 aa, Glycine max
  Coding DNA Sequence Number=SeqID_31888
MTASLCKGVMPENHYAGHRGE

SEQ ID NO: 123574 - protein, 68 aa, Glycine max
  Coding DNA Sequence Number=SeqID_31889
MNHSLRSNDHLLLVLVLLPPLDTERMWMANEDLQAFVGDSFDAMESRITRLEDDTSFICRCFDPLADP

SEQ ID NO: 123575 - protein, 125 aa, Glycine max
  Coding DNA Sequence Number=SeqID_31890
MDSMMEAMLGMRQLMEKNVATAAVVSSAAEVDPTLLATTHHPPPNAVGREKSTQGHNNNSHGGKGRSRGGGQSHAQVYWKMLRFYPDPVEGDRPRHIPQAGNLTCGTGPILLCTLNGSQGPLPCC

SEQ ID NO: 123576 - protein, 105 aa, Glycine max
  Coding DNA Sequence Number=SeqID_31891
MRQNLVILHPLSSRGGGPDDTQRQNLVIPHPFAIQTQSCPMRQNLVILHPLSSRGGGPDDTQRQNLVIFRTHKICHTDFGVTLTGGNTRVVIRINILLLSVRQNA

SEQ ID NO: 123577 - protein, 120 aa, Glycine max
  Coding DNA Sequence Number=SeqID_31892
MLKMGDSAKVVIKQDMKGRRHKYGFNNNEREKAQKKRVVDDETADKHQLDEIMGSPPASTTPPPLPPPPPSPPPPPPTSDASASTSAVKRTHKASRLRSLSTRPPGVERPVVHVDPATGK

SEQ ID NO: 123578 - protein, 52 aa, Glycine max
  Coding DNA Sequence Number=SeqID_31893
MKPPILPSRFLRDCCCMRFMLLEDLRNVNLGHEFIWGVVIMLDIPRGGNRVF

SEQ ID NO: 123579 - protein, 149 aa, Glycine max
  Coding DNA Sequence Number=SeqID_31894
  Subcellular localization annotation: CTP_CleavageSite=28; ConfidenceScore=5.62e-01
MPGANLLAMGSSSDSTSSRSMRSPGAGRASAFGAEDVGTSLSTSGTETFGVEDVGTSSSASGTDAFFRMLLTILRIFLSISVSTSLGLVARLGFSEIFTPCCRLGTSFSGTGAEPGIICMGWIWNSGCSWIDGALVDDGDDGTEGEGIL

SEQ ID NO: 123580 - protein, 178 aa, Glycine max
  Coding DNA Sequence Number=SeqID_31895
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=100%, E-value=3e-21, Identity=33%"; Hit description= UPI00006A17C9 related cluster
  Subcellular localization annotation: CTP_CleavageSite=12; ConfidenceScore=5.23e-01
MRTRSPLKVRACSALKARMCSPLEVGACSPLLARTCSPLKVRACSSLLARTCSPLKVRAYSSLLTRTCSPLKVRACSPSKVGTCSPLMARACSPLKVRTCSPLRACSPTKVRTCSPLMARACSPLKVRTCGPLKVRACSPTKVRTCSPLMARAVSPMMARTCNPLKVRAWPPLKMGNM

SEQ ID NO: 123581 - protein, 168 aa, Glycine max
  Coding DNA Sequence Number=SeqID_31896
MWRHLDDSSASCCRQHAWSLVVKAKVTNVCFISGNHTAWKPAPRWKSYFNSSWTGGSSKCPSTPPTAPKPTSFSYQSNKAVPWKYTPPAFGERAATEVLLAKVTNITGLSDVTRSCRVFAPPHSAEFPSKGKAPMIQEPADVATPSKEVDPPMVKGAEKKEGLQGGIL

SEQ ID NO: 123582 - protein, 44 aa, Glycine max
  Coding DNA Sequence Number=SeqID_31897
VSYELYNHTTIRPFKGEELMLRPFKDDELMLKPFKGDELMREEY

SEQ ID NO: 123583 - protein, 195 aa, Glycine max
  Coding DNA Sequence Number=SeqID_31898
MLGHTQDRCFKLHGYPPNYKRTSFSLEVKKHSSSSEPPHKVAQQVSVDMSDSPSSSGDSGSQFQLTAHQYSQLMNLLESHATNVVIPQGVSSASDSGASIHISCSLHHFQSYQLVFDKIVTLPNNDVIPIIAIGSEKPACKRIGRGALIQGLYVLDLKDTLDCKFTFPVINSHTNSIPCKNAHIWHSRSGHISDK

SEQ ID NO: 123584 - protein, 105 aa, Glycine max
  Coding DNA Sequence Number=SeqID_31899
MASYGVSLFLTHLLLEVASLIIFLPFSIPLPLIFKKKRTPLMTKIQGLKAPHGATSCDTFVHVFLQLLWGSSRVDLIAGTKFRAPSLPLPHSSSLLQALSMATYG

SEQ ID NO: 123585 - protein, 110 aa, Glycine max
  Coding DNA Sequence Number=SeqID_31900
MEFGDIVVHFNILDAMKHPFEDHSVLRAEILDQIVDDYMFDFDSLHESECTNHLARSTYTSDLLYEVQAEGPSSSSPTLVPPTVQLPSTPELKPLPVNLSMLTWRQEKFQ

SEQ ID NO: 123586 - protein, 214 aa, Glycine max
  Coding DNA Sequence Number=SeqID_31901
MKSSNSSYGRQQTFLGSTGGPHYAQSQNKHAFTPYGLPPNLIHHSNVAYTPQWNVNNSTPILIESRQPQTDHAHVSQPVGETYEIPHHSLADFEPWLGYATEGQAVGGIPLENTSEGPQYHPQLHLLHSTTSKNPHAMAEMGKLDHLEERLRAIERGEDYAFDNLKKLFLEPNIITPPKFKVLDFDKYKGTTCPKNYLKMYYRRWGHAQKMRNY

SEQ ID NO: 123587 - protein, 105 aa, Glycine max
  Coding DNA Sequence Number=SeqID_31902
  Homolog annotation: Hit_ID=Q84VI1; Match level="QueryCoverage=78%, HitCoverage=12%, E-value=2e-36, Identity=95%"; Hit description =Envelope-like protein
MDKKIRSIVSSILKDASVPEADEDVPTSSNPNVSVPDVKKDVPTSSAPNAEALPSPSEEGSTEEDDQAAEEILPRAPEPAPGWPVLELIAEKGYKADDREKHFPW

SEQ ID NO: 123588 - protein, 346 aa, Glycine max
  Coding DNA Sequence Number=SeqID_31903
  Homolog annotation: Hit_ID=Q2HW90; Match level="QueryCoverage=65%, HitCoverage=57%, E-value=9e-23, Identity=31%"; Hit description =Putative uncharacterized protein
MGQLQQQAFRKAYGKIWDLARVEVSMEPIASLSQYYDQPLRCFTFEDFQLVPTVKEFEEILGCPLGGRKPYLFSGSIPPRQELPRKGQRPWKIKANGLSFIDILALLIFGVVLFPNMEGLVDLAVIDAFLAFHHGKESPVVAILAMYDTFDRGCEKSDARIFCCALALYVWLVSYPFLQEGRKNQDSIFMRRMSKCSLDGTRGCINYNPVLAIRQLGYPMRGVPSDESITPFIARGFSDHNARDRELRGSSNGIIGGYHKWLRVRTQGLDWLPNLKTVRDDEVKASKESDEVQALKADLKRARVVEEKFKSIAIKGSNSKLKLRRGERQSSRVKGMILKDELKALP

SEQ ID NO: 123589 - protein, 308 aa, Glycine max
  Coding DNA Sequence Number=SeqID_31904
  Homolog annotation: Hit_ID=A7UQU7; Match level="QueryCoverage=46%, HitCoverage=24%, E-value=2e-24, Identity=43%"; Hit description=IMP dehydrogenase/GMP reductase, putative
ALGDLSMTERYAWGVAALVYMYDHLNDASMSHSRQLGGYITLLQCWIYEHFPSVAESTADQDYGEASPRACKWIATKKTVKSIHTPSYRECLDRLQILDVCWFPYGEHREVRDFHVRSCYSGLLRWGPVAVYYRLERGVRQFGYTQTIPAPPVDSWVSYDDIHDRWMHYENHIVPAGEVCVVPGACSSDYIDWFFRISHPFMTPGHALDPLPHGHAPQPRVVPQAPQTDIPRVLEPGASSTSAEEPRHAVEVCDDIAERLERHLSLGVVTSGSSTHEVIEECLKLARSVTQDHLVYVRCRRRRHTDQA

SEQ ID NO: 123590 - protein, 18 aa, Glycine max
  Coding DNA Sequence Number=SeqID_31905
ISSLGFFPFAIFNAFLCG

SEQ ID NO: 123591 - protein, 121 aa, Glycine max
  Coding DNA Sequence Number=SeqID_31906
MKWTTTKVHQKNRRKLKRFKRYNYSVKMKNEKNEEERRRTVNFREGTSAKENPFLVSLAFRLPFSTGDIPPVATYSSAGGRRVTRGMRVPRKEYARSRHQRLFEENVGKTGKDAIYELFSE

SEQ ID NO: 123592 - protein, 150 aa, Glycine max
  Coding DNA Sequence Number=SeqID_31907
  Homolog annotation: Hit_ID=A5AK77; Match level="QueryCoverage=43%, HitCoverage=8%, E-value=4e-08, Identity=43%"; Hit description =Putative uncharacterized protein
MTRGNPSDLQPFDPEIDRTFHRLVRHHFIPFDHSEHSITSESVHSVIGDFEHPDLEHYNFEHSDSEHSDFAHSENMAQPPPRERTLREMAAPDFTYESLCIQYPDEDVPCVLKTGLIHLLPKFHGLAGEDPHKHLKEFHIVCSTMKPGIL

SEQ ID NO: 123593 - protein, 292 aa, Glycine max
  Coding DNA Sequence Number=SeqID_31908
  Homolog annotation: Hit_ID=Q84VH5; Match level="QueryCoverage=100%, HitCoverage=47%, E-value=1e-119, Identity=72%"; Hit description =Envelope-like protein
MIPGQAPVPEKLVPKRQQGVKISENPSLATSPREVDTEMDKKIRSIVSNILKNASVPDADKDQRGINRGRGSSHRGDPAPRAPEPAPGDLIDLEEVESDEEPIANKLAPGIAERLQSRKGKTPIKRSGRIKTMAQKKSTPITPTTSRRSKVAIPSKKRKEISSSDSDDDVELDVPDIKRAKTSGKKVPGNVPDAPLDNISFHSIGNAERWKFVYQRRLALERELGRAALDCKEIMDLIKAAGLLKTVTKLGDCYESLVREFIVNIPSDITNRKSDEYQRVFVRGKCVRFSPA

SEQ ID NO: 123594 - protein, 175 aa, Glycine max
  Coding DNA Sequence Number=SeqID_31909
MGNEEGVQEQMKANMSTLKDQMASMMEAMLKIQKSIEDNAMAAATNTTREAEPVLQPAMNSSRDRSTTGFNWRLHSPYRYRQFELSPYLQGATPSSCRLPSRGRRRGRCPFGPFTSPKGADTHELPWPNIIHHAPSQSAPVREPVPISKDKGKINLLEERLRAVEDLGNYPFSEQ

SEQ ID NO: 123595 - protein, 38 aa, Glycine max
  Coding DNA Sequence Number=SeqID_31910
MGLNQFRFSAWSMTSLSRNGFMIPTWLAHEENAKIMHE

SEQ ID NO: 123596 - protein, 41 aa, Glycine max
  Coding DNA Sequence Number=SeqID_31911
MASVVSSSAGAGAGGSSISGSWAAEAPPPPEEEGWSPGQAT

SEQ ID NO: 123597 - protein, 47 aa, Glycine max
  Coding DNA Sequence Number=SeqID_31912
MEHRELMLAWVKFRNEALLREHPKLLNLNPSSDRINPSFVLRSLLLD

SEQ ID NO: 123598 - protein, 109 aa, Glycine max
  Coding DNA Sequence Number=SeqID_31913
MKAQVEKDEGPEAETLSRLLIVAEGPSNPCGVYPDLSSFIGSGVYPDLSSLTGSGVYPDLSSFTGSGVYPDLSSFTGSGVIQTFVACIKRSAPTQVHIIWYQRMQRCDP

SEQ ID NO: 123599 - protein, 152 aa, Glycine max
  Coding DNA Sequence Number=SeqID_31914
YPELRRSEFLIGGYVGAKASLLSTTLLSVTMIQELANVVICALSGDVSIFRWRLSQVSQVIQNYVETKFGHSAPLYHPEAAGPMIRGDTLRLSAPFCHPEAAGPMTSRDQVWSFCTFVSSRGGGPDDTRRYLTVIRTLLSSRGGGPDDKQRP

SEQ ID NO: 123600 - protein, 110 aa, Glycine max
  Coding DNA Sequence Number=SeqID_31915
  Subcellular localization annotation: CTP_CleavageSite=49; ConfidenceScore=5.19e-01
MDPPLVCLQRGSRQNPYAMHMQKTQYGNSPVESPTVATYPSTGGRRVTRGMRVPRKEYARSRHQRLFEENVGKTGKDAIYELLSERLESCILRAGKVLAPHTSVTRDGSL

SEQ ID NO: 123601 - protein, 120 aa, Glycine max
  Coding DNA Sequence Number=SeqID_31916
  Gene Ontology: Mol. function=aspartic-type endopeptidase activity; Biological process=proteolysis
  Homolog annotation: Hit_ID=A5CBJ4; Match level="QueryCoverage=65%, HitCoverage=7%, E-value=1e-13, Identity=45%"; Hit description =Putative uncharacterized protein
MANIYNRPPQPRAAKCNRFSRAIMLSSNRYNPDGGSHHQMFFKTGLIHLLPKFHGLAGEDPHKHLKEFHIVCSTMKPPDVQEDHIFLKAFPHSLEGVAKDWLYYLAPRSITSWDDLREYS

SEQ ID NO: 123602 - protein, 141 aa, Glycine max
  Coding DNA Sequence Number=SeqID_31917
GRDHLELPSGVETEHEQQKPIKERMQVRMGSRPTDRRPFLHTKQAENVAARQPPLGSSFFAFFDSVLRFCSSPTRMAPRKLASKRSRKDKAAEGTISAPEYDSHRFRSAVHQQCFEAIKGWAPAVGITGYSHGQVRSRNSP

SEQ ID NO: 123603 - protein, 83 aa, Glycine max
  Coding DNA Sequence Number=SeqID_31918
PLGPSGIFLQKAVASGGSNPARLGELGGNHLPYFAINRGGSEEEKAEALPKRFRNVFREEFRKGFNRSSTFFIRSSSFFDLQR

SEQ ID NO: 123604 - protein, 103 aa, Glycine max
  Coding DNA Sequence Number=SeqID_31919
MIQFHEIESFLKGGMNILTAHSQEWEQELSSNYQYEEERTPNLESVFDEFMAYHASSKANQNSMKNHEIHFGKSYSIENFHVGPKLQPSYQNAAKEDPIWINC

SEQ ID NO: 123605 - protein, 211 aa, Glycine max
  Coding DNA Sequence Number=SeqID_31920
HIPTKKSLLELTSHDALLSQNKLLSKQLEALTETLRCTICGGAHEFGRCIPIEEQPTHEVNYMGNQPINNFDAGGFSGFQHGQQYNQQQGQWRNHPGGPSTRPQQQGPSLYDRTTKLEETLAQFMQVSMSNQKGTESAIKNLEVQVGQLAKQLADRSSSSFTANTEKNPKEECKDVMTRSIMAIHVDESEAGKKMEEHKQQLAPKPELEPL

SEQ ID NO: 123606 - protein, 143 aa, Glycine max
  Coding DNA Sequence Number=SeqID_31921
  Homolog annotation: Hit_ID=A5BVM8; Match level="QueryCoverage=95%, HitCoverage=8%, E-value=1e-22, Identity=43%"; Hit description =Putative uncharacterized protein
MVRSMGYKFYDPTLRSIFETGNARFLEEVEFGKEENIRKVLFEEKPIIDSSQVLIPIVVQETTPVIENSVQTIVDDIVQEQDNDEVLPQIPIQQPQQSQEVPLRRSDRERRSAIADDYIIFLQEHEDGIGLAEDDPINLSSHA

SEQ ID NO: 123607 - protein, 188 aa, Glycine max
  Coding DNA Sequence Number=SeqID_31922
MEEAEKEILETFRKVELALNQKICLPCCKKSFNLEQLSSLKLIAANIYNRPPQPQQQNQPQQNNYDLSSNRYNPGWRNHPNLRWSSPQQQQQQPAPSFQNAAGPSRPYIPPPIQQQQQPQKQPTVEAPPQPSLEELVRRMTMQNMQFQQETRASIQSLTNQMGQLATQLNQHSPRILTAAFSSCPNPK

SEQ ID NO: 123608 - protein, 335 aa, Glycine max
  Coding DNA Sequence Number=SeqID_31923
PEELGLATAHEHRIADEYAQVYAEKEARGRVIDSLHQEATMWMDRFAITLNGSQELPRLLAKAKAMADTYSAPEEIHGLLGYWKNTITKRATRHPYRTRSKSRTMGDQEETQEQMKADMSALAGEEQSVGPPDGRPYTRQHSAAAVEGYPQMDGEAPTEESMSPFLVRDFGAQNSKTIQRIHKAWEAPLKKDQELRGIRNGIIGGYHEWLKVHIRGLDWLAKLKVVSKESFETPEEDEEVQALKSELGKAKLAKEKFKLAATHVRKECAGLREENAITARALEQETKRARKEEYGRNKFRGALWGSNSELKLRKEERDQSRAHSMVLKEELVACS

SEQ ID NO: 123609 - protein, 206 aa, Glycine max
  Coding DNA Sequence Number=SeqID_31924
NGVIDDYHKWLKARTQGITWLPKLKSPCGEETKVPEESKEVQALKAELERMRVVKEKLKMTVTRVRKECDKLRDVNMTTTEADESRVESMILEDKLKACQRSKRSLTEQLSRTKENMLTIIDQYKGNLNQATSHGQRLEDECHTLISSGDLCSMTCDHSLVLVRPTWALRNIPPEGGCFWRKQPCSPGQAELAWASWAATTSPILL

SEQ ID NO: 123610 - protein, 138 aa, Glycine max
  Coding DNA Sequence Number=SeqID_31925
MAQSETAWQCLCKRPAFSNTTKVAYLSCYGFGIPWQGTVIAAILNGLHLLDAPIPGSRLVFRLRVVGPQIVPSESVLCGPNLLLNTLTTVAILLKEGRYPEERYGFLPPRGHPRISSNSSMVGTNWKSANVKHLKGWS

SEQ ID NO: 123611 - protein, 128 aa, Glycine max
  Coding DNA Sequence Number=SeqID_31926
  Homolog annotation: Hit_ID=A5BSR3; Match level="QueryCoverage=78%, HitCoverage=32%, E-value=4e-11, Identity=39%"; Hit description =Putative uncharacterized protein
KLLAEKTKKKLQEAAQSGSVDGVIDPPSPVRRHVKWKIAHTKKTGEMTTEASKEIAEKIDSFEEHATQGSFVPHGRQDVLAAAIGRPEHPGRVRAAGAGVTIKQYFGSAPRMSRNISSLPPDELQQLT

SEQ ID NO: 123612 - protein, 104 aa, Glycine max
  Coding DNA Sequence Number=SeqID_31927
MWAIIDECKEKLNLAATHEQRLEDEYAKISAEREARERVLLVTGSRKGVHNYNPCPRHKSLYTHERQCAPKSREEHHAFPALARGFSDHNARVLRGVRKAWDAA

SEQ ID NO: 123613 - protein, 206 aa, Glycine max
  Coding DNA Sequence Number=SeqID_31928
MLQTLVIIEEGETLFAYSRFALLRPDPQDLATKLCIPGRGFKLNVDGQPLKILRKNMTTLAQPWSIVSYSNLVPTSHTFDITLDRAKLIYGIIMKMDMNLGYLISPQISIIAQHDSSRVGFPALITALCKARGVTLDFRSLESLSPAINLAYIKNCWNLDDPTVTFRGPRKARGKRSEAPPTSATPDTSAPCSSTLSYTSDRSRTE

SEQ ID NO: 123614 - protein, 83 aa, Glycine max
  Coding DNA Sequence Number=SeqID_31929
PLGPSGIFLQKAVASGGSNPARLGELGGNHLPYFAINRGGRQEGRAEALPKRFRNVFREESRKGFNRSSTFFIRSSSFFDLQR

SEQ ID NO: 123615 - protein, 98 aa, Glycine max
  Coding DNA Sequence Number=SeqID_31930
MASSSGDATLSSPKIARLRVEMIKLGDQMRRMSYEDKERMKRMRKENEESLGRIHRSSKALNMRGMKRMREEGGMRDIGREKIIEDMKVDKERKELRE

SEQ ID NO: 123616 - protein, 38 aa, Glycine max
  Coding DNA Sequence Number=SeqID_31931
MEVEEPWLGLWLPLNYRVDMGSSGLRHWKCGRQTLWLI

SEQ ID NO: 123617 - protein, 94 aa, Glycine max
  Coding DNA Sequence Number=SeqID_31932
  Homolog annotation: Hit_ID=A5ADL2; Match level="QueryCoverage=60%, HitCoverage=15%, E-value=6e-11, Identity=54%"; Hit description =Putative uncharacterized protein
MSVMVSMGRSLTFKARRKDGLNTHQDLVEKGIRAQLHPSKVLDLVKLDELENKAVIILCQLEMYFPSAFFDIWSEKSNVVVFFIYVGCTWLSDT

SEQ ID NO: 123618 - protein, 196 aa, Glycine max
  Coding DNA Sequence Number=SeqID_31933
FECDNDPLQFLKSENRSKEGSVIKNHTLCGGEETKNDEAKLAREKKIEKVMEEEVDPSIKREKHKKSGVTNVGCKDDFLDNPITDLIKKEVEAGDSTKPHCFQDSDFHKKIVMVKQKSFMKVVGTTMVLESWNVNLLGEPLALNFVASMADSLAMELRQKESTRGAVVFQQSDKTLGSFSVKFQFSDSNLEDKIDF

SEQ ID NO: 123619 - protein, 182 aa, Glycine max
  Coding DNA Sequence Number=SeqID_31934
MEAMKEKMTKIMEVVMSMKRMMEVNAATVVAPSTATKMEPTHPLGFDQVNHPASDMVGQGGEALGSIGGPHFVQVRNKHSFPPYGLPPNYTPPNVAHTPEENVDISIPMPIEGQQPQFDHAHVSQPMGKTHEAPRDHSLADFEPYLEYATKGQAVGGVPLPNTLEGPQFCPLLQPLHFAGGK

SEQ ID NO: 123620 - protein, 132 aa, Glycine max
  Coding DNA Sequence Number=SeqID_31935
  Homolog annotation: Hit_ID=B0HC01; Match level="QueryCoverage=25%, HitCoverage=72%, E-value=1e-11, Identity=100%"; Hit description =Putative uncharacterized protein
GGGAYGKTPATRPFYGSWPFAGLLLTCSFLRYPLILWITVLPPLSELIPLAAAERPSAASHWHDRFPDWKAGSERNAINETAMTMITNSSSVPGWSMKGHSMSEQERSSPCSAASKTPPQHLEQIPALGDIV

SEQ ID NO: 123621 - protein, 368 aa, Glycine max
  Coding DNA Sequence Number=SeqID_31936
  Gene Ontology: Mol. function=nucleoside-triphosphatase activity; Cellular component=integral to membrane; Biological process=transport
  Homolog annotation: Hit_ID=Q1H0H6; Match level="QueryCoverage=99%, HitCoverage=71%, E-value=1e-137, Identity=59%"; Hit description=ABC transporter related
  Pfam annotation: Domain name=ABC_tran; Domain location=3-158; Score =67.0; E_value=6.2e-17; Accession=PF00005.18; Description=ABC transporter
QWVIAHVAQETPALAQSALEYTLDGDEELRLLQTNLANEHQDPLQLAEWHQRLADIDGYSAEARASALLAGLGFSQSQLSQPVSDFSGGWRMRLNLARALMCRSDLLLLDEPTNHLDIEAVIWLEGWLNAYRGTLLLISHDREFLDNTVNHILHIEQQQLTLYRGGYSDFERQRAEKLTLQQASYQKQQQQIAHLQKYIDRFRAQATKARQAQSRIKALERMERISAAHVDSPFNFGFRDTGASPDPLLVMNHASLGYTDKPLVKLGHLAIRPGERIGLLGKNGAGKSTLIKALADSATLLAGERVEGKDLRIGYFAQHQLEQLIASDSPLQHLQRLDPLTREQELLDFLGSFDFRGEMAKTPCGPFS

SEQ ID NO: 123622 - protein, 152 aa, Glycine max
  Coding DNA Sequence Number=SeqID_31937
MKPTRKVTRLRSLATRLVGAEKPLAHVNLATEKADGPHRKKLRTCLGIVACDKVDVAYENWKQTVRERWRQFKFDLTSKWAFEADKDSADDTDVRKKSHAIQKQNIAPHMLSRGGYEFLENKLMEEKKNKQLEEPTKSGSTDFVINTPSLIR

SEQ ID NO: 123623 - protein, 199 aa, Glycine max
  Coding DNA Sequence Number=SeqID_31938
  Subcellular localization annotation: CTP_CleavageSite=53; ConfidenceScore=5.04e-01
MRGYLMIIRSFCQPEASKPVNTQRLTSSSAPFVNQGQASPLTHRDYGRLCTILSSKDSESDDMWGASEPIDTQRLTSSSAPLSSRGGECDDMRGYLMVIHTFCHPEMASPMTPYGYPHILSTRDGESDDMQGYPMVIRTFCQPEASKPTADFDDMSGYLMVIRTFCQPEGSKAVNTQRLTSSSAPFVNHGQASPLTRRD

SEQ ID NO: 123624 - protein, 101 aa, Glycine max
  Coding DNA Sequence Number=SeqID_31939
SYIEESLDEDDSVDGISDTDNEVIDMIQPVRIVHPTEGVEGIQNPFWNDALHYNNINPDGEDICGLEMPSNFNVGQELYVGMNFDSKDAVKNALKQYVMKA

SEQ ID NO: 123625 - protein, 166 aa, Glycine max
  Coding DNA Sequence Number=SeqID_31940
  Homolog annotation: Hit_ID=Q2HW90; Match level="QueryCoverage=37%, HitCoverage=13%, E-value=8e-09, Identity=41%"; Hit description =Putative uncharacterized protein
MGTNQTGKRFYQVKPSARAYGKILELTIAEVSIEAIASLTQYYDQPLRCFTFGDFQLVPTIEEFEEILGCPLGGRKPYLSSGCLPSLSRIAQGFSKRFGPHKTDSEWHSGPTTGVPRRQGEGYGQSRRLGPVYGCVSFANFWGRPLSKRGWFGGPSSNRRFPCIPP

SEQ ID NO: 123626 - protein, 158 aa, Glycine max
  Coding DNA Sequence Number=SeqID_31941
MNLIIVIKRKEHALRHPYRTHARARVMGEVEEVQEQMKVDREALKEQMATMMEAMMSIKKIMEVNAAAITSTSTIVEVDLTPPIWPQTNKSSNLRYGRSERPRVGRYGWPSFSAKNKHAFPPYGLPPNYTPPQMWHTLPSEDVNNSAPILIESPTTSN

SEQ ID NO: 123627 - protein, 232 aa, Glycine max
  Coding DNA Sequence Number=SeqID_31942
MEISCRFLVSGKYIALQICDDEDVETMLESFKQQQEMSVLELYIEKDVARGSMFHSANSLTSCGNYVSNDDTQPPTNMSNLNLDEDDDHDDDDYLESNSYVEESLDEDDSVDGISDTDDEVTDIPQPVRIVHPAEGAQRIENPFWNDALHYNNINWSYPDEEDICGLEMPSTFNVGQELYVGMEFDSKDAVKNALKQYVMKVHQSFKVVESKSNKHGQRRSINKNFVDSRED

SEQ ID NO: 123628 - protein, 84 aa, Glycine max
  Coding DNA Sequence Number=SeqID_31943
LVSQPTLLRASEARLTGAPSIGGKCAESPPTFIERKMLKKPKETDHEAYSRFGSYLYVDKSGALAPTYPPSKRKSDLRSSFKRQ

SEQ ID NO: 123629 - protein, 231 aa, Glycine max
  Coding DNA Sequence Number=SeqID_31944
  Gene Ontology: Mol. function=N-acetyltransferase activity; Cellular component=intracellular; Biological process=metabolic process
  Homolog annotation: Hit_ID=A4WDF3; Match level="QueryCoverage=100%, HitCoverage=26%, E-value=1e-113, Identity=90%"; Hit description=GCN5- related N-acetyltransferase
  Pfam annotation: Domain name=CoA_binding; Domain location=8-102; Score=7.9; E_value=0.00068; Accession=PF02629.10; Description=CoA binding domain
MSQRGLEALLRPKSIAVIGASMKPDRAGYLMMRNLLAGGFNGPVMPVTPAYKAVQGVLAWPDVQSLPFVPDLAVLCTNAKRNLELLEALGKKGCKTCIILSSPPEQQPELLAYASRYQMRILGPNSLGLLAPWQGLNASFSPVPIRKGKLAFISQSAAVSNTILDWAQQREMGFSYFIALGDSLDIDVDELLDFLARDSKTSAILLYLEHLSDARRFVSASRSASRNKPIL

SEQ ID NO: 123630 - protein, 127 aa, Glycine max
  Coding DNA Sequence Number=SeqID_31945
MARVMLGNGYEPRMGSGKDNGGITSLINAKGNRAKEASREGRAVVKARVGDKKGGKKEVSRYGSSDVPPSNCMSEFRYRTMLTKLHALGLSWKLGVTHGAPNASSGSYATSISKPLRFLEEASIVRP

SEQ ID NO: 123631 - protein, 249 aa, Glycine max
  Coding DNA Sequence Number=SeqID_31946
  Gene Ontology: Cellular component=viral envelope
  Homolog annotation: Hit_ID=Q84VI1; Match level="QueryCoverage=81%, HitCoverage=29%, E-value=3e-96, Identity=88%"; Hit description =Envelope-like protein
IDVSEHQIAKEITAKRVQHWPRKGKLSAGKLSVKYAILHRIGAANWVPTNHTSTVATGLGKFLYAVGTKSKFNFGNYIFDQTVKHSESFAIKLPIAFPTVLCGIMLSQHPNMLNYTDSVMKRESPLSLHYKLFEGTHVPDIVSTSVSTSGKAAASGAVSKDALIAELKDTCKVLEATIKANTEKKMELERMITRLSESGIDDGEAAEEEEDPAEQDEAAERRRAAEREKLLRERCSRRDRSDDDSEATP

SEQ ID NO: 123632 - protein, 71 aa, Glycine max
  Coding DNA Sequence Number=SeqID_31947
MLQDRTVASILEEETHFSDLLSPNSPSSREFANQNSEVVTVATCPFAGMRGRQKRGFCSYIPSIEEEVRPT

SEQ ID NO: 123633 - protein, 86 aa, Glycine max
  Coding DNA Sequence Number=SeqID_31948
AVSSTSFNVNVTSDNVKNCIKLWRSWYGISHKSAKPFRFKVLQNWDDIVDLCAKDRPPKKMDGKVDDEDIQEVLREAALILDLNRQ

SEQ ID NO: 123634 - protein, 60 aa, Glycine max
  Coding DNA Sequence Number=SeqID_31949
MKYPRLYRISLQQHKLIQQVGSFNDSSWEWNLSWRRFSGRNLSDYNPATYSRLLEVGSRA

SEQ ID NO: 123635 - protein, 107 aa, Glycine max
  Coding DNA Sequence Number=SeqID_31950
MEKWKSQELKQIGDVSTPKQFILEALREAGVIKCGGNKEDSCLIHPGVLHDVERCPIAKELLQGLISRGQIEIHNAKKEEGEGYYHSDTSRFLALCRKDASTLPLKE

SEQ ID NO: 123636 - protein, 269 aa, Glycine max
  Coding DNA Sequence Number=SeqID_31951
  Subcellular localization annotation: CTP_CleavageSite=45; ConfidenceScore=5.44e-01
MNSLPSTVHVSSTIESGALRIHCLALFANSPFSTFIRRPMNSLPSAVHVSSTIESGVPRIHCLALFANSPFSTFIRRPMNSLPSAVHVSSTIESGVPRIHCLALFANSPFSTFIRRPMNSLPSAVHVSSTIESGVPRIHCLALFANSPFSTFIRRPMNSLPSAVHVSSTIESGAPRIHCLALFANSPFSTFIRRPMNSLSSAVHVSSIIESGAPRIHCLALFANSPFSTLIRRPMNSLPSAVHVSSIIEFGAPRIHCLALSANFSILHF

SEQ ID NO: 123637 - protein, 233 aa, Glycine max
  Coding DNA Sequence Number=SeqID_31952
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q5U6B7; Match level="QueryCoverage=100%, HitCoverage=46%, E-value=3e-81, Identity=61%"; Hit description=DNA polymerase
MPGGTPVWHSDLEYMTLDNMFGFIEAYVECPKSIKKPFLPYRDNKDGTLIFPTGTFVGVYYSEELKYARDIGYTIIPICGYLFEEMESPFKDYINSLFESRSNAKKKGNNALSFVYKLLMNSLYGRFGINPQSTKTEMCNKSKRDRIFRRPEFIDDVFIREDLYMVSYLTNPGKGPSYWDPPKNSAVQLAAAITAGSRIYMYKYISREDCLYTDTDSIVLGNPLPEEDVSSSV

SEQ ID NO: 123638 - protein, 249 aa, Glycine max
  Coding DNA Sequence Number=SeqID_31953
  Homolog annotation: Hit_ID=Q84VI1; Match level="QueryCoverage=25%, HitCoverage=9%, E-value=6e-30, Identity=100%"; Hit description =Envelope-like protein
PTDGVIDIDVSEHQIAKEITAKRVQHWPKKGKLSAGKLSVKYAILHRIGAANWVPTNHTSTVATAKRDQQRKHDQATKETPCTKGTRTCFQVTSLTWKKSNLMQGTIAQVGTWHCGKPLQTEEGKKPLLIKGSRRIIDYGSSRKKSTPITRCPSRRSKVARKRKEENSSDSDDDSNPPRVSTLRGPRNLEERCLEMFLMHHWTTSLSTPLAMLKSGNMCINADLRLKENWEEMPWIARRPWTSSRLLDY

SEQ ID NO: 123639 - protein, 106 aa, Glycine max
  Coding DNA Sequence Number=SeqID_31954
MSILTLGSEKRREGKFPIKEKKREGKFPIKEKAKNERRKISNQRKKRGKEIPNQRMGESKKEGKKGPDQGSKENRRNVQKGLWTRQYLKNIELSPNEQKEGKETTT

SEQ ID NO: 123640 - protein, 105 aa, Glycine max
  Coding DNA Sequence Number=SeqID_31955
  Homolog annotation: Hit_ID=A7VSA3; Match level="QueryCoverage=51%, HitCoverage=47%, E-value=2e-07, Identity=56%"; Hit description =Putative uncharacterized protein
  Subcellular localization annotation: CTP_CleavageSite=56; ConfidenceScore=5.13e-01
MQHLYESQYHPVKDWFCCSYVKGWPPSIPLSFGLATVLPRRSVSRVSWAPDPRRPRANTHRLRHGLPGYLIPFAPHAFALQRRAFHQFLATFTFNPIHRLRALYA

SEQ ID NO: 123641 - protein, 488 aa, Glycine max
  Coding DNA Sequence Number=SeqID_31956
  Homolog annotation: Hit_ID=Q2HW90; Match level="QueryCoverage=69%, HitCoverage=66%, E-value=3e-43, Identity=34%"; Hit description =Putative uncharacterized protein
MEPLQMQAFRKTYGKILDLTIAEISIEAIVSLTQYYDQPLRCFTFGDFQLVPTIEEFEEILGCPLGGRKPYLFSGCIPSLSRIATVVKDSARGLDRVKQTRNGIAGLPRKYLEDKARDMANQEEWVPFMDVLALLIFGVVLFPNVDGLVDLAAIDAFLAYHHSKESPVVAVLADLFDTFDRRCEKSSARIICCLPALCVWLVSHLFPLDTRHPCPLQSYRSCTEKGRVDWDQHLAGIGGSAINWFPRWKEGKEGVLFSCGDYPNIPLIGTRGCINYNPALAIRQLGYPMRGAPTEESLSPFLARNLGAQSLKAIQRVHWAWRSPLRKDQELRGIRNGIIGGYHEWLNVHIRGLDWLAKLKVVSEESFEAPEEDEEVQALKSELGKMKLAKERFKLAATHIRKECAGLREENATTARALEQETKRARKEEYGRNKFRGALWGSNNELKLRREERDQSRAHSMVLKEELVACSRSKRSLSQRLCRRRPTC

SEQ ID NO: 123642 - protein, 53 aa, Glycine max
  Coding DNA Sequence Number=SeqID_31957
  Subcellular localization annotation: CTP_CleavageSite=46; ConfidenceScore=5.20e-01
MAVLCPTRSFSSGHFSASGARFNVHQNSLTPVMCLEQPLSRYQSSLADALSEV

SEQ ID NO: 123643 - protein, 69 aa, Glycine max
  Coding DNA Sequence Number=SeqID_31958
MWAFHTGRQLDWAHLYKFDAIGKELQVGSKRFDARNRITKVEEDVSFSEIYSAYDPEDVIRYHRLQNSI

SEQ ID NO: 123644 - protein, 210 aa, Glycine max
  Coding DNA Sequence Number=SeqID_31959
  Gene Ontology: Mol. function=protein transporter activity; Cellular component=1-2nm peptidoglycan-based cell wall; Biological process =response to antibiotic
  Homolog annotation: Hit_ID=A4WDP7; Match level="QueryCoverage=95%, HitCoverage=51%, E-value=2e-95, Identity=90%"; Hit description =Efflux pump membrane protein precursor
MSANAESTNPQQPANKKGKRKSALLLLTLLFIIIAVAYGIYWFLVLRHAEETDDAYVAGNQVQIMAQVSGSVTKVWADNTDFVQKGDVLVTLDPTDAQQAFEKAQTALASSVRQTRQLMINSKQLQANIDVQKTALAQAQSDLNRRVPLGTANLIGREELQHARDAVASAQAQLDVAIQQYNANQAMVLGTSLENQPAVQQRRLKCVTHG

SEQ ID NO: 123645 - protein, 130 aa, Glycine max
  Coding DNA Sequence Number=SeqID_31960
MKREKHVSYSSHDSCKSLSEELSDYYRGRHSSHTKHHSQRREKDRRPQEVNISLPYFHGKDNVEAYLDWEMKVEQLFACHHISDQREKFPFTLFFLAFGYCLSLLFPCLSIGCHILKKSLSQKQRQSLLL

SEQ ID NO: 123646 - protein, 95 aa, Glycine max
  Coding DNA Sequence Number=SeqID_31961
MAVEWRRKRGKRRHFKEKMSLEEAHHHSRPWIRAWRKKEMNEGRGREEHEFLCPKRALKSEFIPLIQDQVQDSPLVCLGVMRHVKHEGHAQSVTI

SEQ ID NO: 123647 - protein, 123 aa, Glycine max
  Coding DNA Sequence Number=SeqID_31962
MEARKKKKGFRSREEERFRGLGSKEDEGRDTCPTLPRKMELMMGNGDRGDGYTVNVRSVLQSKSLVRTCSNRKERRVFKKEFPGSKEYLRSTKLRQERGLRAIGQFELVYGRVEVEAARILDL

SEQ ID NO: 123648 - protein, 46 aa, Glycine max
  Coding DNA Sequence Number=SeqID_31963
NTSRFKRKVDFKNQDSRFQESRFKRSRFKTQDSRIKRRLNQDKYEK

SEQ ID NO: 123649 - protein, 174 aa, Glycine max
  Coding DNA Sequence Number=SeqID_31964
MGEVEECGYNSRYQHHCWGGPDPPIWPQPNKSSNLRYGRSGRQRVGRYGRPSFSAKNKHAFPPYGLPPNYTPPNVAYTPSEDVNNSAPILIESQQPQSDHAHVSQPMGETHETPHHNLADFEPCLGFATEGQAIGDIPLQNTLESPRYHPQPHLLHSTTSKGLESFKEYVQKGA

SEQ ID NO: 123650 - protein, 134 aa, Glycine max
  Coding DNA Sequence Number=SeqID_31965
MIRGDTLWLFAPFCHPEAAGPMTSRDQVWSFCTHDTRRYLTVIRTPLPFRHSRVRWHAETKFGHSAPMIRGDTLRLSAPFCHPEAAVPMTSRDQVWSFCTHDTRRYLTVIRTPLPFRHSRVRWHAETKFGHSAP

SEQ ID NO: 123651 - protein, 105 aa, Glycine max
  Coding DNA Sequence Number=SeqID_31966
  Homolog annotation: Hit_ID=A5C647; Match level="QueryCoverage=70%, HitCoverage=5%, E-value=2e-14, Identity=43%"; Hit description =Putative uncharacterized protein
AEEPSSSPTLVPPTIRPPPTPELKPLPATLKYAYLEDKEKFPVIISASLAAEKEEKFHSGDSNPVILDVVKKEVTKLLQAGIIYPISDSQWNSWRVCIDYRRLNQ

SEQ ID NO: 123652 - protein, 71 aa, Glycine max
  Coding DNA Sequence Number=SeqID_31967
MWAVIDECKEKLNLAATHEQRLEDEYARYQQKAKQGRGSQELPRLLAKAKAMADTTPPPRRSTDFSAIVNI

SEQ ID NO: 123653 - protein, 219 aa, Glycine max
  Coding DNA Sequence Number=SeqID_31968
PEEDEEVQALKNELGKAKLAKEKFKLAATHIRKECAGLREENATTARALEQETKRARKEEYGRNKFRGALWGSNNELKLRREERDQSRAHSMVLKEELVACSRSKKSLSQRLCETETNMLAIIAKYQEELGLATAHKHRVVDEYAQVYAEKEARGRVIDSLHQEATMWMDRLALTLNGSQELPRLLAKAKAMADTYSAPKRFMGFSAMSAYDRLNGPHN

SEQ ID NO: 123654 - protein, 242 aa, Glycine max
  Coding DNA Sequence Number=SeqID_31969
  Gene Ontology: Mol. function=phosphoribosylaminoimidazole carboxylase activity; Cellular component=phosphoribosylaminoimidazole carboxylase complex; Biological process='de novo' IMP biosynthetic process
  Homolog annotation: Hit_ID=A1ZLM0; Match level="QueryCoverage=99%, HitCoverage=64%, E-value=4e-58, Identity=45%"; Hit description =Phosphoribosylaminoimidazole carboxylase, ATPase subunit
  Pfam annotation: Domain name=ATP-grasp; Domain location=2-143; Score =65.2; E_value=2.2e-16; Accession=PF02222.13; Description=ATP-grasp domain
MTLPFVQKMNTGGYDGKGVQVIKNEEDLQNLWKEPSVIEKLVDIDKELSVIVARNEKGETKTFPVTEMVADPKLNLLDFNICPVFLHENTQKQIDVITEKFLNAINSPGLFAIELFLDKAGKVWVNETAPRLHNSGHQSQEGNANSQFEQMYRVVKNLPLADTESLGYSGMLNLVGAEGYSGKVIYEGMEEVLKLPKTYVHLYGKTETKPGRKMGHINVLADSKEELMEKLIKVKAMVRVIA

SEQ ID NO: 123655 - protein, 85 aa, Glycine max
  Coding DNA Sequence Number=SeqID_31970
  Gene Ontology: Mol. function=nucleic acid binding; Biological process= regulation of transcription, DNA-dependent
  Homolog annotation: Hit_ID=A5B0P7; Match level="QueryCoverage=72%, HitCoverage=33%, E-value=9e-11, Identity=36%"; Hit description =Putative uncharacterized protein
MSPYRVVFGKARHLPVEIEHKAYWAVKTCNFSIDQAGEEIEIKSESTDKGFKVNGHRMKPFLINPSLVDVVVEETSLLHPIFLLP

SEQ ID NO: 123656 - protein, 80 aa, Glycine max
  Coding DNA Sequence Number=SeqID_31971
MKARVIGGRITLLGATGTPNDWQRHVINAGNPRALLDLFGSRGCLRSTEPHGRSSVSGWHTPADTSAEGGRSYDRWAGCC

SEQ ID NO: 123657 - protein, 86 aa, Glycine max
  Coding DNA Sequence Number=SeqID_31972
MGAKYLEVVKQGSHPNNGWSPDKIRTRNDHNLSLDFVGHDRAWAARHKMTIICLCVPPDTIASGWRKGVWNDHNLSPPTSQLAIFE

SEQ ID NO: 123658 - protein, 430 aa, Glycine max
  Coding DNA Sequence Number=SeqID_31973
  Homolog annotation: Hit_ID=UPI00006A2D9E; Match level="QueryCoverage =92%, HitCoverage=100%, E-value=2e-12, Identity=21%"; Hit description= UPI00006A2D9E related cluster
  Subcellular localization annotation: CTP_CleavageSite=17; ConfidenceScore=5.05e-01
MLVSRVPKGANKVQGPTASTLGRNLGMTHALAFRGLHVLTFRGLHVLALKDYTSSPSKGYMPSPSEGYTPSPELHALPFRRLHTLTFRGLHALTIRGLHVLAFRGLHALAFRGLHAFAFRGLHVLAFRGLHALTFRGLHALALRTTCPPLERATRPRLQRTTRAPLQRTTCAPLQRTTRPHLQRTACPRLQRTTRSGLLGTSTLTFRGPHVFTLEGGLHVLAFRGLHAFTFRELHALAFRGLHVLTFRVLHVLTFGGLHVLAFRGLHTFTFREVHTLTFRGLHVLAFKGLHVLAIKGLHVLAFRGLHVLAFLGLHALALRGLHVLAFSGLHALAFRRLHTLAFRGLHALAFRGLHVLAFRGLRVLTLEGCTPSPFEDYTPSPSKGYTSSPSEGYAPSPSEDYIPRLHRTTRPCLQRAARPHFQRAPHLPL

SEQ ID NO: 123659 - protein, 217 aa, Glycine max
  Coding DNA Sequence Number=SeqID_31974
  Pfam annotation: Domain name=G-patch; Domain location=120-159; Score =25.4; E_value=0.00016; Accession=PF01585.14; Description=G-patch domain
MPKSTLENYHSMLPTKAEFNGGSCFDDTRRELSVGAPVDPLSRSCALYTPPKVKIRSGGAFGHRVRRGRHLGELPILYALCGSRRRIVRNRFQSFEVVSISSVDSFSGQPCLSDAAVMMARVMLGNGYEPGMGLGKDNGGITSLINAKGNRGKYGLGYKPTQADMKRSIAGRKSSGQSSHWRQESEGSPPCHISRSFISAGLGDKGQVVAICEDDVS

SEQ ID NO: 123660 - protein, 190 aa, Glycine max
  Coding DNA Sequence Number=SeqID_31975
MRGPLKDVNLLEGYMPSPCKDYTSSPSRYLHVLTLRGLNVHRLERTTCPHHQRAARPHLQRTTRPRLERAISPRPWVLVTLTIRGLHALTIRGLHVLSTTRPRLERTTRPHHQRAARPHHQRTTCPRLERATRPHLGTITLTIKGLHVLALRGLHVLTIIGLHALTFRGLHVLALRGLHALTLGTSYPHR

SEQ ID NO: 123661 - protein, 162 aa, Glycine max
  Coding DNA Sequence Number=SeqID_31976
MSRGSGDLWDVRQAPGSQQIKGTKTTKQGGLWWLASCEFCVICGLWPLVIDYQGWVIDYRLKNEDRRLRWPLVIDYQGCNRLPGLKRSQETKGALRDGSLVIDYQIVMAAQLIHDRVEMECLEGAWETLEGNTRCRFRGTIRFTATSLVHPDEPARTLQRTV

SEQ ID NO: 123662 - protein, 188 aa, Glycine max
  Coding DNA Sequence Number=SeqID_31977
MSLHSSSSVNGRHRSHLRPYSHRREKERNPQEANINLPYFHGKDNVEANSDWEIRVEQQLKRKSTSKSYDSHSYPKKDQGQGILGVTPSKLKDDKGKTIEKQPLKVSMQEKTSSMKFFKCLGRGHITSQCPTKKTMIMRGQDIYSSQDEATTSPSSSESEEAKGEESSEEIYPPEEGQPFIVKEKCKE

SEQ ID NO: 123663 - protein, 44 aa, Glycine max
  Coding DNA Sequence Number=SeqID_31978
MKCFLDPIALKVVGPLLLDFQILRDGPILLSNSHMATHFIIGYM

SEQ ID NO: 123664 - protein, 62 aa, Glycine max
  Coding DNA Sequence Number=SeqID_31979
MPTSSRRLGGSSPELHFLHPAAVILLPRTMFVIITGNSLSVSTRHAHLGNCAEFVETTWLCT

SEQ ID NO: 123665 - protein, 141 aa, Glycine max
  Coding DNA Sequence Number=SeqID_31980
SLRAIRLFVLQIEKKFYTDNHSGISARQRDSKVSMTDLVSAEDDEDDVSLCVLSGFSSYRCKKVYTDNHSGISGRQRDSKVSMTDLVSAEDDAFRLTDSKKVYTDNHSGISARQRDSKVSLTDLVSAEDDNGKKFYTDNHS

SEQ ID NO: 123666 - protein, 72 aa, Glycine max
  Coding DNA Sequence Number=SeqID_31981
MSHAVKDNRGKWAPNYEGPFVVKRAFPEEPWCLPTWMAKSYLHPDFPSVVSLDRLELPSGVRTKHGQQKPIK

SEQ ID NO: 123667 - protein, 112 aa, Glycine max
  Coding DNA Sequence Number=SeqID_31982
MIQSFEQQQEMSVIELCVEVDVAGASAINLTNSLLSCGNNMSHNESGSATVGTNSEEDFDDDDYLISNSYAEDSLDEDEDINEMSDTDDEAVRLIEPLTVVQSGEGGSQTPF

SEQ ID NO: 123668 - protein, 184 aa, Glycine max
  Coding DNA Sequence Number=SeqID_31983
  Homolog annotation: Hit_ID=Q6WAY6; Match level="QueryCoverage=28%, HitCoverage=9%, E-value=9e-09, Identity=51%"; Hit description =Putative uncharacterized protein
MTPSTEDVKKAMQGLFAVLQLSMWGWFHTFFSKKVGPSIRYKEGRIKILSSCEGCPNVPLMGTRGCINYNLVLAIRQLGYPMRGAPLDESITPFITRGFSDHNARVLQGVARHGMRREERTESLGEATVRDNEVKASEESDEVQALKQSLKEPGAAIVSSNSEEVKGIITGQRHDLEGRAKGLP

SEQ ID NO: 123669 - protein, 110 aa, Glycine max
  Coding DNA Sequence Number=SeqID_31984
MQGLKISEARCEQLDNGGCGFQKPMNRQEVFRSYPLGRCKPIGGHHAQKNQTSNRQSVHLQMKSISMNYGSIMERDEKRFVYRIRCSSDENNDPEGIEEGIGVSYDPECR

SEQ ID NO: 123670 - protein, 101 aa, Glycine max
  Coding DNA Sequence Number=SeqID_31985
MTRGDTLRLSAPLCHPEAAGPMTSGVPYGNLENPGTTSHTRRYLTVIRTLVSSRGGGPDDMRRYLTVFRTLVSSRGCGPDDTRRYLTVIRTLLSSRGGGAR

SEQ ID NO: 123671 - protein, 58 aa, Glycine max
  Coding DNA Sequence Number=SeqID_31986
EPQPAEPGFYFFPCPTPNQFRAEVTWPGDWPKARAGEAPAEAPDEADEGAGPHDWEIP

SEQ ID NO: 123672 - protein, 59 aa, Glycine max
  Coding DNA Sequence Number=SeqID_31987
MPYPEGGNPASCLENSLILSELNYNNDEARLEFKNLFLSMTGGMFFLYGYGGTGQKIKL

SEQ ID NO: 123673 - protein, 65 aa, Glycine max
  Coding DNA Sequence Number=SeqID_31988
MEDIEEAKEHHLDEDALIPHDVAPCGACRPWLDLLHQWSPLLLKDKWKRNGEGRKMIGDTTSRRR

SEQ ID NO: 123674 - protein, 114 aa, Glycine max
  Coding DNA Sequence Number=SeqID_31989
MRGIVHEPQDGPLGTSTLVFRGLLALVFKGLHVLTIKGLHAHAIRGLPILTIRGLHALTFIGLHALTFRGLHVLTFRGLHDLAFRGQHVLAFAFVGLHAHTFRGLHVFAFRGLH

SEQ ID NO: 123675 - protein, 286 aa, Glycine max
  Coding DNA Sequence Number=SeqID_31990
  Gene Ontology: Mol. function=alpha,alpha-trehalase activity; Cellular component=periplasmic space; Biological process=trehalose metabolic process
  Homolog annotation: Hit_ID=A4WBE4; Match level="QueryCoverage=100%, HitCoverage=50%, E-value=1e-138, Identity=82%"; Hit description =Alpha,alpha-trehalase precursor
  Pfam annotation: Domain name=Trehalase; Domain location=1-286; Score =201.0; E_value=2.8e-57; Accession=PF01204.9; Description=Trehalase
MEKEYAWWMDGVDALQPGQANKRVVKLDDGAILNRYWDDRDTPRPESWLDDVNTAKSNPNRPATEIYRDLRSAAASGWDFSSRWMDDPQKLATIRTTSIVPVDLNALMFKMEKLLARASQESGDAASASKYEALATARQKAIESHLWNDKEGWYADYDLKSKKVRNQLTAAALFPLYVKAAAQDRADKVAAATASRLLQPGGIATTTVNSGQQWDAPNGWAPLQWVATEGLQNYGQDKVAMDVTWRFLKNVQHTYDREKKLVEKYDVSTTGTGGGGGEYPLQDGFG

SEQ ID NO: 123676 - protein, 85 aa, Glycine max
  Coding DNA Sequence Number=SeqID_31991
  Subcellular localization annotation: CTP_CleavageSite=79; ConfidenceScore=5.04e-01
TYQGNPCGVYPDLSSFTGSGVYPDLSSFTGSGVYPDLSSFIGSGVYPDLSSLTGSGVYPDLSSFTGSGVYPDLSSFIGSASSKPS

SEQ ID NO: 123677 - protein, 58 aa, Glycine max
  Coding DNA Sequence Number=SeqID_31992
MEYLSSDSIDKSETSENSYFQSITTEFLNSLKTSGKNIGMAVYIPKNVNVSFTITLAV

SEQ ID NO: 123678 - protein, 158 aa, Glycine max
  Coding DNA Sequence Number=SeqID_31993
  Gene Ontology: Cellular component=nuclear chromosome; Biological process=chromosome segregation
  Homolog annotation: Hit_ID=A7PLS4; Match level="QueryCoverage=87%, HitCoverage=53%, E-value=2e-21, Identity=41%"; Hit description =Chromosome chr14 scaffold_21, whole genome shotgun sequence
  Pfam annotation: Domain name=Rad21_Rec8_N; Domain location=8-122; Score=46.2; E_value=1.1e-10; Accession=PF04825.4; Description=N terminus of Rad21  Rec8 like protein
MSKAKLTRFTSDPVRIAAFCFKNLKKTQVLDADISSAVVFTVRLESSCFCVVVFLMQKNDKILQEMDGVSYRVLGYLLLGTIRIFSRKVEYVLEDCNEVLLKISKFVIHKEGLIPVETLRMPITIPERFELDAFELDGLEDAGRGHTAPPEEITLGDK

SEQ ID NO: 123679 - protein, 45 aa, Glycine max
  Coding DNA Sequence Number=SeqID_31994
MAYGTGKNTRKKPKELSRISSESKLLVDLDNYVPEILHKKNITIV

SEQ ID NO: 123680 - protein, 171 aa, Glycine max
  Coding DNA Sequence Number=SeqID_31995
DVQFVVDMMNLNVVSLMKNKSHMKSIIWGTSPKTILMQGQWRNHPRNQFNRDQGGSSIRSQPQGPSLYDYTTKLEETLAQFMQVSMSNQKSTESCYKEFGGPSRQEAFSANTEKNPKEECKAVMKRSRMTNHVDERKAEKKMEEHKQQLAVKLALEPVDDLVELEEIVEEA

SEQ ID NO: 123681 - protein, 185 aa, Glycine max
  Coding DNA Sequence Number=SeqID_31996
  Homolog annotation: Hit_ID=P03851; Match level="QueryCoverage=45%, HitCoverage=100%, E-value=6e-44, Identity=98%"; Hit description =Uncharacterized 9.4 kDa protein
VDSRGSPCAHCPLSSRETCRASCINESANARGEAVCVLGALPLPRSLTRCARSFGCGERYQLTQRRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 123682 - protein, 81 aa, Glycine max
  Coding DNA Sequence Number=SeqID_31997
  Homolog annotation: Hit_ID=UPI0000ECBAF8; Match level="QueryCoverage =50%, HitCoverage=48%, E-value=1e-16, Identity=100%"; Hit description= UPI0000ECBAF8 related cluster
MGYGERGAGGVIPPNAWLVFDVELSRPAGMQAWHWPSFYNVVTGKTLALPNLIALQHIPLSPAGVIAKRPAPIALPNSCAA

SEQ ID NO: 123683 - protein, 71 aa, Glycine max
  Coding DNA Sequence Number=SeqID_31998
MEKDPMKALQLLDATSVSYPNFVWGPLFVGMRPLFDHLKMFNTHRCRICKVPRCFGKKPVKNTKTGVYLAK

SEQ ID NO: 123684 - protein, 137 aa, Glycine max
  Coding DNA Sequence Number=SeqID_31999
MDEDEWMYEIMSGQADIDYENAEACGANEPHVDCFNAFNTSQVIMLMYLSAKRMFFDGLDPLLMKTDLWRSGEYRCRKKEFIRRDTGTRKCRCPFKLCYKPVIGGKGWMVKLICGVHNHELAKSLVGHPYAGRLTKA

SEQ ID NO: 123685 - protein, 171 aa, Glycine max
  Coding DNA Sequence Number=SeqID_32000
  Homolog annotation: Hit_ID=Q84VI1; Match level="QueryCoverage=100%, HitCoverage=25%, E-value=3e-51, Identity=64%"; Hit description =Envelope-like protein
MATSPKETSASGSPAVPSSPHQEQPEFNIQPIQIIPGQASVPEKLIPRRQQGVKIAENPSPATSPRKVDTEMDKKIRGIVSSILKDASVPDAEKDVPTSSNPNDSVPDVKKDVPTSSAPNAEALPSPSEEESSKEEDQASEETPAPQAPEPAPGDLIDLEEVESDEEPIAN

SEQ ID NO: 123686 - protein, 145 aa, Glycine max
  Coding DNA Sequence Number=SeqID_32001
MAPTRHPLDPDKSNRALGFPALITGLCQSFGVPVSPSKVIRPPITQAFIEKYCTQRQVQGDAPQAADAPPPHQAGPAGSFDTEQYLWHLMSLSLQSQGFTSFPCPTPDQFRAEIAWPGNWPEARAGEAPAEAPDEADEARTRTRR

SEQ ID NO: 123687 - protein, 122 aa, Glycine max
  Coding DNA Sequence Number=SeqID_32002
MTLLLSNILPSDRNANLPLQKYQLVCVVPTWGSHPQRHLVDLKKSNRALGFPALVTGLYRPYRALVPPASSCHHDIGKDCARKTPSGPEEGQQCLGVASSKYGSLSVQGSACCPQQGHQAPY

SEQ ID NO: 123688 - protein, 91 aa, Glycine max
  Coding DNA Sequence Number=SeqID_32003
MSLPSEGYTPSPSEDCMSLPSEGYTPSPSENCTSSPWVLITLTIRGLHVLALRGLHVLTIRGLHALTFRGLHVLALRGLHALTLGTSYPHR

SEQ ID NO: 123689 - protein, 89 aa, Glycine max
  Coding DNA Sequence Number=SeqID_32004
MGILRNQDICRNMPFCGRARRGSRERFPKEENVRSRHQRLFVENIGKNRRKPVKKNIPSLGVVFTFEEGRQKRGSCSYVPSLEEEIRPT

SEQ ID NO: 123690 - protein, 86 aa, Glycine max
  Coding DNA Sequence Number=SeqID_32005
MASMTDAMLGMRQLMEKNAATAVAVSLAAKADPTLPAIAHHPILDMVGQERSTLGHISNPYLGYNRVAYPYGLPPNYTPPVIRDDA

SEQ ID NO: 123691 - protein, 64 aa, Glycine max
  Coding DNA Sequence Number=SeqID_32006
MFCAQFPLEDDMPFKDNPIRRHSIWVLCRQSDVPKTSSGALDLQQSMGQNTPNDYNDGWLKFSQ

SEQ ID NO: 123692 - protein, 127 aa, Glycine max
  Coding DNA Sequence Number=SeqID_32007
MAYTHIPDSTSDSPQISASPYQLDLAPYASEPYNAQWNAPGLLRDKHTLRSSRILGEMEVDEPWLGLWLPLNYQVDMGSSLAYDNGIWGEPYRLFAAKFLFVGVFFFVCAKSGLRHWKCGRQTLWLI

SEQ ID NO: 123693 - protein, 37 aa, Glycine max
  Coding DNA Sequence Number=SeqID_32008
MTLGAEFNVESLTCRDWNTSFESIPKGARKKRTTYIA

SEQ ID NO: 123694 - protein, 109 aa, Glycine max
  Coding DNA Sequence Number=SeqID_32009
MASLSYYHEELGSSTGNLVHLDLEIEATLRRNRAERKRKLLQDRTIVSILEEETHFFNSSSSDSPSSRESATYLPEAVSMADEHQQRVTLEDYSRSSVPQFFTSIARHE

SEQ ID NO: 123695 - protein, 137 aa, Glycine max
  Coding DNA Sequence Number=SeqID_32010
  Homolog annotation: Hit_ID=A5CB00; Match level="QueryCoverage=89%, HitCoverage=12%, E-value=1e-09, Identity=28%"; Hit description =Putative uncharacterized protein
MHDNLYIVLALRDMNSNFDHIRDQILTGQEVPSMDSLMTRLLRVPTPRKIGNSLKHFESLAMVSTRGRGDRGNCGGRRGGGGRNTNSDLRCSHCKKWGHTQDKCYYIIGWPDKTANVTKSETLDPKFYEEEYKECLR

SEQ ID NO: 123696 - protein, 146 aa, Glycine max
  Coding DNA Sequence Number=SeqID_32011
MKDVGCAPQSFADLVFASEGITVGPKKGKFDHPTRTTEKTGANKEGEKEGETHAVTAIPIRPSFPPTQQCHYSANNKPPYPPPTRKPVEFTPIPVSYADLLPYLLDNSMVALNPSQGSINLHFSGEYDSNATCACHGETPGRSIEH

SEQ ID NO: 123697 - protein, 183 aa, Glycine max
  Coding DNA Sequence Number=SeqID_32012
  Gene Ontology: Mol. function=microtubule binding; Cellular component =cortical microtubule, transverse to long axis; Biological process =positive regulation of microtubule polymerization
  Homolog annotation: Hit_ID=A7P409; Match level="QueryCoverage=74%, HitCoverage=22%, E-value=5e-51, Identity=71%"; Hit description =Chromosome chr1 scaffold_5, whole genome shotgun sequence
MIEKDSAEVDRLAKLKASRMKELVFKKRSELEEICRLTHIEPDPSIVAEKASALIDSGLVDPFELLAKIEEQIIKAKNEVLSRKEVTDRIDKWFAACEEENWLDKYNQDDNRYSVGQCNHINLKRAEHARITIGKIPGFWRFLGFRVFLGLGFGVWGSGFGVWGSGFGVRGSRFGVQGSGFRV

SEQ ID NO: 123698 - protein, 228 aa, Glycine max
  Coding DNA Sequence Number=SeqID_32013
MANLKLVPHANPQLSILHARVNTPKLHISMKHHRHYFNPTPCASPRNHNTHPTTPWRGRWQRHSEPHPGDVPHGFPTPSSPRRRSPWCNAAPPLRHLAHRQPLGAGGGDAALHLLQPAAGPRRLRHRNGGDRGAGGGGVRAGGARVVLVGGELSPADATGDDDDDGAAGASEAARGGHGGVRGAEDEGGWARHSDKGTSCPGNNKDDSALSYHETRKWFQFISLMYDL

SEQ ID NO: 123699 - protein, 297 aa, Glycine max
  Coding DNA Sequence Number=SeqID_32014
  Gene Ontology: Cellular component=nucleus
  Homolog annotation: Hit_ID=A7QI09; Match level="QueryCoverage=87%, HitCoverage=68%, E-value=1e-108, Identity=69%"; Hit description =Chromosome chr17 scaffold_101, whole genome shotgun sequence
  Pfam annotation: Domain name=NUC156; Domain location=139-267; Score =220.0; E_value=5.7e-63; Accession=PF08160.3; Description=NUC156 domain
MEWLGLGPFLIVVKCLFFGDVSSKRDPSTYLSYVFAIYDYYQKKYCIYEKGENPCKVKLPLIVNTPGWVKGVGYDVLVDMLKYISPTHVVKISIASEKKNLPAGEFWLDGEHDETINLIEINSAHQDSLNRSLLVQKDARLLRDLRIMAYFKQCFSSDSNISTIKELAHALASHCPYEVPIASIKIRHLHCEVPSSEIFFSLNATIVGLAVDSEGPENLPWCLGLGIVRGIDTVKGVLYVITPVPHNSLEKVNVLLQGYIQIPSCLLQASYCFHNEQSAACERQTKTTNMMKPSLET

SEQ ID NO: 123700 - protein, 690 aa, Glycine max
  Coding DNA Sequence Number=SeqID_32015
  Gene Ontology: Mol. function=methyltransferase activity; Biological process=DNA methylation
  Homolog annotation: Hit_ID=Q76KU6; Match level="QueryCoverage=89%, HitCoverage=99%, E-value=0.0, Identity=58%"; Hit description=DNA methyltransferase
MVKFYEVEFELTCIFFEFCAEVGIRAPAFSDWVWHDFRLVCLISLVLCDANTLTSVLGQPNYLLFCEVTERLKMGGDDSGLESDNFDWNTEDELEIQNYNSSSSCLTLPNGDAVTGSGELLMSYSLPLQASSSAVLANSKVLDHFVSMGFSREMVSKVIQEYGEENEDKLLEELLTYKALESSSRPQQRIEPDPCSSENAGSSWDDFSDTDIFSDDEEIAKTMSENDDTLRSLVKMGYKQVEALIAIERLGPNASLEELVDFIGVAQMAKAEDALLPPQEKLQYNDYAKSNKRRLYDYEVLGRKKPRGCEKKILNEDDEDAEALHLPNPMIGFGVPTESSFITHRRLPEDAIGPPYFYYENVALAPKGVWQTISRFLYDVEPEFVDSKFFCAAARKRGYIHNLPIQNRFPLLPLPPRTIHEAFPLTKKWWPSWDIRTKLNCLQTCIGSAKLTERIRKAVEIYDEDPPESVQKYVLHQCRKWNLVWVGRNKVAPLEPDEVETLLGFPRNHTRGGGISRTDRYKSLGNSFQNPMATFNLCCETLAKALVDTVAYHLSVLKEMYPNGINLLSLFSGIGGAEVALHRLGIPLKNVVSVEKSEVNRNIVRSWWEQTNQKGNLYDMDDVRELDGDRLEQLMSTFGGFDLIVGGSPCNNLAGSNRVSRDGLEGKESSLFFDYFRILDLVKNMSAKYR

SEQ ID NO: 123701 - protein, 236 aa, Glycine max
  Coding DNA Sequence Number=SeqID_32016
  Gene Ontology: Mol. function=hydrolase activity, acting on glycosyl bonds; Cellular component=extracellular region; Biological process =cell wall organization and biogenesis
  Homolog annotation: Hit_ID=Q9SWS3; Match level="QueryCoverage=92%, HitCoverage=56%, E-value=2e-84, Identity=68%"; Hit description =Polygalacturonase PG1
MKNYMNMKLNSIALVIGIAFSVWSSSCTAARVSHWRKLKAAYATTFNVLDYGAKGDGHADDTKAFEDAWAAACKVEGSTMVVPSDSVFLVKPISFSGPNCEPNIVFQLNKITIKGKGVIDGQGSVWWNDSPTYNPTKVMVESSGRLPSTRPTVTVLLEQNHTLTLLYYDYILALRFYGSDESQVYDINVSSPGDSPKTDGIHLQNSQGVVIYSSTLASGKHNPERNQNLKCIISSS

SEQ ID NO: 123702 - protein, 220 aa, Glycine max
  Coding DNA Sequence Number=SeqID_32017
  Gene Ontology: Mol. function=nucleotide binding; Cellular component =intracellular; Biological process=small GTPase mediated signal transduction
  Homolog annotation: Hit_ID=Q677H6; Match level="QueryCoverage=90%, HitCoverage=90%, E-value=6e-96, Identity=90%"; Hit description=ADP -ribosylation factor
  Pfam annotation: Domain name=Arf; Domain location=5-196; Score=402.1; E_value=8.6e-118; Accession=PF00025.12; Description=ADP-ribosylation factor family
  Pfam annotation: Domain name=MMR_HSR1; Domain location=18-115; Score=- 4.4; E_value=0.0027; Accession=PF01926.14; Description=GTPase of unknown function
  Pfam annotation: Domain name=Miro; Domain location=19-118; Score=7.3; E_value=0.0021; Accession=PF08477.4; Description=Miro-like protein
  Pfam annotation: Domain name=Ras; Domain location=19-198; Score= -60.2; E_value=7.9e-05; Accession=PF00071.13; Description=Ras family
  Pfam annotation: Domain name=SRPRB; Domain location=15-196; Score= -42.4; E_value=0.00018; Accession=PF09439.1; Description=Signal recognition particle receptor beta su
  Pfam module annotation: Pfam domain module=Arf::MMR_HSR1::Miro::Ras::S RPRB; Domain location=5-196::18-115::19-118::19-198::15-196
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNESPHRAASHSQGFECVLVLRDELRDAVLLVFANKQDLPNAMNAAEITDKLGLHSLRQRHWYIQSTCATSGEGLYEGLDWLSNNIASKIIELGEDESVRKNTSNRKLEA

SEQ ID NO: 123703 - protein, 140 aa, Glycine max
  Coding DNA Sequence Number=SeqID_32018
  Homolog annotation: Hit_ID=Q9FY61; Match level="QueryCoverage=67%, HitCoverage=7%, E-value=2e-31, Identity=73%"; Hit description =Putative uncharacterized protein T5K6_30
MIILLEETKKPKKARAIEKGTMHEEPVPYLGSKQGQVCYWASTLLRKVVELLTSAADGAKSSIDASDRLILYIEIARLYGSLGYQRKAAFFSRQIARLCLQQGNRLAAISAMQVLTMSTEAYHVQSRSSVSDHSLHNVSS

SEQ ID NO: 123704 - protein, 25 aa, Glycine max
  Coding DNA Sequence Number=SeqID_32019
MKHMLKEWVTCPLRRDGSGWLQKCN

SEQ ID NO: 123705 - protein, 813 aa, Glycine max
  Coding DNA Sequence Number=SeqID_32020
  Homolog annotation: Hit_ID=A7PM85; Match level="QueryCoverage=51%, HitCoverage=47%, E-value=4e-59, Identity=34%"; Hit description =Chromosome chr14 scaffold_21, whole genome shotgun sequence
  Pfam annotation: Domain name=PWWP; Domain location=370-445; Score= -4.3; E_value=0.062; Accession=PF00855.8; Description=PWWP domain
MGTDESDSMVLGSEQEKEVREVLGGLRSEEGSCGVTVNGDGFSSIESEGLCCDGVVDFVVENSSVLETKVSVLSENDCQVLADSEVNGVPSWLGMQESDMDAVFSGDGAEKLDFGYGSEKLDYMFASESTVPEAAVLSVNRSVEVGGEDGRGGKSEETGTFEDCDGGIVAVGSESRVAEASVSSVEGLVGVSTEDRRGGMKEEEGIDENCDEDAVATASESRAAEAAVLSVDNLVRVVGEDGSVEGINEEDGKDVDCDGNIVAVASESREAEASILSVDSLIGIGGEVVRDGGESEEVEKDEDCNGNILTLESESRVAEAADLIVDSSVGLGGEDKTERGESEEEEKDEDCGGNIVTIEVPVAETSENMDVDVEDLSVEVESHPSWHGRIYDPSDESYFALRLKQKNRLLVAYFGNGTFAWCQPSQLKPFGDNFDDMVKQNSSIDFASAVQEAVNEFGRLLHLKLSHPFVAKKTGPESSLPLAKNSGIKEGVLVPENAIERLDFLIEPAELLSYVKQISQIIEFGSILELEILKAQLSAYYLSKGGYKLADYMDPQPIPGVEDSVMDETVAGDDGKSTVEAPTQGPFDELGHSPGLSGSISNPVRKQKSIAEIMGEDKDVHTANRELDATVEMVNAIGSNVGKKRKGSEDGMASKPVQKKMELLLDADGDVSCAKNDGNGDEGNSDVGSLLQSKEKKEAFDEGKSEERNEKGNLSRERKRSKYLSPPFTIPTRGQREVYLEPESLKVSRKAKVSQRRAGDAGLSSLPVYKGRFFDGSSYQTREDDGKNIVDPNKIQLLWRKFCLKSSMQLLVH

SEQ ID NO: 123706 - protein, 179 aa, Glycine max
  Coding DNA Sequence Number=SeqID_32021
MNKKRQRKERYAYGDGSGDSTLRIMKKKKNQSEEKNPRGRFEKEEEGGGEKIKCSTKHCGSCCGGYVADCVAVCCCPCAVLHCCAMAIVKGPSLVGRKCLGLGKKNKNKNTKKKGCEDDVVVVVVERNKNNNIERVQRAVREMDNITVNAGFDAEKVWKELYQIGHMDFGRVSSSSHDD

SEQ ID NO: 123707 - protein, 85 aa, Glycine max
  Coding DNA Sequence Number=SeqID_32022
MSLPKLVFWITNMLRNNTFRMDIPEAYSTILDKPFWKPISLSYSPFRKLNSSSVMALGLGRKRRKREGRVSCGGAEDDREWVGSA

SEQ ID NO: 123708 - protein, 748 aa, Glycine max
  Coding DNA Sequence Number=SeqID_32023
  Gene Ontology: Mol. function=nucleotide binding; Cellular component =intrinsic to membrane; Biological process=defense response
  Homolog annotation: Hit_ID=Q6R270; Match level="QueryCoverage=85%, HitCoverage=65%, E-value=1e-171, Identity=47%"; Hit description =Disease resistance protein
  Pfam annotation: Domain name=LRR_1; Domain location=427-449; Score =8.8; E_value=7.3; Accession=PF00560.24; Description=Leucine Rich Repeat
  Pfam annotation: Domain name=LRR_1; Domain location=451-472; Score =5.7; E_value=27; Accession=PF00560.24; Description=Leucine Rich Repeat
  Pfam annotation: Domain name=LRR_1; Domain location=474-496; Score =16.2; E_value=0.12; Accession=PF00560.24; Description=Leucine Rich Repeat
  Pfam annotation: Domain name=LRR_1; Domain location=498-519; Score =0.4; E_value=2.5e+02; Accession=PF00560.24; Description=Leucine Rich Repeat
  Pfam annotation: Domain name=NB-ARC; Domain location=105-370; Score =79.5; E_value=1.1e-20; Accession=PF00931.13; Description=NB-ARC domain
  Pfam module annotation: Pfam domain module=LRR_1::LRR_1::LRR_1::LRR _1::NB-ARC; Domain location=427-449::451-472::474-496::498-519::105 -370
MAAEFVGGALLSAVLQVAFVRLASPKVLDFFRARKLDETLLDRLNTKLLFIDALADDAEHKQFRDPHDFLDEIDYELSKCEVEDQSESQTFACKATNSDVGSGSKVSQKLPSTSLVVESVIYGRDDDREMILNWLTSETDSYQYLLLWAWVDWEADFHIKAWVCVSDDFNVFRLTKIILEAITKSKDNSRELEMIHGRLKEKLTGKRFLLVLDDVWNERREEWESVQTPLNHGAPGSRILVTTRCEEVVCIMRSNKVYHLKQLQEDHCWQVFVKHAFQDDHSILNAELKEIGTKIVQKCKGLPLALKSIGSLLHTAKSSISEWESLSPPSVSSQDVLSLLCLISQRLRVCQGTSIILLWMAENFMQCPQQSKCPEEVGERYFNDLLSSLHDAKRLRTFMPASREMMFADDPWKCKMSLHELFSKFKFLRALSLSGCSDFREVPDSVGELIHLRSLDFSLSGIKILPESTCLLYNLQTLKLNYCRNLEELPSNLHKLSNLHCLKFVYTIVRKMPMHLGKLKNLQVLSIFFAGKSSKFSTKQLGELNLHGKLLIGELQNIVNPSDALAADLKNKTHLVKLELEWNSNHSPDDPRKERENLKSLPKLMHILLPSLTDLTIWGYPHVEMFPDGGLPPNLKRVNLLSSKLIASLKRALGDNASLENLGIFKDWIKKNHKFQIVDAPILISLTLHQALSEQLTAGAERGVKHEAHDLNALSARYGAERDYEGPPKKPTMYNELQELSMQRNLFQ

SEQ ID NO: 123709 - protein, 92 aa, Glycine max
  Coding DNA Sequence Number=SeqID_32024
  Gene Ontology: Mol. function=carbonate dehydratase activity; Cellular component=chloroplast; Biological process=carbon utilization
  Homolog annotation: Hit_ID=Q9XQB0; Match level="QueryCoverage=72%, HitCoverage=20%, E-value=6e-19, Identity=73%"; Hit description =Carbonic anhydrase
  Subcellular localization annotation: CTP_CleavageSite=55; ConfidenceScore=5.86e-01
MSTSSINGWCLSSISPAKTSLRKATLRPSVFATLNTPSSPSSSSSFPSLIQDRPVFAAPAPIITPTVGHKILINFALLDHNMCLSCHHDLAS

SEQ ID NO: 123710 - protein, 230 aa, Glycine max
  Coding DNA Sequence Number=SeqID_32025
MTFLVPNKARPGSLWNLQHVQCERILPKHETPNIETNQKDNRGSVFLEEANGGEFIGLELPGGGDDEGGGGVGVREEESEGEGERGAEKEKGFGNGEFGEERYYWKCWIWGAKEEEGGSVEMEGFGKEERENEEEEEGKSVEMSEKVAIVLVGVTKDDAIERIECLKVQKLNFALPNFVLTMNLIQASKGMCLCTYDLVDFVLGTSVLLCVSDMSKMQCTTWFVARLGHN

SEQ ID NO: 123711 - protein, 134 aa, Glycine max
  Coding DNA Sequence Number=SeqID_32026
  Gene Ontology: Mol. function=protein dimerization activity; Biological process=DNA integration
  Homolog annotation: Hit_ID=Q2R1C3; Match level="QueryCoverage=64%, HitCoverage=11%, E-value=7e-12, Identity=39%"; Hit description=HAT family dimerisation domain containing protein
MAVQRRVFLGFLRMCTFIYKSFLMSYIYYSHEWLSEDSNRIPPHQDGELTRERLKCFKRYFDDDNERRQVNIEFANFYGGRKDFDDIDSLRDRSLMEAKSWWLAVLLKSGYGGGTALRNFRKTPPNSSGVAELR

SEQ ID NO: 123712 - protein, 182 aa, Glycine max
  Coding DNA Sequence Number=SeqID_32027
MERANTGFTTKPYVEGRTVAAAFLLLTLTQLKLETLEEKNDVEVVVLSRASAAADAADGGAGAAALRLPSPRRAQPHAPPHLRRRFRQARHHLPLPGLLSPGQALDHPNHAQADRQSSRRCHRNRPLDHKPEESIAGDALFRWQSLLSCFLFALVGAVMLMILTRLWTFMYPRPIRKYLLLE

SEQ ID NO: 123713 - protein, 146 aa, Glycine max
  Coding DNA Sequence Number=SeqID_32028
  Gene Ontology: Mol. function=oxidoreductase activity; Cellular component=chloroplast; Biological process=metabolic process
  Homolog annotation: Hit_ID=Q43677; Match level="QueryCoverage=65%, HitCoverage=42%, E-value=2e-15, Identity=43%"; Hit description=Auxin- induced protein
  Pfam annotation: Domain name=ADH_N; Domain location=5-77; Score=5.5; E_value=0.0004; Accession=PF08240.3; Description=Alcohol dehydrogenase GroES-like domai
MHVIDHLMQMRNDSVVAAALNPADSKRALGVLKDTDSPLPSVPGCDVAGVVVKVGSEVSKFKVGDEVYAASLPLAIITAYQGFEKVEFSAGKSILVLGGTGGVESLVIQALTIVIELLIAVDESLTYKTWPRAIPANISLIKTWQC

SEQ ID NO: 123714 - protein, 232 aa, Glycine max
  Coding DNA Sequence Number=SeqID_32029
  Gene Ontology: Mol. function=cytochrome-b5 reductase activity; Cellular component=mitochondrial intermembrane space; Biological process=biological_process
  Homolog annotation: Hit_ID=A7PF07; Match level="QueryCoverage=75%, HitCoverage=53%, E-value=7e-77, Identity=77%"; Hit description =Chromosome chr11 scaffold_13, whole genome shotgun sequence
  Pfam annotation: Domain name=FAD_binding_6; Domain location=15-78; Score=-17.5; E_value=0.031; Accession=PF00970.15; Description =Oxidoreductase FAD-binding domain
  Pfam annotation: Domain name=NAD_binding_1; Domain location=87-195; Score=133.8; E_value=5e-37; Accession=PF00175.12; Description =Oxidoreductase NAD-binding domain
  Pfam annotation: Domain name=NAD_binding_6; Domain location=83-198; Score=-34.8; E_value=0.062; Accession=PF08030.3; Description=Ferric reductase NAD binding domain
  Pfam module annotation: Pfam domain module=FAD_binding_6::NAD_binding_ 1::NAD_binding_6; Domain location=15-78::87-195::83-198
MPGFHLIPLRNWVWILPLASLQGLHWDKMLKENQNLLYARYLHPNLQVYPEGKMSQHFASLKPGDVVEVKGPIEKLRYTPNMKKHIGMIAGGTGITPMLQVIEAILKNPDDKTQISLLYANVSPDDILLKQKLDILATSHPNLKIFYTVDNPTKNWRGGAGYISKDIVVKGLPGPSDDTLILVCGPPGMMKAISGEKAKDWTQGEVSGVLKEAGYTEQMLSSMEVNNGHLWG

SEQ ID NO: 123715 - protein, 162 aa, Glycine max
  Coding DNA Sequence Number=SeqID_32030
  Gene Ontology: Mol. function=zinc ion binding; Cellular component =intracellular
  Homolog annotation: Hit_ID=A7P7R9; Match level="QueryCoverage=62%, HitCoverage=78%, E-value=5e-21, Identity=38%"; Hit description =Chromosome chr9 scaffold_7, whole genome shotgun sequence
  Pfam annotation: Domain name=zf-RanBP; Domain location=4-33; Score =20.6; E_value=0.0029; Accession=PF00641.9; Description=Zn-finger in Ran binding protein and others
  Pfam annotation: Domain name=zf-RanBP; Domain location=48-76; Score =21.5; E_value=0.0022; Accession=PF00641.9; Description=Zn-finger in Ran binding protein and others
  Pfam module annotation: Pfam domain module=zf-RanBP::zf-RanBP; Domain location=4-33::48-76
MSWSGGDWMCGVCEHINFKKREACQSCGYPKYGGPDPSTYRYNRTEALPGDWFCNCGAHNYANRSSCYRCGSMKDDYSSGYGNNSGGYGSDTFPPGWKTGDWLCPSSMKSLHLIMSTNTNYISPICPTSPSKNGVNLTLDDWCNCLYVFYDGWYNCLISPII

SEQ ID NO: 123716 - protein, 147 aa, Glycine max
  Coding DNA Sequence Number=SeqID_32031
MQRSRRWRMDSCRRTLKIFAQSLKKNKKLQIEQSTNQQPTRGKKKKTIEEGKKIPSLSGCWALREGGRRGRGRGRWSRRRKKKGEVVVEKEEGEGKKVKNKTKWGMERVEHGGKMKRQGEGKSGKKKKKGESDTSGEGEWTLRKEKD

SEQ ID NO: 123717 - protein, 202 aa, Glycine max
  Coding DNA Sequence Number=SeqID_32032
MSNQTREIQLYVSNEFVVKKARNNLNGHSSVFPAQGIGVVDDDIGGIDGEEAGGVLEQSFVGQGGFEKLRDESEEKENENDAGMRVEGGIELGEVKKMMDGGHDGGVIGEVDEEGEGVAAEEVHVESVGGGVEAAKREDAGGEEGEGKEGREEAEGHGFLEELPGDGKVIVEADVGDQAVGQLDGREGDAAGVEGGADLDGP

SEQ ID NO: 123718 - protein, 582 aa, Glycine max
  Coding DNA Sequence Number=SeqID_32033
  Homolog annotation: Hit_ID=A5C9E2; Match level="QueryCoverage=83%, HitCoverage=68%, E-value=8e-92, Identity=41%"; Hit description =Putative uncharacterized protein
  Pfam annotation: Domain name=DUF827; Domain location=18-500; Score= -20.0; E_value=5.5e-09; Accession=PF05701.2; Description=Plant protein of unknown function (DUF827)
MDGSASKPGHTTRGVGLVKASVNLYGNRIEDVNSPLLKKYFSTKQSSKAKELHRASKDMVRYKETKRVAESAKAQAEAKLSNAKQTVKDLFSMIGESSYKAKARMRDVAPLKEYGKPSKNDDDNEYSQVMRELEHAKREFFQLKLDVASVLEEKQRAEKEIEASRSSMLSFSRVAQKLRKEIEEASEEQVVVELARMDALNEMRDIEALENTRNRLKEAIEEINESKELEMKLATTLSDIDMLKNELNFVKKRVERGESMEHVEGESRDVGVLETATEEIEAAKKDLASIREQGFKFMASMDVTRNELKHVNTATVHLKNTESKMGAKVRNLSYKLLRAKSKLEAVSAAEEKAKSIVSNLSQTLDKLKSETEAAKKEKEIINGEVAATKEDIKKALLEIKVSEEGFEGARQELEAVKSSEAIALEKLKILTENVMSMRERISLTKPSSIIIISKFEYEYLRNHARKANEIAEKKVEAAKAWVEAVRASEKEIMMKTKIAAAEAREKRESKKGDKYEYPSRTRPKSMTPSSRGSSKFQKASSPRPVSPFIVKKKKKVIPNWTKIFRGKKNHQQYVAAGKLVTL

SEQ ID NO: 123719 - protein, 637 aa, Glycine max
  Coding DNA Sequence Number=SeqID_32034
  Gene Ontology: Mol. function=nucleic acid binding; Cellular component= nucleus
  Homolog annotation: Hit_ID=Q6AUH9; Match level="QueryCoverage=55%, HitCoverage=56%, E-value=1e-84, Identity=50%"; Hit description =Unknow protein
  Pfam annotation: Domain name=CRS1_YhbY; Domain location=97-181; Score= 119.4; E_value=1.1e-32; Accession=PF01985.12; Description=CRS1  YhbY domain
  Subcellular localization annotation: CTP_CleavageSite=15; ConfidenceScore=5.26e-01
MFYLQLNLLNGSLSRAMSTSKGRSMRSKVERRMQKESGKTLREIRRAKKLKKKLMTEEERLIYNLKRAKKKVALLLQKLKKYELPELPPPRHDPELLTPEQLQAYKKIGFRNKNYVPVGVRGVFGGVVQNMHLHWKFHETVQVCCDNFPKEKIKEMASMLARLSGGIVINVHNVKTIIMFRGRNYRQPKNLIPINTLTKRKLLLGLTAQICCLFFFPLKIHHFCPWLCTYYTKNLVLEEALFKARFEQALESQKLNIKKIEQQLRRMGVNPEDPAAMASIQRVASTFFNAIDQKEGSPYVFREGKQSIIEPAEGFEESEPTADSDQEELDRFIAEIEDAADKEYEAEEAKEKEEFGRIRYWNKEEFGGRYRRSDSSRNDDHDVEARGSRVWNTTHPKRHAIDSDDEENAHSDNDDDDDDEEEEWHFNNIADASDLDSNSDESDGTRGKFKESRRKREKQNNPGIGRARDDESSNRHAGANFRRNMAIKDSESEGMLSDVENAMWESEDEEQENNDSGHLRKFSGNYRSSSSDDEYAHQTMSNKKSGVRDHESKVGGSAQYHDSFDAPNSVRGMHAVNKIDSESVDEFSSSENWLWPSDAEETGDYPTNQNSNNVIKSDIPKTKRRTPKETDEAWDSD

SEQ ID NO: 123720 - protein, 160 aa, Glycine max
  Coding DNA Sequence Number=SeqID_32035
MESSSSSSHQEGFMGYCGFNTNMIVELLGIFNGLNIAKAASFCTVACETNSQIALQMISQAEWPLSAMESLVAGWIEVAMVIKITLEQVRIELRVCIEFASLLFPHSIPQRWDCESEGKVRMRGARSHMRGGRGDGEVCGCNKPTTVKGVSATVSAMARD

SEQ ID NO: 123721 - protein, 121 aa, Glycine max
  Coding DNA Sequence Number=SeqID_32036
MDECTINFLPVMVEGKDSGENVMGERHRLRRGLQHHADKFLNVSNEETIRGASDPLLGEMAFNFSGSPPEQDSELEEEEKEHEVAWLFNTRKKDMDKERERGVNQGQRRRGRHWNSKGQRM

SEQ ID NO: 123722 - protein, 853 aa, Glycine max
  Coding DNA Sequence Number=SeqID_32037
  Homolog annotation: Hit_ID=A7PM31; Match level="QueryCoverage=96%, HitCoverage=38%, E-value=0.0, Identity=56%"; Hit description =Chromosome chr14 scaffold_21, whole genome shotgun sequence
MESKCTKGSNIEEKIGSDTILEGSLGPNSTPKASSWGETIIASVFANGNTVICEARSFLRVGVPSTVTLHVQSEQLGIGRKLPIYPLFPEGTLSSFYELCKNYQWSIEDEKTTEMEYCKLHKTCAASNGTANYQLSDYLPCIYHQAVTIVFLISTIINRVYHNTQLYPHISTLTKPATKVLSFKVAETLHEDSIQLTASAGSQVNSYFDDNDLGFINVLYGRSAGKTNVAVSFSCELSTSGSRTQSRFYSSSLSVTVIPDLPLALGVPITWILPPYYTMTSPLPSSSESHSQNDSRNRRGTISYSLLRSLEKNEALQKDAIFIDADRIKTTKSNNLACIQAKDRTTGRTEIASCVKVAEVTQIRIASKEVLLNIINLAVGAELDLPTSFYDALGNPFHEAYNAVPFYAETNYPDVLCVNKTADGKGNVHIKAIQHGKALVRVAISEDLQKSDYVLIRVGAHIYPQNPVLHIGSPLNLSIKGLSDTISGQWFTTNGSVISVDTLSGMAKAIGEGSAQVSFHYGRLRLQTTITVLKGNYIFVNAPKETLTNVPYPSKGYNFSVKFSESLGAPGEKKRILFNCRVDPLFVGYVKPWLDQDSGNSYCLFFPYSPEHLVHSVPKLEGMRPDVSLSISASLEHEHVSGSASALFIGGFSIMEMSKNSMQLNLTPGSNKTCITVLGNTDVEIHWHHRDLIMISLIHKEDFGIRGFARYEVKLLKAKRFKDRIIITLPANGQSVEIDINHEPEETASSSVTINKAFWASILGYLLLLILSIAIITRFLDRPERSQQTSSSVTTTPSIAAPTTPDRSTPSSVVNDSSPRTPQPFVDYVRKTIDETPYYKREGRRRINPQNTF

SEQ ID NO: 123723 - protein, 932 aa, Glycine max
  Coding DNA Sequence Number=SeqID_32038
  Gene Ontology: Mol. function=protein binding; Cellular component =endoplasmic reticulum membrane; Biological process=intracellular protein transport across a membrane
  Homolog annotation: Hit_ID=A7PM31; Match level="QueryCoverage=99%, HitCoverage=46%, E-value=0.0, Identity=63%"; Hit description =Chromosome chr14 scaffold_21, whole genome shotgun sequence
MVNMALLLSFLVTATVLASSSHAASSGPHIADVNILLPPKMTFPVDYRLQGSDGCFQWSWDHHDILSVEPEYNSSSKCSTSARIRSIAPYSGRKETAVYAADLQTGIVIRCKVFIDNISRIQIFHNSIKLDLEGLATLRVRAFDSEENVFSSLVGLQFMWSLMPEANGLPCHLVNVPLKDSPLSDCGGLCGNLDIQIKLEDNGVFSDLFVVKGIEIGHEIVSVHLLEPQLKNLADEIVLTVAEAMSLDPPSPVFVLVGAVIPYTLKVIRGNVPQVVTLPSAHHQWSVSNASVAQVDSKTGLAYAWNLGMAAVIVEDTRIAGHVQVSSLNVVLPASLCLYISPLSSSGDPVEGIKSIALTTRWYVVSGHQYLIQIKVFAHDHDAQEIYITENDDVKVYDNDSGHWKTFWVSNDIAVKHGWRNSKILKAYSPGLEKLTASLSYPGGADDKKEIIKAVQEVMVCDRVKYTLGNESGIILLPWSPGVYQEVELKAIGGCAKTVSDYKWLSSDLSTVSVSAFGVVQAKKPGKATIKVLSVYDSLNYDEPKSVPMLYAVVFDCKNVVLSGVVMWYVLSLSILAGDVLVEVSIPSSMVMLHNFPVETVVGSHLQAAVTMKAANGAFFYRCDAFNSLIKWKAGSESFVIVNATQELLYLETVPNTQFQSSVDGSPCSWTYVYASNPGQAVIHAIFSKEDHHYSLGPGVLKASSRIVAYLPLIVRQAGDGNQFGGYWLDLVQAESNKQSHSLEELYLVPGTSLDIVLVGGPEWWDNGVDFIETVEVLDEGNALAEDGVLVHRKLLFRRGNLVGDDHPLPSVAEVWLSVTCNIPSSIVLIADEPVNERRIIKAAAQAERSSGRLRDTPVIVANGRSIRVSAVGISDSGEAYANSSSLSLRWELGSCEGLAYWDYAFDIVKSNSWERFLVLQNESGLVLKDSY

SEQ ID NO: 123724 - protein, 165 aa, Glycine max
  Coding DNA Sequence Number=SeqID_32039
MEEGYSTNKQPMFRGVKYDYWKEQKIAHFKSIHIDLWDVNLPVEERRTMKNLHEIAHGNVLAARKEGGGCRLLPPEGTAFCRNPMEGPSGPECCGTLPIVQQCFLSISGMLRNFTDYLTMGVKYLEGTSFVVQVEGTSLVDQFKWTDFTRLKRNLKDRRSLGDSM

SEQ ID NO: 123725 - protein, 87 aa, Glycine max
  Coding DNA Sequence Number=SeqID_32040
  Subcellular localization annotation: CTP_CleavageSite=63; ConfidenceScore=5.29e-01
MGIQIATRPTWAFQDVPPEGGCFWRNQPSSPGQAGKSKPRHFRNVSMGDFAKIFNRSSTFFVRSSSFFGLQPVQRLKRTAFQVKRIA

SEQ ID NO: 123726 - protein, 80 aa, Glycine max
  Coding DNA Sequence Number=SeqID_32041
  Homolog annotation: Hit_ID=Q84VI1; Match level="QueryCoverage=93%, HitCoverage=10%, E-value=8e-24, Identity=76%"; Hit description =Envelope-like protein
MATSPKDTAAPGSPSVPSSPHQEQPEFNIQPIQIIPGQASVPEKLVPRRQQGVKISENPSLATSPREVDPEMDKRSAYCE

SEQ ID NO: 123727 - protein, 106 aa, Glycine max
  Coding DNA Sequence Number=SeqID_32042
MDVKADGNYGYRAIAALLGMGEESWSLVRNHLHKELTSWSEEYIDLLGGIERFEELKRSLLVDGLSMVRYHGQVDKYYRHEICHCFMIQHDRCFSFTTTKHDIFSS

SEQ ID NO: 123728 - protein, 285 aa, Glycine max
  Coding DNA Sequence Number=SeqID_32043
MGSSQKPSFKKRFYQVKIKSLEVTSLREVGQLMGQLQRQAFRKPMDFQLVLTVKEFEEIRGCPLGGRKPYLFSGFYPSTTELPGKAKALEIKANGLSFIDILALLIFGVVLFPNMEGLVDLAVIDAFLAFHHGKESPVVAILAMYDTFDRGCEKSGARIVCCALALYVWLVSHLFLQEGRPVYPLQGHRSCVEKGKANWDQLLASMEGRLLICSLARRKEESGFYLHAKDECRQTKASRLSSHGVSVTPMRGYSKEFTRHVMWCEERIESLGEAVMGASAAIISG

SEQ ID NO: 123729 - protein, 56 aa, Glycine max
  Coding DNA Sequence Number=SeqID_32044
MDRSWMNESRMSPAYKEDVDAILPRKGPVTRAMSKRLQEDWARAAEEGPRVLMNLR

SEQ ID NO: 123730 - protein, 200 aa, Glycine max
  Coding DNA Sequence Number=SeqID_32045
ERTRFTTPLRTRARVMGEVEEVQEQVKADTEALKEQMATMMEAMMSIKEIMEVNAVAIAATSTIAECKNKHAFPPYDLPPNYTPPNVAYTPSEDVNNSAPILFESRQPQTDHAHVSQTMGETHEIPHHNLADFEPCLGYATEGQAVGEERLKVVEESGGYAFANLEELFLVPNVVTPPKFKVSDFDKYKETTCPKNRLKD

SEQ ID NO: 123731 - protein, 91 aa, Glycine max
  Coding DNA Sequence Number=SeqID_32046
MAKYLDVLEIPRGAHVQFLVPQNALSMHEWPRGSLPQRGPGRTRRQKELVPPRSMIVTTLGALRCTSSASKPSRGGRFSGSDASSSGRRVY

SEQ ID NO: 123732 - protein, 87 aa, Glycine max
  Coding DNA Sequence Number=SeqID_32047
  Subcellular localization annotation: CTP_CleavageSite=24; ConfidenceScore=5.42e-01
LPYGYRTFHRPGANKPVDTRRLTSSSAPFVIQGRQVFTLVVRKHSSPTTREILLCWLGTIECNGEGKCRGSAGRDIDWPDDVPLEGN

SEQ ID NO: 123733 - protein, 236 aa, Glycine max
  Coding DNA Sequence Number=SeqID_32048
MVQLISDTIYCLQGSHPQDTQWTRKSPTGPWGFQLWLRASISPIGCPYPPRQGYVIIGIAPARHPVDPKKSNRVLELSSSNYGKGIRPPTDRAFIKKCCVPRQAQGETPQQHWDGRQRETDAPPSPLEFTSGLIHKKVDPWVLVPITFRGLYVLAIRGLHILAYRGLHALAFRGLRILIFIPGPPPDIGGRPTVRAHLEREPIMHLLCIPGQDFTRAAQKMSAIMRTNMTTLHGYG

SEQ ID NO: 123734 - protein, 248 aa, Glycine max
  Coding DNA Sequence Number=SeqID_32049
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-36, Identity=31%"; Hit description= UPI00006A17C9 related cluster
  Subcellular localization annotation: CTP_CleavageSite=24; ConfidenceScore=5.56e-01
MRACNPLMAKTCSPMKGRSLSPLKASMCSPLKVRAYSPTKARACSPLKGRTCSPLKVRTCIPLKARTCSPLKVRACSPLKGRTCSPLKARTCSPLMARTCSPLKVRTCSPFKARTCSPMKARTSRPLKARAGNPMKARACSPLKMWICSPLKGRTDSPLKASRCSPMKVRTCSPLKGRLCSPLKASMCSPLKVRACSPTNARACSPLKGRTCSPLKVRTRIPLKASTCSPLMARTCSPLKAWACSPHK

SEQ ID NO: 123735 - protein, 53 aa, Glycine max
  Coding DNA Sequence Number=SeqID_32050
MTTLCKSRRKEIRTFPEGLPKVQVLRFLTMQTISPNEKFVFHGKWSESSSGNS

SEQ ID NO: 123736 - protein, 236 aa, Glycine max
  Coding DNA Sequence Number=SeqID_32051
MAHHGLVLRRTANVYRLSDDCRQRWLKFAMTGGGRSDCIITPAQGWCAVVAGPAPQRLASPLFASVAGLAHARRCRAVQRGQQRCRVRHCAKNTALHMNHAERRLMMLQLRRRAAVAQHQTFKAAIVGFAQCGMHANVGEPLPGLSIITSSGSGRSSGMISQPGSPRTRMRPQGPGAPIPPASAAIASACWPADRSGPDDGLHGVNITALTAEVGLHINHQQRGILHRAVAVNGHG

SEQ ID NO: 123737 - protein, 122 aa, Glycine max
  Coding DNA Sequence Number=SeqID_32052
MPIAPCRCIGWDRTHKDTQWTRRSPTGPWGFQLWLRASVSPIGCPFPQRGHAIVTYEWHPQRHPVDPKKSNRALGFPALVTGLYSPTGCLFPLARSRHHRDRACKTPSGPEEVQQGLGVVKL

SEQ ID NO: 123738 - protein, 231 aa, Glycine max
  Coding DNA Sequence Number=SeqID_32053
  Homolog annotation: Hit_ID=A5B5G7; Match level="QueryCoverage=90%, HitCoverage=15%, E-value=2e-10, Identity=26%"; Hit description =Putative uncharacterized protein
MASRKRKTPSTPTQVKFDRSRFTSQEAWERYTDVIVPRKLLPERNVDEELTDFIDDNIDVAIVKEFYANLYDPEEKSPKQVRVRGQFIKFDKDTLNTFLKTFVIMEEGESLCAYSRFALLRPDPQELAAKLCIPGRGFELNVDGQPLKILRKNMTSLAQTWSVLSFSNLIPTFHTSDVTLDRAKLIYGIIMKMDMNLGYLISHQISLIAQHDTSKLGFPPLITALCKAGGV

SEQ ID NO: 123739 - protein, 65 aa, Glycine max
  Coding DNA Sequence Number=SeqID_32054
MTLGAEFNVESLTCRDWNTSSKVSQKECVRFCARKKRTTYISMKFSRFKKLGLGFDMLMKDRDTG

SEQ ID NO: 123740 - protein, 80 aa, Glycine max
  Coding DNA Sequence Number=SeqID_32055
MFQLYVACVFFTDRACTMTLNTVTTQIPICWKVINVASPSDAILPRKGPVTRAMSKRLQEDWARAVEEGPRVLMNLRVDF

SEQ ID NO: 123741 - protein, 100 aa, Glycine max
  Coding DNA Sequence Number=SeqID_32056
MTDRCLKKMNHRMTPIRHLIMLNFAAFRADCTESAPLRCEIPHRCVRRKYRIRRHSPFRLRNCWEGRSVRASSLLRQLAKGGCAARRLSWVTPGKYYSGD

SEQ ID NO: 123742 - protein, 171 aa, Glycine max
  Coding DNA Sequence Number=SeqID_32057
  Subcellular localization annotation: CTP_CleavageSite=56; ConfidenceScore=5.69e-01
MASPPASPPPPPPSPLAAPTDASASPSIVKQTRKASCLRSLSTRPPGAERPVVHVDPATGKADGPHRKKLRTYLGIVARDKVDVTYDHWKEVPTAQKDLIWEDIQAEFEIPEASDTDQDGVEDTVCEKYVISKEKLAQFCQTHRDPSWEKLLAEKTKKKLEEVAQSGSVDG

SEQ ID NO: 123743 - protein, 243 aa, Glycine max
  Coding DNA Sequence Number=SeqID_32058
  Gene Ontology: Mol. function=transporter activity; Cellular component= integral to membrane; Biological process=transport
  Homolog annotation: Hit_ID=UPI00005F7CB4; Match level="QueryCoverage =57%, HitCoverage=35%, E-value=3e-19, Identity=38%"; Hit description =COG0477: Permeases of the major facilitator superfamily
  Subcellular localization annotation: CTP_CleavageSite=44; ConfidenceScore=5.01e-01
MLNFVARTTYDNDTFMTALDAAQPNKLHQRVNLGTRLVFLIAGLSMSAWAPLVPFASQRLQLTGASLGGLLLCLGIGSLAAMPVTGALVARFGCRRVMLCSTLVVLAVLPLLATLDVMWLMAATLMVFGAGLGMLDVAMNVQAVEVEKAAAKPMMSGFHGFFSLGGILGAGAVSLLLGAAPASARSTLAGDPARLGRLPRLPVLYSVPCGRRGTRLERPAAAAKSGHERGARRSWVTPSSPSP

SEQ ID NO: 123744 - protein, 314 aa, Glycine max
  Coding DNA Sequence Number=SeqID_32059
  Gene Ontology: Mol. function=transcription regulator activity; Biological process=regulation of transcription, DNA-dependent
  Homolog annotation: Hit_ID=A8GGX0; Match level="QueryCoverage=48%, HitCoverage=81%, E-value=2e-37, Identity=51%"; Hit description =Transcriptional regulator, TetR family
  Pfam annotation: Domain name=TetR_N; Domain location=144-190; Score =56.0; E_value=1.3e-13; Accession=PF00440.14; Description=Bacterial regulatory proteins, tetR f
MAALAELFRLYAGGRGAGGQPAACHHIPAAGGKGQTLAQRATIGTKVPVFIAVAAEPVAAVIAPLIGKTHRQLIVVPRPQLFNQPIIQLAGPFALQKCHDVRAAVNEFAAIAPADNPVYPRKQEFFLMLAPLLFDASASARDRILLSAQQLFYAQGIRATGIDKVIAAAGVTKVTFYRHFPAKNDLILAFLQQRHQRWMSGFRSALAQQPAINVALPAALLSWFQEEDFRGCAFINSAAELADTLPEASALIRQHKREMAAAIAERLSTAQQDKTGQIVLLVDGAIVQVQMGEAAQQVTATLQAALNALLESRA

SEQ ID NO: 123745 - protein, 608 aa, Glycine max
  Coding DNA Sequence Number=SeqID_32060
  Gene Ontology: Mol. function=sulfuric ester hydrolase activity; Cellular component=integral to membrane; Biological process =metabolic process
  Homolog annotation: Hit_ID=A1JLM3; Match level="QueryCoverage=32%, HitCoverage=35%, E-value=5e-48, Identity=47%"; Hit description =Putative membrane protein
  Pfam annotation: Domain name=ACPS; Domain location=489-552; Score =26.2; E_value=8.6e-06; Accession=PF01648.11; Description=4' -phosphopantetheinyl transferase superfamily
WQNWLNGQKGGAPWFSWIALNGVTVTGDSTKARQRSYMRQATGVDEQIATVLHTLQQNDALKNTVVVITAQRAITFDNSDNPGNRATLQVPLVVHWPNTPAQSIDRLTDQQDVMTTLMQRLLHVRTNPVNYSQGEDLFAAQRSHNWVASSEDGKLVVTTPTVTLVLSNNGNYSAYDAQGKELKDHKPQLALLLQLSCRHIAIANGTSSITLHVRHVAQPGSALSWGVRGRSAQKRCQVQYLHPVVLGKSLLTCTWGRNHRRNGWQRFKMTAPLTAPDAASIRHPLRLALTVIVQGSCKILQHKISHHTSFMLRIRMRKNSCTQASAKWSWRMILAAMISSAWRATDEELRYPAKSLTRSSLFGLLCPRLTAETPLPLPACGFITAAGHTAESLSLAWCRFDRQQWHAALPAQWQLPLPSALQQAASKRKIEYLASRWLVRQQLAQLGITDFVLHNAPDRSPCWPAGIRASLSHSHDCVVMAATREALYVGIDVEQVMAEETAQDTAELLMNAQERALLEGQPLPFAQAATLLFSLKESLYKALWPRLHQPMAFHQAVLIDIDLPQQRARLQLCQDFSAEFTRSTVLDARFWLQPTRVVTLLTHPACTQ

SEQ ID NO: 123746 - protein, 268 aa, Glycine max
  Coding DNA Sequence Number=SeqID_32061
  Gene Ontology: Mol. function=oxidoreductase activity, acting on NADH or NADPH; Cellular component=integral to membrane; Biological process=ATP synthesis coupled electron transport
  Homolog annotation: Hit_ID=A7FGR6; Match level="QueryCoverage=100%, HitCoverage=55%, E-value=1e-107, Identity=73%"; Hit description=NADH- quinone oxidoreductase subunit N
  Pfam annotation: Domain name=Oxidored_q1; Domain location=122-268; Score=7.1; E_value=3.1e-07; Accession=PF00361.11; Description=NADH -Ubiquinoneplastoquinone (complex I)
MTITPQQLIALLPLLIVGLTVVVVMLSIAWRRNHFVNATLTVIGLNLALLSLWFVGHVGAMDVTPLLRVDGYSMFYTALVMLASLATCTFAYPWLAGFPDNKDEFYLLVLIAALGGIVLASANHLAALFIGIELLSLPLFGLIGYAFRQKRSLEAALKYMILSAAASSFLIFGIALVYADSGSLSFVQLGKSLNDSMIQQPLLLVGLGMMIIGLGFKLSLVPFHLWTPDVYQGAPAPVSTFLATASKIAIFAVIMRLFMYAPVTDSEA

SEQ ID NO: 123747 - protein, 393 aa, Glycine max
  Coding DNA Sequence Number=SeqID_32062
  Gene Ontology: Mol. function=FMN adenylyltransferase activity; Cellular component=cytoplasm; Biological process=Mo-molybdopterin cofactor biosynthetic process
  Homolog annotation: Hit_ID=Q6D7V6; Match level="QueryCoverage=99%, HitCoverage=98%, E-value=1e-144, Identity=65%"; Hit description =Putative molybdopterin binding protein
  Pfam annotation: Domain name=CinA; Domain location=247-373; Score= -65.5; E_value=0.0039; Accession=PF02464.8; Description=Competence -damaged protein
  Pfam annotation: Domain name=MoCF_biosynth; Domain location=1-166; Score=155.9; E_value=1.1e-43; Accession=PF00994.15; Description =Probable molybdopterin binding domain
  Pfam module annotation: Pfam domain module=CinA::MoCF_biosynth; Domain location=247-373::1-166
MLSTGDEVLHGQIVDTNAAWLADVLFQHGLPMTSRSTVGDAMSSLVEALQSRSQIADVLIVNGGLGPTSDDLSAQAAATASGSELVLQQAWLEKMEAWFASRGRLMAPSNRKQAEIPANAELIDNPVGTACGFALQLNRCWIFFTPGVPSEFKVMVEQQIIPRLKARFTLPEPPLCLRLTTFGRGESDIAAELEPLPLPEGVVMGYRSSMPIIEIKLTGPASQRVAMEQVWQQVKLLLAECTIFEGFEGLPAVLARELHDRGFRLALSEQYTAGLLHWQLAAAQVPLSAAELLPAREESLEAQVTRTRQLAAQQGTVLALSVGDLQEGEVSIALHTPEASWGQRVKFTHGRHNLETRQKVVAMMAMNMLRRWLHGSEVSTGHGWIDVLETVKS

SEQ ID NO: 123748 - protein, 633 aa, Glycine max
  Coding DNA Sequence Number=SeqID_32063
  Gene Ontology: Mol. function=ribonucleoside-diphosphate reductase activity; Cellular component=ribonucleoside-diphosphate reductase complex; Biological process=DNA replication
  Homolog annotation: Hit_ID=P37426; Match level="QueryCoverage=100%, HitCoverage=83%, E-value=0.0, Identity=92%"; Hit description =Ribonucleoside-diphosphate reductase 1 subunit alpha
  Pfam annotation: Domain name=ATP-cone; Domain location=5-94; Score =86.7; E_value=7.4e-23; Accession=PF03477.7; Description=ATP cone domain
  Pfam annotation: Domain name=Ribonuc_red_lgC; Domain location=222 -633; Score=595.0; E_value=7e-176; Accession=PF02867.6; Description =Ribonucleotide reductase, barrel doma
  Pfam annotation: Domain name=Ribonuc_red_lgN; Domain location=141 -220; Score=90.6; E_value=5e-24; Accession=PF00317.12; Description =Ribonucleotide reductase, all-alpha d
  Pfam module annotation: Pfam domain module=ATP-cone::Ribonuc_red _lgC::Ribonuc_red_lgN; Domain location=5-94::222-633::141-220
MNQSLLVTKRDGRQERIDLDKIHRVLDWAAEGLNNVSVSQVELRSHIQFYDGIKTSDIHETIIKAAADLISRDAPDYQYLAARLAIFHLRKKAYGQFEPPKLYDQVVKMVEMGKYDRHLLEDYSTEEFEQMDGFIDHWRDMNFSYAAVKQLEGKYLVQNRVSGEIYESAQFLYILVAACLFSGYPRDTRMDYIKRFYDAISTFKISLPTPIMSGVRTPTRQFSSCVLIECGDSLDSINATSSAIVKYVSQRAGIGINAGRIRALGSPIRGGEAFHTGCIPFYKHFQTAVKSCSQGGVRGGAATLFYPMWHLEVESLLVLKNNRGVEGNRVRHMDYGVQINKLMYTRLLKGEDITLFSPSDVPGLYDAFFADQDEFERLYTKYEKDDSIRKQRVKAVDLFSLMMQERASTGRIYVQNVDHCNTHSPFDPAIAPVRQSNLCLEIALPTKPLEDVNDESGEIALCTLSAFNLGAIESLDDLEELATLAVRALDALLDYQDYPIPAAKRGAMGRRTLGIGVINYAYYLAKHGVRYSDGSANNLTHKTFEAIQYWLLKASNELAKEQGACPWFKETTYSQGILPIDTYKKDLDSVCNEPLHLDWEALRESIKTHGLRNSTLSALMPSETSSQISNATN

SEQ ID NO: 123749 - protein, 599 aa, Glycine max
  Coding DNA Sequence Number=SeqID_32064
  Gene Ontology: Mol. function=transferase activity, transferring phosphorus-containing groups; Cellular component=integral to membrane; Biological process=two-component signal transduction system (phosphorelay)
  Homolog annotation: Hit_ID=P14376; Match level="QueryCoverage=92%, HitCoverage=58%, E-value=0.0, Identity=63%"; Hit description=Sensor kinase protein rcsC
  Pfam annotation: Domain name=HATPase_c; Domain location=388-498; Score=155.0; E_value=2.1e-43; Accession=PF02518.17; Description =Histidine kinase-, DNA gyrase B-, and HSP90-like ATPase
  Pfam annotation: Domain name=HisKA; Domain location=276-341; Score =78.2; E_value=2.6e-20; Accession=PF00512.16; Description=His Kinase A (phosphoacceptor) domain
  Pfam annotation: Domain name=RcsC; Domain location=515-599; Score =23.7; E_value=8.7e-07; Accession=PF09456.1; Description=RcsC Alpha -Beta-Loop (ABL)
  Pfam module annotation: Pfam domain module=HATPase_c::HisKA::RcsC; Domain location=388-498::276-341::515-599
MYWITNSSQPGIGNFYMVVPVYVANKLQALLGVEQNIRLDEFIQPGGLPLVATITDENYRPLISSRRGGPGYSLDDLPDNSTWFGYLDGYRQLVLKKPLPPSSLNVVWSLSTDVLMDQLKLMLINALLLNILSALILFTLAWVFERRMFLPAEDNAHRLEEHEQFNRKIVASAPVGICILRTSDGTNILSNELAHNYLTLLTQEDRLRLNEIIGGQQVNFVDMLTGSNTNLQISFVHSRYRNENVAICVLVDVSARVRMEQSLQEMAHAAEQASQSKSMFLATVSHELRTPLYGIIGNLDLLQTKSLPKGVDSLVTAMNNSSSLLLKIISDILDFSKIESEQLKIEPRPFSPREVVNHIASNYLSLVVRKRLTLYVFIENDVPLALDGDPLRLQQVISNLLNNAIKFTHTGCIILHAYVKEGYLAFRVRDTGVGIPAKEITRLFDPFFQVGSGVQRNFQGTGLGLAICEKLINMMDGDIEVDSEPGMGSQFVVRIPIYAGQQPAPPLLDGLQEKAIWLDLRNDYLAAFLLRLLQQQGIQVAHYQGRAGADDVMICDHHDAPAQTVRARIRNDAGTVGAQQRDAARSAAAAGPDLSHAID

SEQ ID NO: 123750 - protein, 417 aa, Glycine max
  Coding DNA Sequence Number=SeqID_32065
  Gene Ontology: Mol. function=protein histidine kinase activity; Cellular component=integral to membrane; Biological process=two -component signal transduction system (phosphorelay)
  Homolog annotation: Hit_ID=A7MPB3; Match level="QueryCoverage=92%, HitCoverage=43%, E-value=2e-91, Identity=45%"; Hit description =Putative uncharacterized protein
  Pfam annotation: Domain name=HATPase_c; Domain location=90-202; Score= 40.4; E_value=6.2e-09; Accession=PF02518.17; Description=Histidine kinase-, DNA gyrase B-, and HSP90-like ATPase
  Pfam annotation: Domain name=Hpt; Domain location=331-414; Score =47.2; E_value=5.6e-11; Accession=PF01627.14; Description=Hpt domain
  Pfam module annotation: Pfam domain module=HATPase_c::Hpt; Domain location=90-202::331-414
MVTQLVQLSQRDDDESVLDLLDESQGLARLVDDIVLLNRLEAHDWSPDAGVFNLQDLLDEIALESLPLLRRKGLTLVVNNQLANDEMRFGDRRALRKVLTTLMHYALTTTQWGKISLDIKASDSKANSVLFQLVDTGSGLTGDELANVDFPYLGETTQDRYGQASGMAFFLCKQLCKQMGGQLEIIAKPDIGTRYNIQLPLALEQQSEQEEKLLEGVTALVDIAVEDVHKIVCRHLENWGANCLTSDERLSGQERDVLVTDDPARLHGWALLLAGDEMGHHALNDQQFRVNFNLSNALLDALLALIEKQLAHDSIEESDDDEAATPLLSGGYFQLFTETVPPDVKRLYTESAEKDYPSLAQTAHRLKGVFAMLNLLPGKQLCEELEQHIKLCDDLTIKNTTSEIDAYVNQLLQQGNQ

SEQ ID NO: 123751 - protein, 164 aa, Glycine max
  Coding DNA Sequence Number=SeqID_32066
  Homolog annotation: Hit_ID=P03851; Match level="QueryCoverage=49%, HitCoverage=96%, E-value=2e-42, Identity=98%"; Hit description =Uncharacterized 9.4 kDa protein
STLEDPRLSTESGDNAGKNMTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVADYAQKKGSQEDPLIFSTGSDAQWNENS

SEQ ID NO: 123752 - protein, 127 aa, Glycine max
  Coding DNA Sequence Number=SeqID_32067
  Homolog annotation: Hit_ID=A0ST23; Match level="QueryCoverage=25%, HitCoverage=67%, E-value=2e-12, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVDSRGSPDKQRPMWSSAPFPEMSTSPVGKPVVPAALMNRPTRGERRFAYWALFRFLAH

SEQ ID NO: 123753 - protein, 101 aa, Glycine max
  Coding DNA Sequence Number=SeqID_32068
MGEVEEVQEQTKADTEALKEKMATMMEAMMSIKEIMEVSAAYRTCARARVMGEVEEVQEQMKADMEAMKEKMATMVEAMMSMKKIMEANTVAVAATSAVAK

SEQ ID NO: 123754 - protein, 176 aa, Glycine max
  Coding DNA Sequence Number=SeqID_32069
  Pfam annotation: Domain name=zf-CCHC; Domain location=84-101; Score =17.5; E_value=0.0034; Accession=PF00098.14; Description=Zinc knuckle
MSHHSYSVNGEGTSHKDTLSRILHELSSLKLWKEKLERKEKGKERKDQAQGILGVTPSKPKDDKGKTIERQPLKASMQEKTRFIKCSKCLGRGHITSQCPTKKTMIMRGQDIYSSQDEATTSPSSSESEEAKGEKPSEEIYPQEEGQPLMVKEECKEASVSSKRLAKKERHFGGIL

SEQ ID NO: 123755 - protein, 75 aa, Glycine max
  Coding DNA Sequence Number=SeqID_32070
IAYPAFTGRVASLGEWRGRRGQGMRKQITPIKEAKTRTLNQNQRFLLSFKGVVKKAKDEASRSDTAFGSLPLRRQ

SEQ ID NO: 123756 - protein, 179 aa, Glycine max
  Coding DNA Sequence Number=SeqID_32071
MAPTRHPLDPDKSNRALGFPALITGLCQSFGVPVAPTKVIQPPITRAFIEKYCTQRQAQGNAPPAAGAPPPPHQAGPAGSFDMEQYLRHLVRQQAANHRAHVQTHDCLYQMSLSMQSQGFASFSCPTPDQFRAEVAWPGDWPEAQAGEAPPEVPGDGEEAHEDEEMADLLNFLGGSGAT

SEQ ID NO: 123757 - protein, 244 aa, Glycine max
  Coding DNA Sequence Number=SeqID_32072
  Homolog annotation: Hit_ID=A5BSS4; Match level="QueryCoverage=80%, HitCoverage=11%, E-value=7e-09, Identity=25%"; Hit description =Putative uncharacterized protein
MWDATLFGLFNEKFPLYIKHEDLSEIAHGGQCLSISVIQLWILHMTETSMRAGNIDVYGFLEPQSIQRSGQSQFESENYIKNWMQNSKRDVYLGAYLNGIITYIGLPLQCTLANGRHLPKENVVIWFCSLHNKPDNYLKGIINRSVLFFNIFALALVSALKGLDDTQQSKSKTPARWIVVKCNRQKGSTECGYYVMHWMSTIILGNFQNNWEMYFTDPRPLEPERLKALRNQWAKYYLKVKNET

SEQ ID NO: 123758 - protein, 118 aa, Glycine max
  Coding DNA Sequence Number=SeqID_32073
MPYVEAAEESLETAFQSFEVGLRGPPSLCWEPADAREKEKCGGTDGEAPQLLRIKIFQQRGPRKNGGVERRCLEEAKRIPSDNSAERIREGYRTVNKTPAQRSRCWRQEMSFEPRSAI

SEQ ID NO: 123759 - protein, 42 aa, Glycine max
  Coding DNA Sequence Number=SeqID_32074
MSAEKYKSRLYNDRCREMFDRRHPVIASFLDLDRLMFFLPSK

SEQ ID NO: 123760 - protein, 90 aa, Glycine max
  Coding DNA Sequence Number=SeqID_32075
MGEVEEVQMKAEMEAMKEQMATMMEAMMSMKKIMEANAVAIAATIVVAKAKIWEVRAAPVMRKFKTSMPSHHMACPPTIHHPIWHTMGIL

SEQ ID NO: 123761 - protein, 75 aa, Glycine max
  Coding DNA Sequence Number=SeqID_32076
RYHSFEKHIAAVGTTNNNMLSKRKTLDEGSLLSSKSETQHDHRFTSTPYDPMDSGIRPLFNSPCVQKGIGVVCIK

SEQ ID NO: 123762 - protein, 98 aa, Glycine max
  Coding DNA Sequence Number=SeqID_32077
MGLNQFRFFNMVHDILVKVKLEVTRTSTVLNVFGTWFNPITQGKAILIANTSTTFHRDERLRNTHTMHEECNYQIEKWVYDPNMVGSWCLTHATKNVV

SEQ ID NO: 123763 - protein, 296 aa, Glycine max
  Coding DNA Sequence Number=SeqID_32078
  Homolog annotation: Hit_ID=Q2HW90; Match level="QueryCoverage=61%, HitCoverage=39%, E-value=1e-11, Identity=29%"; Hit description =Putative uncharacterized protein
EGKEGVLFSCGDYPNVPLIGTRGCINYNPALAIRQLGYPMRGAPMEENLSPFLVRDFGAQSLEVVQRVHKAWRSPLRKDKELRGIRNGVIGGSHEWLRAHTRGLDWLSKLKFIDEKNFEAPKEDEEVQALKLELGKARLAKEKFKTAATNIRKECTELREENAATARALEQETKRARKEEHGQDKLRELCGAATMSSSSGERKGTSHGSLAQHLEATEQSMLAIIGQYKEELNQSLTHEQKLVEDFAQAYAENEARGRVIDALHQEATMWMDRFALTLNGSQDLPQLLAKAKAIAE

SEQ ID NO: 123764 - protein, 148 aa, Glycine max
  Coding DNA Sequence Number=SeqID_32079
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSAGIL

SEQ ID NO: 123765 - protein, 162 aa, Glycine max
  Coding DNA Sequence Number=SeqID_32080
MVCLPNYTPPNVVYIPNEDVNNSTPILIKSQQPQSDHAHVSRPMEETHEIPHHNLADFEPWLGYATEGQAVGGIPFENTLEGPQFCPQPQPLHFAVGRAPPATAEQERVKFSSALLNPYESCSEVCRSNMVPFPGYRVEPSSWTFRQVQGYLSSSTKSEIWK

SEQ ID NO: 123766 - protein, 142 aa, Glycine max
  Coding DNA Sequence Number=SeqID_32081
MEVGKDPQGMYPLLFSLNTKWMYPPLELIAQEMYPLLFSVKTTQVDVPSTCTTKDVPSNVLRQNFQAVSPLNPCKGKQKISQAISPLKSFVYGKGKNQKNSQAVSSLNCLGKGEGRHKRIQAVSPSILLEKGEERQKKNSGD

SEQ ID NO: 123767 - protein, 68 aa, Glycine max
  Coding DNA Sequence Number=SeqID_32082
MVDEPRSRPITCEPVSSGPIDDPLRARTLPTRPQVRRGYPLSLSISISGGKETNKDSLSNGERTGGIL

SEQ ID NO: 123768 - protein, 64 aa, Glycine max
  Coding DNA Sequence Number=SeqID_32083
MAARELSPLIACSLEVTITLDDVASLLHLPIRQELRRFSVMALIFDYCGYETCIKRRLRHITGL

SEQ ID NO: 123769 - protein, 87 aa, Glycine max
  Coding DNA Sequence Number=SeqID_32084
MAQERVCSLPLFGNLWDNIYGSLITTSQPFITHTARLTGALAKGGKMRGVATNVDKSGAFAPTYPPLERKSDLRSSYLGMNQAILFT

SEQ ID NO: 123770 - protein, 109 aa, Glycine max
  Coding DNA Sequence Number=SeqID_32085
MTNANCPQESLHSVSNGNLRVLNSKYGGWRNLEETGNSAKQCVWWRDVKQAFNQSQQELVIQNNMRWKVGDGEKVRFWTDKWINQEESLAERYPRLFIISLLDKWPQIS

SEQ ID NO: 123771 - protein, 177 aa, Glycine max
  Coding DNA Sequence Number=SeqID_32086
MSSKLAGFICSLYSPFCCLWPIRGGVMMLDLEIFAHFLHHLIVQIGAIVSNDLPGRINLPSPSNGWDSTWAASPQLGHLFLHMEKGQGADITFRGCGLDLVHWFRSGLCRRSGQAVLKEIGPIAFCPQNTPPSFGNTSEDPFWTCRPFVLIKVWMVPLTKKPVANLLNVLLSLSEIP

SEQ ID NO: 123772 - protein, 127 aa, Glycine max
  Coding DNA Sequence Number=SeqID_32087
MRVSFATLNIHGITLKGKQDENWGQLFAPMINQWNNRADFRVDGYPRQEGLLSFNSDYMVWYRRKTKMFVDPKNASTITLTEVVETLQYMVSPQGRNTWTVDDLVPYVEKITILSEEQERINEPMSH

SEQ ID NO: 123773 - protein, 239 aa, Glycine max
  Coding DNA Sequence Number=SeqID_32088
  Homolog annotation: Hit_ID=Q5NRP4; Match level="QueryCoverage=46%, HitCoverage=7%, E-value=4e-07, Identity=30%"; Hit description =Putative gag-pol polyprotein, identical
  Pfam annotation: Domain name=zf-CCHC; Domain location=104-121; Score =22.3; E_value=0.00064; Accession=PF00098.14; Description=Zinc knuckle
MHRSHLRPHSHRREKERKPQEANINLPYFQGKDNLEANLVLEIRVEQQLKKKSTSKSYGSHSYPKKYQGQGILGVTPSKPKDGKGNTIEKQALKARMQENASSIKCFKCLARGHITSQCPTTKTMIMRGQDIYSSQDEATTSPSYSESEEAKREESSEEIYPQEEGQPLVVKEKCKETLASIATPLGLEVIPQVKKLLDEGLVRKSLNPCALLVPKIGIINIKIQKKIVIKGFPRTLRE

SEQ ID NO: 123774 - protein, 15 aa, Glycine max
  Coding DNA Sequence Number=SeqID_32089
VNAVKIFPDAQNGLG

SEQ ID NO: 123775 - protein, 82 aa, Glycine max
  Coding DNA Sequence Number=SeqID_32090
  Gene Ontology: Mol. function=serine-type endopeptidase activity; Cellular component=chloroplast; Biological process=proteolysis
  Homolog annotation: Hit_ID=A4GGD0; Match level="QueryCoverage=89%, HitCoverage=37%, E-value=2e-32, Identity=97%"; Hit description=ATP -dependent Clp protease proteolytic subunit
  Pfam annotation: Domain name=CLP_protease; Domain location=2-82; Score=-9.9; E_value=9.7e-08; Accession=PF00574.14; Description=Clp protease
MNAGMEKPVMIHQPASSFYEAQTGEFILEAEELLKMRETITRVYVQRTGKPLWVISEDMERDVFMSAAEAQAHGIVDLVAVE

SEQ ID NO: 123776 - protein, 107 aa, Glycine max
  Coding DNA Sequence Number=SeqID_32091
  Homolog annotation: Hit_ID=A5ASG5; Match level="QueryCoverage=94%, HitCoverage=8%, E-value=2e-09, Identity=35%"; Hit description =Putative uncharacterized protein
NDICDDPFVFASQAKKVFYVEDKTQNSWLVVVHAKIRDVYDMGDKQSNDTDQGNEQVLQEINHNGLIRVEADDSDDIIEVTIPMENILPHDKDDNYIDDDESDADFF

SEQ ID NO: 123777 - protein, 71 aa, Glycine max
  Coding DNA Sequence Number=SeqID_32092
TYQGNPCGVYPDLSSLTGSGVYPDLSSFTRSGVYPDLSSLFGSGVIQISVACIKRFVPSQDHIIWYQSFGS

SEQ ID NO: 123778 - protein, 39 aa, Glycine max
  Coding DNA Sequence Number=SeqID_32093
MPNPAKFITETSISRLAGVTPTNRSIEGSLIMKCGEILT

SEQ ID NO: 123779 - protein, 17 aa, Glycine max
  Coding DNA Sequence Number=SeqID_32094
MADQWATKSKAKGSKIP

SEQ ID NO: 123780 - protein, 221 aa, Glycine max
  Coding DNA Sequence Number=SeqID_32095
QRAVFAPRYPAALRRHQNVAHALADVVNVRDRLAGAPVARPQINPRMLPARAHASRQTERFSRYSSVVPLVQISSCPGIPAHTMKPACAVLKHVWLAPPNSRLAGQAFPESYGSGSANAVSRLPPSAQQYNTCSPTDGFHHVRVLPARRVSQLIQSGFKVARFHPAQPVHLIHLGHSAGADQARGVILRAVSQHRQQRAVFAPRYPAALRRHQNVAHALAD

SEQ ID NO: 123781 - protein, 201 aa, Glycine max
  Coding DNA Sequence Number=SeqID_32096
EEFDIPEASDSRTKRKLLHTVGERWRQFKTDLTRKWAHAADQDGVEDTVCEKYGISKEKWAQFCQTPRDPLGRYDVRKKAQAIRSRILPPTFCLVGDSFEEQATQGSFIPHERQDVLAAAIGRPEHPRRVRAAGAGVTIKKYFGSAPRTSRSASSLPPDELQQLTQQIRDQLEESITEKVTRQVMASFSHMQSQLQSQMQS

SEQ ID NO: 123782 - protein, 138 aa, Glycine max
  Coding DNA Sequence Number=SeqID_32097
  Gene Ontology: Mol. function=endonuclease activity
  Homolog annotation: Hit_ID=Q9AY32; Match level="QueryCoverage=36%, HitCoverage=77%, E-value=1e-19, Identity=96%"; Hit description=RRNA intron-encoded homing endonuclease
STLEDPANYPILTRGVKKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGRHHQ

SEQ ID NO: 123783 - protein, 118 aa, Glycine max
  Coding DNA Sequence Number=SeqID_32098
MPGDHNANLPLQMYQLGSRLQDTLVDPEEVQQGPRVSSSGIAPARHPVDLKKSSRFYGVPVTSSKGIRPPTNRVFIKKYCIPRQAQGETPQQPGDGQQRATNAPPSPLEFTSAHPQKG

SEQ ID NO: 123784 - protein, 287 aa, Glycine max
  Coding DNA Sequence Number=SeqID_32099
  Gene Ontology: Mol. function=metalloendopeptidase activity; Cellular component=integral to membrane; Biological process=proteolysis
  Homolog annotation: Hit_ID=Q1H146; Match level="QueryCoverage=95%, HitCoverage=60%, E-value=1e-58, Identity=41%"; Hit description =Peptidase M50, putative membrane-associated zinc metallopeptidase
  Pfam annotation: Domain name=PDZ; Domain location=37-113; Score=23.9; E_value=0.00059; Accession=PF00595.15; Description=PDZ domain (Also known as DHR or GLGF)
  Pfam annotation: Domain name=Peptidase_M50; Domain location=15-283; Score=-7.6; E_value=0.00073; Accession=PF02163.13; Description =Peptidase family M50
  Pfam module annotation: Pfam domain module=PDZ::Peptidase_M50; Domain location=37-113::15-283
EAQWQMLESWVAHRPATVLTKTVQGDVHQHLLPLNRLPGDPDGEVMQKAGLAVLMPVIPAVIGEVLPGSIAEQNGLQTGDRILKVNQKTISDWQQFVKLVRGHPGQSLKIEYQRDEHVFQVKLLPESVQQGGQKIGRLGAAVNMEAVDMAPYQVVRQYSITQAAQRAVDKMQETIAFTLKMLGKMITGQASLKAISGPVSIADAAGESAGMGVKPYIGFIALLSISIAVMNLLPIPVLDGGHLLYHMAELIRGEPLPDKVLAIGQRLGLGVMHLNAYATEPFVITDI

SEQ ID NO: 123785 - protein, 105 aa, Glycine max
  Coding DNA Sequence Number=SeqID_32100
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=47%, HitCoverage=9%, E-value=1e-17, Identity=92%"; Hit description=ATP synthase subunit alpha
  Pfam annotation: Domain name=ATP-synt_ab_N; Domain location=1-45; Score=10.2; E_value=0.022; Accession=PF02874.14; Description=ATP synthase alphabeta family, beta-barrel domain
MAGELVEFEEGTIGIALNLESKNVGVVLMGDGLMIQEGSSVKATGRIAAVDLEAPVVNTLQEREHILEYTIVVAETADSPATLQYLALIQGSSRLNILCTVNVTL

SEQ ID NO: 123786 - protein, 321 aa, Glycine max
  Coding DNA Sequence Number=SeqID_32101
  Homolog annotation: Hit_ID=Q6WAY6; Match level="QueryCoverage=23%, HitCoverage=12%, E-value=2e-09, Identity=44%"; Hit description =Putative uncharacterized protein
MAGIGGYPNIPLIGTRGCINYNPALAIRQLGYPMRGAPMEESKSPFLVRDFGAQNFKAIQRIHKAWETPLRKDQELRGIRNGIIGGYHECLKVHIRGLDWLAKLKVVSEDSFEAPKKTKKSKLSKRVRKGELAKEKFKLAATHIRKECAGLREKNATTAKALEQETKRARKEEYGRNKFRGALWGSNSELKLRREERDQSRAHSMVLKEELVACSRSKRSLSQRLCETETNMLAIIAKYQEELSLATTYEHRVADKYAQVYAEKEARGRVIDSLHQKATMWMDRFALTLNGSQELPRLLAKAKAMADTYSAPEEIHGLLGY

SEQ ID NO: 123787 - protein, 63 aa, Glycine max
  Coding DNA Sequence Number=SeqID_32102
MSRNFTYCATKGAKYLEAVKQRLHAIKQWYPDEIRENYKQLGLNPELGLDLKRAANFILSNLI

SEQ ID NO: 123788 - protein, 40 aa, Glycine max
  Coding DNA Sequence Number=SeqID_32103
MPSTSQGPKKGRMSSSKGPRTKLGYDRNGFMIPTWLAHGD

SEQ ID NO: 123789 - protein, 220 aa, Glycine max
  Coding DNA Sequence Number=SeqID_32104
SFESSHTGIVVPHGRQDVLAAAIGRPEHPGRVRAAGAGVTIKKYFRSAPRTSRSASSLPPDELQQLTQQIRDQLEESITEKVTRQVMASFSHLQSQMQSQGVAVPPEPWFGPGPKNSGSIVSTKTLFVLPQAEFDILRRASDSAVYIEKRSPTRPWCHGRQKLLAEKTKKKLQEAAQSGSVDGVIDPPSPVRRHVKWKMARTKKTGEITTEAAKKIAEKI

SEQ ID NO: 123790 - protein, 327 aa, Glycine max
  Coding DNA Sequence Number=SeqID_32105
  Homolog annotation: Hit_ID=UPI00016621D1; Match level="QueryCoverage =66%, HitCoverage=40%, E-value=7e-17, Identity=34%"; Hit description =UPI00016621D1 related cluster
MSKSCGFGMTGPLDESISCFLIRVDPWVLVPITFRGLHVLALRGLHVLTFVGLHALTFRGPHVLNFRGLHALAIRGPHVLTFVGLHALIFRGPHVLTFRGLHALAIRGPHVLTFRGLHALAIRGLHVLTFRGLHALAIRGLHVLTFRGLHALAIKGLHVLTFVGLHVLTFRGPHVLTFRGLHALAIRGLHVLTFVGLHALAIRGLHVLTFRGLHALTLRGLHVLAIRGLHTLTSRGLHILALRGLHALTFRGLRYGPGVSSSGYGPLDCARKTPSGPKEGQQGLGVASSKYGSLKVIRPPTNRAFIKKYCAPRQAQGETPQQHWDGR

SEQ ID NO: 123791 - protein, 58 aa, Glycine max
  Coding DNA Sequence Number=SeqID_32106
MDRATSLLRLLPNTFSIVDILVTSSFTLTKIGGAREDEGRHGGHERENGHNDGGHDKA

SEQ ID NO: 123792 - protein, 144 aa, Glycine max
  Coding DNA Sequence Number=SeqID_32107
MASGLELSAGRVREPSFEWETFVVERALFARWALDWKGFRRGPKSWVGVGNIGKCYEGSGIIELSPFQAYLDPLARKYQICEARGHRTSTAKRNFSMLSTIEESGRASISGSRAKREIKALSATVVFSQAQCMTGAKLKSTYSR

SEQ ID NO: 123793 - protein, 202 aa, Glycine max
  Coding DNA Sequence Number=SeqID_32108
  Homolog annotation: Hit_ID=Q6WAY6; Match level="QueryCoverage=19%, HitCoverage=6%, E-value=7e-08, Identity=64%"; Hit description =Putative uncharacterized protein
MQDEQCKDVYCTPALYVWLISHMFCHESRPVSPLQGHRMCAEKGKANWEEILVNMGFPNVPLMGMRGCVNYNPVLVIRQLGYPMRGAPSEESIAPFIARGFSDPNAKGSSGEVTKVPEESEEVQALKAELERMRAVKEKFKTMAIRVRKKCDMLKDINVVTTEALERETKRAQKEEWGRNKFRGALWGSNSKLKLRRAERDE

SEQ ID NO: 123794 - protein, 273 aa, Glycine max
  Coding DNA Sequence Number=SeqID_32109
  Subcellular localization annotation: CTP_CleavageSite=40; ConfidenceScore=5.09e-01
NSRDRAPAAFPSGRPPAGPARGAWRGAVRPAPIGRSAGCSGGKEQQMGQIKPEMEQNRHPQAAAPHPRQAVDHPGQRREDHHQHAAGQMRGAEHQRSDDQRRPGAQPLAEALLQVAAKQRFFGHTDEEQRHGQQQQRRHGQQQRNPARFADVAAAFSGKQRGQAGEQQEGHHRLVEVVIHGERRAERAGFFTVDHQLIVDARHQVQEQRHAAGDHQPFERDRQTTPLAKMVTQPRQRHDGQQATQAERRQHPMIKPHARRGGQDNPGYQPVKR

SEQ ID NO: 123795 - protein, 171 aa, Glycine max
  Coding DNA Sequence Number=SeqID_32110
  Homolog annotation: Hit_ID=A7Q0K5; Match level="QueryCoverage=39%, HitCoverage=54%, E-value=2e-16, Identity=70%"; Hit description =Chromosome chr7 scaffold_42, whole genome shotgun sequence
CTGSYRLAVGTPHLHGEFNFTGYCRRLPGLPFKAYNTSPSDLPAPGRRAPLLPKLRGHFAEFLRHGSLKRPSILYLFTCVGLGYGQFTGRIALPIRSFFLEVSTLLTMTTVATINRLATMAGRYALLSRDPTLTSKQVNYLLKRQSRRATGPGRVRKALMTQARFILGKGE

SEQ ID NO: 123796 - protein, 230 aa, Glycine max
  Coding DNA Sequence Number=SeqID_32111
  Gene Ontology: Mol. function=NADH dehydrogenase (quinone) activity; Cellular component=integral to membrane; Biological process=electron transport
  Homolog annotation: Hit_ID=A7MPB4; Match level="QueryCoverage=100%, HitCoverage=70%, E-value=1e-116, Identity=90%"; Hit description=NADH- quinone oxidoreductase subunit H
  Pfam annotation: Domain name=NADHdh; Domain location=13-230; Score =320.2; E_value=3.9e-93; Accession=PF00146.12; Description=NADH dehydrogenase
MSWLTPDLIDILLSILKAIVILLVVVTCGAFMSFGERRLLGLFQNRYGPNRVGWGGSLQLVADMIKMFFKEDWIPRFSDRVIFTLAPMIAFTSLLLAFAIVPVSPTWVVADLNIGILFFLMMAGLAVYAVLFAGWSSNNKYSLLGAMRASAQTLSYEVFLGLSLMGVVAQAGSFNMTDIVNNQADIWNVIPQFFGFITFAIAGVAVCHRHPFDQPEAEQELADGYHIEYS

SEQ ID NO: 123797 - protein, 101 aa, Glycine max
  Coding DNA Sequence Number=SeqID_32112
  Gene Ontology: Mol. function=aspartic-type endopeptidase activity; Biological process=proteolysis
  Homolog annotation: Hit_ID=Q2AA10; Match level="QueryCoverage=95%, HitCoverage=27%, E-value=2e-10, Identity=36%"; Hit description =Putative uncharacterized protein
MEEAEKEILETFRRVEEVKELAWAEMSSALIGKSVPHILEKWNNKFDNAMLDLGASISVMPLSICISLSLGPLQSTDVVIHLANRSVAYPAGFIEDVLVRV

SEQ ID NO: 123798 - protein, 379 aa, Glycine max
  Coding DNA Sequence Number=SeqID_32113
  Homolog annotation: Hit_ID=Q6WAY6; Match level="QueryCoverage=94%, HitCoverage=59%, E-value=1e-23, Identity=26%"; Hit description =Putative uncharacterized protein
MASQEKWGPFADILALLIFGVVLFPNVDGLVDLAAIDSFLAYHHSKESPVVAILADLFDTFDQRCEKNSARIVCCLPALCVWLISHLFRQDTRHPCPLQSYRSCAEKGRVVWDQHLAGIGGSTINWFPRWKEGKEGVLFSCGDYPNVPLIGTTGCINYNPVLTIRLLGYPMRGAPTEESLSPFLVRDLGAQGLKVIQRIHKAWRSPLRKDKELRGIRNGVIGENFEAPEEDEEVRALKLELGKARLAKEKFKSAATHIRKSAPSYKRKTQPLQNPLNKKPKGPARRNMAERNSEEHCGVATMSSSSEEKREIGHGNLAQHLEATEQSMLAIIGQYKEELNQSTAHEQKLVEDYAQVYAEKEARGRVIDALHQEATMWMD

SEQ ID NO: 123799 - protein, 137 aa, Glycine max
  Coding DNA Sequence Number=SeqID_32114
MERLPSSHCGEHSVTKVMSFGLKNAVGQLIERLGHGGAVLFHGQSMMSLSQQTRSTWIDIIAPSLTSEYEEPVCPAGSVDKLDSNVKLLKVYRRLSVDSYRSSPPFVSHCSNSYAKTKLTAGMRVAKRLSEGSRSAS

SEQ ID NO: 123800 - protein, 107 aa, Glycine max
  Coding DNA Sequence Number=SeqID_32115
  Subcellular localization annotation: CTP_CleavageSite=75; ConfidenceScore=5.28e-01
GRSLWKNASNAAFYGSWPLLAFAHMFFPALSPDSVDNRITAFEKRKSAQYANRLSPRVGRFINAAGTTGFPTGKRAVSATQLITCKKNLQDSGTLKRVAWGLDVGTR

SEQ ID NO: 123801 - protein, 95 aa, Glycine max
  Coding DNA Sequence Number=SeqID_32116
MSQNFTDCATMLSFDFRHVIELHGLPNDGCQVPRSGQMRVTSQQTDGPRTKLGYDKGHKVVKVLTIKISIPWIMGLNQAYAFKKRFSSSQGQVWK

SEQ ID NO: 123802 - protein, 175 aa, Glycine max
  Coding DNA Sequence Number=SeqID_32117
GELERRNFHKRLTNLADSSIDLALVKEFYANLYSPEGPSPKQVRIRGHLIRIDADNLNDFLETPVVLAEGESLPAYSRYCRMPTDTREIEAAWCIPGRGFILNAEGHLRKILRKYLTTLAQVWSVLSYSNLSPTSHTLDLTVDRARLIFGLVTQLDMNVRALISGQITSMAQSNS

SEQ ID NO: 123803 - protein, 261 aa, Glycine max
  Coding DNA Sequence Number=SeqID_32118
IPTIRGLHALTSRGLHVLALRGLHVLTIRGLHALTSRGLHVLALRRLHALTLGTSYPHRSEDYTGLHALTLGTTYPHRQRTTRPRLERTTRPHHQRAARPHLPEDYKGLHVLAFKGSCTFNFRGLHVLAVKGSCAFTFVGLHALTFRGLHVLTFRGLHDYTPSPSKGDTSELQRATRPRYRGLCVLTFRTSSFLLTVPGPPPDIGGGPTVRAQPEREAITQLLCILGQDFTRAAAKRRGSHPQRHPVNLKKSNRALGFPAL

SEQ ID NO: 123804 - protein, 81 aa, Glycine max
  Coding DNA Sequence Number=SeqID_32119
MSKMEDTLNQFMQDNDEKKNKKGVEKENEKKDEVVTSEEVEEKMINIPFSEVLEQIPTYAKFMKDLLMKKKRIMDGEIIKP

SEQ ID NO: 123805 - protein, 42 aa, Glycine max
  Coding DNA Sequence Number=SeqID_32120
  Gene Ontology: Mol. function=nucleoside-triphosphatase activity; Cellular component=chloroplast
  Homolog annotation: Hit_ID=Q2PMM5; Match level="QueryCoverage=100%, HitCoverage=3%, E-value=4e-09, Identity=52%"; Hit description =Protein ycf2
LDPQQIEEDFSITSSFRDKRIIYDEEDELQENDSEFLQGGTM

SEQ ID NO: 123806 - protein, 214 aa, Glycine max
  Coding DNA Sequence Number=SeqID_32121
  Gene Ontology: Mol. function=nucleic acid binding; Cellular component= cytoplasm; Biological process=regulation of transcription, DNA -dependent
  Homolog annotation: Hit_ID=A1JTB9; Match level="QueryCoverage=32%, HitCoverage=100%, E-value=1e-30, Identity=91%"; Hit description=Cold shock-like protein CspC2
  Pfam annotation: Domain name=CSD; Domain location=4-70; Score=141.8; E_value=1.9e-39; Accession=PF00313.13; Description='Cold-shock' DNA -binding domain
MSNMIKGQVKWFNEAKGFGFITPADGSKDVFVHFSAIQDQGFKTLAEGQNVQFSIENGAKGPSAANPASLRAKVPCYFFICERFSGGETPEDRLRETGLRFCGQTVKKVKIQAAATLIAEAGRARAVSIALDGGPRREGIILAVEVFNEGTMYLVSLDDYPAGVWFFNEIDSRDGTGKILFIDDKKIPVALAGDNAAGILLRAPASDIQMTLSP

SEQ ID NO: 123807 - protein, 25 aa, Glycine max
  Coding DNA Sequence Number=SeqID_32122
MGVKYLEAVKQGSHPNKQMIPGQIR

SEQ ID NO: 123808 - protein, 79 aa, Glycine max
  Coding DNA Sequence Number=SeqID_32123
  Subcellular localization annotation: CTP_CleavageSite=38; ConfidenceScore=5.12e-01
MENSSITVNHLIQPYFNLLSDPPQLRVFNIPSGTTYTRRTARKPHYKRNLKESWASSSKGNNTRKSSLTWIQTENAIET

SEQ ID NO: 123809 - protein, 68 aa, Glycine max
  Coding DNA Sequence Number=SeqID_32124
MGFQTLPYSNIPNTSVDGRSPEFQEPLDLRSNPFQGRENDEILPPQGHWIEDSKKIGPEMQEKALWFS

SEQ ID NO: 123810 - protein, 122 aa, Glycine max
  Coding DNA Sequence Number=SeqID_32125
MPREMGPEIYMIEEVHVEEGSFGTTPWAAYGQEDGLKSRDFPSELSCSCYNLSRGERNDIGIEALGLNVSRFNPRSVDLCHLGRGASAIPMSRGVWWSGSLRKRSSADMVCRGRLSQTTAPT

SEQ ID NO: 123811 - protein, 129 aa, Glycine max
  Coding DNA Sequence Number=SeqID_32126
MQAVGHHRDVVKAAEQGDHLQDGAACVEDDGITIVNKFNGGLGNKRFLVGIDQRFVIDRRVSFVLIQHHPAVSSDDGARVFEQYQVLAYCRAGGVKVVGQILHRAFPLLLQILENGRLPLTWFHRRFVP

SEQ ID NO: 123812 - protein, 214 aa, Glycine max
  Coding DNA Sequence Number=SeqID_32127
  Homolog annotation: Hit_ID=A8ACR3; Match level="QueryCoverage=16%, HitCoverage=71%, E-value=5e-10, Identity=86%"; Hit description =Putative uncharacterized protein
YTVDALAVRGDEGRANLRKAPARLTRRTGGTETSKYPEEKKSTEIPPVAASERGAAQSLNQLYREGKAKRTPARGVKKNLKPCTYKQWEHLRGIDPKPGDLAMGRLKVGTVSARGSSRLTNPMQTTNTEECYHGRHTAGANVRREEGNNPDRQLSLRRWPVRVAGGIRSANADISNDNAGEKPARRKTKGSCPTLIGAGGDGEGYVSRATVVPV

SEQ ID NO: 123813 - protein, 78 aa, Glycine max
  Coding DNA Sequence Number=SeqID_32128
MKANMEAIKQQMTTMMEAMMSMRKMMEDNTATVVAVSTAIEMDLIHLADFNQVNRLVSDVVCQGGSEQAFLPIIWVAS

SEQ ID NO: 123814 - protein, 60 aa, Glycine max
  Coding DNA Sequence Number=SeqID_32129
LASTRKSRAKHLFGHALSRESLALSAQPLHLRLIWSAKLAKAKLSLFQFDLNWAKRWPSR

SEQ ID NO: 123815 - protein, 359 aa, Glycine max
  Coding DNA Sequence Number=SeqID_32130
MVRALEVSFNRMSKKMFEFDSTVFRHFKDYFFKILATDVVADGLPRFSFYYYYDLAGCIDLFVSSLGIMGGQPTTGVGLIDKVVEVFPNMPSCILAKRKHDDGVGVLGYKKSRAPSSLRAMREAEISASSIAASAASLGPIEVPPSVVAAPLLSECRLPPLFTLVFIWITSTLLVMLIHCGRGSPWADLRFNELRTRDAFVLGIGEAHQGDVFVLGFGKAHHGWTLGLTSLYRCIEAHQGADLGFDESLEKRDLLRKNLGFDKLLEKRDSPRTKLEFDEPLEKQDSARTNLGFDEPLENETHQGQAMGLKSLWRSKTHQGQAMGLTSLWRKPLELQLGMHLFGFFQGLPRTNLGFDKPL

SEQ ID NO: 123816 - protein, 55 aa, Glycine max
  Coding DNA Sequence Number=SeqID_32131
MSGHRIRHLGSCSFNASLDFYLALYSTSSILEQDVRTLYPTGTELEFVIMVIAVS

SEQ ID NO: 123817 - protein, 28 aa, Glycine max
  Coding DNA Sequence Number=SeqID_32132
MAGVTDYICETWIVPHKEKFILAWTNKG

SEQ ID NO: 123818 - protein, 109 aa, Glycine max
  Coding DNA Sequence Number=SeqID_32133
  Homolog annotation: Hit_ID=A4DID9; Match level="QueryCoverage=39%, HitCoverage=38%, E-value=7e-11, Identity=79%"; Hit description =Putative uncharacterized protein
PEGQGSCDLMTGEPTTEAPVNGGRNYNGPKGKEGLLLGGPEPSVRYHSGRARILTLCQDLRAEGQSQAEGSLTARPTRRAGTKVGLSDPTVPSGRAVAQRIKVTLGITG

SEQ ID NO: 123819 - protein, 64 aa, Glycine max
  Coding DNA Sequence Number=SeqID_32134
  Homolog annotation: Hit_ID=A7QL08; Match level="QueryCoverage=57%, HitCoverage=50%, E-value=2e-10, Identity=91%"; Hit description =Chromosome undetermined scaffold_116, whole genome shotgun sequence
MVGAGLKKDLRVSRVVPGGSLNAFLFLLIGVISQRLAMCDDLLHGRGLWFKSRMAQLRQGKDRN

SEQ ID NO: 123820 - protein, 221 aa, Glycine max
  Coding DNA Sequence Number=SeqID_32135
  Homolog annotation: Hit_ID=UPI00016621D1; Match level="QueryCoverage =88%, HitCoverage=39%, E-value=2e-15, Identity=32%"; Hit description =UPI00016621D1 related cluster
MSSPSKGLHALAFRGLHALAFRGLDVLTFKGLHALTFRGLYVLPLRGLHVLTFKGLHALTFRGLHVFPFKGLHALAFRGLHVLAFNGLGLHALAFRGLDILTFRGLHALTFRGLYVLPLRGLHVLAFGGLHALTFRGLHVFPFRGLHALAFRGLHVLAFKGLYAFAIRGLHDLTFRGQHVLTFRGLHALAFKGRHVLNFRGLHTLASKATHPKLQGCTPSL

SEQ ID NO: 123821 - protein, 488 aa, Glycine max
  Coding DNA Sequence Number=SeqID_32136
  Gene Ontology: Mol. function=hydrolase activity, hydrolyzing O -glycosyl compounds; Cellular component=extracellular region; Biological process=carbohydrate metabolic process
  Homolog annotation: Hit_ID=A8AIM7; Match level="QueryCoverage=100%, HitCoverage=55%, E-value=0.0, Identity=78%"; Hit description =Putative uncharacterized protein
  Pfam annotation: Domain name=CBM_5_12; Domain location=408-448; Score= 60.4; E_value=6.2e-15; Accession=PF02839.5; Description=Carbohydrate binding domain
  Pfam annotation: Domain name=CBM_5_12; Domain location=458-488; Score= 31.8; E_value=2.5e-06; Accession=PF02839.5; Description=Carbohydrate binding domain
  Pfam annotation: Domain name=Glyco_hydro_18; Domain location=1-158; Score=11.9; E_value=1.1e-07; Accession=PF00704.19; Description =Glycosyl hydrolases family 18
  Pfam annotation: Domain name=PKD; Domain location=187-270; Score =26.7; E_value=8.4e-05; Accession=PF00801.11; Description=PKD domain
  Pfam annotation: Domain name=PKD; Domain location=286-365; Score =32.2; E_value=2e-06; Accession=PF00801.11; Description=PKD domain
  Pfam module annotation: Pfam domain module=CBM_5_12::CBM_5_12::Glyco _hydro_18::PKD::PKD; Domain location=408-448::458-488::1-158::187 -270::286-365
MSYDFYGAWSMTDLGHQAALHAPAWRPDTNYTTANGVDALLQQGVQPGKIVVGTGMYGRGWKGVHGYTGDNPFTGTATDAVKGTWEPGVVDYRQIVNEYKGKPGWEYGYDADAEAPYVFNKSTGELISYEDARSATAKGKYVMAKNLGGLFAWSIDSDNGDILNAMNESLLGGSTPDPVVTNHAPIASAADQTVTGPATVTLDGSASTDPDGDALTYKWTQISGPSVTLTNSTKAKATFSVGAVTSNQTLAFRLTVTDPKGLSSTADVQVVNKAPKANQAPVVNQMQAVTLEAGQSYTLNVQAADPDGDALTYTWSVPSDMHATGTNTSSVQITAPDVSTDSTYTLSVMVSDGKASVQSNVQVTVTPKATPVVPDEDNTPADEGDKPSDEGQATGSCDNPVDANASKYAAWESSKVYNNGDMVSSDNLVWKAKYWTQGNKPGFDADAWEMVSQVKMNWRADKVYNGGDKTSYQGFEYRAKWWTQGDKP

SEQ ID NO: 123822 - protein, 76 aa, Glycine max
  Coding DNA Sequence Number=SeqID_32137
MWTTTGEELATQLAQASKVASSRSNSLLEEGSGRPKWARLLFLSKKLRKLTDCAKTPLFDFRHITEFHGLRKPASF

SEQ ID NO: 123823 - protein, 497 aa, Glycine max
  Coding DNA Sequence Number=SeqID_32138
MTTRPNFRGFHVLTFRGLHALTIRGLHILAIKGTRTLTFRGMHALAFRRLHVLVFREQLALAFKRTTRPPHQRATRAHLKEDHTPSPSEGHIPTTSEDYTSSPSECRVPSPSKAYMSSPSEDYMSSPSKDYTSSPLEGHMTTRLHLQRATRPRHQRATRPHLQRSSRPRLQKTTRPHLKRTICLRLQRTIRPRLQRTTRPRLQRATRPRLQRTTCPHLQRTTCTLLQRATRRRLQKTTRPHLQRTTHLTIRGLHIHDFTGLHVLTFRGLQALTFKGLHAPTFTGLHSTTRPHLQRATRPRLLRTTHPRHNRVVGLLALAFRGLHVLAIRGLHALTLRGLHVVSIRGSRTHTFRGLHILAIRGSRLLALAFRGLHVLAIRGQYVLTFRGLHVVAIRGSHTHTFRGPHILAIRVSRTLTFKGLHVLAFRGLHVLAFRGLHILAFRGPHVVAFRGLHALPLEDYTTSPSGGYTSSPSEGYTPSPSEDFTSSPSEDYTSSP

SEQ ID NO: 123824 - protein, 86 aa, Glycine max
  Coding DNA Sequence Number=SeqID_32139
  Homolog annotation: Hit_ID=A6FJQ2; Match level="QueryCoverage=44%, HitCoverage=84%, E-value=4e-11, Identity=89%"; Hit description=50S ribosomal protein L5
MRKEKLPHQAPFAIQAAQLLGRAIGAGLFAITPAGERGMCCKAIKLGNARLLVSNEFIDSLPSVAPSSSIILEGQLRQCKASVCQL

SEQ ID NO: 123825 - protein, 77 aa, Glycine max
  Coding DNA Sequence Number=SeqID_32140
MYASMQIANQMTWHYENRRSSSVILLMEEQKCLQKKGSRKDESPRMLKPTQVWHRVRDLPKVIETGLPPPNVHGYGE

SEQ ID NO: 123826 - protein, 28 aa, Glycine max
  Coding DNA Sequence Number=SeqID_32141
ECGIIPQYTMSGSPSMNGVAETELLRIW

SEQ ID NO: 123827 - protein, 90 aa, Glycine max
  Coding DNA Sequence Number=SeqID_32142
  Pfam annotation: Domain name=zf-CCHC; Domain location=54-71; Score =9.8; E_value=0.051; Accession=PF00098.14; Description=Zinc knuckle
MILKNQGSHLVHYVSHQENQGAGKKFMKKHDKGNEPLKINDASVQIQKKASENSNCHFCGKAEQFQKDCPKHKAWFEKKDISYNPNHKPK

SEQ ID NO: 123828 - protein, 226 aa, Glycine max
  Coding DNA Sequence Number=SeqID_32143
MLGHREGVRDMRSWVRVSGSRLMPTLSASSGISVSAGKGPGVRVWPEEEPDFARTAAGRRVRIMRTNMTTLTQIWMTLLLSNILPSDHNSDLPLPKCQLVYAILTRMSIHVAQLIADAIYIFAGMAPTRHPLDPDKSNRALGFPSLITGLCQSFGVPVAPTKVIRPPINRAFIEKYCTQRQAQGDAPQAAGAPPPPHQAGQAGAFDMEQYLRHLVRQQVANHRAHV

SEQ ID NO: 123829 - protein, 88 aa, Glycine max
  Coding DNA Sequence Number=SeqID_32144
MLRNFTDYVIIPFLPSRTLRNFTDCALTLPFNFRHVTELHGLCYDAFLLASGMSRNFTNCLTMGAKCLEVVKRGSHPNNGWSPGEIRI

SEQ ID NO: 123830 - protein, 75 aa, Glycine max
  Coding DNA Sequence Number=SeqID_32145
MNFDAYTPVHNHCMFYHLRTKFAKRNLQWLSTRKNPKEDELSSSLSAPIPGHQAHRFSSSAKRKKCAKPISIYAR

SEQ ID NO: 123831 - protein, 132 aa, Glycine max
  Coding DNA Sequence Number=SeqID_32146
MPSPLEDHTSSPSEDYTSSPSGGYTPSPSEDYTSSPSEGYTPLPSEDYMSSPSKGYMPPPSEDYMSLPSEDYTSSPSKDYTSSTSRVAGNRRTATTSRVHLSSSTKSRTHLVAHDPRNLNKTSTSSEGSKIP

SEQ ID NO: 123832 - protein, 80 aa, Glycine max
  Coding DNA Sequence Number=SeqID_32147
  Subcellular localization annotation: CTP_CleavageSite=59; ConfidenceScore=5.31e-01
MANKNISSNETYPSTLIPKTIPKLKNSLRAYKNKMPKSSPNMHVKQEVSTRVKPRLLCKQSMGQNTPNKIDDGSSNSHQG

SEQ ID NO: 123833 - protein, 149 aa, Glycine max
  Coding DNA Sequence Number=SeqID_32148
MGQLQRQAFREAYGKIWDLARVEVSMEPIASLSQCMPCQVSSYPNYGRLVDLAVIRLFPFPFIIGQGKQTGRRHFWPCMTRIDQTVMLKRAAQELFVVHRLSMCGWFRTFFSKKVGSSIRYKVTARASKKRRTNWDQLLASKRASGGIL

SEQ ID NO: 123834 - protein, 46 aa, Glycine max
  Coding DNA Sequence Number=SeqID_32149
MAPDAVFSPYASVRPDTRQHPLTRPDGLVCSRHPLTDKLVTSQELH

SEQ ID NO: 123835 - protein, 172 aa, Glycine max
  Coding DNA Sequence Number=SeqID_32150
MEEGYEAAVQVGAATGGGTRFGCQTLRSWHSHFLDYAQFVKAICQNFGTEHDSEWRLLSLAEISYSGWSFVSLTLLRKVEEEPQLLVVFVVTAVAAAAVLEEEHMACLGQQHSGNKGQAIVVVEDLPISDLDDFSNLDCIYCLKDHNYYVVVGFAAEGVYYKCWQHKLQVAH

SEQ ID NO: 123836 - protein, 105 aa, Glycine max
  Coding DNA Sequence Number=SeqID_32151
  Homolog annotation: Hit_ID=A6FJQ2; Match level="QueryCoverage=36%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVDSRGSPKLEPPFYQSEKNPNSKRTKNSIHRLKKKKIYGYKILFHGEKHGKVVPP

SEQ ID NO: 123837 - protein, 102 aa, Glycine max
  Coding DNA Sequence Number=SeqID_32152
  Homolog annotation: Hit_ID=A5AGE5; Match level="QueryCoverage=82%, HitCoverage=6%, E-value=1e-30, Identity=67%"; Hit description =Putative uncharacterized protein
  Pfam annotation: Domain name=zf-CCHC; Domain location=27-44; Score =10.5; E_value=0.04; Accession=PF00098.14; Description=Zinc knuckle
MSTQQRRPPPLGQRRMTLAEREQYRNEKCQYCDKMGHMTKICWWVSKKPTQSNDIPQALVALTLDNTIAKTEWTFDIGASNHMTGTDSVLIGDGSSLPISWY

SEQ ID NO: 123838 - protein, 125 aa, Glycine max
  Coding DNA Sequence Number=SeqID_32153
VGTGERTRELPGGNAGIFIVLSGFATSDLSVDFCDARQGGGAYGKTPATRPFYADTARRSRTTERSESVSEEAEERPIRKPPLPARNSYDHDYEFELGTDIPEGQQIFDPMVKYGLDPETWVGIL

SEQ ID NO: 123839 - protein, 369 aa, Glycine max
  Coding DNA Sequence Number=SeqID_32154
  Homolog annotation: Hit_ID=Q6WAY4; Match level="QueryCoverage=92%, HitCoverage=59%, E-value=3e-42, Identity=33%"; Hit description =Putative uncharacterized protein
MGTNQNGKRFYQVKVKGLDVTILKELGRLMGPLQRQAFRKVYGKILDLAVAEVFTEAVVSLAQYYDQSLRCFTFGDFQMVPTIEEFEEILGCPLGGRKPYLFFGFLPSLSKVAAVVGDSAKELDRIKQIRNGVVGLPRKYLEDKARDMASQEKWGPFADVLALLIFGVVLFPNVDGLVDLAAIDAFLAYHHSKESPVVAILADLFDTFDRRCEKNSARIVCCLPALCVWLISHLFRQDTRHPCPLQSYRSCAEKGRVDWDQHLAGIGGSTINWFPRSKEGKEGVLFLCGDYPNVPLIGTRGCINYNPALAIRQLGYPMRGAPTEESLLPFLVRDLGAQGLKVIQRIHKAWRSPLRKDKELRGIQNGVIG

SEQ ID NO: 123840 - protein, 170 aa, Glycine max
  Coding DNA Sequence Number=SeqID_32155
MGSSQAPLLKKRFYQVKVKSLGVTSMKELGQLMGQLHQQAFHKAYAIRQVGYPMRGAPLEEDLTPIIARGFNSTNAEALQKVRKAWEMVQKKDKEFRGSSNGPIGGYHRWLKAYMQGLDWLPNLRTTKGWKLKLRRRTKSAGPQTELEKAQTVKEKFKSTALRIRKEMSN

SEQ ID NO: 123841 - protein, 61 aa, Glycine max
  Coding DNA Sequence Number=SeqID_32156
MAAERRRKRERRRHFKEKMSLEEAHHHRRPWIRAWRKKEMNELWFSPTNPRSIPRFSTKCA

SEQ ID NO: 123842 - protein, 106 aa, Glycine max
  Coding DNA Sequence Number=SeqID_32157
MTLMHGSVKNGMQRVRSVPYSRDLYGRELTRLLVVIPKVVISLLKVSRGVSHGKTLHKIKWPNSLKTVPSGVANCRNLPFGERATRDSRDACSTKGIRAESPPTFI

SEQ ID NO: 123843 - protein, 77 aa, Glycine max
  Coding DNA Sequence Number=SeqID_32158
APLPPHQADLVGSLGMEHYLQHLVRQQAANHLGQVQIHECLYQLSLSQQGQGFAPFACPTPDQFRPEVAWPGDWPEA

SEQ ID NO: 123844 - protein, 62 aa, Glycine max
  Coding DNA Sequence Number=SeqID_32159
MAIWWEYLSWVKEDKVFHCRPLDNFIQHYSSATSKVSNTRRTMWWIAATDLSNFYNGFGIHE

SEQ ID NO: 123845 - protein, 165 aa, Glycine max
  Coding DNA Sequence Number=SeqID_32160
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPVKSSSLQHLLSATSLFQDVKTSYVTSPFCSPCLHALAAVSSISYS

SEQ ID NO: 123846 - protein, 193 aa, Glycine max
  Coding DNA Sequence Number=SeqID_32161
  Homolog annotation: Hit_ID=Q2HW90; Match level="QueryCoverage=54%, HitCoverage=20%, E-value=6e-13, Identity=40%"; Hit description =Putative uncharacterized protein
MAVDEEPLQMQAFRKTYGKILELTIAEGSSRAEENRNNLSSGCLPSLSSNCNYGQRFSERFGMKQTRNGIAGLPRRYLEDKARGMANQGDWVPFMDVLALLIFGVVLFPNVDGLVDLAAIDAFLAYHHSKESPVVAILADLFDTFDRRCEKSSAWIICCLPALYVWLVSHLFQQDTRHPCPLLSHRSCTERGE

SEQ ID NO: 123847 - protein, 234 aa, Glycine max
  Coding DNA Sequence Number=SeqID_32162
  Gene Ontology: Mol. function=cytochrome-c oxidase activity; Cellular component=mitochondrial inner membrane; Biological process=electron transport
  Homolog annotation: Hit_ID=P92514; Match level="QueryCoverage=26%, HitCoverage=23%, E-value=2e-29, Identity=98%"; Hit description =Cytochrome c oxidase subunit 3
  Pfam annotation: Domain name=COX3; Domain location=4-75; Score= -102.9; E_value=2.7e-10; Accession=PF00510.9; Description=Cytochrome c oxidase subunit III
VDSRGSPDSIYGSTFFLATGFHGFHVIIGTLFLIICGIRQYLGHLTKEHHVGFEAAAWYWHFVDVVRLLRWFWNSRKEAFKGCALNPIPGFIGAVGVSVGTTLSCRMKSCTTTLTAQAWAGPTSIPRGAGLVRETAIHKSMGLTLYLGMKRGKIACHKSEARFVTLLREGRLASRASRDEAFWRSQVNFGPPNPATDEKAYGVKGSVGTGDGHLEAHHDLQARPARPGKATRLG

SEQ ID NO: 123848 - protein, 87 aa, Glycine max
  Coding DNA Sequence Number=SeqID_32163
GLLLHLRSNLLGVFYPMPLWGRIASALGSAGSPHFVQVQNKYSFPPYGLPPNYTLPNVAHTLDENVDNSAPIPIESQQPQFDHAHVS

SEQ ID NO: 123849 - protein, 105 aa, Glycine max
  Coding DNA Sequence Number=SeqID_32164
  Homolog annotation: Hit_ID=Q2HW90; Match level="QueryCoverage=60%, HitCoverage=13%, E-value=3e-07, Identity=38%"; Hit description =Putative uncharacterized protein
MGQLQHQAFHKTYGKIWDLATIEVSVEAIASLTQYYDQPLRCFTFGDFQLVPTVEEFEEILGCSLGGRKPYLFLGFYPSMARVQRVVKISVQELDRVKNNRNGVV

SEQ ID NO: 123850 - protein, 343 aa, Glycine max
  Coding DNA Sequence Number=SeqID_32165
  Homolog annotation: Hit_ID=Q6WAY6; Match level="QueryCoverage=72%, HitCoverage=44%, E-value=2e-09, Identity=22%"; Hit description =Putative uncharacterized protein
IPQSSARIVYCTPALYVGLVLHLFRHESRPVYPLQGHRICSEKGKANWEQLLASMGFSNIPLMGMRGCINYNPALAIRQLGYPMRGASSKESITPFIARGFSDPNARIFQRVQKALSVVQIKDKELRGSNNGIIGGYHKWLKARTQELDWLLKLKVPSKEEAETPEESEEVQAFKAELEKAQAIKGKFKMTAIKGPKGKVGPKQVPRALWVSNSELKLQRAERDQSRIKGMILEDKLKACQRSKRSFSDQFSKTEENMWAIIDQYKEKLSLAATHEQRLEDEYEKVSVLQAEREARERVIDSLHREAMMWMGRFAFTLNGSQKLPRLLAKAKVMVDVYSAPEE

SEQ ID NO: 123851 - protein, 84 aa, Glycine max
  Coding DNA Sequence Number=SeqID_32166
MADKLDSILRARPCDERWCVALQGKTVGVNVENDDSYMDTYVSPLTSQITETEVTKPRLHPAHVCRQFHHPPPFSSLASHVHCC

SEQ ID NO: 123852 - protein, 151 aa, Glycine max
  Coding DNA Sequence Number=SeqID_32167
MKEREWKIFRPDKFSARLPFSTGDIPPHMNKEEKTETPNFLSKNTTLEKILLVRDPCFPFRWKNPVDRSVLPTNFYSETHECHCLALFMCPPPSSLEPCECHCLALFAIILGTFRNNWEMYFNDPSSLEPERLKALRIQWAHYYLRVRDQT

SEQ ID NO: 123853 - protein, 314 aa, Glycine max
  Coding DNA Sequence Number=SeqID_32168
MAPRKLSTKRSRKDATAEGTSAVPEFESHCFRSAEHQQRFEAIKGWSFHRERRVQLRNNEYTDFQEEIARQRWTSLVTPMAKFDPDIVLEFYANAWPTEEGVRDLRRPSQFLGYPLVLEEGQECEYSQRRNRADGFDEEAIAQLLCIPGMSPTRHPLDPDKSNRALGFPALITGLCQSFGVPITPSKVIRPPITRAFIEKYCTHRQAHGDAPQAADAPPPPHQADPAGSFGMERYLWHLVRQQAANHRAQVQTHDSLYQLSLSLQSQGFAPFRALLQISLGLRSHGPEISPRTRQRRHLQRLPAIQRTPAWMRR

SEQ ID NO: 123854 - protein, 106 aa, Glycine max
  Coding DNA Sequence Number=SeqID_32169
  Homolog annotation: Hit_ID=A5ZQM3; Match level="QueryCoverage=62%, HitCoverage=93%, E-value=1e-20, Identity=55%"; Hit description =Putative uncharacterized protein
VEGKEGSSGGPEPSVRYHSGRARILTLCQDYGPRDSLSAKAEGSLTARPTRRAGTKVGLSDPTVPSGRAVAQRIKGWAVRPLKRYVSWVQNVVRQFGPYPVWALEH

SEQ ID NO: 123855 - protein, 153 aa, Glycine max
  Coding DNA Sequence Number=SeqID_32170
  Subcellular localization annotation: CTP_CleavageSite=67; ConfidenceScore=5.59e-01
MLSSNAEDSVRKKGFYKSCPPPPPPPPPIMFQKSVFMKPRFNGSSNEAPSFNKELKRSFTSERTTPPAEKESLLVESNDDDDDDDTEIEDQDVEGGRTVAQNNDRGKGPPVIGGESSKIDGDEGPDVDKKADEFIAKRIESIERSRRSARNSS

SEQ ID NO: 123856 - protein, 141 aa, Glycine max
  Coding DNA Sequence Number=SeqID_32171
  Homolog annotation: Hit_ID=A5C3T2; Match level="QueryCoverage=95%, HitCoverage=17%, E-value=3e-31, Identity=47%"; Hit description =Putative uncharacterized protein
  Pfam annotation: Domain name=zf-CCHC; Domain location=105-122; Score =22.9; E_value=0.00052; Accession=PF00098.14; Description=Zinc knuckle
MDIDYAIRKDEPPAITNESSPADVALYERWERSNRLSVMFIKTKISAGIRGSVDQHEKEEERLVMEMGESALLTTAYGKNKAIKSQAYQKGNGKIPPQADIKKVAKCFFCKKKGHMKKNCPGFQKWLEKKGYAKPKETSGK

SEQ ID NO: 123857 - protein, 57 aa, Glycine max
  Coding DNA Sequence Number=SeqID_32172
MSVKNLVRRLGVHDKTNHTLGDQSMSHCYARMLQSYGINIGLKKHSNRVYLPPRPTL

SEQ ID NO: 123858 - protein, 219 aa, Glycine max
  Coding DNA Sequence Number=SeqID_32173
MKREKHASYSSHNSCKSLSEELRDYYEGRHRSHLRPHSHRREKERMPQEANINLPYFHGKDNVEANLVWEIRVEQQLKKKTHYFSMPHTKTMIMRGQDIYSSQDEATTSPSSSESEKAKGEESSEEIYPQEEGQPLVVKEKCKEELASIATPLGLEFIPQVKKLLDEGLVRKSLNPCALLVPKIGIIRHQVPKIGGMMNVLSGATLFCKITRTPNIFME

SEQ ID NO: 123859 - protein, 71 aa, Glycine max
  Coding DNA Sequence Number=SeqID_32174
  Homolog annotation: Hit_ID=Q2HSN5; Match level="QueryCoverage=83%, HitCoverage=39%, E-value=2e-08, Identity=49%"; Hit description =Transposase, putative
YKLSLLDIVGVTPTGMTFSIVFAYLEGERLNNVFWALQRFWGLFMKVGALPGVIVTDRDIFDECSENCIFG

SEQ ID NO: 123860 - protein, 216 aa, Glycine max
  Coding DNA Sequence Number=SeqID_32175
DAGSRQARQGASAGVGGCRGWLNYAASEQIVLRVHHMRAIGAGLFAITPAGERGMCCKAIKLGNARVFPVTTLLAKEKFKLAATSIRKECAELREENAATVKALEQETKRARKEEYGRDKFRAAISKRSWAQHLEATERSMLAIIGQYKEELNQSLTHEQKLVEDFVQAYAEKEARGRVIDALHQEATMWMDRFALTLNGSQDLPRLLAKAKAIAE

SEQ ID NO: 123861 - protein, 259 aa, Glycine max
  Coding DNA Sequence Number=SeqID_32176
  Gene Ontology: Mol. function=oxidoreductase activity, acting on single donors with incorporation of molecular oxygen, incorporation of two atoms of oxygen; Cellular component=integral to membrane; Biological process=...
  Gene Ontology: Biological process=entry of virus into host cell
  Homolog annotation: Hit_ID=A8GGX1; Match level="QueryCoverage=37%, HitCoverage=90%, E-value=9e-37, Identity=61%"; Hit description =Glyoxalase/bleomycin resistance protein/dioxygenase
  Pfam annotation: Domain name=Glyoxalase; Domain location=67-160; Score=11.7; E_value=0.008; Accession=PF00903.16; Description =GlyoxalaseBleomycin resistance proteinDioxygenase superfamily
MSTYVDYKINLVDNNDFTDAAGINTDNVVAHGLIRCRHGKRFGSPPLGLRCQYSKQNGGDMELKIDKVIETVLYVSDIERADAFYRQGDSLSGAHYPTGFIPAHDGVGPAHIGLAVAKEQLPHWERHLVANGVEIEGRMRWEHGGESIYFRDPDAHLLELRGLRLPLYLHSDDGAVDQHRQHCRPLFPLRPGGQVARQFIRHLPLMPAGDVQAFRQQVGYLHRSIDKRAAAKARIVEPFRQAGRQRRQQPAGLRHMAGQ

SEQ ID NO: 123862 - protein, 90 aa, Glycine max
  Coding DNA Sequence Number=SeqID_32177
MSKSFEFGMTGSLDESISCFLIRMDPRRTACPHLQRATCPRHQRTACPHLQRATRPRHQRTACPHLQRVTRPRHQRTACPHLRRATRPHL

SEQ ID NO: 123863 - protein, 62 aa, Glycine max
  Coding DNA Sequence Number=SeqID_32178
MGIAPTKTPSGPEEVQQGPGVSSSGYGPLSALQGARSPQQVHVVVGLARKTPSDPKTPTGLG

SEQ ID NO: 123864 - protein, 75 aa, Glycine max
  Coding DNA Sequence Number=SeqID_32179
MYGVACQCYDSTSDSPQISASPYQLDFTLYASGSDNAQWNAPGLLHDKHTLRSSRILRKMEVVFVIGSAVDRLCG

SEQ ID NO: 123865 - protein, 54 aa, Glycine max
  Coding DNA Sequence Number=SeqID_32180
  Gene Ontology: Mol. function=shikimate 5-dehydrogenase activity; Cellular component=cytoplasm; Biological process=tetrapyrrole biosynthetic process
  Homolog annotation: Hit_ID=Q3BX06; Match level="QueryCoverage=94%, HitCoverage=11%, E-value=4e-17, Identity=82%"; Hit description =Glutamyl-tRNA reductase
  Pfam annotation: Domain name=GlutR_N; Domain location=1-49; Score= -22.8; E_value=6.2e-06; Accession=PF05201.6; Description=Glutamyl -tRNAGlu reductase, N-terminal domain
MASMGEPQILGQVKEAWSTARDHGLLGQRLDRLFQQTFSVAKRARTDTQVGANP

SEQ ID NO: 123866 - protein, 55 aa, Glycine max
  Coding DNA Sequence Number=SeqID_32181
MEENLKKTLKFLDATNAINLNKKAYIAWDDNDSSDGSEKEINLLTKDYESDENIS

SEQ ID NO: 123867 - protein, 104 aa, Glycine max
  Coding DNA Sequence Number=SeqID_32182
MPSKVILMMPKNKELSKVSSKYSRIKFQVSRFKIQDSRIIKIKIQESSEDSIKISIKKFFKTLSSTRSFHKIIAKEFYSLVIDYQKVVIDYWCFKMLDFKFQQF

SEQ ID NO: 123868 - protein, 85 aa, Glycine max
  Coding DNA Sequence Number=SeqID_32183
MKDTAYQKPMNRHKGVPVISAWWGKPTGRHHVQRNQISNCHSVYLQNGIHRPGTWVIGKGISENSVDEDMEGGIGAVDALLAPER

SEQ ID NO: 123869 - protein, 57 aa, Glycine max
  Coding DNA Sequence Number=SeqID_32184
MQRLTLSPAPFVILTREVRVTLWLPTLFINQRPNEPVDALRLTLSPTPPVVLTREVR

SEQ ID NO: 123870 - protein, 236 aa, Glycine max
  Coding DNA Sequence Number=SeqID_32185
SEDHPPKQSRVRGHLVKIDANSLNTFLETPVVLSEGETLPAYSRYCRLPTDYREIEAALCIPGQGFILNSEGHPRKILRKDLTTLAQVWSVFSYSNLAPTSHTSDLTVDRARLIFGLVSHLDMNIGALISGQMTSIAQSNTSRLGFPALITALCRARGVVSDSHTFERLSPVINLAYIRKNCWNPEELTVSIRRARRERARPAELPFTSAAPTLASTSAAPSVPVQTDSQRFEAML

SEQ ID NO: 123871 - protein, 77 aa, Glycine max
  Coding DNA Sequence Number=SeqID_32186
  Homolog annotation: Hit_ID=B0HC01; Match level="QueryCoverage=45%, HitCoverage=74%, E-value=3e-12, Identity=100%"; Hit description =Putative uncharacterized protein
MRKRHASRREKGGQYPGGGAYGKTPATRPFYGSWPFAGLLLTCSFLRYPLILWITVLPPLSELIPLAAAERPSAASQ

SEQ ID NO: 123872 - protein, 89 aa, Glycine max
  Coding DNA Sequence Number=SeqID_32187
ATENWMTPLPVKEDKSGILITITLDDMASLLHFPIIGAFHSFEQLHVNDAIKILVELLENPNRATRGGALESTRDVTIANREHLSDYIE

SEQ ID NO: 123873 - protein, 212 aa, Glycine max
  Coding DNA Sequence Number=SeqID_32188
  Subcellular localization annotation: CTP_CleavageSite=33; ConfidenceScore=5.16e-01
MDMNVGALISGQITSIAQSNSSRLGFPTLITALCKARGVNSDSLVFERLSPVINLAYIRKNCWNPYDLTISIRGARRARTRPAEPPSTSTAPIPACTSAAPSVPASADFQRSIPSVEQFTELVAWPGTQSSLRREDEGPTAQVSQHVEDDSSEATIPEPFVRGMEAEETQEAAATLERSLEVASESPAQGEDIPSPQPATDPSTLVLDLSED

SEQ ID NO: 123874 - protein, 70 aa, Glycine max
  Coding DNA Sequence Number=SeqID_32189
MEGQNIIDGVKLDVPPFKGRSDPDAYLDWEMKIEHLQQNHAIETSEVDPGKFDRGGVLQGDGDDTSEGQH

SEQ ID NO: 123875 - protein, 137 aa, Glycine max
  Coding DNA Sequence Number=SeqID_32190
  Gene Ontology: Mol. function=transporter activity; Cellular component= intracellular; Biological process=transport
  Homolog annotation: Hit_ID=A7Q7Z5; Match level="QueryCoverage=81%, HitCoverage=24%, E-value=2e-22, Identity=49%"; Hit description =Chromosome chr18 scaffold_61, whole genome shotgun sequence
MLSNPYCKNKVAIVGSSYYGILQKVLGNKFQSRLLQIIDTSQLPDFLDGSCSCPNDGGCLRSDKGPWNDPDILKLLHSREAMKLTKFGSPSVADGVDVKSYSSKVKSTGISEPLSASEVRLNPSAFVQSVPSSEKVS

SEQ ID NO: 123876 - protein, 150 aa, Glycine max
  Coding DNA Sequence Number=SeqID_32191
  Gene Ontology: Mol. function=chitin binding; Cellular component =extracellular region; Biological process=chitin metabolic process
  Homolog annotation: Hit_ID=UPI000069F178; Match level="QueryCoverage =54%, HitCoverage=35%, E-value=4e-08, Identity=35%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=42; ConfidenceScore=5.35e-01
MRACSPLKARTCSPLEVRACSPLMVRTCSPLKARTCSPLTVRVRACSPLKARTYCPLEVRACSPLVLRTYSPLKVRTCSPLTVRVTWGWQLSQPTLRRVESPTVATYPSAGGRRVTRGMRVPRKEYARSRHQRLFEENVGKTGKDAIYEL

SEQ ID NO: 123877 - protein, 100 aa, Glycine max
  Coding DNA Sequence Number=SeqID_32192
MMEGSGGPVMSMKKIMEANAVAVAATRAVAKVNLIPTFDLNQMNHPTSDMVGKDLGSTDDPMMCKFKTSTPSRHMACLPIIRHPMCVHSHENVNNSLLYP

SEQ ID NO: 123878 - protein, 95 aa, Glycine max
  Coding DNA Sequence Number=SeqID_32193
MSSIVCRDCARKTPSGPEEANSVLELPALNTGLYQFKGVPVAPSKVIKPPSNRAFIKKYCVSRQAQGETPQQPGDGRQWAIDTPPPPLKFTSAHP

SEQ ID NO: 123879 - protein, 75 aa, Glycine max
  Coding DNA Sequence Number=SeqID_32194
MNFDDAKEESNKAASRISICFKINSRCFNKTKPCLKITKIKPCLKTKGFKVMQGSGNRLPGSVIDCQKGRMKKSF

SEQ ID NO: 123880 - protein, 163 aa, Glycine max
  Coding DNA Sequence Number=SeqID_32195
  Homolog annotation: Hit_ID=Q0KIL1; Match level="QueryCoverage=70%, HitCoverage=12%, E-value=2e-08, Identity=34%"; Hit description =Gag/pol polyprotein, 3'-partial, putative
MVGGQLVIVSSEEDILVSYLSSTPYVEAAEESLETSFQALEIVNSAYLKSLLIQPRLFDTSLMVARVMLKDGYKPRMGLVQNGGGAVSLLKIDENCGRFRLGYKPTSADKRRIALERKEKDLARLQGRGSQVERVPICHINESFMNVRWMHEDQVPMLDEEID

SEQ ID NO: 123881 - protein, 54 aa, Glycine max
  Coding DNA Sequence Number=SeqID_32196
TNPNDGVGLSQFQMQALMQHLERGNGGVPRQNRIDGIKLNIPPFKGNNDLEAYL

SEQ ID NO: 123882 - protein, 196 aa, Glycine max
  Coding DNA Sequence Number=SeqID_32197
  Homolog annotation: Hit_ID=Q9JKS4-3; Match level="QueryCoverage=28%, HitCoverage=8%, E-value=3e-08, Identity=50%"; Hit description =Isoform 3 of Q9JKS4
MSLPSEGYTPSPFEHYTSSPSEGWTPSPKEGCTPSPSEGYTPSPLEDYTSSPSEDYTGLHVFTFRGLHVLGFRGLNVLIFRGPHALAFRGLHILTFRGLHVLAFRGLHIITFRGQHALAFKRLHALTFRGLYVLNLKRTTRPHLQRTTRPRHQRTAHPHLQRATRPPLQRTKGPHLQRTTRPRLYRATRPRIQRTT

SEQ ID NO: 123883 - protein, 255 aa, Glycine max
  Coding DNA Sequence Number=SeqID_32198
  Gene Ontology: Mol. function=motor activity; Cellular component=cell projection
  Homolog annotation: Hit_ID=UPI00016621D1; Match level="QueryCoverage =98%, HitCoverage=40%, E-value=2e-25, Identity=38%"; Hit description =UPI00016621D1 related cluster
GLHVLTFRGLHVLALRVLDVLTFRGLHVLTFRGLHVLAIRGLHVLAIKGLHVLAIRGLHVLTFRGLHVLTFRGLHVLTFKGLHVLTSRGLHALAFRGLHVLTFRGLHVLTFRGLHALTFRGLHVLSIRGLDVLTFRGLHVLTFRGLHVLTFRGLHTLAFRGLHVLIFSGPLALAFSGLHILTFGGLHVLTLRGLHILTCRGLHALAFRGLHVLTFSGLHALAFRGLHVLTFRGLHALAFRGLHVLTFRGLHVLHF

SEQ ID NO: 123884 - protein, 204 aa, Glycine max
  Coding DNA Sequence Number=SeqID_32199
MHENMDHTAHLTFEGKPPHPTGGAREDPRKRAQGDIDSCLLFTTEGPAPNALPQPNIARVSQPHPMQPLLFSVGEPPLAVEGREKLDLIEERLRAVEGFRDYPFANMTDLLSYPNFVWGLLLDDMQPLIGRFKILGTLCCAICKSDTRRKSKGSRLKGAVLRVPDPPGDVFQLFWVKKIAFVRKIQAKVFLRYSPFFIRSSFFN

SEQ ID NO: 123885 - protein, 192 aa, Glycine max
  Coding DNA Sequence Number=SeqID_32200
LAFRGLHVLTFKGLHVPHLQRATCSHLQRDYASSPSEGCNVLAFRGLHALTFRGATCPHLQRTTRPPILRGLHVLAFRGLHALTFRGLRRPHLLRTTWLHALALKGRHVLCLQRATALAFEDYTSSPSEDYTSCAFRGLHVLAFRGLHALAFIGLHVLTFKGLHVHAFRAQNALACRGLHILAFRGLHVLCH

SEQ ID NO: 123886 - protein, 98 aa, Glycine max
  Coding DNA Sequence Number=SeqID_32201
MIKLRAMLSIIFGITPICGSCAVTSVATCPFAGEGGEAHGCVFRRRKMRGVATNDYLWKTSEKPKETGHEEYSRFGRCRQKRGSCSYVPFIEEEIRPT

SEQ ID NO: 123887 - protein, 65 aa, Glycine max
  Coding DNA Sequence Number=SeqID_32202
MSVRVQPIAFLCFLRTDNNFSSCSSAREADIITGKTLLSSKGKTPPSDMQSISLLDSLSASNSDI

SEQ ID NO: 123888 - protein, 149 aa, Glycine max
  Coding DNA Sequence Number=SeqID_32203
AAASAPARYGRRSQSNTKQARKALSILLVKPKLIENESANEQENGKVGSRTRWSKERKGEVLIPGRSRMTRESHARRAVHGAASLLTWSMHIALSRRLAAYPRSSHFQEDPGLDLEFPSCLSNGKRASPRKCPFACRWGSKSYLLKLYL

SEQ ID NO: 123889 - protein, 89 aa, Glycine max
  Coding DNA Sequence Number=SeqID_32204
MIEEGDEDAQTIKGTCHTLISSGDLCLMTCDLSLVLVRCLAPIIRQFVKFQDMPENQKILMHNPQKGDDYCNPQGSVTLRKDNKYRYEI

SEQ ID NO: 123890 - protein, 66 aa, Glycine max
  Coding DNA Sequence Number=SeqID_32205
MKVLREGAQSIKNLMMQAPLELVGLGSSSSMDSFASWKINGSGMEKEEREETPLQGEDESRRSSPP

SEQ ID NO: 123891 - protein, 38 aa, Glycine max
  Coding DNA Sequence Number=SeqID_32206
MWTTTGEVVAAQLAQASSARPGEPGCFLQKQQPSGGIF

SEQ ID NO: 123892 - protein, 60 aa, Glycine max
  Coding DNA Sequence Number=SeqID_32207
MAVSKLRNDAKENHEGQIGLRSQPKPRDKLEDSALIERFLSLWSFNGRQRWFVVANGGYG

SEQ ID NO: 123893 - protein, 76 aa, Glycine max
  Coding DNA Sequence Number=SeqID_32208
MAAEWRRKRERRRNFKEKMSLEEAHHYRRPWIRAWRKKEMNEGRGREEHEILCSKRALKSEPTNPRSIPRFSTKCA

SEQ ID NO: 123894 - protein, 67 aa, Glycine max
  Coding DNA Sequence Number=SeqID_32209
MKFDDRAQMITRRNYLKADGRLVARALLRGERRSCSQVRFPEGTDARSRHQRLFVENVGKIEGNRSK

SEQ ID NO: 123895 - protein, 106 aa, Glycine max
  Coding DNA Sequence Number=SeqID_32210
  Gene Ontology: Mol. function=aspartic-type endopeptidase activity; Biological process=RNA-dependent DNA replication
  Homolog annotation: Hit_ID=Q6WAY3; Match level="QueryCoverage=33%, HitCoverage=1%, E-value=1e-09, Identity=75%"; Hit description =Gag/pol polyprotein
MEKLGIPRKLIASLKCKLTARLAKSGLRGFLSHLGKISGQACGKLYAIEEERDGKPWYFDIKQVSRTKTPRHNDSGKKEQAIYYLSKKFTACEMNYSMLERTCCAL

SEQ ID NO: 123896 - protein, 131 aa, Glycine max
  Coding DNA Sequence Number=SeqID_32211
  Homolog annotation: Hit_ID=Q2AA51; Match level="QueryCoverage=56%, HitCoverage=22%, E-value=3e-08, Identity=39%"; Hit description =Retrotransposon gag protein
  Pfam annotation: Domain name=Retrotrans_gag; Domain location=1-81; Score=23.7; E_value=0.00027; Accession=PF03732.8; Description =Retrotransposon gag protein
EAKRWLHSFKGNSLKTWEEVVEKFLKKYFPESKTAKGKAAISSFRQFPDESLSEALERFRGRKIKLKTPEEAMELIENMSSSDHAILRDRVVPYVVVLMNPAFAFLLKSKRKRLATWGINKGKDTINVDSQ

SEQ ID NO: 123897 - protein, 111 aa, Glycine max
  Coding DNA Sequence Number=SeqID_32212
  Homolog annotation: Hit_ID=Q51617; Match level="QueryCoverage=36%, HitCoverage=57%, E-value=4e-12, Identity=87%"; Hit description =Putative uncharacterized protein
  Subcellular localization annotation: CTP_CleavageSite=52; ConfidenceScore=5.63e-01
MTLTYKIGVSRGPFVSRVSVMTVKTSDTCSSRRRSQLVCKRMPGADKPVRARQRMRKEKIPHQAPFAIQAAQLLGRAIGAGLFAITPAGERGMCCKAIKLGNARVFPVTTL

SEQ ID NO: 123898 - protein, 168 aa, Glycine max
  Coding DNA Sequence Number=SeqID_32213
  Homolog annotation: Hit_ID=Q6WAY6; Match level="QueryCoverage=58%, HitCoverage=17%, E-value=3e-08, Identity=36%"; Hit description =Putative uncharacterized protein
MGPNQTSKRFYQVKVKSLDTTSIKELGRLMEPLQMQAFRKTYGKIFRVDPSRELQLWSRIQQEVGPRKTDSERHSGPRRYLEDKVRGMANQGDWVPFMDVLALLIFGVVLFPNVDGLVDLAAIDAFLAYHHSKESPVVAVLADLFDTFDRRCEKSSARIICCLPALCV

SEQ ID NO: 123899 - protein, 101 aa, Glycine max
  Coding DNA Sequence Number=SeqID_32214
  Subcellular localization annotation: CTP_CleavageSite=31; ConfidenceScore=5.42e-01
MHTQSFTIPQFPKIGLTHKNSRQLSQPTLLRASEARLMGASSKGGKCAESPPTFICGKCRKKPKETGHEEYSRFGSEVDKSGALAPTYPPSKRKSDLHRSF

SEQ ID NO: 123900 - protein, 96 aa, Glycine max
  Coding DNA Sequence Number=SeqID_32215
  Pfam annotation: Domain name=G-patch; Domain location=2-46; Score =9.0; E_value=0.015; Accession=PF01585.14; Description=G-patch domain
MMVARVMLGYGYEPEMGLGKNNGGKTSLVSTRGNRRRSDNESLEGTNTQDPTIDFKQEAGQTESEEDEDVGLPPELEKIVAQEDREMESHQEEIEL

SEQ ID NO: 123901 - protein, 56 aa, Glycine max
  Coding DNA Sequence Number=SeqID_32216
MSISPCRSISWGRAHKTPSGPEEVQQGPGVSSFGYGPLLVLQGARTPRQGHAIATY

SEQ ID NO: 123902 - protein, 142 aa, Glycine max
  Coding DNA Sequence Number=SeqID_32217
  Subcellular localization annotation: CTP_CleavageSite=61; ConfidenceScore=5.29e-01
MGIAPTKTPSGPGKVQQGPGVSNSGYGPLSILQGARTPPARDRACKTPSGPEEVQQGLGVSSSNYGSLSVLRSTCHSSKGIRPLLIELSSRSIAPQTGVGRNTTAALGWSAAGNRRTAITSRVHLCSSTKRFEYCLHNMADQ

SEQ ID NO: 123903 - protein, 92 aa, Glycine max
  Coding DNA Sequence Number=SeqID_32218
MGVEIAPRPLGPSRLFLQKAVASGGSNLARLGELGGNHLPYFAINRGGSEEEKAEALPKRFRNVFREEFRKGFNRSSTFFIRSSSFFDLQRI

SEQ ID NO: 123904 - protein, 153 aa, Glycine max
  Coding DNA Sequence Number=SeqID_32219
  Homolog annotation: Hit_ID=Q84VH5; Match level="QueryCoverage=60%, HitCoverage=13%, E-value=7e-35, Identity=83%"; Hit description =Envelope-like protein
MLSQHPNILNYTDSVMKRESPLSLHYKLFEGTHVPDIVSTSGKAAASGAVSKDALIAELKDTCKVLEATIKATTEKKMELERLIKRLSDSGIDDGEAAEEDGEAAEEEEEAAEEEEDAAEDTESDDDDSEAPPMTIRPLFLLFTLTSYRGMSL

SEQ ID NO: 123905 - protein, 97 aa, Glycine max
  Coding DNA Sequence Number=SeqID_32220
  Homolog annotation: Hit_ID=A5AXE9; Match level="QueryCoverage=78%, HitCoverage=5%, E-value=7e-11, Identity=48%"; Hit description =Putative uncharacterized protein
MSEFDAESESEFDIDYTSGDVLPLEIDFLESDRTNHVSGMIISASLADEQEEKLLSVLKKHKKAIGWTWRTFLEVAKLLQDGIIYPISDNQWVSPVQ

SEQ ID NO: 123906 - protein, 94 aa, Glycine max
  Coding DNA Sequence Number=SeqID_32221
MVKEFYANLYSPKDQSPKQVRVRGHLIRIDADSLNTFLETTIVLEEGETLPTYYRFTRMRIDPQEFAARLYIPGRDMECPLLQQPDSHFPQGIL

SEQ ID NO: 123907 - protein, 35 aa, Glycine max
  Coding DNA Sequence Number=SeqID_32222
MSEIGRRRQPTGNRLHEYCNRLQAIYSSVIDYTKW

SEQ ID NO: 123908 - protein, 58 aa, Glycine max
  Coding DNA Sequence Number=SeqID_32223
MCVEMAPRKLFTKRSRKDAAAEGTSASPEFDSHRFRSAEHQQRFEAIKGWSFHRERRV

SEQ ID NO: 123909 - protein, 150 aa, Glycine max
  Coding DNA Sequence Number=SeqID_32224
  Homolog annotation: Hit_ID=B0HC01; Match level="QueryCoverage=22%, HitCoverage=72%, E-value=1e-11, Identity=100%"; Hit description =Putative uncharacterized protein
GGGAYGKTPATRPFYGSWPFAGLLLTCSFLRYPLILWITVLPPLSELIPLAAAERPSAASHWHDRFPDWKAGSERNAINETAMTMITNSSSVPVHAQNKHSFPPYGLPPNYTPPNVAHAPNEKSITPIPYSLRANNPTLVRYMRHPKTTI

SEQ ID NO: 123910 - protein, 243 aa, Glycine max
  Coding DNA Sequence Number=SeqID_32225
MADAVQQRRVAVAHCTDFLQGQLVADTALVGALHQPRLIGQQLVAHLAGGQRVTRHAFAQHLRHRTERHLEFAAAAIGLDHAHFQIAAVARRVQVVDDEAARRHGGGVDQLLVLAHFDACIGLGDAAHDRRVAAQRIGQHAVVAGQAGTAVTDRVEQFTGGVGLTDGEHAAHLRDAALRIGGDALPMAAVTLGPGQVGVVAELPATQVHAGVEAEVGTAVALATFDTAVAVDGIEAVADEARH

SEQ ID NO: 123911 - protein, 75 aa, Glycine max
  Coding DNA Sequence Number=SeqID_32226
MAGVPWVRATTMWVSRERFPADFRREEKEKIDFRQEDDKEKREGKVFERARLVKSQFLLTYKHNNIGFLRITDVN

SEQ ID NO: 123912 - protein, 101 aa, Glycine max
  Coding DNA Sequence Number=SeqID_32227
MVKETWNRDQQVGWGGIVLKNKLRNLKSSLKQWSREFGDVKMKKIQQLRQQLNDIDTIACDRILTEAELMSKKSIQHDLWMASNAYESLLRQKSRAKWFKE

SEQ ID NO: 123913 - protein, 85 aa, Glycine max
  Coding DNA Sequence Number=SeqID_32228
  Homolog annotation: Hit_ID=A5CBJ4; Match level="QueryCoverage=75%, HitCoverage=5%, E-value=4e-10, Identity=50%"; Hit description =Putative uncharacterized protein
MAQPPPREDPHKHLKEFHIVCSTMKPPDVQEDHIFLKAFPHSLEGLAKVWLYYLAPRSIFSWDDLKRVFLENSSLHLGPLPSFIS

SEQ ID NO: 123914 - protein, 80 aa, Glycine max
  Coding DNA Sequence Number=SeqID_32229
MFHIPGHSKKYCPTVYAQDKKKSNEQTTKKELSLHVLGTCLFFKRRMKKWKILMVISLEETELLNHDHQGDFDDYFIGGG

SEQ ID NO: 123915 - protein, 115 aa, Glycine max
  Coding DNA Sequence Number=SeqID_32230
  Subcellular localization annotation: CTP_CleavageSite=38; ConfidenceScore=5.13e-01
VCDIYPRIELANGQTKYAKYSDSKSIQMPKLRRISMMRVMSKMTATATKSISLKPLGRDGTVRRHLVEEIPIVVPRYVVKPLATVAEGAVGNRHVDDKLSVAESGEEGAEAGSGN

SEQ ID NO: 123916 - protein, 19 aa, Glycine max
  Coding DNA Sequence Number=SeqID_32231
DTLVAHDPRNLNKSSTSSK

SEQ ID NO: 123917 - protein, 107 aa, Glycine max
  Coding DNA Sequence Number=SeqID_32232
MPQVGTGIAERLQGRKGKTPLRGLDEFTSYGIPEKSNWSHQSLATSRRSRLLSPPRKGKKFLLAVEKRTEEMPWIANGDTCPDMSDIKAASGLLKMSASWELIAMRV

SEQ ID NO: 123918 - protein, 174 aa, Glycine max
  Coding DNA Sequence Number=SeqID_32233
MSLATLFGKLQEHEMELLRLHQHEENDKKKKGIALKASSSIQEESDQDNDPDDDDDDLSLFVRRFNKFLKKKMEKSEKKNHSEKKLKKAYITWDENDMESSEDSENEEINLCLKAKSYESDEEGINLINNKSFIKTFPLPHKNVILILSLVFTVEEEDMAYQLATSRKITVTLK

SEQ ID NO: 123919 - protein, 75 aa, Glycine max
  Coding DNA Sequence Number=SeqID_32234
  Homolog annotation: Hit_ID=A6FJQ2; Match level="QueryCoverage=50%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLDLRVENRRTALSNQFVGLQTRWWRTHEKR

SEQ ID NO: 123920 - protein, 292 aa, Glycine max
  Coding DNA Sequence Number=SeqID_32235
MRGAPTEESVSPFLVRDFGAQNSKTIQRIHKAWETPLRKDQELRGIRNGIIGGYHEWLKVHIRAKRILKHRKKTKKSKLSKRVRKGKLAKEKFKLAATHVRKECAGLREENTITARALEQETKRARKEEYGRNKFRGALWGSNNELKLRREERDQSRAHSMVLKEELIACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 123921 - protein, 75 aa, Glycine max
  Coding DNA Sequence Number=SeqID_32236
MGTPSQKLRLQRQGHAGKNESDEVQALKAELERARVVEEKFKSIAIKGRIVVKLRREVFGGKGKGLGKIKANGLL

SEQ ID NO: 123922 - protein, 256 aa, Glycine max
  Coding DNA Sequence Number=SeqID_32237
  Gene Ontology: Mol. function=hydrolase activity
  Homolog annotation: Hit_ID=Q12DJ7; Match level="QueryCoverage=91%, HitCoverage=79%, E-value=8e-59, Identity=49%"; Hit description =Putative uncharacterized protein
MARNSASTISERPQDYDEDGTETHELIVIIHGTGRTAAQYRDHFANFARENRCIILAPLFPAGIVVQGDLANYKRIEFQGIRFDHILLSMIDEVAAKYRLKSNRAIMYGFSGGGQFCQRFFMLHPHRLKAVSIGAPGVVTLLNSDYDWWVGVRDVEARFGCRIDLEAMKAVTVHTVIGEEDTATWEIAIPRESAFWMDGADLQGDCRIDRIEALAKSFEAHGIAVRRDRVPGVAHEPFKVLEPVEAFFADVLRSQS

SEQ ID NO: 123923 - protein, 66 aa, Glycine max
  Coding DNA Sequence Number=SeqID_32238
MPIGGADIEEEEPTDLRSNPLQGGGDDAILPRNGSVTRAMSKRLQEDCARAAEEGPMVLMNLRINF

SEQ ID NO: 123924 - protein, 82 aa, Glycine max
  Coding DNA Sequence Number=SeqID_32239
  Subcellular localization annotation: CTP_CleavageSite=62; ConfidenceScore=5.28e-01
RSGVYPDLSSFTGSGVYPDLSSFTGSGVYPDLSSFTGSGVIQKLYSLYQVIRPVRFTSSGIRASALDTVGLKQTTVAKVMSI

SEQ ID NO: 123925 - protein, 179 aa, Glycine max
  Coding DNA Sequence Number=SeqID_32240
  Subcellular localization annotation: CTP_CleavageSite=36; ConfidenceScore=5.14e-01
VDSRGSPVYIDRSYRSTAPGSYGLLSVGQPNAACMRASGAPSSACELRWTLGTVADVEAMVVRLLSVVVTGLAPAVVPASACGPVNGEQDELCGRDWYPVELAEACDQCWKSQCPIGLLWDSVDQLAFRKREIRIMVTGKDVAEQKRHTDLSESGHASAHDPYPPPCYALCTIMSRGAQ

SEQ ID NO: 123926 - protein, 40 aa, Glycine max
  Coding DNA Sequence Number=SeqID_32241
MGPREPKPMCCASVVGAQKGCVSGNLDESPLRTSHKFFSP

SEQ ID NO: 123927 - protein, 92 aa, Glycine max
  Coding DNA Sequence Number=SeqID_32242
  Homolog annotation: Hit_ID=Q949K8; Match level="QueryCoverage=70%, HitCoverage=23%, E-value=7e-09, Identity=44%"; Hit description=Gag polyprotein
MAGRGRDQNRDVLDRITVVLETLVQERDVEPAKYRGLMAFRKNHPSKFSGDYDLEGARLWLAKTEKIFEAMGCLEEHKVPYATFMLQGEAQN

SEQ ID NO: 123928 - protein, 153 aa, Glycine max
  Coding DNA Sequence Number=SeqID_32243
  Gene Ontology: Mol. function=oxidoreductase activity; Cellular component=proton-transporting two-sector ATPase complex; Biological process=ethylene biosynthetic process
  Homolog annotation: Hit_ID=A7NX58; Match level="QueryCoverage=44%, HitCoverage=25%, E-value=1e-20, Identity=70%"; Hit description =Chromosome chr5 scaffold_2, whole genome shotgun sequence
MEVSITYEIADTVELNPDRLRELKAFDDSKAGVKGLVDEGVTKIPTLFHHPRDDGIPVMFPEDFKDGVQRIYKQDNKLITNDRFKSVEHRVLANLIGPRILCIACFFSVGLKSSPKLYGPIKDLLSEDNHPKYRETTVAEYARYCQKNKGENT

SEQ ID NO: 123929 - protein, 293 aa, Glycine max
  Coding DNA Sequence Number=SeqID_32244
  Gene Ontology: Mol. function=hydrolase activity; Cellular component =integral to membrane; Biological process=iron ion transport
  Homolog annotation: Hit_ID=Q6J5M7; Match level="QueryCoverage=98%, HitCoverage=95%, E-value=1e-88, Identity=51%"; Hit description =Purple acid phosphatase 1
  Pfam annotation: Domain name=Metallophos; Domain location=40-237; Score=12.4; E_value=0.029; Accession=PF00149.19; Description =Calcineurin-like phosphoesterase
MGMQLVFIGTIALCLVVSSAMLEQFEQAPKQDGSLSFLVVDKLVATDTAEKPQTVIAEEEQPMNIVLFLAIQSGIDDPAFDDSFTKIYTASSLQKQWYSVLGNHDYRGNVEARLSPVLTNLDKRWLCLRSFTVNAEVAEFYFVDTTPFVDKYFTEPKDMSIYDWSGILPRKQYISNLLKDVDLALQQSNAKWKIVVGHHTIRSAGLHGNTDELVKQLLPILEANNIDLYINGQDHCLQHIGSLGRGVVNWWKPEEMKFYYDGQGFMSVKITETEIDIVFYDVYGHVLHKWNAS

SEQ ID NO: 123930 - protein, 100 aa, Glycine max
  Coding DNA Sequence Number=SeqID_32245
  Homolog annotation: Hit_ID=A5AXN9; Match level="QueryCoverage=95%, HitCoverage=17%, E-value=2e-10, Identity=33%"; Hit description =Putative uncharacterized protein
MEALCKPAFHFPHPPQGKYYLVNSGYPTFMDFLGPYKKTRNDKSDGEFDSLDEDNEYIDSDEDESEVGPNTTTWEEPNAQSTLQMERLRESSKNMFSTRI

SEQ ID NO: 123931 - protein, 111 aa, Glycine max
  Coding DNA Sequence Number=SeqID_32246
MALGRKKSVQLAFLLLLFLCLDLGIAHQHQGHSHSHSGFCASDAHHHCGDDHLHGHAHDHHHDKIDGRSKLLPEELAEEEDMKLYGFGLPHHHHHDHGIEAAELSGLARGN

SEQ ID NO: 123932 - protein, 618 aa, Glycine max
  Coding DNA Sequence Number=SeqID_32247
  Gene Ontology: Mol. function=protein binding; Cellular component =integral to membrane; Biological process=phagocytosis, engulfment
  Homolog annotation: Hit_ID=Q9FHT4; Match level="QueryCoverage=99%, HitCoverage=99%, E-value=0.0, Identity=70%"; Hit description =Endosomal protein-like
  Pfam annotation: Domain name=EMP70; Domain location=51-576; Score =970.3; E_value=7.6e-289; Accession=PF02990.7; Description =Endomembrane protein 70
  Pfam annotation: Domain name=Oxidored_q3; Domain location=333-532; Score=-33.1; E_value=0.083; Accession=PF00499.11; Description=NADH -ubiquinoneplastoquinone oxidore
  Pfam module annotation: Pfam domain module=EMP70::Oxidored_q3; Domain location=51-576::333-532
MGRSTLALVLAILISFQGTHVRSDASDHRYKDGDSVPLYANKVGPFHNPSETYRYFDLPFCVTGTEYWIAIVFCFYGITSRGNEPSGRTKCHEKEKTEALGEVLNGDRLVSAPYELSFKKEKDSKVVCKRKLTKEQVAQFREAVKKDYYFQMYYDDLPIWGFIGTIDKEGKTDPSEYKYFLYKHIQFDILYNKDRVIEISARMDPHSVVDLTEDKDVDVEFMYTAKWKETDTSFEKRMDKYSQSSSLPHHLEIHWFSIINSCVTVLLLTGFLATILMRVLKNDFMKYAQDEEAADDQEETGWKYIHGDVFRFPKHKSFFSAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTIVVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 123933 - protein, 300 aa, Glycine max
  Coding DNA Sequence Number=SeqID_32248
  Gene Ontology: Mol. function=small conjugating protein ligase activity; Cellular component=intracellular; Biological process =regulation of protein metabolic process
  Homolog annotation: Hit_ID=A9PH42; Match level="QueryCoverage=85%, HitCoverage=56%, E-value=1e-95, Identity=59%"; Hit description =Putative uncharacterized protein
  Pfam annotation: Domain name=UQ_con; Domain location=126-275; Score =78.1; E_value=2.8e-20; Accession=PF00179.17; Description=Ubiquitin -conjugating enzyme
MIDDDADMIDDDGDEDADYAFDYNDDDIYEDDYSSMQDQFDNVDLPPGVEASLPWLKDISSSECKQAIAFSRTESSSKAKVDETDDIVMQKFQQFKQFDTVDSFPDHHYDKEGTKDAQKPKNWAKKIQEEWKILEENLPETIFVRVCESRMELLRAVIIGPQGTPYHDGLFFFDCLFPSTYPAGPPKVHYHSGGLRLNPNLYQCGKVCLSLLGTWHGRNSENWIPEKSTMLQVLVSIQALILNEKPFFNEPGYPSTYPGSEGQRRSKEYNESTFILSLKTMMYTLRKPPKVCRLEQYMNL

SEQ ID NO: 123934 - protein, 100 aa, Glycine max
  Coding DNA Sequence Number=SeqID_32249
MDKHENRCSLETSQRASAQLVCVHAKDVECDRMLGSNKVDGRCDSQEGLGCEYTSQPTAAETTRLELLSGGGCASKGRMGVVPQLQNMSAGCKRMGAIVR

SEQ ID NO: 123935 - protein, 311 aa, Glycine max
  Coding DNA Sequence Number=SeqID_32250
MGQTGIPSLGPVMKIPSCNNPVGSGPLNKNTKEDCRIISTGSVGSGNRFWHLIKGATGGPVIKGGLNSGRRKFVKGRKQDGGLQWVASPAEGVWRNNGKEIIIVNSYAPCDRMARRRVWEELKARKDENVGEREELNNFLADMRLEDMSLVGRKFTWYRSNGGAKRRKPFKVFDCGFSDTRFSKFVEDTWRDLKFEVVERFQEELNRVRVVFEEEDTWRWRVKSTYLALHGRDFANEGVIWHDKCDLIVVMCGWLSTWSPNDPRCEISFLDMVEKLGKSVWLFLDAVGFEFEVHMLKDKLHAGNGHCMAIL

SEQ ID NO: 123936 - protein, 325 aa, Glycine max
  Coding DNA Sequence Number=SeqID_32251
  Gene Ontology: Mol. function=protein binding; Cellular component =extrinsic to mitochondrial inner membrane; Biological process =intracellular protein transport across a membrane
  Homolog annotation: Hit_ID=A7P2M0; Match level="QueryCoverage=98%, HitCoverage=97%, E-value=1e-112, Identity=62%"; Hit description =Chromosome chr1 scaffold_5, whole genome shotgun sequence
  Pfam annotation: Domain name=Mmp37; Domain location=5-319; Score =423.6; E_value=2.9e-124; Accession=PF09139.2; Description =Mitochondrial matrix Mmp37
MDNATFRSFLQVLPPVEFACVYGSSLHPSNHDKTTMTDYILGVSDPKQWHSENLKLNKHHYASWMVHLGGESLITGVADRIGVGVHFNPFVTWNGKLFKYGVIQMHDLLQDVQYWEKFYLCGRLQKPVHIVVDNLDVNSTNSVNLRAAVSAALLLLPSEFTEEDLYAKVCSLSYTGDIRMLFAEDKNKVKKIVTGQFDLFHSMYKPFLEEYEAKKLLRLSSTANNQIHATQDCDLSVACALVSALPPSIRSQISKNGELTETGRFIHDTKVSAREVAANCLQRILRQRVMVSSARQAISGLLAVGGVNATRYLSKKVSKAWRSWR

SEQ ID NO: 123937 - protein, 490 aa, Glycine max
  Coding DNA Sequence Number=SeqID_32252
  Gene Ontology: Mol. function=hydrolase activity, acting on glycosyl bonds; Cellular component=extracellular region; Biological process =cell wall organization and biogenesis
  Homolog annotation: Hit_ID=A7NVV5; Match level="QueryCoverage=74%, HitCoverage=97%, E-value=1e-172, Identity=76%"; Hit description =Chromosome chr5 scaffold_2, whole genome shotgun sequence
  Pfam annotation: Domain name=Glyco_hydro_28; Domain location=122-455; Score=330.0; E_value=4.4e-96; Accession=PF00295.8; Description =Glycosyl hydrolases family 28
MDLIRVFFTLCITVILLNHNFGNVEGRYHHHTKQKKVSTAPADSSTEPEKPSVPPPSDSPSVPSDPSASPPSNSPSVPSDPYPKDNQTSSSDCVFDVRSFGAVGDGCADDTRAFRAAWKAACAVDSGVVLAPENYIFKISSTIFSGPCKPGLVFQVDGTLMAPDGPNSWPEADSRNQWLVFYRLDQMTLNGTGTIEGNGDKWWDLPCKPHRGPSGKTLSGPCGSPAMIRFFMSSNLKVNGLKIQNSPQFHMIFNGCQGVLIDKLSISSPKLSPNTDGIHVENSKYVGIYNSMISNGDDCISIGPGSSNVDIAGLTCGPSHGISIGSLGVHNSQACVSNLTVRDSIIRESDNGLRIKTWQGGMGSVSSLRFENIQMENVGNCIIIDQYYCMSKECLNQTSAVHVNDVSYSNIKGTYDVRTAPIHFACSDTVACTNITLSEVELLPFEGALLDDPFCWNAYGTQETLTIPPINCLREGDPETVGDLSEYQCS

SEQ ID NO: 123938 - protein, 2483 aa, Glycine max
  Coding DNA Sequence Number=SeqID_32253
  Gene Ontology: Mol. function=ubiquitin-protein ligase activity; Cellular component=intracellular; Biological process=protein modification process
  Homolog annotation: Hit_ID=Q8GY23; Match level="QueryCoverage=99%, HitCoverage=65%, E-value=0.0, Identity=53%"; Hit description=E3 ubiquitin-protein ligase UPL1
  Pfam annotation: Domain name=HECT; Domain location=2154-2481; Score =537.6; E_value=1.3e-158; Accession=PF00632.16; Description=HECT -domain (ubiquitin-transferase)
  Pfam annotation: Domain name=UBA; Domain location=21-58; Score=44.9; E_value=2.9e-10; Accession=PF00627.22; Description=UBATS-N domain
  Pfam annotation: Domain name=UIM; Domain location=66-83; Score=21.3; E_value=0.0035; Accession=PF02809.11; Description=Ubiquitin interaction motif
  Pfam module annotation: Pfam domain module=HECT::UBA::UIM; Domain location=2154-2481::21-58::66-83
VKRNRINIVGSTNQRFMPPPPDEATIATIVEMGFSRARAEEALRRVETNSVEMAMEWLFSHADDPVQEDDELARALALSLGSSSESTKAESAEKTIDVLTEEGHVKKPPVDDILAASVKLFQSSDSVPFQLTDLLVTLCSQSKGDDRPKDNCALSVLAHILALLLFEDGSTREIAAQNGIISTIIDILTNFKGRQELGKELPVPKCISALLLILDQMVQSRPKVENMEGTQTGSLPDSSGEQFSDTVLPKEKNSNGIEKEPAMAFENILGKSTGFATIDESHKLLDIACDLIKQHVPAVVMQAVLQLCARLTKTHALALQFLENGGLAALFNLPRTCLFPGYDSVVSAIVRHLLEDPQTLQTAMELEIRQTLSGNRHSGRVSPRSFLTSLAPVISRDPMVFMKAAAAVCQIETSGGRTVVVLSKEKEKEKSKSSSVEVGLSSNECVRIPEIKSHDGLGKFLKSHKKVPVNLTQVIDQLLEIVLKYPLVKGQEDSECDSTFMDIDEPTMKVKGKSKVEEAGILEPESERSTGLVKVTFVLKLLSDILLMYGHAVGVILRRDSEMCQFRGSNQPSGHSGIIHHVLHRLLPLSVDKSAGPDDWRGKLSEKASWFLVVLCGRSGEGRKRVTNELVKELMSFSHLESNSMKSSLLPDKRLFTFVDLVYSILSKNSSSGSLPGSGYSPDIAKSMIDGGIILSLTSILQVVDLDHPDAPKIVNLILKGLEGLTRAANASEQIFKSDGTEKKRSAVLNDRSDDQITAPSAAEAVAHDQNAGSQEASRDAMDNAHNQGTSQGDDRADNPDQSMEHDIRVEEGGTMAQNQTMELGMDFMREEMGEGGVLHNPDQIEMTFHVENRADDDMGDEDDDMGGDEDEDEDDDEGEDEDEDIAEDGGGMMSLADTDVEDHDDVGFGDEYNDEMIDEDDDDFHENRVIEVRWREALDGLDHLQILGQPGFIDVAAEPFEGVNVDDLFRLQSFERRRQTGRSSFERSATEVNGFQHPLLVRPPPSGDFVSMWSSSGNSASRDSETLSSGNLDVAHFYMFDAPILPYDHVPSSLFGDRLGGAAPPPLTDYSVGMGSLHLPGRRVLGNGRWTDDGQPQGSAQAAAIAQAVEEQFLAQLCSVAPASSPVERQLQNSGEQENKSDALASHDGPILTAGIDSTSQQIDSQEQENGNGTRAQQINDGGLCEEEINVDSGGRDTAEELQANEPMSVQPVSLNIMPNGFDCTVIEGNVTHDENVAQAFVNSSINSDAAIQCESGADVPTSIHNVPIESMEFNGSSNADGQPPNIELGGSGFETPNPGDSHASSIYASADVDMGGTDAEGNQSEQPTVFEDGRGEMLSTQNTEVAPDATQADQVSANNEASGANTIDPTFLEALPEDLRAEVLASQQAQSVQPPAYAPPSAEDIDPEFLAALPPDIQAEVLAQQRAQMVAQQAEGQPVDMDNASIIATFPAELREEVLLTSSEAVLSALPSPLLAEAQILRDRAMSHYQARSLFGSSHRLNNRRNGLGFDRRPVMDRGVGVTIGRRSALTDSLKVKEIEGEPLLDGNALKALIRLLRLSQPLGKGLLQRLLLNLCAHSVTRATLIYLLLDMIKPEAEGSVSRPATLNSQRLFGCHSNTVYGRSQLLDGLPPLVFRRILEILTYLATNHSAVAKLLFHFDQSIIPDSSCPVKVHMNEKGKEKVIEGRPSPNSSGAQTGDVPLVLFLKLLNRPLFLRSNAHLEQVMGLIQVVVDTAASKLESQSQSEKGMADTQNLSASEAPSNTEKDAPSVESDSNQQDKHADTNPCHSEGKKNVDMYNIFLQLPQSDLRNLCSLLGREGLSDKMYMLAGEVLKKLAFIVSSHRKFFTLELSESAHALTGSAISELVTLQKTNMLGLSAGSMAGAAILRVLQALSSLTSLNTLGDLDMENDADQHDDQATIWNLNTALEPLWQELSNCISAAEMQLGQSSFSPNMSNINVAENLQGSSTSPPLPPGTQRLLPFIEAFFVLCEKLQANESFMQQDHCNATAREVKESAGCSASTSVKIGGDSLRKFDGAITFTRFAEKHRRLSNAFIRQNPGLLEKSLSMMLKAPRLIDFDNKRAYFRSRIRQQHDQHLSGPLRISVRRAYILEDSYNQLRMRPTQDLKGRLNVQFQGEEGIDAGGLTREWYQLLSRVIFDKGALLFTTVGNNATFQPNPNSVYQTEHLSYFKFVGRVVGKALFDGQLLDVYFTRSFYKHILGVKVTYHDIEAVDPDYYKNLKWMLEEKTDCGCRERELWSLVYSLVSENDVSDIPDLTFSMDADEEKHILYEKNEVTDYELKPGGRNIRVTEETKHEYVDLVAEHLLTNAIRPQINSFLEGFNELVPRELISIFNDKELELLISGLPEIDLDDLKANTEYTGYTVASNVVQWFWEVVKTFNKEDMARLLQFVTGTSKVPLEGFKALQGISGPQRFQIHKAYGAPDRLPSAHTCFNQLDLPEYTSKEQLQERLLLAIHEASE

SEQ ID NO: 123939 - protein, 1000 aa, Glycine max
  Coding DNA Sequence Number=SeqID_32254
  Gene Ontology: Mol. function=hydrolase activity, acting on acid anhydrides, catalyzing transmembrane movement of substances; Cellular component=integral to membrane; Biological process=ethylene mediated signaling pathway
  Homolog annotation: Hit_ID=A5B663; Match level="QueryCoverage=97%, HitCoverage=97%, E-value=0.0, Identity=75%"; Hit description =Putative uncharacterized protein
  Pfam annotation: Domain name=E1-E2_ATPase; Domain location=394-634; Score=306.5; E_value=5e-89; Accession=PF00122.11; Description=E1-E2 ATPase
  Pfam annotation: Domain name=HMA; Domain location=128-192; Score =55.0; E_value=2.6e-13; Accession=PF00403.17; Description=Heavy-metal- associated domain
  Pfam annotation: Domain name=HMA; Domain location=45-109; Score=57.6; E_value=4.3e-14; Accession=PF00403.17; Description=Heavy-metal -associated domain
  Pfam annotation: Domain name=Hydrolase; Domain location=638-901; Score=117.7; E_value=3.5e-32; Accession=PF00702.17; Description =haloacid dehalogenase-like hydrolase
  Pfam module annotation: Pfam domain module=E1-E2_ATPase::HMA::HMA::Hyd rolase; Domain location=394-634::128-192::45-109::638-901
MAPSTGDVQLTSPASGEDSDDLEDVRLLDSYDKNDVVHDETKRIQVRITGMTCAACSNSVETALRSVHGITEASVALLQNKADVVFVPGLVKDEDIKNAIEDAGFEAEILPDSGAVAHGGAAAAVVGQFTIGGMTCAACVNSIEGILRNLNGVKRAVVALATSLGEVEYDPNVISKDDIVAAIEDAGFEGTFVQSNGQDQIVLGVSGVYSLGDAQVLEAMLSGTKGVRQFRFDTAVNELDVVFDPEVISSRSLVDGIQLGSNGRFKLHVRNPYARMASKDGVVLVCTGISSKIPLFFMGVICPHIPLVYSLLLWRCGPFLMGDWLNWALVSVIQFVIGKRFYIAAGRALRNGSTNMDVLVALGTTASYAYSVCALLYGALTGFWSPTYFETSAMLITFVLLGKYLECLAKGKTSDAIKKLVELTPATALLIAKDKGGRTVEEREIDSLLIQPGDTLKVLPGTKIPADGIVTWGSSYVNESMVTGESIPVSKEVNASVIGGTINLHGVLHVQATKVGSDTVLSQIISLVETAQMSKAPIQKFADYVASIFVPTVVVLALLTLLCWYVAGALGAYPDEWLPKNGNHFVFALMFSISVVVIACPCALGLATPTAVMVATGVGANNGVLIKGGDSLERAQMVKYVIFDKTGTLTQAKATVTVAKVFGGMDRGDFLTLVASAEASSEHPLAKAILQYARHFHFFDESSPTSDTKSASEDYKSGWLYDVSDFSALPGRGIQCFIDGRRILNYFPESCLLEAAYPKQVGNRKLLEENGINISTEVENFVVELEESAKTGILVAYDDILIGVLGIADPLKREAAVVIEGLQKMGVIPVMVTGDNWRTARAVAKEVGIQDVRAEVMPAGKADVVRSFQKDGSIVAMVGDGINDSPALAAADVGMAIGAGTDVAIEAANYVLMRDNLEDVITAIDLSKKTFFRIRLNYVFAMAYNVVAIPVAAGVFFPWLGIKLPPWVAGACMALSSQYARVHVNVSLFAKPGQENTEIE

SEQ ID NO: 123940 - protein, 494 aa, Glycine max
  Coding DNA Sequence Number=SeqID_32255
  Gene Ontology: Mol. function=phosphatidylinositol binding; Cellular component=Golgi apparatus; Biological process=clathrin cage assembly
  Homolog annotation: Hit_ID=A7P3R3; Match level="QueryCoverage=100%, HitCoverage=100%, E-value=1e-132, Identity=65%"; Hit description =Chromosome chr1 scaffold_5, whole genome shotgun sequence
  Pfam annotation: Domain name=ANTH; Domain location=29-235; Score =214.0; E_value=3.5e-61; Accession=PF07651.7; Description=ANTH domain
MGTLQSWRRAYGAIKDTTKVGLAHVNSDYADLDVAIVKATNHVECPPKERHLRKILFATSAVRPRADVAYCIHALSRRLAKTRNWTYDIEAERLPKPAEGQEKGCSKTRDLDSEELLEQLPALQQLLYRLVGCRPEGAAVSNYVIQYALALVLKESFKIYCAINDGIINLVDKMPRHEAIKALDAYKRAGQQAASLSDFYDVCKGLELARNFQFPVLREPPQSFLTTMEEYIKEAPRVVTVPTEPLLQLTYRPEEVLAIEDAKPSDEEQEPPVPVDNNVVVSDSESAPPPPPPSAHNNFETGDLLGLNDTAPDASSIEERNALALAIVPTETGATSAFNSTASQTKDFDPTGWELALVSTPSTDISAANERQLAGGLDSLTLNSLYDEAAYRSAQQPVYGAPAPNPFEVQDPFALSSSIPPPPAVQMAAMQQQANPFGSYQQPFQPQPQLQQQQQLMLMNPANPFGDAGFGAFPASNPVPHPQNNNPFGSTGLL

SEQ ID NO: 123941 - protein, 77 aa, Glycine max
  Coding DNA Sequence Number=SeqID_32256
MGGIVIYLEKGMGAVRREAVGADAKATVQAKDVLLVLLVILMDPTTTKECLSHKPLKPCSRFSVASTKLTNGITTRN

SEQ ID NO: 123942 - protein, 905 aa, Glycine max
  Coding DNA Sequence Number=SeqID_32257
  Gene Ontology: Mol. function=potassium ion transmembrane transporter activity; Cellular component=integral to membrane; Biological process=potassium ion transport
  Homolog annotation: Hit_ID=A7P2Q0; Match level="QueryCoverage=93%, HitCoverage=97%, E-value=0.0, Identity=78%"; Hit description =Chromosome chr1 scaffold_5, whole genome shotgun sequence
  Pfam annotation: Domain name=K_trans; Domain location=51-905; Score =1287.5; E_value=0; Accession=PF02705.7; Description=K+ potassium transporter
MGSRVDTDEDSDNRGSMWDLDQKLDQPMDEEAGRLRNMYREKKSSALLLLRLAFQSLGVVYGDLGTSPLYVFYNTFPNGVKDEEDVIGALSLIIYSLTLVPLLKYVFVVLRANDNGQGGTFALYSLLCRHAKIKTIPNQHRTDEDLTTYSRSTFHEKSFAAKTKRWLEEQESAKRAILILVLVGTCMVIGDGILTPAISVYMLLHPKGGTIDGTSGSMEWRSGGCEQRRGPAVQDEKICKWVGNKESHKWVGKGFMNEKKGTLELGHTDPTWFFQLALPCRGSTISQLHVEDLNPTLILPTGDPGTIQLARVYSTHRMYDPMSYFKRFITIYSVVVLSAVGGIKVNQPRMSSGLEKASFFLGYRCSSAGCCGIGIFNIWKYGSGVLKAFSPVYIYRYFRRGGKEGWTSLGGIMLSITGTEALFADLAHFPVSAVQLAFTLVVFPCLLLAYSGQAAYLMNNLTHSQDAFYRSIPDRIYWPVFIVATLAAVVASQATITATFSIIKQALALGSFPRVKVVYTSKKFLGQIYVPDINWILMILCIAVTAGFENQNQIGNAYGTAVVIVMLVTTILMILIMILVWRCHWILVLVFTGLSLIVECTYFSSVLFKVDQGGWVPLAIAGAFLIIMSVWHYGTVKRYEFEMHSKVSMAWILGLGPSLGLVRVPGIGLVYTELASGVPHIFSHFITNLPAIHSVVVFVCVKYLPVYTVPEEERFLVKRIGPKNFHIFRCVARYGYKDLHKKDDDFEKKLFENLFTFVRLESMMEGCSDSDEYSLYGQKIEHPRDGLLHNNGSTVSSNMDLTMSSVDSIVPVRSPHHMNITVRSSGQTSSQTEVDEFEFLNTCRDAGVVHILGNTVVRARRESRFYKKIAVDYIYAFLRKICRENSVIFNVPHESLLNVGQIFYV

SEQ ID NO: 123943 - protein, 333 aa, Glycine max
  Coding DNA Sequence Number=SeqID_32258
  Gene Ontology: Mol. function=carboxyl- or carbamoyltransferase activity; Cellular component=chloroplast; Biological process='de novo' pyrimidine base biosynthetic process
  Homolog annotation: Hit_ID=Q43064; Match level="QueryCoverage=99%, HitCoverage=82%, E-value=1e-163, Identity=86%"; Hit description =Aspartate carbamoyltransferase 3, chloroplast precursor
  Pfam annotation: Domain name=OTCace; Domain location=177-330; Score =181.9; E_value=1.7e-51; Accession=PF00185.15; Description =Aspartateornithine carbamoyltransferase, AspOrn binding domain
  Pfam annotation: Domain name=OTCace_N; Domain location=29-173; Score =174.0; E_value=4e-49; Accession=PF02729.12; Description =Aspartateornithine carbamoyltransferase, carbamoyl-P binding domain
  Pfam module annotation: Pfam domain module=OTCace::OTCace_N; Domain location=177-330::29-173
MDRRDAFHCRALKTERAPTFSVGQKFQLNDIIEAQQFDRDILSAIFEVAQDMENVEKDSPDNQLLKGYLMATLFYEPSTRTRLSFESAMRRLGGEVLTTENAREFSSAAKGETLEDTIRTIEGYSDIIVMRHFESGAARRAAATSDIPIINAGDGPGQHPTQALLDVYTIQREIGKIDGIKVGLVGDLANGRTVRSLAYLLAKFKDVKIYFVSPDVVKMKDDIKDYLTSKGVEWEESSDLVEVASECDVVYQTRIQKERFGERIDLYEKARGKYVVNQGILNVMQRHAVVMHPLPRLDEITVDVDADPRAAYFRQAKYGLYIRMALLKLLLVG

SEQ ID NO: 123944 - protein, 938 aa, Glycine max
  Coding DNA Sequence Number=SeqID_32259
  Gene Ontology: Mol. function=3-oxoacyl-[acyl-carrier-protein] synthase activity; Cellular component=chloroplast; Biological process=biosynthetic process
  Homolog annotation: Hit_ID=A7PFK7; Match level="QueryCoverage=32%, HitCoverage=60%, E-value=1e-101, Identity=60%"; Hit description =Chromosome chr11 scaffold_14, whole genome shotgun sequence
  Pfam annotation: Domain name=ketoacyl-synt; Domain location=716-935; Score=-49.1; E_value=7.4e-05; Accession=PF00109.17; Description=Beta- ketoacyl synthase, N-terminal domain
MSGFSKDMPAVDEDQQEDDVHANRTDHDEGLWENIPMLMASPPPSPNATDNPLKVTSKKTRQATRLRSYLGVVAREKIPIVHATWNDVQDDLKKLVWEDILRKLDIPEGENAKKKVMSTVASKWRQFKSHLTSKFVFADNEGQASSEPTVKHGIDLATWAEFAKSRQTPNWQYANGRRRFRNTMIAPTPYLEGGYELPDKKLVDEKTKRREQLAEFIENPSSSIDPPSPVSRQEKWKMARTNRYGKMSSTVAKEIADKIDSLEQEATQGSFVPHASRGSSTSSPSITQAQLADIIIGITDQVRRRVEEEHQQREDAWQREFEAQHTCQIEMMKKELQASIKIEVSQIASHQPVPIESALIQVLGARVSTKGSCAEPQAQGLAKDPSDVGVELMGLYVVDGDGTMLVAMGISLMQMTWLGTSRGLTPVYGFLEPQAIHCAKDKRTKCEQYIANWVKESHREVYLGPYLNQAHWKLLVLCSRDNIVLWFCSLRKKPDVHIKAAINSTFEGKENGHAPQWIEPKYKSKHEGDLVAKCYFAKHKLVWEVLEGELKNKMEIQWSDIMALKANCLDTGPSLLTVVLARQPLLFKETNPQPRKHTIWQPTSDFTEGEACKHRQHFLEFPQGLLAKHFEKLIQCDTHLNFLSQQPEIILDSPHFGTRPAAFENLDNPEDPDLHLVNCKGSTTSCLQDIGSPHSSLSPSFKIEHNDLLGIASNNLPCEAPFPSSGSTSSETDFKGPRNWDQIKLPRLRPSMAVSDFIGHIEHCLFEQITSGNPSFCGGRLEFQEMLEEIAQHLLNDNKVITTSDEKSLMTRVNSLCCLLQKDPAALQSSHDKESADEGPADGKTLRISYKKMNPFCVPFATTNMGSAMLAMDLGWMGPNYSISTACATSNFCILNAANHIIRGEADVMLCGGSDATIIPIGILLLLILRGLCEVIMP

SEQ ID NO: 123945 - protein, 300 aa, Glycine max
  Coding DNA Sequence Number=SeqID_32260
  Gene Ontology: Mol. function=nucleoside-triphosphatase activity; Cellular component=integral to membrane; Biological process=transport
  Homolog annotation: Hit_ID=A7Q129; Match level="QueryCoverage=44%, HitCoverage=34%, E-value=8e-36, Identity=61%"; Hit description =Chromosome chr10 scaffold_43, whole genome shotgun sequence
HCLGVGTRYEALVVLSRRERQAGIKPDPEIDAIHEGYSIVRSQNQFGNRLCSQAVKLCLGDLLVMGSNPETASLHMQGASPGAAVKLCLGDLLVMGSNPETVSLHMQGIGQFHHFSDMQVHEANEGQIAYQGSRENVLEFFEHMGFECPERKGVADFLQERPATILDFKLYYDAKFGRKKVAENGDTATDKAVSNGNSVTVTIVSNGNKRASEMAVYEQFRGEGLNQIHTNGFVPTIVDERPQKSLLPPFESAEMRALAESLSRDIIRGSPDVKWESIKGLENAKRLLKEAVVMPIKYPK

SEQ ID NO: 123946 - protein, 934 aa, Glycine max
  Coding DNA Sequence Number=SeqID_32261
  Gene Ontology: Mol. function=zinc ion binding
  Homolog annotation: Hit_ID=A7P3Z4; Match level="QueryCoverage=91%, HitCoverage=99%, E-value=0.0, Identity=58%"; Hit description =Chromosome chr1 scaffold_5, whole genome shotgun sequence
  Pfam annotation: Domain name=DUF1423; Domain location=406-929; Score =740.5; E_value=1.1e-219; Accession=PF07227.2; Description=Protein of unknown function (DUF1423)
  Pfam annotation: Domain name=PHD; Domain location=559-621; Score=1.7; E_value=0.0084; Accession=PF00628.20; Description=PHD-finger
  Pfam module annotation: Pfam domain module=DUF1423::PHD; Domain location=406-929::559-621
MMQRAKKSKRQWMDEVCIEMVVHSLTHSCLVVRLSQTKTNVQNVTNKRKNLWFSLCFLNCPSYSQPSLSLLPLAMIGSKDRVVDSEGENSRSKLSRHNFEANKEYPDEKGVEFLRDSKVGGGGVDGVFHSKPTKVVVVGGGGGSSSGFQELTLSYLCDNPKFNLAEKEIPGKSLLNSLEKMSHKGKEVVICENSNQDGKWVERDFLSLSEPREDSSKRSLEEVVERESNREKKPKLETLNLSLALPDVSLSLTASNALQNGDQQQPIRTKPCRPSTTTHTSYSNDYTAASLSYSYSHPFSHNPSCSLTRNSTDNFDYSVSKDDQIWNCGEGTNGSVHSRFKPIGDGLVGLSNHGGAAGGISSFMQGNNSQYKTTSSDNHSFFPSELPARSRFEAQSGDSRGRNSKNLRILEGLDDGKVRKISRPERIVREIVSESIPVMALTIQELTDDVIASTKEYLRNLIEKPEKKEELVSLQNRLERRSDLTKESLSKCHKVQLEVLVAVKMGLASFLSNKIQLSEMVEVFLFKRCRNVTCKHLLPVDDCDCKICSGNKGFCSSCMCPVCLNFDCASNTCSWIGCDVCSHWCHATCGIQKNLIKPGPSLKGPSGTSEMQFHCIGCGHASEMFGFVKDVFVCCAKDWGLETLMKELDCVRKIFRGSEDCKGKELHVKTDDMLLKLQTKMISPLDACNYIMQFFSYIFILALAFCTEVLHEIGSNGMPLVLENCSGGRNWKDAYITVTYADSMSDFHTSGISSKDLPASQSNLTKDTPSLSKPNSLLPEYGYDMGYSRSHPDAMSSDLLQKDLKASILSELKNEADFHLGALLRKGGLESLESIVRIKEAEARMFQTKADEARREAEGFQRMIRTKTAQMEEEYAEKLSKLCLHETEETQRKKLDELKVLENSYFDYYKMKKRMQDEIDGLLRRMEATKQQWV

SEQ ID NO: 123947 - protein, 116 aa, Glycine max
  Coding DNA Sequence Number=SeqID_32262
  Subcellular localization annotation: CTP_CleavageSite=74; ConfidenceScore=5.67e-01
MKYWSSSGVLGSSAISREAAASCPTYVSPASSSTMNGSGMVASGQATLFRNCSTEGMDLVGATTWAAEVDVGVGAANVEGSSILRIPTALPDVGQVNDRAQALKSKAVRDNPSSST

SEQ ID NO: 123948 - protein, 186 aa, Glycine max
  Coding DNA Sequence Number=SeqID_32263
MIRGDPYGIAPFCHPEAAGPMTSRDQVWSFCTLVSSRGGGPMIRGDTLRLSAPFCHPEAAGPMTSRDQVWSFCTLVSSEAAGPMIRGDTLRLSAPFCHPEAAGPMTSRDQVWSFCTLRRQGPMTSRDQVWSFCTLVSSRGGGPDDTRRYLTVIRTLLSSRGGGPDDKQRPNLVILHPCIIQRRRAR

SEQ ID NO: 123949 - protein, 307 aa, Glycine max
  Coding DNA Sequence Number=SeqID_32264
  Homolog annotation: Hit_ID=A5B5V0; Match level="QueryCoverage=78%, HitCoverage=53%, E-value=2e-11, Identity=24%"; Hit description =Putative uncharacterized protein
MEFFSNENFECFQAFENSNLIPFMSLKLPVYSELVKAFYSNLEIHEDVLMSEIYGIKMVIDQSLFYDLTKLPSEGVPFEAALIDEWKFDFSVHDARRLVCTNQADMTGRLLVGSLAFESRILHYLIVHILLPRSSNLSQVSEEDLIVMWAFHKGLQIDWSHLVRYRMHKALRLNAPLPYPHLVTLFLQHFNIPLDSEPYVPIKRSFLIGASVIASFGYIKEHDGSWVKKGARNIGEEGHEGKDSSLLSKILERFDGLQTFVGERFDTLELQVDMRFNEMESRMTKFEEDVSYIRSSFDLPPPPPPSS

SEQ ID NO: 123950 - protein, 363 aa, Glycine max
  Coding DNA Sequence Number=SeqID_32265
  Homolog annotation: Hit_ID=Q84VH5; Match level="QueryCoverage=100%, HitCoverage=57%, E-value=1e-154, Identity=75%"; Hit description =Envelope-like protein
  Subcellular localization annotation: CTP_CleavageSite=21; ConfidenceScore=5.15e-01
MATSPKETSSPGSPSVPSSPSSTKAPSNQEQPEFNIQPIQMIPGQAPIPEKLVPKRQQGVKISENPSLATSPREVDTEMDKKIRSIMFQHLPPQMLKSSLHPVKRNQQRRGSSHRGDPAPRAPEPAPGDFIDLEEVESDEEPIAKKLAPAIAERLQSRKGKTPITRSGRIKTTAQKKSTPITPTTSRWSKVAIPSKKRKEISSSDSDDDVELDVPDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCIRFSPAVINKYLGRPTEGVVDIAVSEHQIAKEITAKQ

SEQ ID NO: 123951 - protein, 216 aa, Glycine max
  Coding DNA Sequence Number=SeqID_32266
  Gene Ontology: Mol. function=motor activity; Cellular component=cell projection
  Homolog annotation: Hit_ID=UPI00016621D1; Match level="QueryCoverage =98%, HitCoverage=40%, E-value=2e-25, Identity=37%"; Hit description =UPI00016621D1 related cluster
LHILTFRGLHVLTFRGLHVLAFKGLYTLTFRGLQVLAFKGLHALALRGLQVLTFRGLQALAFRGLHVLAFRGLYVLAFTRLHVLAFRGLHVLAFRGLHALTFKGLHVLAFRGLHVLTFRGLHALAFRGLYALAFRGLHVLAFTRLHVLAFRGLHVLAFRGLHALSFRGLHVLAFKGLHVLTFRGLHALAFRGLHVLIFRGLHVLTFRGLHALAFRG

SEQ ID NO: 123952 - protein, 248 aa, Glycine max
  Coding DNA Sequence Number=SeqID_32267
  Homolog annotation: Hit_ID=UPI00016621D1; Match level="QueryCoverage =86%, HitCoverage=42%, E-value=1e-17, Identity=33%"; Hit description =UPI00016621D1 related cluster
MSSPLEDYRSSPLEDYTSSPLECYRPSPSEDYTSSPSYGCTQTFRGLDILALRGLRVLLFRGPHVLAIRGLHTLTFRGLNVITFRGLHVLTFRGRHVLPLRGPHVLTIRGLHALAFRGLHVLSFRALHLLPYKGLYVLAFRVMEVLTIRGLYVLAFRGLHVLTIRGRHVLTIRGFHALAFRGLPVLTFRGLHVLLFRGLHVLLFRGLHTLAFRGMDIFTFRGLHALTFRGLHVLAFRGLHVLTIKGQH

SEQ ID NO: 123953 - protein, 74 aa, Glycine max
  Coding DNA Sequence Number=SeqID_32268
MGTTTANREELATQLARLARLLPPEAAAFWRKNLEGPSGPAFKELQKLTDCVTTLPFDFRHVTKFHGLRNNASF

SEQ ID NO: 123954 - protein, 128 aa, Glycine max
  Coding DNA Sequence Number=SeqID_32269
MERSMIDAASAGALGDMTPTEARNLIEKMASNSQQFSARNDAIVLRGVREVATDSSSSTENKKLEGKLDALVNLVTQLAMNQKSTLVARVCGLCSSANHHTALCPSLQQSGVNEQRQAYAANIYNRPP

SEQ ID NO: 123955 - protein, 57 aa, Glycine max
  Coding DNA Sequence Number=SeqID_32270
MKKILEKTVASSRKDWSSKMKSKWSGPFIIKDVKPYGAVELFDPQLENLDRPWVVNG

SEQ ID NO: 123956 - protein, 132 aa, Glycine max
  Coding DNA Sequence Number=SeqID_32271
MECLEEVWETPEGNERCRFRGTIQLTATSLVHPEEPARTLQQPVEWILPNPTPYRLVEPVQVIEVSSSKEDPEEDPEELPPEPVVDALDFPEDDEDPLPDVDSSEDIMSASEADSTDESGPGGTANSEDSSS

SEQ ID NO: 123957 - protein, 144 aa, Glycine max
  Coding DNA Sequence Number=SeqID_32272
MTVKTSDTCSSRRRSQLVCKRMPGERQARIGRQGFARMVHTKYEPEASKCKRHGRHSSDATDIELAIGAASLRYYASRRNLGDRAKAALSESVQRRGGVLKLTRMPQVDSRGCGERIASEGGSFAPSWAVCTNPPFSPTAAPYP

SEQ ID NO: 123958 - protein, 145 aa, Glycine max
  Coding DNA Sequence Number=SeqID_32273
  Subcellular localization annotation: CTP_CleavageSite=47; ConfidenceScore=5.33e-01
NHGNTTSIPSQSNQQSEAMSRNTRRLTRLRMLTRRTLDQPRPIVTVDAATGWKDVPDTLKELVWNEILAKFDIPEALDAKKKVMSTMATRWRQFKSSLTSKFVFSISEDQHKEDPSVRYGFDAQIWEEFATTRKTPSWQGIRKKM

SEQ ID NO: 123959 - protein, 69 aa, Glycine max
  Coding DNA Sequence Number=SeqID_32274
MDGGDSYLYKYLRTRTIFLTPDTPQGLFSIDDSDDIDDSYDSDDIDRDLDMELELLTMMNTLTMDMMPE

SEQ ID NO: 123960 - protein, 91 aa, Glycine max
  Coding DNA Sequence Number=SeqID_32275
  Subcellular localization annotation: CTP_CleavageSite=66; ConfidenceScore=5.49e-01
PTNSLPSAVRQFSILNLIRRPMNSLPSAVHVSSTIESGAPRIHCLALFANSPFSTFIRRPMNSLPSAVHETHEFDCLALYMCPPLSSAEPP

SEQ ID NO: 123961 - protein, 254 aa, Glycine max
  Coding DNA Sequence Number=SeqID_32276
  Gene Ontology: Mol. function=phosphoprotein phosphatase activity; Biological process=intracellular signaling cascade
  Homolog annotation: Hit_ID=A7R8Y3; Match level="QueryCoverage=51%, HitCoverage=38%, E-value=1e-22, Identity=39%"; Hit description =Chromosome undetermined scaffold_3090, whole genome shotgun sequence
MSNLGSKEDSFPSRKYTIETQFVWEPYPSTVLSLLPPVCLVGSLAWYAVVPLICFQVIEWHQPDRVLRQFGMQQPVPESPSQPLNIHGITLKGKHDKNWGQLFAPMIQQWNNRHAFRVDAYPRQEGLLSFNSDYMGEVAEALQYMVSPEGRNTCTFDDPVPYVEKITILSEEQERVTKPVSHGPASERQFSAQQFHMLQSSIETQGIDRRRDTVEAEEYSQQMAERGHGMYYTPQTFAQYPTQMYQYPFQGSSH

SEQ ID NO: 123962 - protein, 148 aa, Glycine max
  Coding DNA Sequence Number=SeqID_32277
MARLSGHLPGQLSELCLAKRIMASRKRARTDDIPSSSIPAPQSAAIGPDVAWPEAQLPLVRPNEAAPPEPAPAWVEPIPAEPRSPVVNPPPSPELEVVPPSPPLIIISDASSDETAAPPDSPIGEIVDPPVSPVGGLPIFLIHHLEEA

SEQ ID NO: 123963 - protein, 55 aa, Glycine max
  Coding DNA Sequence Number=SeqID_32278
MSLNQVPVKRKKAEWCDKNTEVMLKVCIEEGRTQVLAGMGEETIAASDECEKPNQ

SEQ ID NO: 123964 - protein, 78 aa, Glycine max
  Coding DNA Sequence Number=SeqID_32279
MAGTFFLLKKQNSLEIMSGDVAPCGACRPWIFFINRVLCFLKIMAVEWRRKKDDWRCHFKEQMSQEEAHHHRKPWIRA

SEQ ID NO: 123965 - protein, 28 aa, Glycine max
  Coding DNA Sequence Number=SeqID_32280
LVNRSASSTAFPKTACLTKYFAVCAAFS

SEQ ID NO: 123966 - protein, 125 aa, Glycine max
  Coding DNA Sequence Number=SeqID_32281
MASGFHVQKLCNSSLGIGNRLHTLYIRRNPHARFTACGVDTTYTYSYRLVVPVQVIEVSSSEEDPEEDPEELPPEPTVDDLDLPEDDEDPLPDVDSPQDIMSASDADSIEESGPGGTANSEDSSS

SEQ ID NO: 123967 - protein, 77 aa, Glycine max
  Coding DNA Sequence Number=SeqID_32282
MLRNLTNCATMLPFEFRHVADFMNCATMLPFEFWHVTELHKLPDDGCQRKNLSEFNSNNRTSKRVVLDHQEKTTLET

SEQ ID NO: 123968 - protein, 168 aa, Glycine max
  Coding DNA Sequence Number=SeqID_32283
VHLLGDCYTENKRGCISCGSVQVEGTSTWLFKENKVGDIPYGSLACKGFYKVERNLKNCSVYAYMFLVEVGIVGARSAGQIFLTYVAEYGSQSKEKVGPSCSTQMETSPTLFRQLSLSLTLPFSSSSFSIEAPSKASTFGHHFCPKSRKDGIFGVVKCVSTSGTSKIQ

SEQ ID NO: 123969 - protein, 140 aa, Glycine max
  Coding DNA Sequence Number=SeqID_32284
  Homolog annotation: Hit_ID=A7PB81; Match level="QueryCoverage=93%, HitCoverage=18%, E-value=3e-32, Identity=49%"; Hit description =Chromosome chr16 scaffold_10, whole genome shotgun sequence
PVAASSVHALLEEKNKLISEVENSRDEDQNSKKAMESLASALHEVSAEATETKENLLHIQPESESYDAQIEDLKLVLKDTNEKYNSMLDEAEWEQREVQLVSCIKKNEEEKCRNLPFGGRATRDSRDACSTKGIRAESPP

SEQ ID NO: 123970 - protein, 95 aa, Glycine max
  Coding DNA Sequence Number=SeqID_32285
  Homolog annotation: Hit_ID=Q84VI1; Match level="QueryCoverage=83%, HitCoverage=10%, E-value=3e-24, Identity=79%"; Hit description =Envelope-like protein
MQFCTGLELQDLGSHQIHTSTEFATGKAAASGAVSKDALIAELKDTCKVLEATIKATTEKKMELELLIKRLSESGIDDEEAAEKNEKQLKKRRSC

SEQ ID NO: 123971 - protein, 116 aa, Glycine max
  Coding DNA Sequence Number=SeqID_32286
MTQELVARGDTLRLSAPRHSVTPSVIDEQRPIWSSAPFPEMSAFSDGDFSSLTSYLELRHVTCTLVSSRGGGPDDTRRYLTVIRTLLSSRGGGPDDKQRPSLVILHPCIIQRRRAR

SEQ ID NO: 123972 - protein, 87 aa, Glycine max
  Coding DNA Sequence Number=SeqID_32287
  Homolog annotation: Hit_ID=A5BTR2; Match level="QueryCoverage=88%, HitCoverage=3%, E-value=4e-14, Identity=55%"; Hit description =Putative uncharacterized protein
  Pfam annotation: Domain name=zf-CCHC; Domain location=51-68; Score =22.9; E_value=0.00052; Accession=PF00098.14; Description=Zinc knuckle
MCVQEEERLVMEMGESALLTTAYGKNKAIKSQAYQKGNGKIPPQADIKKVAKCFFCKKKGHMKKNCPGFQKWLEKKGYAKPKETSGK

SEQ ID NO: 123973 - protein, 222 aa, Glycine max
  Coding DNA Sequence Number=SeqID_32288
MVISPGTTCPAQGRRIYRLPGGDSSPAVGIAGYPHGQVDPDIVLEFMLMIGLQRRCTRYAILGEGSVDPFDADALNQFLGYPLVLEEGQECEYGQRRNRADGFDEEAIAQLLCILGQDFARTVAGRRARIMRTNMTTLTQIWMTLLLSNIQPSDHNSDLPLPKCIAPTRHSLDPDKSNRALGFPALITGLCQSFGVPVVPSKVIRPPISRAFVEKYCTQRQA

SEQ ID NO: 123974 - protein, 100 aa, Glycine max
  Coding DNA Sequence Number=SeqID_32289
MTRGGNPVSLNHNIGFMTVFEGWLFYIGCLATTDVEWVGFYSGSKAETDVEWVGFYIGYQSTDIENERMGTNGKVSTSVFNQPMYNLKSFYIVYRLTDVE

SEQ ID NO: 123975 - protein, 210 aa, Glycine max
  Coding DNA Sequence Number=SeqID_32290
MKDKRDEEEKLENQKKKKDRKALSSKAKGKEKEEKDSSKKIVKKENHFAIKCDIKRELLLKQYFYLLLSRETSLSTTIPLELEVIPQVKELLDEGLVRKSLNPCALLVPKKSIMRHQIPMIGGMMNVLSGATLFCKITHAPNIFMMCVHRDLISDQGLPMNPKRVKVILEWLTPPSVEERINEFQEPRDLTSNPFQGGGNDAILPSKGIG

SEQ ID NO: 123976 - protein, 78 aa, Glycine max
  Coding DNA Sequence Number=SeqID_32291
MEEAPTRAPDDAEKAHMDEGDDRLARLLGRNRSHVTEVTAFFDITEIFDVMALSYFVTVLRHTIFVRFSFTLWLDVSR

SEQ ID NO: 123977 - protein, 96 aa, Glycine max
  Coding DNA Sequence Number=SeqID_32292
VDSRGSPVRQQAANHRAHVQTHDCLYQLSLNMQSQGFASFSCPTPDQFRAEVAWPGDWPEAQAGEAPPEAPGDGEEAHEDEEMADLLDFLGGSGAT

SEQ ID NO: 123978 - protein, 220 aa, Glycine max
  Coding DNA Sequence Number=SeqID_32293
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=31%, E-value=1e-105, Identity=79%"; Hit description =Photosystem I P700 chlorophyll a apoprotein A1
  Pfam annotation: Domain name=PsaA_PsaB; Domain location=2-220; Score=- 198.0; E_value=0.0018; Accession=PF00223.10; Description=Photosystem I psaApsaB protein
IPDPTHIRPSAQVVWPIVGQEILNGDVGGGASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHK

SEQ ID NO: 123979 - protein, 16 aa, Glycine max
  Coding DNA Sequence Number=SeqID_32294
MELTSPSEFKIHRKVE

SEQ ID NO: 123980 - protein, 170 aa, Glycine max
  Coding DNA Sequence Number=SeqID_32295
  Gene Ontology: Mol. function=catalytic activity; Cellular component =nucleus; Biological process=metabolic process
  Homolog annotation: Hit_ID=A4FE55; Match level="QueryCoverage=97%, HitCoverage=32%, E-value=5e-60, Identity=67%"; Hit description =Medium-chain acyl-CoA ligase
VDSRGSPIGVRVSVAEDGEVLTQSNTNLDGYWDQPQATAEALAGNWFHTGDRGSVDDGYLTISDRKKDIIITGGENVTSIEVEDALISHPDVREAAVVGVPDEKWGELVTAVVVVVTLDDPPSGADLIAHCRDRLAGYKCPKRVEFVDSLPRTATGKVQKFRLREQLARD

SEQ ID NO: 123981 - protein, 102 aa, Glycine max
  Coding DNA Sequence Number=SeqID_32296
MKDESSEATIPEPFVIREEAEETQGRQVTAATPERSLEATLEPSAQGEDIPSPQHAADPSTPLLEMPEDPTTSVLAMDTSPLATPVLHLIDEEDVQTLDTHD

SEQ ID NO: 123982 - protein, 88 aa, Glycine max
  Coding DNA Sequence Number=SeqID_32297
MEMQRKTNKKSSIGACRPRIFFINGFLCFLEDEWQRNEERKRERRHHFKEKMSLEEAHHHMRPWIRAWRKKEMNEGRGRKEHEILCSK

SEQ ID NO: 123983 - protein, 70 aa, Glycine max
  Coding DNA Sequence Number=SeqID_32298
MCNLRKTNALPLLRLNEMTPQPSCMKFFRSYEASTPMLELHCHHQKGGDCRSQTLMMPVTTHLVATVSTL

SEQ ID NO: 123984 - protein, 86 aa, Glycine max
  Coding DNA Sequence Number=SeqID_32299
  Homolog annotation: Hit_ID=Q37082; Match level="QueryCoverage=74%, HitCoverage=46%, E-value=2e-16, Identity=65%"; Hit description =Uncharacterized protein ycf72
  Subcellular localization annotation: CTP_CleavageSite=58; ConfidenceScore=5.45e-01
KPQGVAGFFLPIGALPSPPPCGWSTGFITTPLTTGRLPSQHLDPALPKFFWFTPTFPTCPTVAEQFLDIKRTSPEDGSYDNLYIYR

SEQ ID NO: 123985 - protein, 82 aa, Glycine max
  Coding DNA Sequence Number=SeqID_32300
MVIDYQQFIQILKPVIYYTSLVRSIYQRRFSENNFHEESIYGSNGFLEGIKGALAKHEFKESCDKFESGKCSSGLYMRNNGQ

SEQ ID NO: 123986 - protein, 115 aa, Glycine max
  Coding DNA Sequence Number=SeqID_32301
  Pfam annotation: Domain name=Tryp_alpha_amyl; Domain location=31-112; Score=5.7; E_value=0.07; Accession=PF00234.13; Description=Protease inhibitorseed storageLTP f
MGPKGVAFLLSLNLLFFSMIGSFNPSFPAQNDDPSSQIRCPDLIECSNVGLGVSIISNQCCTAVAALPIIGGAFCFCRAVSLGILPPLATEILAQILFSACGRNNTIFDYNCQQD

SEQ ID NO: 123987 - protein, 241 aa, Glycine max
  Coding DNA Sequence Number=SeqID_32302
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=98%, E-value=5e-16, Identity=28%"; Hit description =UPI00006A17C9 related cluster
MLLSSNVIYICVRVVMLVRMVRTLLFAAARVKSCPSMHSSCVIASLSGCARTVGPPPISGGGPGTVWIWSPLKVRTRSPLKARACSPLKFRTCRLSKARECSPMMARTCNPLKVRACSPTKVKAYDPLTARTCSPLKLKVHDPLKARTCSPLKVKARTYSPLEVRACSPLVVRTCSPLKARTCSPLTVRVRACSPLMVRTCSPLKARTCSPMTVRVRACSPLMVRTCSPLKARTCSPLNGE

SEQ ID NO: 123988 - protein, 104 aa, Glycine max
  Coding DNA Sequence Number=SeqID_32303
MCGRLPEGLSDPINCVSRSALARVLFLYERDSIQICHSLGDALFSMNTPPLNDELCQSSPPTRPGENTESSQALTRQNGIHISFVWSRREKAQSNINHFTDAID

SEQ ID NO: 123989 - protein, 89 aa, Glycine max
  Coding DNA Sequence Number=SeqID_32304
MDARCGLVHQPFDFFPKALWQSLFHRNRLFLRQRWPYHFLKGSDLLPFLTIYDQILAASPDFTLQRCTVVQFIGYCPQSKPNLAVKGIH

SEQ ID NO: 123990 - protein, 107 aa, Glycine max
  Coding DNA Sequence Number=SeqID_32305
MSALLFLMPTSSRKALDLSPHPDRNPPYDCAFLYGEVHTSQLFIDRSGAISECTIPALGRGSHQPYQVRLAAIREASNCINCSHTTCEGVSRPDPLGKTVSSTAFHL

SEQ ID NO: 123991 - protein, 116 aa, Glycine max
  Coding DNA Sequence Number=SeqID_32306
MSVEEFLQKVAWPGVQPSPLGGGEASAAQEPQKDQQEDIPEAAEPTPPEPFTLEFDPVVVQVQEDVTASEPSPPKPFIFYADPAISPHPEPSVPVSSLPLSQDPSSAPALDLNEHA

SEQ ID NO: 123992 - protein, 93 aa, Glycine max
  Coding DNA Sequence Number=SeqID_32307
  Homolog annotation: Hit_ID=A7R886; Match level="QueryCoverage=33%, HitCoverage=100%, E-value=4e-09, Identity=96%"; Hit description =Chromosome undetermined scaffold_2358, whole genome shotgun sequence
MVHLLMGERRGLNPRVVDSQSTALIHLATSAPTPAQGKQSFKQRGWAVHFIDLTSLYLRLKIGAGRAVKARLVESKLRFLKRAPRKPLHASLL

SEQ ID NO: 123993 - protein, 135 aa, Glycine max
  Coding DNA Sequence Number=SeqID_32308
ESIDEEDPRPTSSNGVYIKLGSTEQPSAPSDLSDPEWRLLSLAKIAYSGWSFASLTLLRNAEEEPQLLVVFVVTTFVLEEHMACLDQQHSRKEGQAIVVVEDLPISDLDDFSNLDCICCLKDHNYFVVVGFATEG

SEQ ID NO: 123994 - protein, 110 aa, Glycine max
  Coding DNA Sequence Number=SeqID_32309
  Gene Ontology: Mol. function=receptor activity
  Homolog annotation: Hit_ID=Q08WY5; Match level="QueryCoverage=76%, HitCoverage=18%, E-value=3e-14, Identity=42%"; Hit description=Trap transporter solute receptor, taxi family
MLEATLPSILLISLALFFAYKFIDPAPPRHIVIATSNDDLNYNAFASVYGVYLQKEGITLEVRKTAGDNDNLRLLKDPDSGVDIAFIQDGVAHSEGAGSLLSLGSLYYQP

SEQ ID NO: 123995 - protein, 79 aa, Glycine max
  Coding DNA Sequence Number=SeqID_32310
MVGKDLGSTGGPHDVQIQNEHAFPSYGLPLNYTPPNVAYTPNKNVNNSTPIPWKASNPKLIMHMSLKPWKRPMKFPITI

SEQ ID NO: 123996 - protein, 73 aa, Glycine max
  Coding DNA Sequence Number=SeqID_32311
  Subcellular localization annotation: CTP_CleavageSite=44; ConfidenceScore=5.11e-01
MTKLGLCLSSGPPPLDDKRVRITVSKRGADNRKVSQQATSSWVMATKGGVVDKSEALAPTYPPMRNSDLRSSG

SEQ ID NO: 123997 - protein, 123 aa, Glycine max
  Coding DNA Sequence Number=SeqID_32312
  Subcellular localization annotation: CTP_CleavageSite=66; ConfidenceScore=5.30e-01
MPLSESLLIRRSSSIFFSVVALMVASSTLHVSLSSAIKASLDTAPEAAAFPDVETMSGTCVTPQTVVMQGQSRTSLFITESIKHSGICSGDSKILQVASCFQDVKTSHVTSAFCSPCLHALTV

SEQ ID NO: 123998 - protein, 131 aa, Glycine max
  Coding DNA Sequence Number=SeqID_32313
MPASWFAPTKRMIGRLLAGSLAFESRILHYLIVRILLPRSSNLAQVSEENLIVMWAFHTDRQIDWAHLVRYRMHKALRLNAPLPYPHPVTLFLQHFNIPLDYEPYVPIKRSFLIGAAVIASFGYCKERDGS

SEQ ID NO: 123999 - protein, 72 aa, Glycine max
  Coding DNA Sequence Number=SeqID_32314
GLVGACALSANLDRLARISEFRLSARLLAQQMDSSGALSGMTPRSANMHNSSFFQILPLAQRMECCVQWMAR

SEQ ID NO: 124000 - protein, 180 aa, Glycine max
  Coding DNA Sequence Number=SeqID_32315
  Homolog annotation: Hit_ID=Q6L477; Match level="QueryCoverage=58%, HitCoverage=16%, E-value=5e-08, Identity=26%"; Hit description =Putative uncharacterized protein OSJNBa0009L15.8
  Subcellular localization annotation: CTP_CleavageSite=36; ConfidenceScore=5.70e-01
MASPPASPPPHSPSPPPPHAPSDALASPSVIKRTCKASRLQSLSTRPPGAERPVVHVDPSIGKADGPHRKKLRTYLGIVARDKVDVTYENWKEVPTTQKDLIWEDIQAEFDILEASDSRTKKKLLQTMGERCRQFKLDLTRKWALAADQDGVEDTVCEKYDISKEKWAQFCQTHRDPYWE

SEQ ID NO: 124001 - protein, 156 aa, Glycine max
  Coding DNA Sequence Number=SeqID_32316
  Homolog annotation: Hit_ID=UPI00006A17C9; Match level="QueryCoverage =76%, HitCoverage=94%, E-value=2e-11, Identity=29%"; Hit description =UPI00006A17C9 related cluster
  Subcellular localization annotation: CTP_CleavageSite=74; ConfidenceScore=5.29e-01
MWTRSPLKARACSPLKFRTCRPLKARACSPLKVRMCSPLEVRSFNLLMVKAYSPLKARKCMPLKGRMYSPLKVRACSPWKVRTSNPLKARACSPLKARTCSHLKVRACSPLKGGTCSPLKIDCPFERGDNSCNLILSFANLSGNSLRVCVLFDLVT

SEQ ID NO: 124002 - protein, 87 aa, Glycine max
  Coding DNA Sequence Number=SeqID_32317
VNSKVVAVRLLPATGHPNATVCLACVCLGAQYFLMKARLVEGLMPLLEVTGLIEARNQSWKPQGPVGLLQVHWGEIGIAVAGQNVAK

SEQ ID NO: 124003 - protein, 66 aa, Glycine max
  Coding DNA Sequence Number=SeqID_32318
MNTHPLAELPVAKRGGIAKPRWPLRNIRMVILDHRIKMITGDFTERKPRTDISIILDRRILPERNV

SEQ ID NO: 124004 - protein, 112 aa, Glycine max
  Coding DNA Sequence Number=SeqID_32319
MVGSGLQMHRHHLQSPSAHLQRLKRCLRPVADQQATKSKAKGKKKYKVRDRQVIMRPAQDVKEALLGGILELAMMKLPAKQSRKGTIKEGSSAAPQADIGFDKHRFQSLEHQ

SEQ ID NO: 124005 - protein, 89 aa, Glycine max
  Coding DNA Sequence Number=SeqID_32320
  Homolog annotation: Hit_ID=A5BKB9; Match level="QueryCoverage=92%, HitCoverage=8%, E-value=4e-14, Identity=43%"; Hit description =Putative uncharacterized protein
MTTLCKSRRRHFQKDCLKCKSWFKKKGELNAPGFLTIQAISPNVKFIFMENRVKAQVEAIETYHLKLDTGHHFDLLETLYVPSLPTNLV

SEQ ID NO: 124006 - protein, 87 aa, Glycine max
  Coding DNA Sequence Number=SeqID_32321
  Subcellular localization annotation: CTP_CleavageSite=54; ConfidenceScore=5.63e-01
MYIPLKERKCSPLKVRTYSPLKVRTCSLLKSRMCSPLKSRTCSPLKSRTRSPLKARMYNPRKARTCSPLKARTCSPQGVQPYEKARD

SEQ ID NO: 124007 - protein, 37 aa, Glycine max
  Coding DNA Sequence Number=SeqID_32322
DLWFKLKKSDLNIMAGLCGGSKVQMKNGKHLMVWSYD

SEQ ID NO: 124008 - protein, 243 aa, Glycine max
  Coding DNA Sequence Number=SeqID_32323
  Gene Ontology: Mol. function=transferase activity, transferring nitrogenous groups; Cellular component=intracellular; Biological process=regulation of transcription, DNA-dependent
  Homolog annotation: Hit_ID=A9IS69; Match level="QueryCoverage=86%, HitCoverage=43%, E-value=5e-72, Identity=62%"; Hit description =Transcriptional regulator, GntR-family
TRCIASPVRSCAAPSTPALAHFPLAQWRRALNQTAQQAQLLGYGDPLGELALREALAQHLALARGVRCAPQQIVITEGAQQALTLCVALLTNRGDTGWVEEPGYRGAKAAMRLGDLQIEPIAVDAQGLAPTAQDWQQRPPRLIYTTPTHQYPTGAIMSAARRLALLAAAQRHQAWIIEDDYDSDFRYSGEPIAAMQGMAQPTPVIYIGSFSKTLFPALRIGYMVLPAPLLPRLRPALHELLRG

SEQ ID NO: 124009 - protein, 131 aa, Glycine max
  Coding DNA Sequence Number=SeqID_32324
  Subcellular localization annotation: CTP_CleavageSite=62; ConfidenceScore=5.71e-01
MTLSSWQNKLNRTMTNPPGSPPPPSPPPPADPFTVKRTRKATRLRSLATRPLGAERLVVHVDPATGKADGLQKKKLRTYLGIVTRDKVDMTYETWKELPAAQKDLIWKDIQAEFEIPEASDSRTKKKVLQT

SEQ ID NO: 124010 - protein, 21 aa, Glycine max
  Coding DNA Sequence Number=SeqID_32325
MGPEMQEKALRFIKSLRGSIM

SEQ ID NO: 124011 - protein, 103 aa, Glycine max
  Coding DNA Sequence Number=SeqID_32326
MKHIAGFNSNEEVYVEQPPVLSAVPDLKLISRENTSGTCQFIGSLLSHGIVRNKTVLLYPLLKRNIFLPAVVVHIDFMDEATNYLTMASFLIVYQLGVEILVP

SEQ ID NO: 124012 - protein, 323 aa, Glycine max
  Coding DNA Sequence Number=SeqID_32327
  Gene Ontology: Mol. function=transferase activity; Biological process= biosynthetic process
  Homolog annotation: Hit_ID=A9DWJ3; Match level="QueryCoverage=99%, HitCoverage=85%, E-value=5e-98, Identity=56%"; Hit description=A -glycosyltransferase-related protein, glycosyltransferase family 4 protein
  Pfam annotation: Domain name=Glycos_transf_1; Domain location=185 -323; Score=83.7; E_value=5.8e-22; Accession=PF00534.11; Description =Glycosyl transferases group 1
MKIGILCYPTYGGSGIVATELGMSLANKGYEVHFISSALPARLDITNPNIFFHRVNVQTYPLFQYQPYDIALSSMIYRVVNLYKLDLLHAHYAIPYAYAAFTAKQMLQEDNNDIPLVTTLHGTDITLVGQHPSYKHAVEFSINKSDAITSVSESLKKDTLQFFNIKKPIQVITNFIDNSEFDECNECQRTQFADPDEKILIHVSNLRPVKRVDEVLQIFKNVHKKVKSKLIIIGEGPDMEKVNQFLEENPDLISKIRLLGKVNDLYRILQLSDVFLLPSEQESFGLAALEAMAAYTPVISSNAGGIPEVNVQGETGFLAESEM

SEQ ID NO: 124013 - protein, 243 aa, Glycine max
  Coding DNA Sequence Number=SeqID_32328
  Gene Ontology: Mol. function=metalloendopeptidase activity; Biological process=proteolysis
  Homolog annotation: Hit_ID=A3J3K9; Match level="QueryCoverage=66%, HitCoverage=39%, E-value=1e-20, Identity=28%"; Hit description =Possible membrane protein; possible peptidase, M23/M37 family
MTNWSLQQHSKGKKIIEDDIYLRQLEINRQNKELAVLRKNYAEVLVNAYKNKGVQNKVTFILSAKNLGEAIRRVQYLKEYSDYQDKKAAEITDAANQIKKTIAQRQKSVADKQQLLIDQQKDLATINVERAQKEQLVEDFKKNESKLTAELKQKQVQSKALEGQIRSIIAEEIRIAKAEEEARRKAEAEKIRLAKIAAEREKARIEAENRARAEALERERKLAEAEAKRAEELAAKKAEEERK

SEQ ID NO: 124014 - protein, 55 aa, Glycine max
  Coding DNA Sequence Number=SeqID_32329
MGVQIAPRPIWALQKIPPEGGCFWRKQPFLPGRAGRQPPPLLAINRGGNEEGSSR

SEQ ID NO: 124015 - protein, 128 aa, Glycine max
  Coding DNA Sequence Number=SeqID_32330
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=4e-24, Identity=100%"; Hit description=LacZ protein
MLYHCIASPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRTHHPVSS

SEQ ID NO: 124016 - protein, 108 aa, Glycine max
  Coding DNA Sequence Number=SeqID_32331
MAPKKLSTKRSRRDAAAEGSSAAPEFDSHRFRSAEHQQCFEAIKGWSFHRERHAQLREDEYTDFQEEIAHRHWTLLVTPMAKSDPEIVLQFYANAWPTEEGVRDMRSW

SEQ ID NO: 124017 - protein, 122 aa, Glycine max
  Coding DNA Sequence Number=SeqID_32332
  Homolog annotation: Hit_ID=B0HC01; Match level="QueryCoverage=27%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPLSMQNRAMEEMK

SEQ ID NO: 124018 - protein, 341 aa, Glycine max
  Coding DNA Sequence Number=SeqID_32333
  Gene Ontology: Mol. function=triose-phosphate isomerase activity; Cellular component=integral to membrane; Biological process=pentose -phosphate shunt
  Homolog annotation: Hit_ID=Q1GZK6; Match level="QueryCoverage=49%, HitCoverage=67%, E-value=6e-53, Identity=57%"; Hit description =Triosephosphate isomerase
  Pfam annotation: Domain name=Oxidored_q4; Domain location=240-340; Score=178.3; E_value=2e-50; Accession=PF00507.10; Description=NADH -ubiquinoneplastoquinone oxidore
  Pfam annotation: Domain name=SecG; Domain location=167-221; Score =32.9; E_value=1.1e-06; Accession=PF03840.5; Description=Preprotein translocase SecG subunit
  Pfam annotation: Domain name=TIM; Domain location=1-205; Score=166.0; E_value=9.7e-47; Accession=PF00121.9; Description=Triosephosphate isomerase
  Pfam module annotation: Pfam domain module=Oxidored_q4::SecG::TIM; Domain location=240-340::167-221::1-205
MQSLLTGSRLAWGAQNIAKYEEGAYTGEVSAEMLRDFGAQYVIIGHSERSTAYCESDENIAEKFMMAKRHGLIPILCVGETLLEREAGVMERVVGKQLETIIRLFGGEAFAGTIVSYEPIWAIGTGLAASAEQAVAMHTFIRETVAAADKAAAQTLKILYGGSVNPQNAHGKGADMGAAFGSGASGSLFGVSGSSNLLSKLTSIFITVFFATSLTLAFMSSHKAGSGSVVKAPLTQQAPAKGLGPLIAGKILSPHKPDAEKNSPYECGFEAFEDARMKFDVRYYLVAILFILFDLEIAFLFPWAVVIQEIGSAGFWAMMVFLFVLVVGFIFEWMKGALEWD

SEQ ID NO: 124019 - protein, 150 aa, Glycine max
  Coding DNA Sequence Number=SeqID_32334
  Gene Ontology: Mol. function=helicase activity; Biological process =viral genome replication
  Homolog annotation: Hit_ID=Q2QZU2; Match level="QueryCoverage=89%, HitCoverage=8%, E-value=5e-30, Identity=44%"; Hit description=AT hook motif-containing protein, putative, expressed
KVEILLIHNLFPNSCYNQKARSWNLRKKGNTIGRLIWVPPTTGELFYLRIMLTTCKGPTLFEDIRTVENVLYLTYREACFAMGFLQDDREFVEAIKEAKDWGTTNYLRKLFVLMLFTGAITKPEELWNQTWNSLAEDIAYHYKKTTLNTC

SEQ ID NO: 124020 - protein, 92 aa, Glycine max
  Coding DNA Sequence Number=SeqID_32335
MGGYVGARASLLSTTPPFVAMTQELVARGDTLWLFAPFCHPEAAGPMTGRDQVWSFCTHDTRRYLTVIRTLLSSRGGGPDDKQRPSLVILHP

SEQ ID NO: 124021 - protein, 106 aa, Glycine max
  Coding DNA Sequence Number=SeqID_32336
MITKDDDKGDDKKLKDQSKNNSSESRTIQEFKIESRRIQDSRGKLRVKNQRFKVQDLKNQDQDSRLKIQESREGLIKITHDFSQNMFTKEFYSLVIDYQIAVIDYQ

SEQ ID NO: 124022 - protein, 42 aa, Glycine max
  Coding DNA Sequence Number=SeqID_32337
MTPEQVMYNIIIIHPMPVNILIAIKQDHELLHFGVTSSHGRT

SEQ ID NO: 124023 - protein, 77 aa, Glycine max
  Coding DNA Sequence Number=SeqID_32338
MLQLYGISISLKEHSNPVTPKPYTPKSPSGPLPPDSGPTPKIHFSTQTLLVNYTILMTSHSCVKHVQHIALQFNTGS

SEQ ID NO: 124024 - protein, 161 aa, Glycine max
  Coding DNA Sequence Number=SeqID_32339
SKSLAFVDHTAFCCHNSRAGSPRRYLTVIRTLLSSRGGGPDDKQRPSLVILHPRYAEIPYGYLHPFARQTQLCPMASRDQVWSFCTQDTRRYLTVICTPLLGRHSCVRWQAETKFGHSAPKIRGGYLTVIRTLLSSRGGGPDDKQRPSLVILHPRCAEIPY

SEQ ID NO: 124025 - protein, 97 aa, Glycine max
  Coding DNA Sequence Number=SeqID_32340
MPRQTQGDAPLGAGAPPPPHQASPAGSLGMERYLQHLVRQQAANHRGQFAAEVAWVGDWPDAQAGEEPTGSPGRMDEPRMDEDMTDLFDFLGGSGAT

SEQ ID NO: 124026 - protein, 119 aa, Glycine max
  Coding DNA Sequence Number=SeqID_32341
MSILTLGNKKGGKEISNQRERKEEERKFPIKEWEKAKRKERKFPTKEWEKNCHQMNKRKKRNHDLKWSSPFDYQPKSCAASDFFARTKQNRKEKPPKSKAKTPKAENHQRPTPGSPIGS

SEQ ID NO: 124027 - protein, 57 aa, Glycine max
  Coding DNA Sequence Number=SeqID_32342
GALPLPTLTDYASATVVRLAASGQQKARNRKKAALLAFFHRLRPPDEHTQKSTLKSE

SEQ ID NO: 124028 - protein, 185 aa, Glycine max
  Coding DNA Sequence Number=SeqID_32343
MSCLVIITPTFLCRSVSWCMPPTRQPLDQDKSNRALGFPALIMGLCQSFGVLVTPSKYCTPRQAQGDAPQAIDAPPPPHQADPAGSLGMEHYLQHLVRQQAANHRGQVQIHECIYQLSLSQQGKGFAPFACPTLEQFRAEVAWPGDWPEAQVGEAPAGAPGDVEEARMGEEMTDLLGFLGGSGAT

SEQ ID NO: 124029 - protein, 34 aa, Glycine max
  Coding DNA Sequence Number=SeqID_32344
VEGRSLEYEEPRDLRSNPFQGGGDDAILPPKNYH

SEQ ID NO: 124030 - protein, 37 aa, Glycine max
  Coding DNA Sequence Number=SeqID_32345
MRLFDILSICTVCQYPGRRSATDKEPLEALGLTAILV

SEQ ID NO: 124031 - protein, 58 aa, Glycine max
  Coding DNA Sequence Number=SeqID_32346
MGSEIYPKVHENPRAFFSSSSPILLEPLAHGSRINEALGLNPELGLSLKRGDYFILQN

SEQ ID NO: 124032 - protein, 903 aa, Glycine max
  Coding DNA Sequence Number=SeqID_32347
  Gene Ontology: Mol. function=glucosamine-1-phosphate N-acetyltransfera se activity; Cellular component=cytoplasm; Biological process =lipopolysaccharide biosynthetic process
  Homolog annotation: Hit_ID=Q5PKV8; Match level="QueryCoverage=50%, HitCoverage=99%, E-value=0.0, Identity=80%"; Hit description =Bifunctional protein glmU [Includes: UDP-N-acetylglucosamine pyrophosphorylase (EC ...
  Homolog annotation: Hit description=2.7.7.23) (N-acetylglucosamine-1 -phosphate uridyltransferase); Glucosamine-1-phosphate N -acetyltransferase (EC 2.3.1.157)]
  Pfam annotation: Domain name=GATase_2; Domain location=476-644; Score= 118.9; E_value=1.5e-32; Accession=PF00310.12; Description=Glutamine amidotransferases class-II
  Pfam annotation: Domain name=Hexapep; Domain location=277-294; Score =18.0; E_value=0.036; Accession=PF00132.15; Description=Bacterial transferase hexapeptide (three rep
  Pfam annotation: Domain name=Hexapep; Domain location=300-317; Score =15.1; E_value=0.26; Accession=PF00132.15; Description=Bacterial transferase hexapeptide (three rep
  Pfam annotation: Domain name=Hexapep; Domain location=329-346; Score =2.6; E_value=72; Accession=PF00132.15; Description=Bacterial transferase hexapeptide (three rep
  Pfam annotation: Domain name=Hexapep; Domain location=369-386; Score =9.5; E_value=10; Accession=PF00132.15; Description=Bacterial transferase hexapeptide (three rep
  Pfam annotation: Domain name=Hexapep; Domain location=394-411; Score =10.0; E_value=9.2; Accession=PF00132.15; Description=Bacterial transferase hexapeptide (three rep
  Pfam annotation: Domain name=Hexapep; Domain location=418-435; Score =8.5; E_value=14; Accession=PF00132.15; Description=Bacterial transferase hexapeptide (three rep
  Pfam annotation: Domain name=NTP_transferase; Domain location=7-227; Score=-26.8; E_value=9e-06; Accession=PF00483.14; Description =Nucleotidyl transferase
  Pfam annotation: Domain name=SIS; Domain location=739-869; Score =144.6; E_value=2.7e-40; Accession=PF01380.13; Description=SIS domain
  Pfam module annotation: Pfam domain module=GATase_2::Hexapep::Hexapep: :Hexapep::Hexapep::Hexapep::Hexapep::NTP_transferase::SIS; Domain location=476-644::277-294::300-317::329-346::369-386::394-411::418 -435::7-227::739-869
MSTSAMSVVILAAGKGTRMYSDLPKVLHSLAGKPMVQHVIDAATGLGAQQVHLVYGHGGELLQEKLAHNPLNWVLQAEQLGTGHAMQQAAPFFADDEDILMLYGDVPLIAQETLQRLRDAKPAGGIGLLTVVLDNPTGYGRIVRENGTITGIVEQKDASAEQLKIQEINTGILIANGADLKRWLAQLNNHNAQGEFYITDIIAMAHQEGRVINAVHPARISETDGVNNRLQLSTLERTYQREQAEKLLLAGVMLRDPARFDLRGTLQHGRDVDIDTNVIIEGNVTLGHRVKIGAGCIIKNSVIADDCEISPYSVIEDATLAAACTVGPFARLRPGSELAEQAHVGNFVEMKKATLGKGSKAGHLSYLGDAEIGAGVNIGAGTITCNYDGANKFKTIIGDNVFVGSDTQLVAPVSVAAGATIAAGTTVMKDVTAADLVYNRKEQNQKSGWQRPAANAPATWNRKGYPPLSTRLGEQSVAQRDIAEILLEGLRRLEYRGYDSAVANLAEAAEQQPLIGGTGIAHTRWATHGEPSEANAHPHVSEHIIIVHNGIIENHEPLREQMIARGYRFASETDTEVVAHLVHWEQKQGGTLREVILRVIPQLRGAYGMVIMDSRDPSVLVAARSGSPLVIGRGVGENFIASDQLALLPVTRRFIYLEEGDIAEITRREVTIIDRHGNQAQRAEIESNAQYDAGDKGVYRHYMQKEIYEQPNAIKNTLAGRFHDGIVDLSELGANAETLLSQVEHIQIIACGTSYNSGMVSRYWFESLANIPCDVEIASEFRYRKSAVRKNSLLITLSQSGETADTLAALRLSKELGYLGSLAICNVAGSSLVRESDLALMTKAGTEIGVASTKAFTTQLTVLLMLVAKLGRLHGMRAETEHEIVHALQALPSRIEQMLAQDK

SEQ ID NO: 124033 - protein, 199 aa, Glycine max
  Coding DNA Sequence Number=SeqID_32348
  Gene Ontology: Mol. function=aspartic-type endopeptidase activity; Cellular component=small subunit processome; Biological process=DNA integration
  Homolog annotation: Hit_ID=A5ARL5; Match level="QueryCoverage=93%, HitCoverage=11%, E-value=3e-16, Identity=29%"; Hit description =Putative uncharacterized protein
MVAYVSKAQSTVEELKLSLNVDKLEDIKTKLYNLYMVLVLRGMHLDFDHICDQVLTGQEVVSLENLIIRLLRVPSPKIRGNSVDSIETSAMVSNRGGRSGCGNRGGRTRRGGRPQCSYYKRVGHTQDTCYSIHGFPRKSVNISKSETSEIKFSKTNYQEYLQLKAAKESQTSSSISGHNSIACISQFGMWYGSDDWRRT

SEQ ID NO: 124034 - protein, 152 aa, Glycine max
  Coding DNA Sequence Number=SeqID_32349
  Subcellular localization annotation: CTP_CleavageSite=6; ConfidenceScore=5.06e-01
MNPDTVFLMKSNLHMKSIIWGNQPRGNFNTSGFPGLQNNQQYQQQRQWQNHPGNQFNRDQGGSSTRPQQQMPSLYNRNLAQFMQVSMSNQKRIESVIKNLEVQVVQLAKQLAKRPSNSFRANTEKNPKEECKAVMTRSKMVIQAEESRADKK

SEQ ID NO: 124035 - protein, 70 aa, Glycine max
  Coding DNA Sequence Number=SeqID_32350
MHPPPSSPGAPRIELPSAVGASSTIKSYSEPHELISIHASSTIESGVPRIDCLALFVHPPPSSLIRSPMN

SEQ ID NO: 124036 - protein, 169 aa, Glycine max
  Coding DNA Sequence Number=SeqID_32351
  Subcellular localization annotation: CTP_CleavageSite=62; ConfidenceScore=5.81e-01
MATPPGSSPPPPSPSSSPPPTPPADPSTSPSTIKRTCKATWLRSLATRPPGAERPVVHVDPVTSKADDPQKKKLRTYLGGYTEFEILEASNNRTKKKVLQTVDPSWEDVRKKAQAIQKQNTAPHVLSREGYDYLEQKLMAEKTKKKLEEAAQSGSTEGVTNTPFPINDT

SEQ ID NO: 124037 - protein, 250 aa, Glycine max
  Coding DNA Sequence Number=SeqID_32352
  Homolog annotation: Hit_ID=A4Q3V5; Match level="QueryCoverage=29%, HitCoverage=26%, E-value=5e-08, Identity=44%"; Hit description =Putative uncharacterized protein
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDNQQAIQEQPVELIDSGGAHQAEPGNSINWNYPKEASVDYQQTMQEQSVELFDGGGAVQSEPQNSINWNSPKEASGYRARIRNHGHSCFLCEIVIRSQFHTTYEPEA

SEQ ID NO: 124038 - protein, 72 aa, Glycine max
  Coding DNA Sequence Number=SeqID_32353
MHSLDFRTVIIKKGEIVEAMSSKVILMMPKNQELSKFQRFKNQVSRIKIQDSRIKFQESRSRFKNQEKTQSG

SEQ ID NO: 124039 - protein, 148 aa, Glycine max
  Coding DNA Sequence Number=SeqID_32354
PNEFEQDNAAELPGKHRGNRGKKNRGQGSRLGQQAEGAPPCHISRSFISAGLRYDGQVATICEDDSPRRSDLVRSCPPGFGLGNWRVEERPDFYATSIISDDKSLEGTNTRDPAVDFEQEAGRMKSEEDEDVGLPPKLERIIAQEDRK

SEQ ID NO: 124040 - protein, 134 aa, Glycine max
  Coding DNA Sequence Number=SeqID_32355
  Gene Ontology: Mol. function=helicase activity; Biological process =viral genome replication
  Homolog annotation: Hit_ID=Q2A9E0; Match level="QueryCoverage=99%, HitCoverage=9%, E-value=1e-18, Identity=40%"; Hit description =Putative uncharacterized protein
MSQYSGIQSHIVSALTHMLDQHNSHAKSFRMTRDRLADDQADNIKLQLIDARGKDGRVYNMPNIPEIGALIVGDFHPSSKRDIIVETQNGELQRIHELHPSYLPLQYPLLFPYGEDGYRADIFHHSTSSSKKRK

SEQ ID NO: 124041 - protein, 117 aa, Glycine max
  Coding DNA Sequence Number=SeqID_32356
  Pfam annotation: Domain name=zf-CCHC; Domain location=62-79; Score =18.9; E_value=0.0021; Accession=PF00098.14; Description=Zinc knuckle
MATQASSSIQEESDMEDSIDLDEDEELSLFVKRFNKFLRMRETQRRQNFKPKRRIEESSQTPRCYECNQLRHLRVDCPIFKKRMEKFKNKNIGENKAKKAYITWDDNDLESSNDSEK

SEQ ID NO: 124042 - protein, 156 aa, Glycine max
  Coding DNA Sequence Number=SeqID_32357
MSLKLPYYPELAKVFYCNLKIQDGIIISEVHGISMVIDQSLFFSLTHLPSQGAPFEGTIVDDWKFDYSSHDARRMLKKDALPPQDERTPSPPPPREDSALMNEVLSELRGLCSYVGDRFDSLDTRFAGMDIRLTQLEEDVVYIRQSFDLPPPPPSS

SEQ ID NO: 124043 - protein, 171 aa, Glycine max
  Coding DNA Sequence Number=SeqID_32358
  Subcellular localization annotation: CTP_CleavageSite=64; ConfidenceScore=5.19e-01
MRVMRTFLKKVKQKSKVCLSSLKIQTPLIMKKNHQRSERVLRVGVNVILRLRKRRFLPLFPLPNCFHPKNSRYVKAFYSNLEIQEGTLISEVYGIKMVIDQSLFYDLTQLSSEGVPFEGTLIDDWKYEFFVHDARRLVCTNQADMTGRLLAGSLAFESHILYYLIVRILLP

SEQ ID NO: 124044 - protein, 749 aa, Glycine max
  Coding DNA Sequence Number=SeqID_32359
  Gene Ontology: Mol. function=hydrolase activity; Biological process =dodecyl sulfate metabolic process
  Homolog annotation: Hit_ID=A8GGH2; Match level="QueryCoverage=87%, HitCoverage=100%, E-value=0.0, Identity=77%"; Hit description=Beta -lactamase domain protein precursor
  Pfam annotation: Domain name=Lactamase_B; Domain location=172-394; Score=55.7; E_value=1.6e-13; Accession=PF00753.18; Description =Metallo-beta-lactamase superfamily
MTSPIWDYQRKVFALKWPVISPHLNYPLILNIDSGTNNLRGHAMKLNQIAKHLALAGVLTSLSLSAFAAAQQQDATPATQQANNALYNKLPFADKTDFDNAHKGFIAALPQTMIKGEQGNVIWNPAKYDFVKEGEKAPDTVNPSLWRQSQLINIGGLFKVTDGVYQIRNLDLSNMTIIEGEKGITVIDPLLSAEPAKEAMDLYYANRGKKPVVAVLFTHSHVDHYGGIRGVVDEADVKAGKVKIYAPAGFMEEAVSENIMAGTAMSRRASYMYGNLLKPDAKGQVGAGLGTTTSAGTVTLLQPTNYITKTGQQEVIDGLTYDFMMAPGSEAPSEMLWYVKEKKMIEAAEDVTHTLHNTYSLRGAKIRDPLAWSKYINAAIDRWGNDAEVIIAQHHWPTWGNDNIIKLMKGQRDMYRYINDQTLRMANEGLTRDEIAANFKLPESLEKQWSSRGYYGSVSHDVKATYVYYLGWFDGNPATLDELPPQQAAKKFVEYMGGADAIMQKAKADYQQGNYRWVAQVTSKIVFADPQNTDARNLEADALEQLGYQAEAGTWRNFYLTGAQELRNGVQKLPTPNTASPDTVRAMTPEMFFDYLGVHINGQKAGAAKAVFNIDLGKDGGKYKLELENGVLNHTANAVADNADASITLNRDTLNKIILKQETLKQAEDKGDVKISGNGAKLDEMLSYMDKFEFWFNIVTPLDGIPLLQHAARMAQENGMRITIAHISTDYRALNYVSDSLQNDEVSQE

SEQ ID NO: 124045 - protein, 35 aa, Glycine max
  Coding DNA Sequence Number=SeqID_32360
NVTLEAFEKLDFKEGSGSTTRNISFYDTMVLSGPP

SEQ ID NO: 124046 - protein, 123 aa, Glycine max
  Coding DNA Sequence Number=SeqID_32361
VSVDLHDRWFGEFKRAIRAVFETKGSRILKSAMNKIRNGQDKGKWITTKVRAALDEHWGSTYFLNKSSTAKANRSIDRGASTYCGGSISTATHFEKLEFQRLPTAWEVMEKTKKLKSREWVND

SEQ ID NO: 124047 - protein, 241 aa, Glycine max
  Coding DNA Sequence Number=SeqID_32362
  Homolog annotation: Hit_ID=Q84VH5; Match level="QueryCoverage=98%, HitCoverage=38%, E-value=1e-113, Identity=80%"; Hit description =Envelope-like protein
MLKGWKFVYQRRLALERELGRDALDCKEIMDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESALSLHYKLFEGTHVPDIVSTSGKAAASGAVSKDALIAELKDTCK

SEQ ID NO: 124048 - protein, 55 aa, Glycine max
  Coding DNA Sequence Number=SeqID_32363
YGNLSTIALSLKDPVSVKERRERFLQDNLVGSLNLPKVKNSTKGKVLMQAMYGVK

SEQ ID NO: 124049 - protein, 94 aa, Glycine max
  Coding DNA Sequence Number=SeqID_32364
MSSRMHCMLVSSFVTGSRKVHITFLTVHMGNCTPKCAILAIRIAIPWIIGLNQAHAFTKKVHQVKLKYGSNHLAKIRAKDGSSYIAASSTAKHI

SEQ ID NO: 124050 - protein, 81 aa, Glycine max
  Coding DNA Sequence Number=SeqID_32365
MVIRTPFRDPETIESDGTRRQIMFIRTLLLSGANEPVDVKRPTCLMHLWSSRDSESGGRWRYLMVIRAFRQPRGTNSVVSG

SEQ ID NO: 124051 - protein, 75 aa, Glycine max
  Coding DNA Sequence Number=SeqID_32366
MAVKKVARSVFAPCLYFRDLHGRELKGFLVIIPEVVISLFMVSRGIIPFEEHIAAVGTTSNNMSSKRKTLDEGSL

SEQ ID NO: 124052 - protein, 261 aa, Glycine max
  Coding DNA Sequence Number=SeqID_32367
  Gene Ontology: Cellular component=outer membrane
  Homolog annotation: Hit_ID=A0U9E5; Match level="QueryCoverage=62%, HitCoverage=9%, E-value=1e-13, Identity=32%"; Hit description=Outer membrane autotransporter barrel domain
WVTPEFPSHDVVKRRPVPSLHACRSTLEDPPLIIDPSAGPSPGSVSIQTAGAGTGDSGIHLSGPGALTVDSGVTISTTGGGHGVWLASTAATAQMIGTSITTTGNGALGFLISASGSTASLDRVTIRTSGANAYGVALNNGAAAAIDLKDSSISTTGAGADGLMIATPGNQVNMQRVTITTVGAVGIRNQGGSINISDSSVSTQGAGGIGIAVLGGAFTGNSVSVTTSGLGGSAIGMVAQGGAQVSLARPVIRTLAATGIR

SEQ ID NO: 124053 - protein, 86 aa, Glycine max
  Coding DNA Sequence Number=SeqID_32368
  Gene Ontology: Cellular component=chloroplast
  Homolog annotation: Hit_ID=Q3BAI1; Match level="QueryCoverage=59%, HitCoverage=38%, E-value=5e-23, Identity=94%"; Hit description =Putative uncharacterized protein rps12
LWGSRNRRALILGWVYYLDAFSSYPLRTWLPSVYRGHDNWHTRGASFPVLSPTLGTYYRPRWRRADIEVPKLPVDVSSWGRSACYP

SEQ ID NO: 124054 - protein, 23 aa, Glycine max
  Coding DNA Sequence Number=SeqID_32369
MTKIQGLKAPHGATSCGSIIFQS

SEQ ID NO: 124055 - protein, 63 aa, Glycine max
  Coding DNA Sequence Number=SeqID_32370
MAIGKIRMRNSRHGCHTLISSGDLCLMTYDFSLVLVRCLAPIIRQFVKFQDMPENQKNIDAQS

SEQ ID NO: 124056 - protein, 76 aa, Glycine max
  Coding DNA Sequence Number=SeqID_32371
  Homolog annotation: Hit_ID=A5BNU6; Match level="QueryCoverage=75%, HitCoverage=11%, E-value=9e-09, Identity=48%"; Hit description =Putative uncharacterized protein
MEATHILLGRPWQYDTKAIHDGFTNKISIQHHDQKIILKPLSPRENLKMSFPRRFLMDCHLQRHRTSNDSSMSFIA

SEQ ID NO: 124057 - protein, 231 aa, Glycine max
  Coding DNA Sequence Number=SeqID_32372
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=P12862; Match level="QueryCoverage=86%, HitCoverage=39%, E-value=1e-104, Identity=98%"; Hit description=ATP synthase subunit alpha, mitochondrial
  Pfam annotation: Domain name=ATP-synt_ab; Domain location=97-231; Score=9.7; E_value=1.1e-08; Accession=PF00006.16; Description=ATP synthase alphabeta family, nucleotide-binding domain
  Pfam annotation: Domain name=ATP-synt_ab_N; Domain location=1-41; Score=9.0; E_value=0.03; Accession=PF02874.14; Description=ATP synthase alphabeta family, beta-barrel domain
  Pfam module annotation: Pfam domain module=ATP-synt_ab::ATP-synt_ab _N; Domain location=97-231::1-41
MVEFASGVKGIALNLENENVGIVVFGSDTAIKEGDLVKRTGSIVDVPAGKAMLGRVVDALGVPIDGRGALSDHERRRVEVKAPGIIERKSVHEPMQTGLKAVDSLVPIGRGQRELIIGDRQTGKTAIAIDTILNQKQMNSRATSESETLYCVYVAIGQKRSTVAQLVQILSEANALEYSILVAATASDPAPLQFLAPYSGPWHIDKCHYCYADHQAVRLSQAMFSIYIPVS

SEQ ID NO: 124058 - protein, 66 aa, Glycine max
  Coding DNA Sequence Number=SeqID_32373
MRSRGEEEQVLKISHEDKASRGRGRGNGSCLRGGRQRPRAFSHKLNELSKKAEVGVAFRAFLTIPV

SEQ ID NO: 124059 - protein, 230 aa, Glycine max
  Coding DNA Sequence Number=SeqID_32374
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=67%, E-value=4e-34, Identity=98%"; Hit description=LacZ protein
MRKRHASRREKGGQVSGKRQGRNRRAHEGASRGKRLGGGAYGKTPATRPLYGSWPFAGLLLTCSFLRYPLILWITVLPPLSELIPLAAAERPSAARNSYDHDYEFELGTHCTMTNVLLDYGHCFYREFTDLLIPGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 124060 - protein, 195 aa, Glycine max
  Coding DNA Sequence Number=SeqID_32375
LFVLQTAKKNVYTDNHSGISARQRDSNVSMTDLVSAEDDGAEDDVQSAHAIRLFVLQTAKKNVYTDNHSGISARQRDSNVSMTDLVSAEDDVNLRVSMGLSATIDEGAEDDTAKKNVYTDNHSGISAGQRDSNFSMTDLVSAENDINLRVSTGLSARLTKGAEHDVSLCVLSGFSSYRQPKKNVYTDNHSGISAR

SEQ ID NO: 124061 - protein, 76 aa, Glycine max
  Coding DNA Sequence Number=SeqID_32376
MPYGRRNLGKEKIPQLIVQLAEAVGNWSWSERPEPELADETVRRDEMIKSASRLATRIKNAVERKKERTGAILEDC

SEQ ID NO: 124062 - protein, 102 aa, Glycine max
  Coding DNA Sequence Number=SeqID_32377
MRHQSRLYWRVHHMRCEIPHRCVRRKYRIRRHSPFRLRNCWEGRSVRASSLLRQLAKGGCAARRLSWVTPGFSQSRRCKTTASAKLACLQVDSRGSPLKLKY

SEQ ID NO: 124063 - protein, 79 aa, Glycine max
  Coding DNA Sequence Number=SeqID_32378
MMHKEIESMWMSMIAKSKTEERTSRQLAEVVRETAEIPVEIEPRQVHLRGQVRKIFGFRLKSERDRGGPGKGEGHPRDA

SEQ ID NO: 124064 - protein, 66 aa, Glycine max
  Coding DNA Sequence Number=SeqID_32379
MEVSQRALRGRARARLTGALSKGGKMRGVATNVYLWKTSEKLKETGRQKRGFCSYVPSFGEEIRPT

SEQ ID NO: 124065 - protein, 108 aa, Glycine max
  Coding DNA Sequence Number=SeqID_32380
MTEKGFKYTLSIMSFESQCITMKAIIYYCYLALLRKCFDYIFEASKSEVLNIQGRNQQTSRSIGPTNQVMQSYPARALVRRLQVDWARDPTKGPRVLMSLRVDFEPMG

SEQ ID NO: 124066 - protein, 116 aa, Glycine max
  Coding DNA Sequence Number=SeqID_32381
  Homolog annotation: Hit_ID=A5B1P9; Match level="QueryCoverage=82%, HitCoverage=7%, E-value=2e-13, Identity=37%"; Hit description =Putative uncharacterized protein
MVLTLVSLGSHHGDSLGKLVAKADEAIFLGYSLHSRAYKVFNKRTLNVEEFVHVVCDETNSIVQENSLEEDAGFEEKDSTLEDDIKAEELEQNKEISTTMCKEFPREWRTQKFWIT

SEQ ID NO: 124067 - protein, 294 aa, Glycine max
  Coding DNA Sequence Number=SeqID_32382
  Homolog annotation: Hit_ID=A5AIE9; Match level="QueryCoverage=84%, HitCoverage=52%, E-value=3e-09, Identity=23%"; Hit description =Putative uncharacterized protein
MDCFSNESFECIKAFENSNLIPFMSLKLPVYSDLVNAFYSNLEIQEGTLISEVYGIKVVIDQSLFYDLTQLSSEGVPFAGTLIDDWKFDFSVHDVRRLVCTNQADMTGRLLTGSLAFESRILHYLIVRILLPRSSNLAQVSEEDLIVMWAFHKGLQIDWAHLFRYRMHKTLRLNAPLPYPYLVTLFLQHFNIPLDSEPCVPIKRSFLIGVAVIASFGYQKEHDGSWVKKDSSLLQKILDGFDSLQTFVGERFDTLELQVDMRFNEMESRITKVEEDVSYIRTSFDLPPPPPPSS

SEQ ID NO: 124068 - protein, 22 aa, Glycine max
  Coding DNA Sequence Number=SeqID_32383
MEILHRSSSFFTVLHPFFVLQR

SEQ ID NO: 124069 - protein, 287 aa, Glycine max
  Coding DNA Sequence Number=SeqID_32384
  Homolog annotation: Hit_ID=Q6WAY6; Match level="QueryCoverage=85%, HitCoverage=51%, E-value=1e-19, Identity=27%"; Hit description =Putative uncharacterized protein
MANQEEWVPFMDVLALLIFGVFLFPNVDGLVDLAAIDAFLAYHHSKESPVVAILADLFDTFDRRIGGRTVNWFPRWKEGKEGVLFSCGGYPNIPLIGTRGCINYNPALAIRQLGYPMRGAPTEESLSHFLVRDFGTQSFKVIQRVHKAWESPLRKDKELRGIRNGIIGGYHEWLKVRTRGLDWLSRLKIINEENFEAPEEDGELRALKTDLGKARLAKEKFKLVATDVRKECAGLREENAATARALEQETKRARKEEHGRDKFRGALWGSNSELKLRKGRERPITST

SEQ ID NO: 124070 - protein, 75 aa, Glycine max; identical to SEQ ID NO: 103756
  Coding DNA Sequence Number=SeqID_32385
  Homolog annotation: Hit_ID=A6FJQ2; Match level="QueryCoverage=50%, HitCoverage=84%, E-value=3e-11, Identity=92%"; Hit description=50S ribosomal protein L5

SEQ ID NO: 124071 - protein, 139 aa, Glycine max
  Coding DNA Sequence Number=SeqID_32386
  Homolog annotation: Hit_ID=Q84VI1; Match level="QueryCoverage=100%, HitCoverage=17%, E-value=5e-45, Identity=72%"; Hit description =Envelope-like protein
MATSPKETSAPGSPSVPSSPHQEQPEFNIQPIQIIPGQAFVPEKLVPRRQQGVKIAENPSLATSPREVDTEMDKKIRSIVSSILKDASVPDAEKDVPTSSTPDVAVPEADEDVPTSSTPNVSVPNVEKDVPTSSGPNAE

SEQ ID NO: 124072 - protein, 59 aa, Glycine max
  Coding DNA Sequence Number=SeqID_32387
MKITTFSLQFLLMEELSWAVTLSKNAWAMIIGYLWISHQSSWPGRLGESSLVCSHESRL

SEQ ID NO: 124073 - protein, 106 aa, Glycine max
  Coding DNA Sequence Number=SeqID_32388
MVAAQLAQASQVASSRSNSLLEESSGGPKWAWETYEFRNDTCFLSVMLRNLADYIIIPFLTYGMLRNLTNYATMLPFDFRCVTEPYGLCINIFFCFSACLGISQIA

SEQ ID NO: 124074 - protein, 52 aa, Glycine max
  Coding DNA Sequence Number=SeqID_32389
MGVQIATRPTWALQDVLLEGGCFWRKQPSSPGRAELAWGKEGRTKMFNPPGI

SEQ ID NO: 124075 - protein, 52 aa, Glycine max
  Coding DNA Sequence Number=SeqID_32390
MASYGVASPLSLPLSIPLPFIFQEAKESIDEEDPRPTSSNGAYIMWYQSIFI

SEQ ID NO: 124076 - protein, 70 aa, Glycine max
  Coding DNA Sequence Number=SeqID_32391
  Homolog annotation: Hit_ID=A7QEC9; Match level="QueryCoverage=44%, HitCoverage=12%, E-value=6e-10, Identity=96%"; Hit description =Chromosome chr1 scaffold_84, whole genome shotgun sequence
WPFAHMFFPALSPDSVDNRIPPLSELIPLAAAERPSAARPKIRPKGVVDGQQVNIPVLPFVGPEGRRRLG

SEQ ID NO: 124077 - protein, 90 aa, Glycine max
  Coding DNA Sequence Number=SeqID_32392
  Gene Ontology: Mol. function=monooxygenase activity
  Homolog annotation: Hit_ID=Q6T4Q1; Match level="QueryCoverage=43%, HitCoverage=67%, E-value=2e-11, Identity=82%"; Hit description =Cytochrome P450 monooxygenase
  Subcellular localization annotation: CTP_CleavageSite=76; ConfidenceScore=5.35e-01
VDSRGSPSRGYGSILPTSLAYIVPSTRGCSPWRPDAVMSTTGRGRHSVLRIFKGRRGRTGHHATCGALPAAGPYLRLSRFQGGQAVKQKR

SEQ ID NO: 124078 - protein, 95 aa, Glycine max
  Coding DNA Sequence Number=SeqID_32393
  Homolog annotation: Hit_ID=UPI0000ECBAF8; Match level="QueryCoverage =43%, HitCoverage=48%, E-value=1e-16, Identity=100%"; Hit description= UPI0000ECBAF8 related cluster
MPQSGGGSRMGWYVETQSHPNGVRVWHQISVPLGIEGILVLGSMQAWHWPSFYNVVTGKTLALPNLIALQHIPLSPAGVIAKRPAPIALPNSCAA

SEQ ID NO: 124079 - protein, 210 aa, Glycine max
  Coding DNA Sequence Number=SeqID_32394
MAPKKLSTKRSRRDTTGEGSSAAPEFDSHRFRSAEHQQRFEAIKGWSFHRERRVQLKEDEYTDFQEEIAHRRWTSLANAWLTEEGVRDMRSWVTGQWIPYDADALSQFLGDPLVLEEGQQCEFSQRRNKADGFDEEAIAQLLCTPGQDFARTATGRRVRIMSTSMITLTQTWMTLLLNNVLPSDHNSDLPLPKSQLVYAIQTRMSVHVAQ

SEQ ID NO: 124080 - protein, 91 aa, Glycine max
  Coding DNA Sequence Number=SeqID_32395
MMRSCQGSRVCFGRSAMTAGGMYRAKIHPHGLPLKESGPKSFHSPQSFLRRSSFLLSSVAGGGPSIDKTIGDAAMLGWGNVPGAGPSGIGG

SEQ ID NO: 124081 - protein, 82 aa, Glycine max
  Coding DNA Sequence Number=SeqID_32396
  Subcellular localization annotation: CTP_CleavageSite=23; ConfidenceScore=5.30e-01
MTKNERRTMKNAGKSSRNCPRTRLGSVTEAPRLGFSSRKQFFSLILRGKREVVAAQLAQASWVASTKRHRLLLEHPGRPKWA

SEQ ID NO: 124082 - protein, 175 aa, Glycine max
  Coding DNA Sequence Number=SeqID_32397
  Homolog annotation: Hit_ID=Q6B3S1; Match level="QueryCoverage=15%, HitCoverage=29%, E-value=5e-07, Identity=92%"; Hit description =Reverse transcriptase
MNLVDDCVYHKFSRSKRFRYTEIISGYSRIITKEYSKRYLKGLACKNVNPGILQLLRETSLSQTVPKRKLKFRNEKYSLCISYREFDVCPSSMRRYSIHSWGIRRYLRQVSRNGIIGKQPKELQGCLNSLRSTYIWSFIKWMSRRQFLNGNIDETIYMVQPENFVSRDPKNMVAN

SEQ ID NO: 124083 - protein, 172 aa, Glycine max
  Coding DNA Sequence Number=SeqID_32398
  Homolog annotation: Hit_ID=A5C4S3; Match level="QueryCoverage=47%, HitCoverage=8%, E-value=3e-10, Identity=40%"; Hit description =Putative uncharacterized protein
MGLNESFSTIREEKQKEVGASTSRTSASEVSHAFAFKNSFDARDNSDNRSKGSSKNHPLCAHCGMLGHTQDRFFKLHGYPPNYKKTGYSLKVKKESSSSSEPSHKVAHQVSVDMPQSQPSYVDLGSQFQLTAQQYSQLMNLLQSHATNVVIPHSVSSSSVTLYPFLPLVQFA

SEQ ID NO: 124084 - protein, 203 aa, Glycine max
  Coding DNA Sequence Number=SeqID_32399
KKKDSKALSSEAKEKEKEEKDSSKNIVKKENHFATKGDIKRALLLKQSFNLLLSRETSLSTAIPLELEVIPQAKELLDEGLVYKSLNPCALLVPKIGIIRHQIPMIGGMMNVLSGATLFWKITHAPNIFMICVHRDSLGRNNQHENKEKGMFYSITFLNFLNSDQGLPMDPKRIKVIPEWPTPPSVRKEFNEFKNDRGRTRIK

SEQ ID NO: 124085 - protein, 200 aa, Glycine max
  Coding DNA Sequence Number=SeqID_32400
LEDEYAKVSVLQAEREAREKVINSLPREAMMWMDRFVFTLNGSQELPRLLAKAKAMADISYPSLCHKPSKPTHPEHGGIRRGGVGQYRWSTHGQPQPVGGAHEEPLKRAQGDFDPCPTFTAEGSTCNAMPQPNTVGVPQPRPLQPLYFSIGGSPLVEEGREKLDLIVERLRAIEGFRDYPFTDMIKLCLVPNVVIPPKFK

SEQ ID NO: 124086 - protein, 104 aa, Glycine max
  Coding DNA Sequence Number=SeqID_32401
MGVQIATRATWALQKIPPEGCCFWRKQPCSPGRAGGRSEVKKGSAPEALLSLSNLLGKIVSVKKIQAEAFPKRFRNVSVRNLVKVSTVLRRSSFVLHRSSIFNG

SEQ ID NO: 124087 - protein, 95 aa, Glycine max
  Coding DNA Sequence Number=SeqID_32402
MHEDEWHGACLLFAPIWEPIGQYLGVSNNYSPTIHNSHGCFLEVDKSGALAPTYPPSKRKSDLRSSSLRVNHTISFYLKGDHLKVLDLKNDPLTW

SEQ ID NO: 124088 - protein, 106 aa, Glycine max
  Coding DNA Sequence Number=SeqID_32403
DPPTAVEDLNEEQQPPAEEVVTDVEDFSVWNGEERLKLKLSSYGRKMTKFGRPAPKIEGLVAAIGLKVTITLDDVASLLHLPIVGAFHSFEQLHVDTLSICWWNYS

SEQ ID NO: 124089 - protein, 107 aa, Glycine max
  Coding DNA Sequence Number=SeqID_32404
MGEVKEVQEQMKADMDAMKEQMATMMEAMMSMKKIMEANTVAIVATGAVAKVNPTPPSGLNQMNHSTLDMVGKDLGSTGDPHYVQIQNKHAFPPYGLPPNYTPPNVS

SEQ ID NO: 124090 - protein, 115 aa, Glycine max
  Coding DNA Sequence Number=SeqID_32405
MTRGNPGDLQPFDPEIDRTFHRLLRHSVHPDHPVHFEHSEYFVVGDSEHFDFEHSTTNFHTENMAQPPPCERTLREMVAPDFTYESLCIQFPDEDVPYVLKTRLIYLLPKFHGLA

SEQ ID NO: 124091 - protein, 74 aa, Glycine max
  Coding DNA Sequence Number=SeqID_32406
  Homolog annotation: Hit_ID=A6FJQ2; Match level="QueryCoverage=51%, HitCoverage=84%, E-value=3e-11, Identity=92%"; Hit description=50S ribosomal protein L5
MTVKTLTHAAPRRSQLSMRKEKIPHQAPFAIQAAQLLGRAIGAGLFAITPAGERGMCCKAIKLGNARVFPVTTL

SEQ ID NO: 124092 - protein, 73 aa, Glycine max
  Coding DNA Sequence Number=SeqID_32407
MEKIVIMFVFKAKVTITKLNEERRRTTQEKDLLLRQEELDNLLFRISQISQISPLGVHSWLLEDAISNKYLLI

SEQ ID NO: 124093 - protein, 117 aa, Glycine max
  Coding DNA Sequence Number=SeqID_32408
MQLPETSQLSVSGCREQTSPSGRVSGWRCRGWLTMRHQSRCTESAPYAAAQLWGRAIGAGLFAITPAGERGMCCKAIKLGNARVFPVDSRGSPVQTLLVGRSTLNLDDVTVALKENE

SEQ ID NO: 124094 - protein, 58 aa, Glycine max
  Coding DNA Sequence Number=SeqID_32409
MEACLWGFYGGWIFELQWGPLMVIFHHGDAAEDKGKEGESKKISGMVSRILVKSGVAG

SEQ ID NO: 124095 - protein, 125 aa, Glycine max
  Coding DNA Sequence Number=SeqID_32410
  Subcellular localization annotation: CTP_CleavageSite=41; ConfidenceScore=5.34e-01
MAESLKKRKGSSSTTAAASHRHHKPSEAPTAPIHPSLSSPRSSTLFSSDDQRLRYLSQFSSRIILDPKYLDIDFFNDETFDCYQVFQNSGLIDFMSLKLPYYPELVKVFYNNLKIQDGIISSEVH

SEQ ID NO: 124096 - protein, 122 aa, Glycine max
  Coding DNA Sequence Number=SeqID_32411
MDSSSHSPFRGLGNRSLRLKSYIKSWMQSSKHDVYLGAYLNGGYWQMVVIVPKEHLVVWFCSLHNRPDNYLKGIINSLNQRLLLGGLSLSVIDKKGSTECGYYVMHWMSTIILESFRNNWEA

SEQ ID NO: 124097 - protein, 120 aa, Glycine max
  Coding DNA Sequence Number=SeqID_32412
MLDIFISIRDRNIWGGRCWNIFISIRDRSIGKMLVTILRIFLSISVSTSLGLVARLGFSGTGAGPGIICMGWILNSGRSWFDGAEVDEGDDGTEGEPGAEVSFGAVAMEKQSLWSGFVNL

SEQ ID NO: 124098 - protein, 61 aa, Glycine max
  Coding DNA Sequence Number=SeqID_32413
MIGTSKPYTGAMRGTVHEPQGGGDKPWNFNGLIKRQTNSLPSLQNGQVTKSNRTYTLREFP

SEQ ID NO: 124099 - protein, 132 aa, Glycine max
  Coding DNA Sequence Number=SeqID_32414
ALRVNAPLPYPHLVTLFLQHFNVLLEDEPFVKVKRSFAIGVGAITSFGYQKDMDGQWGTSFVVQVEGTSTWVVVTENKRGYISCGSVQVEGTSTWLFKENKGGYIPCGSLLVKDFTRLKRNFKDRTVAWGLD

SEQ ID NO: 124100 - protein, 132 aa, Glycine max
  Coding DNA Sequence Number=SeqID_32415
  Homolog annotation: Hit_ID=UPI0000ECBAF8; Match level="QueryCoverage =31%, HitCoverage=48%, E-value=1e-16, Identity=100%"; Hit description= UPI0000ECBAF8 related cluster
MEKRQQLGLFTVPGLLLAFLLTCSFLRYPLILWITVLPPLSELIPLAAAERPSAASHWHDRFPDWKAGSERNAINSRPAGMQAWHWPSFYNVVTGKTLALPNLIALQHIPLSPAGVIAKRPAPIALPNSCAA

SEQ ID NO: 124101 - protein, 63 aa, Glycine max
  Coding DNA Sequence Number=SeqID_32416
MAVPESEQMQRQDETNKKQGLGFRSLPKPQAKLEDSASVEGFLLVWGFNGEQRWFVVANGGCG

SEQ ID NO: 124102 - protein, 66 aa, Glycine max
  Coding DNA Sequence Number=SeqID_32417
MSQIPTVVVCAIEFRTTYPNFIFPTVNESEIVVFLRQVRWPAEKREDFGRREKKRNCEVEEAEESV

SEQ ID NO: 124103 - protein, 170 aa, Glycine max
  Coding DNA Sequence Number=SeqID_32418
  Homolog annotation: Hit_ID=A1G269; Match level="QueryCoverage=100%, HitCoverage=78%, E-value=6e-79, Identity=84%"; Hit description =Putative uncharacterized protein
MLNIFLGHFLNAAFLNVVGERGEAVIVKSERTSSTMNEQYIWRYEAVLRTAEGRDVEVVFHTNTASLWPLENAIRIPAPDQPFVVKYTPGFPRNFVILTNESPHGIAQARATARERVEVAARKLHFSPGNAGFRADYRRELETWLRDHGNDPQQQPDALRYRAELDALDR

SEQ ID NO: 124104 - protein, 127 aa, Glycine max
  Coding DNA Sequence Number=SeqID_32419
  Pfam annotation: Domain name=DUF1723; Domain location=9-58; Score =6.9; E_value=0.081; Accession=PF08330.1; Description=Protein of unknown function (DUF1723)
MAMFGRPTPEIEGLVTASGLGSLIETSSFHLPVREVTITLDGVASLLHLPIVGAFHSFEQLHVDDIVNTLVELLECWIYKNFPSVGSALTTEDYDKRRPRASQWISSKALPVSTYRRRLDRLTPDVV

SEQ ID NO: 124105 - protein, 194 aa, Glycine max
  Coding DNA Sequence Number=SeqID_32420
DSLEEQVTQGSFVPHGRQDILNTAIGRPDHGGRVRAAGSGVTITQYYGKASRTCSSSSTSISQQQLDEVVARLREDMTGQIREELRTQIKEELRTQLEEENKRSLEIMTNALKEAIKKELSNKGSPELLQIQSDIQQVAARVSTQGSNVVTNVQASQEHHADAIPLMGLYVQLKDGTTRFVEILPYLQLTRGML

SEQ ID NO: 124106 - protein, 333 aa, Glycine max
  Coding DNA Sequence Number=SeqID_32421
MASRKRKSIDNVLGRNIQPERKVELYHTEFDDFKTELERRNLHKRLTNLVDGSIDLALVKEFYENLYFSNGPSPKQARVRGHLVKIDADGFNTFLETPVVLVEGETLPTYFRYCRLPSDPREIEAALCIPGRGFILNAKGHPGRILRKDLTTLAQVWSVLSYSNLAPTSYTSDLTVDRARLIFCLVSHMDMNIGALISGQMTSIAQSNSSRLGFPTLIIALCRARGVVSDSLTFERLCPIINLAYIRKNCWNPYDLTVFIRGARRASARPVELPSTSTAPTPASTSIAPSVPAQTDSQCFEAILQSIHQGQIILLQSLQVVHPLGSIPSVSSF

SEQ ID NO: 124107 - protein, 112 aa, Glycine max
  Coding DNA Sequence Number=SeqID_32422
MLLSKHSVQGPQYRSPPAEVSVGLCRSDIGIVPTRHPVDSEEPNGTLGFQALVTGPDQSYRMPVPPARDHARKTPSGPKEVQQGPRVSSSNYEPLLVLRSACRPQQVHQPPY

SEQ ID NO: 124108 - protein, 36 aa, Glycine max
  Coding DNA Sequence Number=SeqID_32423
MNSLSEHAALSEFISTHCSRAKLSLLGPSAICCGIR

SEQ ID NO: 124109 - protein, 246 aa, Glycine max
  Coding DNA Sequence Number=SeqID_32424
  Homolog annotation: Hit_ID=Q2AA09; Match level="QueryCoverage=62%, HitCoverage=49%, E-value=8e-08, Identity=32%"; Hit description =Retrotransposon gag protein
MERSMIDAASGGALGDMTPVEDRNLIEKMASNSHQFSARNDVIVLRGVHVVATDSSSSAENKKLEGKLDALVNLVTQLAMNQKFAPVARVCGLCSSADHHTDLCPSLQQSGVNEQPEAYAANIYNRPPQQQNQQQQNNYDLSSNRYNPGWRNHPNLRCTSPPQQQQPVPPFQNVTGRSKPYVPPLMQQQQQQQQTQHATEAPPQPSLEKLVRQMTIQNMQFQPETRASIQSLTNQMGQMATQLNQA

SEQ ID NO: 124110 - protein, 198 aa, Glycine max
  Coding DNA Sequence Number=SeqID_32425
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAGTLFNGLLLQPTSVTKPFAIRAFCDADWALDVDDSRPAGMQAWHWPSFYNVVTGKTLALPNLIALQHIPLSPAGVIAKRPAPIALPNSCAA

SEQ ID NO: 124111 - protein, 169 aa, Glycine max
  Coding DNA Sequence Number=SeqID_32426
MACDLIRKLLDASAGGKIKLKTPDEAMEFIENMAANDSSKEVNYMANPNCQGFHHRGPPGYNQGGNFSQGQGWRSHHGNNFNKDQGGPSIRPSNQGPNMYERTTKLEDPLTQFMQVSLSNHKSTEFAIKNLEVQVDQLAKQLVERSTGSFVANTKKNPKEECKAVLTRS

SEQ ID NO: 124112 - protein, 105 aa, Glycine max
  Coding DNA Sequence Number=SeqID_32427
MLTSPERVQMTTLASACQSNLGSPNDEVWITGRCLCMLSDSWVRIARGGVVDKSEAFAPTVYGKLGFWLKACRTAEHDICQDVGLASGLGKKEMSHIISMIHMQH

SEQ ID NO: 124113 - protein, 117 aa, Glycine max
  Coding DNA Sequence Number=SeqID_32428
ASEPLTRGDYVVFGIDYLWQPLTRETNVVFCTLCQPEASEHIDTHITPDSLQRLTSSSAPFVNMRQASPLTREIYVVFGADYLWQPLTREEGKRAIDTRRFTSSSAQTTSWQALTRE

SEQ ID NO: 124114 - protein, 156 aa, Glycine max
  Coding DNA Sequence Number=SeqID_32429
MRFLSGQALHTSCLADTSGQVFITAGSCVSVKTTSKARSGGEFDIEDSEPHHGQSRPPWAIVRILSPESYIETWMQSSKPWMSYAVEPLKGNDPETGDSDRCGLYIEADPARLVAIGRVYEGSTVVHSTPLLPGQVKVSVEEVRDADAPVPVPTDE

SEQ ID NO: 124115 - protein, 192 aa, Glycine max
  Coding DNA Sequence Number=SeqID_32430
  Subcellular localization annotation: CTP_CleavageSite=58; ConfidenceScore=5.29e-01
CHWETKQFPSSCGGGNHHAGRRGISSSFAHHGRVPYLPTSARGRGGADVSRLTTSLTRGSQDRDRTLSWTSATYVHVVFLDALRDLSQSGRYTWGATALVPIYDHLNDACISTGQHVAEYDEKHIHRDVQEVPGSIEDSRCLLDAIWGALTERVMRQFGYVQSISTPPVDSWVSFDEINDRWMHYSNHLALA

SEQ ID NO: 124116 - protein, 126 aa, Glycine max
  Coding DNA Sequence Number=SeqID_32431
  Gene Ontology: Mol. function=aspartic-type endopeptidase activity; Cellular component=chromatin; Biological process=chromatin assembly or disassembly
  Homolog annotation: Hit_ID=A5C5K2; Match level="QueryCoverage=80%, HitCoverage=6%, E-value=2e-07, Identity=32%"; Hit description =Putative uncharacterized protein
MSKLLEMLEADRQENKAQFETLEAAMDSLLKPNNNSGVNLHMNVAGNNSIGGSPFPPFQVCNVKLDFPHFDGSEVLQWIFKAEQFFDYYNTPDTQRLTITAIHTEGSSRVDLQACKLGTGRRFTTS

SEQ ID NO: 124117 - protein, 198 aa, Glycine max
  Coding DNA Sequence Number=SeqID_32432
MTTLTQIWMTLLLSNILPTDHNFDLPLPKCQLVYAILTRMSIHVAQLIADAIYIFAGMAPTRHPLDPDKSNKALGFPALITGLCQSFGVPVTPSKVADAPPPHQAGPAGLFDTEQYLRHLVRQQAANHRAHSQGFTSFPCPTLDQFRAEVEWPGDWPEAQAGEAPAGAPAEAPDEADEAREDEEMTDLLDFLGGSGAT

SEQ ID NO: 124118 - protein, 79 aa, Glycine max
  Coding DNA Sequence Number=SeqID_32433
MEKEMITIIVDTLPVFYYEKMVGYAPSSFTDLVFVEDENEGETLAMTVIPTRSNFPSAQQCHYSANNSPSHPIIHKGHP

SEQ ID NO: 124119 - protein, 36 aa, Glycine max
  Coding DNA Sequence Number=SeqID_32434
  Homolog annotation: Hit_ID=A5BTR2; Match level="QueryCoverage=94%, HitCoverage=1%, E-value=2e-07, Identity=85%"; Hit description =Putative uncharacterized protein
TKILLKAIDDQFITSDKALASTLITKFSSLRLTSVK

SEQ ID NO: 124120 - protein, 68 aa, Glycine max
  Coding DNA Sequence Number=SeqID_32435
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q6I8E6; Match level="QueryCoverage=82%, HitCoverage=17%, E-value=2e-23, Identity=100%"; Hit description =Pseudo-atpA
MEFSVRAAELTTLLESRITNFYTNFQVDEIGRVVSVGDGIARVYGLNEIQAGEMVEKRHTNYQPTFRE

SEQ ID NO: 124121 - protein, 35 aa, Glycine max
  Coding DNA Sequence Number=SeqID_32436
MAGRNDRAISDALQALAQAIGNPNRGETGGVVEYL

SEQ ID NO: 124122 - protein, 239 aa, Glycine max
  Coding DNA Sequence Number=SeqID_32437
  Gene Ontology: Mol. function=chlorophyll binding; Cellular component =integral to membrane; Biological process=photosynthetic electron transport
  Homolog annotation: Hit_ID=Q2MI75; Match level="QueryCoverage=74%, HitCoverage=34%, E-value=3e-98, Identity=97%"; Hit description =Photosystem II P680 chlorophyll A apoprotein
  Pfam annotation: Domain name=PSII; Domain location=1-171; Score= -43.4; E_value=8.6e-10; Accession=PF00421.10; Description=Photosystem II protein
MDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQLLFYFICWEMIPNNSCCEGCPKAIYKAYPVKLTSKPDIEMAIRVAVSIIRILKFQDHNRSIG

SEQ ID NO: 124123 - protein, 28 aa, Glycine max
  Coding DNA Sequence Number=SeqID_32438
MARACSPLRVRTCGPLMARTYSPLKVID

SEQ ID NO: 124124 - protein, 184 aa, Glycine max
  Coding DNA Sequence Number=SeqID_32439
  Gene Ontology: Mol. function=chitin binding; Cellular component =extracellular region; Biological process=chitin metabolic process
  Homolog annotation: Hit_ID=UPI00006A17C9; Match level="QueryCoverage =66%, HitCoverage=100%, E-value=2e-13, Identity=30%"; Hit description= UPI00006A17C9 related cluster
MLVRMIRTRLFAVARVKSCPDMHSSCVIASLSGCARTVGPPPISGGGPGTVKRKLLVWIWSPLKVRTRSPLKARACRLLKARECSPMMARTCNPLKVRACSPTKVKVHDPLKARTCSPLKARTCSPLKVRACSPLLARTCSPPKVRACTPTKVRTCSPLMARACSPLKVRTCSPLMARVCSPLK

SEQ ID NO: 124125 - protein, 91 aa, Glycine max
  Coding DNA Sequence Number=SeqID_32440
KSLQVWAHIRDLALFRRRFTSLQCITDSLIRGRSKSGVQGKLHCLAIAITVYYIWLSRNKLIFEDYQFSVIEIISKIKSLMYRQAHLLHFS

SEQ ID NO: 124126 - protein, 112 aa, Glycine max
  Coding DNA Sequence Number=SeqID_32441
MQKSGPVPVPTDEVVVSPAKPPPKPDDPLYLMTLTIPELFSRPYQVRWDATVFGVFNPDFPLYIKHEDLSKIAHGGQCLSISVLQLWILNLTETCMRAGNSDIYGYLEPQSI

SEQ ID NO: 124127 - protein, 207 aa, Glycine max
  Coding DNA Sequence Number=SeqID_32442
MGDQEETQEQMKANMSALKEQMASMMEAMLGMRQLIEKNVATVAVVSSAAEADPTLLATAHHPPPNAVGRERSTLGHTSNPHLGYNQVAYPYGLPPNYMPPAMHNDAGHVPSPTLEGEPPRQPDEVHEDHREYAQGDVDFYPPIPVEGPAPNTLPQHNPTAQPIFLSTEGPPLAAEERRKLDLLEERLRAVEGFGDYPFKDMMDLWL

SEQ ID NO: 124128 - protein, 194 aa, Glycine max
  Coding DNA Sequence Number=SeqID_32443
  Gene Ontology: Mol. function=oxidoreductase activity; Cellular component=extrinsic to mitochondrial inner membrane; Biological process=electron transport
  Homolog annotation: Hit_ID=A7Q378; Match level="QueryCoverage=66%, HitCoverage=23%, E-value=1e-43, Identity=68%"; Hit description =Chromosome chr12 scaffold_47, whole genome shotgun sequence
  Pfam annotation: Domain name=efhand; Domain location=41-69; Score =24.7; E_value=0.00035; Accession=PF00036.23; Description=EF hand
MLCWPFFADQPTNYRYICNEWEIGIEIDTNVKREEVEKLEDIAVIFSKADKKNSGKLDLKEFKEVFGDIIERYPQVGIYLKKNQMKDMASLLKKSQESNIIVEIEYFKEALSKVDSQMKNLPITAQVASQQGVYLANYFNRMEECEKYLEGPLRFRGVGHHRFRPFRCVCVCACVCVCVNNTSWISKIALGEDY

SEQ ID NO: 124129 - protein, 69 aa, Glycine max
  Coding DNA Sequence Number=SeqID_32444
MYRDKYLIPMTYSMLICVTHFLRRLTKKKRGGIGAEEILIAKHEDGIDHVAHPHGITDTKMNDLHVSVY

SEQ ID NO: 124130 - protein, 59 aa, Glycine max
  Coding DNA Sequence Number=SeqID_32445
VYSRPSMEHWHAMKGDADWNTLSDNSKATSGYIFSIAGGAVSWLKVTSRPSMEHWPAME

SEQ ID NO: 124131 - protein, 390 aa, Glycine max
  Coding DNA Sequence Number=SeqID_32446
  Homolog annotation: Hit_ID=Q6WAY6; Match level="QueryCoverage=95%, HitCoverage=68%, E-value=6e-31, Identity=27%"; Hit description =Putative uncharacterized protein
MVEEFEEILGCPLGGRKPYLFSGFYPSLARISKVVQISAQELDHRKQVENGLVGIPRKYLEAKARILAGKGKWAPFIDILALLIFGGVLFPNVNGLVDLAAIDAFLAYHNHKENPVVAMLADLYDTFNRRCEKSSTRINATVHALEKGGANWDQLLANKEGASINWFPRWKQGRVGVLISCGGFLNVPLMGTRGCISYNPVLAIRQLGYPMRGAPLEEEIAPIISRGFNKTNVETLHKVRKAWEVVRKKDKELRGSNNGPIGGYHKWLRAHVQGLDWLPSLRTAKREEVEASEEDEEVQALRAELKQAQTVKERLKSAALKIRKENAELRDMNTVTTKALEQETKRARREEHGRNKFRGALWGSNRKLKLRREERDQSRVDSLILKDELK

SEQ ID NO: 124132 - protein, 206 aa, Glycine max
  Coding DNA Sequence Number=SeqID_32447
LHGLTFRGLHVLTFRWLHALAFRGLHVLAFKGRHVLNFRGLHTLAFRGLHTLAFKGRRALNFRGLHALAFRGLRVLTFSGLHIHTLRGFKATNCASTTREGGKISPVSLQSDEGCAHKTPSGPGGAQQGPGVFSSGYEPLVLELPALITGLCQFYGVLVAPSKVIRPPTNRAFIKKYYAPRQAQGETPQQPGDGRQWAIDAPPPPL

SEQ ID NO: 124133 - protein, 67 aa, Glycine max
  Coding DNA Sequence Number=SeqID_32448
MVVILPKEHLVVCAIKGLDDAPQPKSKASARWIVVKYFNDPRPLEPERLKALRIQWAQFYLRVRDQA

SEQ ID NO: 124134 - protein, 158 aa, Glycine max
  Coding DNA Sequence Number=SeqID_32449
RILHYLIVRILLLRSSNLAQALRLNAPLPYPHLVTLFLQHFNIPLDSEPYVPIKRSFLIGASVIASFGYQKEHDGSWMKKGARHVGEEGHDGEDSSILSKILDMFDGLQTFVGERFDNLELQVDMRFNEMKSRITKVKEDVSYIRSSFHLPPPPPPSS

SEQ ID NO: 124135 - protein, 178 aa, Glycine max
  Coding DNA Sequence Number=SeqID_32450
  Homolog annotation: Hit_ID=Q2QNX8; Match level="QueryCoverage=78%, HitCoverage=13%, E-value=2e-07, Identity=25%"; Hit description =Retrotransposon protein, putative, unclassified
VEVDLLCDRCGMEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRKATREGVKPAKGGLQGDNSNRVAK

SEQ ID NO: 124136 - protein, 69 aa, Glycine max
  Coding DNA Sequence Number=SeqID_32451
MARNVFAPCPYFRDLQGRELKGLLVIFPQVPSGVANCASLPLGGERAKLAKGMRVPRKEFYAAESPQSY

SEQ ID NO: 124137 - protein, 376 aa, Glycine max
  Coding DNA Sequence Number=SeqID_32452
  Homolog annotation: Hit_ID=Q6WAY6; Match level="QueryCoverage=45%, HitCoverage=29%, E-value=8e-18, Identity=34%"; Hit description =Putative uncharacterized protein
MGPLQMQAFRKAYGKILDLTIAEISTEAVVSLTQYYDQPLICFTFGDFQLVPTVEEFEEILGCPLGGRKPYLFSGFLPSLSKIAVVVRDSARGLDRVKQTLNGTVGLPRKYLEGKARDMANQEEWVPFMDVLALLIFGVVLFPNMDGLVDLAAIDAFLAYHHSKESSVVAILADLFDTFDRRVHKAWESPLRKDKELRGIRNGIIGGYHEWLKVRTRGLDWLSKLKIINEENFEAPKEDEEVCALKTELGKARLAKEKFKLVTTDVRKECAELREENAATARALEQETKRARKEEHGREKFHGALWDNNNELKLQREERNQSRVHNMVLKEELAACSRSKRSLTQHLEATEQSMLAIIGQYKEELNQSLAHEQKLV

SEQ ID NO: 124138 - protein, 157 aa, Glycine max
  Coding DNA Sequence Number=SeqID_32453
EVVAAQLAQASSARPGEPGCFLQKQQPSGGIFWRAQEGKAAISPFHQFPDESLSEALERFRGGKIKLKTPEEATELIENMSSSDHTILRDRVHQPTKKSLLELSSQDAVLAQNKLQVVPYAVVLLNLAFAFLLKSKRKRLATWGINKGRDTIKVNSQ

SEQ ID NO: 124139 - protein, 153 aa, Glycine max
  Coding DNA Sequence Number=SeqID_32454
MGKRKKLNIIQNDGQSQAKEQSIESSTEVNQNNNSILEGNAQFEGEQHIPEDSHVQSHTSLESASESSTKGKKRTRGYTHMLDVWDLPDGEFILVEVDHWGNPMGWEGKTLNVIRSLVRRHQCAPINFLSWKDMPKDYITDMVELIQVWYKTL

SEQ ID NO: 124140 - protein, 110 aa, Glycine max
  Coding DNA Sequence Number=SeqID_32455
MVSGPPPDIGGGPTVQAQPEREAITQLLCIPGQDFTRAAAKRRGSHPQRHPVDLKKSNRALGFPALVVGLCRPYRAPVPPSKFMSSWHRDRARRHLVDPKKANRSWSCQL

SEQ ID NO: 124141 - protein, 84 aa, Glycine max
  Coding DNA Sequence Number=SeqID_32456
MASEKAVRWSMSLDIADHRPHHPAYLQMSRPSKECVESLSHDLNLFRGYRNGSICISNLLNTNLDLIMQQRNVVNGCGSLINSS

SEQ ID NO: 124142 - protein, 184 aa, Glycine max
  Coding DNA Sequence Number=SeqID_32457
MSRGSGDLGDVRVLCNSCLASGNRLPRLCNRLPEMKSLEIVMAAQVIHDRVEMECLEGAWETLEGNARCRFRGTIRFMATSLVHPEEPTRTLQRTMEWILPTPTPYRLVEPVQVIKVTSSEEDPEEDPEELPPEPTVDALDFLEDDENPLREVDSPEDVMSASEADSTEESGPGGIATSGGSSS

SEQ ID NO: 124143 - protein, 167 aa, Glycine max
  Coding DNA Sequence Number=SeqID_32458
  Subcellular localization annotation: CTP_CleavageSite=79; ConfidenceScore=5.38e-01
TFRGPRKARGKRSEALTTSAPETPAPSSSTTPLPPTQTPVIPPTPTQIPLPAPLSVAWPGAQPSPSRGGGAFATQEPVLGETAAVEGEDELTPPEPSYFDAGIHMAQEEDASTDQIHEPSSALVPNDATPSTPAPELEQPISQDSPVPQVLDLNEHAQEKPHDEQDI

SEQ ID NO: 124144 - protein, 158 aa, Glycine max
  Coding DNA Sequence Number=SeqID_32459
  Homolog annotation: Hit_ID=Q0KIL1; Match level="QueryCoverage=60%, HitCoverage=10%, E-value=8e-08, Identity=34%"; Hit description =Gag/pol polyprotein, 3'-partial, putative
  Pfam annotation: Domain name=G-patch; Domain location=43-82; Score =23.8; E_value=0.00025; Accession=PF01585.14; Description=G-patch domain
MPYVEFAEESLETAFQSFEVVSIASVDSFSGQPCLSDAAVMMARVMLGNGYKPGMGLGKDNGGITSLISTRGNRGKFGLGYKPTQAGISKSVARRKSGGQGSRLGQEVKGGLPCDIRRSFISAGLGHEGQVVAICEDDSPSGSELVWPCPPSFRLGNW

SEQ ID NO: 124145 - protein, 106 aa, Glycine max
  Coding DNA Sequence Number=SeqID_32460
MTPQLNEPSQLNADPTIDIHVAQSESNKTSHDYHAQNGFSDEVVGDFSDIEDEILADNNNNDNDIQFLFQQTSTENVYHPYPNSADVGDNQLPDNPNYRHFLDQQQ

SEQ ID NO: 124146 - protein, 101 aa, Glycine max
  Coding DNA Sequence Number=SeqID_32461
MGIRKAEGERRSTSFPWKMTDTYRDWHERVHSNFWGIGIRTYTGETPWLPPFKDPEVFDYLYFEEEEDLAIGLATTLVEHRDKAPITDFFFMISRRLKQTD

SEQ ID NO: 124147 - protein, 30 aa, Glycine max
  Coding DNA Sequence Number=SeqID_32462
MKRKEGLAENREKQRIEAQNRASRNAARLG

SEQ ID NO: 124148 - protein, 115 aa, Glycine max; identical to SEQ ID NO: 116469
  Coding DNA Sequence Number=SeqID_32463

SEQ ID NO: 124149 - protein, 51 aa, Glycine max
  Coding DNA Sequence Number=SeqID_32464
MAIIALLSRSGILGVVFGLGYAAAGFVADLGVAFVDDWVFLADRVVGNEKG

SEQ ID NO: 124150 - protein, 114 aa, Glycine max
  Coding DNA Sequence Number=SeqID_32465
MIMRSQDIYSSQDEATTSPSSSESEEAKGEEYSEEIYPQEEGQPLMVKEECKETLVSTATPLGLEVIPQVKELLDEGLVRVEGRSPEYEEPQDLRSNPFQGGGDDAILPPKGIG

SEQ ID NO: 124151 - protein, 66 aa, Glycine max
  Coding DNA Sequence Number=SeqID_32466
MATRRARSASMYKPHLSESPVSGSFPEGLTQLPCVLTEDRRDQPEGQEALQVPGIAFATEARTACG

SEQ ID NO: 124152 - protein, 175 aa, Glycine max
  Coding DNA Sequence Number=SeqID_32467
MDKSMIDAASGGALGDMNPAEARNLIEKMASNSQHFSARNDAIVIRGVHKLALNQKSVSVARVCGLCSSADHHTNLFPSVQQSEAIEQPEAYVANIYNKPPPPQPQQQNQPQQNNYDLSSNRYNPGWRNHPNLRWSNPPQQQPQQQPYFQNVAGPSRPYVPPPIQQQQQQQQPQK

SEQ ID NO: 124153 - protein, 193 aa, Glycine max
  Coding DNA Sequence Number=SeqID_32468
MKKVLHQLFNRNPQLRVLDFHGKEAPFTIKKGNQEKFLAYIGGGMSPPPLGTSKSLKSSLISLKVGNLAPCSTSSFSEVHTQELSVALKGLKKLDVALSAIFALSTNALPDSLDSLSDLVLGLAADTRKAHGAHLVRHPLWHFFKFALFLPEIEENLTLIPYKEASNEQRSKQRKIYLQSYKRTINWGFIYIL

SEQ ID NO: 124154 - protein, 137 aa, Glycine max
  Coding DNA Sequence Number=SeqID_32469
  Gene Ontology: Mol. function=nucleoside-triphosphatase activity
  Homolog annotation: Hit_ID=UPI0000162C59; Match level="QueryCoverage =89%, HitCoverage=21%, E-value=2e-14, Identity=56%"; Hit description =AAA-type ATPase family protein
MERKSHRGKSFEFDSLYSLVSNRGDSNLILDGIHENILQLNYHDVVMQKTVAFQLLSDKEKNDLAQLVSTMVSYTITYKTVKSYILPQTQRCEVADGLALSLVPPISDFINFKDYTSNHYVLSIAMKQVFVHEVRLH

SEQ ID NO: 124155 - protein, 170 aa, Glycine max
  Coding DNA Sequence Number=SeqID_32470
MSGLAITTPTSLCLSVSWCMAPTRHPLDPDKSNRALGFPALIMGLCQSYGFPITPSKAVGAPPPPRQADGPLGIERYLQHLVLQQAANHRGQVQIHECLYQFSLSQQGLRSTTSICPTPEQFGAEVAWPGDWPDAQIGEEPAGSPGEADESHMDEDMTDLLDFLGESGAT

SEQ ID NO: 124156 - protein, 377 aa, Glycine max
  Coding DNA Sequence Number=SeqID_32471
MGFTLVDLDKGRSSGVSHQNGDSTLDIYETPSFTKCMPSIIEEHEVDNLMATPLSSHLQSSASSESTSRRPRQSTRLKILIARHLDKPKVVVHVNPATRKASGPQKEKFCSYLGMETFDIPEVSNTKKKVISSMAILWRQFKSSLATKYVYAGKEGQDYQNPCNKYGLDPKTWEESIASHKTLSWKGIKKKAQTIQKQNDCSHLLSRGGLLTRSDDKRKLCTHGCQDILTTAIRQPEHSSRLLVVEFGVIISQYFGHASYGSIRQLEHSSLVRVVEFGVEGVPDEQLEPKGIPTTPPVKEDIEVYGARVSIKGNCVDTIVNPSREEPHFDIICTMGLYVNDDHSTRPVALGKVYKGASTVHHVHLADDVVKVVVEEV

SEQ ID NO: 124157 - protein, 229 aa, Glycine max
  Coding DNA Sequence Number=SeqID_32472
MGVVALVNLGYMLLTSIGLYLANSAAHTFMDSIEEQASQGSFVSHGRQDVLTASIGCPEHPGRVRVAGAGVNIKKYFGSAPQTSHSSSSLPPEELQYDSAAHGIVQSDAVPVLVPDAISGTCTASGASRNDPETGDSERCGLYIEANPTHLVALGKVYEGSTVVHNTPLLHVQVKVGNSHLPCLVDTSGQAFITIVVSPAKPPQKLDPEVDDLLYLMTLTILELFLRPY

SEQ ID NO: 124158 - protein, 57 aa, Glycine max
  Coding DNA Sequence Number=SeqID_32473
MSDSNGRCSTSRRSQTPTRMTKMRKAEREKRKAVCDTIAGSYGEMLPLQMKFGNGND

SEQ ID NO: 124159 - protein, 52 aa, Glycine max
  Coding DNA Sequence Number=SeqID_32474
  Homolog annotation: Hit_ID=A7P2W0; Match level="QueryCoverage=63%, HitCoverage=8%, E-value=3e-07, Identity=78%"; Hit description =Chromosome chr1 scaffold_5, whole genome shotgun sequence
MCLHIRREGYQTKVCIKVIGEKSAEMMTNEGAIYVTANRGYNWRDACGSKAS

SEQ ID NO: 124160 - protein, 125 aa, Glycine max
  Coding DNA Sequence Number=SeqID_32475
MVVSTITDMMDRENNVQDLLHFFSKECEIVPQYTMSGKPIMNESLWREALKTIAYILNKVSSQERTTTNVASATTAAVVALESGPGWHRRGRRLPKHIVYDNENAGKAMRVIQLTMVHARAVRNA

SEQ ID NO: 124161 - protein, 140 aa, Glycine max
  Coding DNA Sequence Number=SeqID_32476
  Gene Ontology: Mol. function=RNA-directed DNA polymerase activity; Biological process=RNA-dependent DNA replication
  Homolog annotation: Hit_ID=A5AY05; Match level="QueryCoverage=49%, HitCoverage=28%, E-value=1e-12, Identity=40%"; Hit description =Putative uncharacterized protein
  Pfam annotation: Domain name=zf-CCHC; Domain location=74-91; Score =29.2; E_value=1.6e-05; Accession=PF00098.14; Description=Zinc knuckle
MQLASLEFEGYALVWWNQIQVDRERLRRHRVDTWMKDKDTSKKDGSSSQHLEKKSSRGNPTSPTQPPPNKTSSIKCFKCLGKGHIASQCPNKRTMIVLENGEDDGFLPPKEEDLLMVCSLIIDGGSCTNVASTRLVEKLG

SEQ ID NO: 124162 - protein, 982 aa, Glycine max
  Coding DNA Sequence Number=SeqID_32477
  Gene Ontology: Mol. function=protein serine/threonine kinase activity; Cellular component=nucleus; Biological process=protein amino acid phosphorylation
  Homolog annotation: Hit_ID=A7PWA8; Match level="QueryCoverage=93%, HitCoverage=72%, E-value=3e-61, Identity=45%"; Hit description =Chromosome chr8 scaffold_34, whole genome shotgun sequence
  Pfam annotation: Domain name=Pkinase; Domain location=2-206; Score= -74.1; E_value=0.00036; Accession=PF00069.16; Description=Protein kinase domain
MTLGSIITCYLKSESWNTTFFWSRAANIKKARGSYFSEECLFGWGTMEGKGGEGEFGLAKLLNTEDLTSPVVGTLNYMCPEAFAGMPYGYKSDMWSLGCCMFEIVAHQPAFRAPDRAGLINKINRSSISPLPIVYSSTLLNLPNAYSDGFGEIWALSLGHSSHQCHISTLLNRTESRQKKQLIKSMLRKNPEHRPTASELLKNPHLQPYVLRCRNASSIFLPVHLINSNSKDKTKTKSSSGSKDHWEREAALAGLVNRLDRLYPLEGNGDVQSRNWHNDGKLAVSTSAEDNLETKMVDLTSYTVEFSTSISGSKDGSTTSESTVCSVCKEGDSKNRLTRDTADSEITSKSTMDSGLEEQGLDCHKSYAIDINTVINKVEDTFSNEDFNTDEALSEGVKPEDSSKSIMSSEDSNGNDKDELIDEITSKSTLDSVHEKQGFTAEHFQKSDVIDTSAVSTKIEDNFFSEDRTEAERENAKPEDSRKSIVSSENSDVKDNEGSINEITSTSMLDSVHEEQGFTAEHFPKSDGIDTNAVAIKVEDNFSNEGFDQTETERENAKPDDSRKSVVSSENSDGNDNDGSIDENTLKSTLNSVHEEHEFTAEHFLKSDVIDPNAVASKVEDNFSNEGFDQTETERENAKPDDSRKSIVSSENSDGNDIVAVDETTLKSMLNYVHEERGFTAELVQKSDVEINAAASKVEDKFSNEGFDKAEAQREDAKLESSSKSIISCENRNDNDDYGSGYEITSNSMLDSVGEEKRLPAELFQKSDAIDINAVTTEDEDKLSKEGFDRAETQEKDDKPEDSSNSLSSEDSNSNDKEGSIDEERSSPIAHAVKVEHDTDTGNSLKENENPKVLTEDSCMDSLASESNEMRPGKDEGQADTHTISCSTHKEVDNAVMADKPPNGVSLRTRISRGGDNTCHQRADALESLLELCAQLLQQGKLEELAAVLRPFGEDAVSVSSRETAIWLTKSLVASQNLNPEI

SEQ ID NO: 124163 - protein, 82 aa, Glycine max
  Coding DNA Sequence Number=SeqID_32478
MRNKRSPSDLTFSASSLDRRSPPSLALERRKEEAKKLWEGGNLTSSPSRRVVSESEIETNTDNESESETENEECKCRGSESE

SEQ ID NO: 124164 - protein, 116 aa, Glycine max
  Coding DNA Sequence Number=SeqID_32479
MASGFHVLKLCNSSLGTEEPTRTLQRTVEWILPTPTPYRQVEPVQVIEVSSSEEDPEEDPEELPPEPAVDDLDFPEDDEDPLPDVDSPEDIMSASEADSTEESGPGGTANSGDSSS

SEQ ID NO: 124165 - protein, 93 aa, Glycine max
  Coding DNA Sequence Number=SeqID_32480
MLDTGNRLLPSGNQLPESKILCEPKRISKGSSNPRSILGKPQGISKGSLNPRSALGEPQRFSKGLSNPRSALGEPQIFSKGLLNPSSAVGEPR

SEQ ID NO: 124166 - protein, 110 aa, Glycine max
  Coding DNA Sequence Number=SeqID_32481
MARASNKVDSCSRMAFSTFSSGVKISLSKDLDLGTIILRTSKRQPYMKKKKDGQPNAALTKGKSLLPQAWMTILQESSGLANFSLRSKAATLMEEVMEKRYFRISSLTHP

SEQ ID NO: 124167 - protein, 122 aa, Glycine max
  Coding DNA Sequence Number=SeqID_32482
MSHHSSSVNGEDFKAHLEHKISCSSLPLPSFISFFLQALIHGLLWCGVSSLSSFSIPLPFIFQEAKESIDEEDPRPTSSNGACIITLEGIGHILDLTPIGDKRNKGLKRLTLTFHTSKGRTM

SEQ ID NO: 124168 - protein, 237 aa, Glycine max
  Coding DNA Sequence Number=SeqID_32483
  Gene Ontology: Mol. function=protein serine/threonine kinase activity; Biological process=protein amino acid phosphorylation
  Homolog annotation: Hit_ID=Q9ZVM9; Match level="QueryCoverage=35%, HitCoverage=15%, E-value=1e-17, Identity=54%"; Hit description =Putative serine/threonine-protein kinase At1g54610
MQITLMPSLILLPLTSTKFLIEHWVCLHSCTLENVVEAQNGEKEKEENGGGDDQREQVAAGWPPWLTTVCGEALSRWIPQKAYTFEKIDMICQGTYSNVYKAKDTLTAELDASLGIKFTEPQVRPASKLILMMPKTQVKNQDSSKFQESKSHSIKNQDSSEDSREDSRYARTSRKASTQRSIKNNSRVQDKNQEEFKTQEESLETRIKIQGSRSQESRSRFKAQDSRMKRRLNQDKY

SEQ ID NO: 124169 - protein, 119 aa, Glycine max
  Coding DNA Sequence Number=SeqID_32484
  Gene Ontology: Mol. function=protein serine/threonine kinase activity; Biological process=protein amino acid phosphorylation
  Homolog annotation: Hit_ID=A7Q5S2; Match level="QueryCoverage=99%, HitCoverage=23%, E-value=2e-23, Identity=46%"; Hit description =Chromosome chr14 scaffold_54, whole genome shotgun sequence
MDAKRRDNEARRIRTEKLEEVMDIKDKNRRCLITRANAKSRSEKFLPPHEDGQLVFPLGSSIHIDPDIVPSDVSLGSTSYTFSKEPFRAWLCPIGYTASISVTKRKKHTTGDALDLSKS

SEQ ID NO: 124170 - protein, 107 aa, Glycine max
  Coding DNA Sequence Number=SeqID_32485
MEEVHFPVMPYAVGIKQDGPSRSDDLFEEPTTRLNPPQRLGQENNVDDLGDEREGGIGVGGSPDVPWWRWPAAVVVACSGGGGGGSFVSSTILPFEVVSANSDQWDL

SEQ ID NO: 124171 - protein, 112 aa, Glycine max
  Coding DNA Sequence Number=SeqID_32486
MADDEPSLDRLERLKAAIADLVVAQLHSFVILASMVAKLDVILLKLHISVTSQPSPSFPSVKSPSTDNYMDSTITAPMAQHHTETIPSMSPKKKLTTPLAPMSSQPVSVPKL

SEQ ID NO: 124172 - protein, 201 aa, Glycine max
  Coding DNA Sequence Number=SeqID_32487
MSVRECILAIRRRSKNNSTAKFDGCNISSSFARASVGVEENNAIGDALPNLDTTKQSLIQEIGQKSQTPTTLQNQHGIIDENQFMYDDQYLWSDLAFQNDPSFQIDASFPLWSYDFGNTLVEDRASALGNALNWKISMFEKGNENPTKAGNDGISSFGSSSIGFHPMGSNIQHFKAPNLQIAPVQRYEPLQYGFATNSTHS

SEQ ID NO: 124173 - protein, 73 aa, Glycine max
  Coding DNA Sequence Number=SeqID_32488
MASIIILMMPKNQELSKFQRIKSQKALRIKFQDSRFMNNQEVCDDIAERLECHLSLGVVTPGSSTHEVIEECL

SEQ ID NO: 124174 - protein, 57 aa, Glycine max
  Coding DNA Sequence Number=SeqID_32489
MCPWLNLQKAHPTQGLPLVSLAPPKTLHIQGPSLMYPLLVPQRMYPPMCWDKEFSGG

SEQ ID NO: 124175 - protein, 80 aa, Glycine max
  Coding DNA Sequence Number=SeqID_32490
  Subcellular localization annotation: CTP_CleavageSite=46; ConfidenceScore=5.09e-01
MESWCFPSSCTRAELTTLSTTKRYRSRGTPGLGRLSTCGVAIVFLKAKKAFSQLWEKPRQKCQSSIQLLDFLDIGRAVHF

SEQ ID NO: 124176 - protein, 166 aa, Glycine max
  Coding DNA Sequence Number=SeqID_32491
  Subcellular localization annotation: CTP_CleavageSite=21; ConfidenceScore=5.57e-01
MACLSSAGLNLNGSRGASSSSASSTSSCAGTGSWATEASPPLEGEGCTPGQATCARNSSTLIVGCWPELCNLCMMMIWPLSRLWSMANNVFEVNEEGPVKGTGTDGAGKGAAIEEDGTIVEGAVERGISEDGGVEVDGVVEVKGASNLLPLAFLGLLNVTIGSSRF

SEQ ID NO: 124177 - protein, 225 aa, Glycine max
  Coding DNA Sequence Number=SeqID_32492
MAPKKLLSKKARKDAIGEGSSAAPQADIEFDGHHWSFLKERWVQLREGEYTEFQEKIAKRQWTQLAGPMAKYDPEIVVEFYSNAWPIEEAVRDKHSWVQGQQASFDDDDINQFLGHLLDFTKSVTGRRVWIMHTSMTTLTQKWMTLLLSNILPSDHNFNIPLPKCQLVYAILTQVSIHVAQLISDAIYRFQGIAPLRHPVDPKKSNRALGFSALITSLCQFYGVP

SEQ ID NO: 124178 - protein, 80 aa, Glycine max
  Coding DNA Sequence Number=SeqID_32493
MNTPWHNQSVGQNCKGMRPWVEIGVLGTSEKRSRERSEYLQRDELALVLERGVLGTSEERPKERSERWYGERGEYRQRNE

SEQ ID NO: 124179 - protein, 207 aa, Glycine max
  Coding DNA Sequence Number=SeqID_32494
MDEFDAQEPEPEQPTVEATKGEDELTPPEPFYFDASVHMAQEEETSTDQIPEPSPAPIPDDAIPSSPTCELEKPTSQDLPVAQPLEENEHVIGIMTENVSQFVRLIVKECIDRILAMFDCDSHLAKKLTMCLNDLSLATREHHHRKRGSKQICPKFGGVIIKGRDFTDRFLTPKRRRFAQNSKAHHGAYFEKGTLEAARGAAFAEIP

SEQ ID NO: 124180 - protein, 44 aa, Glycine max
  Coding DNA Sequence Number=SeqID_32495
MEMGLWWEIKSKRGGPLPGPPLLGLPNRRRAPPCHLRPRLLHCL

SEQ ID NO: 124181 - protein, 41 aa, Glycine max
  Coding DNA Sequence Number=SeqID_32496
MARGGPSTRAILFELGRIIINDKLSLQTFDDIFEPSLKPTS

SEQ ID NO: 124182 - protein, 65 aa, Glycine max
  Coding DNA Sequence Number=SeqID_32497
MVSPVKVEKFILRCGVETMALNLFNISLPIKANYEVKLQASRMSSSKVCLWSYLGDAILPPKGIG

SEQ ID NO: 124183 - protein, 75 aa, Glycine max
  Coding DNA Sequence Number=SeqID_32498
MSFMIIPCEAIMICFQAKLHGESKVIQRCFDDNNDDDKGDDKKLKDQSKNNSSESRTIQEFKIRIMKNSRLKKKV

SEQ ID NO: 124184 - protein, 77 aa, Glycine max
  Coding DNA Sequence Number=SeqID_32499
MDHEDGVNALNLETLDDVDQLYDGLTMGPILKSNGLSILQPSTFSLAEGLLVWGEELPVLKYLAKKDLYITYSHAGS

SEQ ID NO: 124185 - protein, 252 aa, Glycine max
  Coding DNA Sequence Number=SeqID_32500
MKKIQGLQALHGATSGKAMVEGDLGNDVIDGIDSDAEVDMVDLDDRDKETDDDKGDNDNYEENDSDDRDDLDAEYDIDKLEYDIASEEDDDCYALSMAQINGEDISIEPVSKRFQPHEMGRDFNFEVGMEFDSISQFKEAIKEYANLHEKLIEPLKYTPNMSTNAVIQKVSESYCVKISSKKTYWARRIAKEKLDLGIGRSPIQLNFRGGDFFGGTKFHALLFLSLHSSSSTFKLLSMSSYGGELLLDSSST

SEQ ID NO: 124186 - protein, 276 aa, Glycine max
  Coding DNA Sequence Number=SeqID_32501
  Homolog annotation: Hit_ID=A7PVV0; Match level="QueryCoverage=82%, HitCoverage=66%, E-value=5e-57, Identity=52%"; Hit description =Chromosome chr8 scaffold_34, whole genome shotgun sequence
MGSNPETASLHMQGFPKKAEDIPFGTTSCILCDDFNSTVFVFIFSASIGQSLPALSSVKSVQYTSAGPTGGRHFANHNSSALASNASATEAAAFDPLIGKKVWTRWPEDNHFYEAVVTDYNPADGRHALVYDINKVNETWEWVDLKEISPEDIKWEGEDPGILHRGGHGGQGGGGRKFFGHGGDSLGAGRGRGHPRFQARQEFLPPQNGIGRRVLDDIELLNTDSLVKEVERIFATSPQDSMELEKAKQMLKEHEQALVDAIARIADASDGESGNN

SEQ ID NO: 124187 - protein, 181 aa, Glycine max
  Coding DNA Sequence Number=SeqID_32502
DISNHLSSFKKIQGIQAPHGATSYTSKFIPHLSYILQCLVLSNLNLGGISRGSFKAETFDKGVKVVDGLWRKFFVSCQCYPFEGCWENTAQDCIIVGVEIGLGEECVQVGIVLGVDGVSGVQFPWNTFMHCVGRVLVALGASNMSFQLVMLFVMDVGGGMELSRRVSHLRIGCMLTIGENR

SEQ ID NO: 124188 - protein, 138 aa, Glycine max
  Coding DNA Sequence Number=SeqID_32503
  Gene Ontology: Mol. function=helicase activity; Biological process =viral genome replication
  Homolog annotation: Hit_ID=Q9C7W5; Match level="QueryCoverage=100%, HitCoverage=18%, E-value=8e-29, Identity=42%"; Hit description =Putative uncharacterized protein F15H21.18
MHTIEFQKRGLPHVHLLLFLHPDNKYSSSTDIDQIISAEIPSHQDDPELYRLVENHMIHGPCGILQPNSPCSRFYPKQFQPQTLLDSNGYPVYRRRNNGHSISKNGYDRVTAVMLSDSDNAAQNVNIQNDELKEYLDC

SEQ ID NO: 124189 - protein, 90 aa, Glycine max
  Coding DNA Sequence Number=SeqID_32504
  Homolog annotation: Hit_ID=A5BEV8; Match level="QueryCoverage=74%, HitCoverage=8%, E-value=1e-09, Identity=43%"; Hit description =Putative uncharacterized protein
MNLFGGTERFEQLKLSLLVDGFSKVSVDKWMDITEMGYVLASRYNVILVSLSRQQSMTFFPLRSQPPPDSSGHRMICVSHVFGNHFVQVH

SEQ ID NO: 124190 - protein, 190 aa, Glycine max
  Coding DNA Sequence Number=SeqID_32505
  Subcellular localization annotation: CTP_CleavageSite=8; ConfidenceScore=5.34e-01
KWFFRNVSERTTSSGKFFQKSQRSSGKFFRNFGILPEELLLLKIFRKRCSGRLLEKVFFRKTFRFFQKNTSSGMFPEQILLEVPEEPLTGLSEASVVSPLSPFFPASSPLVFYPKVTILRFHCYNNVVSYKQREVRETNLVRGEEDELRAWLAEKKQFTDREKKQFAEREKKLHERNDQEEFLPERGGFL

SEQ ID NO: 124191 - protein, 173 aa, Glycine max
  Coding DNA Sequence Number=SeqID_32506
MACASSEADNCSKGLIVVEQEVGFLIPIEDQWQFISHDVSCQDFVKTVLEVMKHVQVKLEQLLGHVVQGDPTNLASSDGKRGRRRPSITAMPHIAETLMSPPLLLLAPQEVEWGRIMVTRMGSLSRKAAKDCTLLRRREVPSPTQHKPTILLEEKDLLLEAPWRESPPLRSCQ

SEQ ID NO: 124192 - protein, 215 aa, Glycine max
  Coding DNA Sequence Number=SeqID_32507
MEEISQDERKKIREEERRKIMKEMKREKHASYSSHNSCKSLSEELRDYYEGRHRSHLRPHSHRREKERKPQEANINLPYFHGKDNIEANLVWDIRVEQQLKKKSTSKSYGSHSYPKKYQGQGILGVTPSKPKDDKGKTIEKQAPKAKDTLLLNALPQKTMIMRGQDIYSSQDRATTSPSSSEEIYPQEEGQPLVVKEKCKEVLREGAQSRKKLKI

SEQ ID NO: 124193 - protein, 62 aa, Glycine max
  Coding DNA Sequence Number=SeqID_32508
  Homolog annotation: Hit_ID=A7Q283; Match level="QueryCoverage=64%, HitCoverage=18%, E-value=2e-08, Identity=67%"; Hit description =Chromosome chr13 scaffold_45, whole genome shotgun sequence
MMRIEYMQVERNIDLVYVGGSIGLMGLISQVVFDGGCHMLGREKEGIKRILRRHLMALKKPS

SEQ ID NO: 124194 - protein, 107 aa, Glycine max
  Coding DNA Sequence Number=SeqID_32509
MNLLSEHAELSEFINTYSRLNRKAQVNSKPADPQSPVVNPPSSAELEAVPPSPPLIVISDASSDEAVAPPDAPTTEIADPPVSPIRGIVDLSDLSSGEVVALTNSPV

SEQ ID NO: 124195 - protein, 117 aa, Glycine max
  Coding DNA Sequence Number=SeqID_32510
  Subcellular localization annotation: CTP_CleavageSite=44; ConfidenceScore=5.57e-01
MLHKIASSSSSVISWSLHSQNSQKKLHPFNFKIQLQIGNSIGMCALSGRSSRLARPGGSSGALSKLILAERIIDNSFASRIFYALSHELLRLADGSLSQKIGLESSSKSTLPPNLPN

SEQ ID NO: 124196 - protein, 162 aa, Glycine max
  Coding DNA Sequence Number=SeqID_32511
GTSTWVVVTKNKKGYISYGSVLVEGLYKVEKKSQGLQVAWGLDVGTDIKKECSKDPVLTTKVRQRPPLKRTLEDKRLVMGVACHMLPQKGRVWWLNEWSCCNTIPQGIETDTTWKGCRARSIAGTHAQLGAAKEEQVTLEVSDEDGITIGKETAREAIVLAD

SEQ ID NO: 124197 - protein, 198 aa, Glycine max
  Coding DNA Sequence Number=SeqID_32512
MGEIIKHLAEVRHMAVEGGVVHQDVIEEHDDKTMKEWFQELVHCCLKCGGHIAQTKWHHFVFRVSLLSAECSLSNIIRRHQNLVKPLSEIQFGEPRCRAKFIKKLIYGRHWEAAGGKHVMHLLLDFSFLKMRIADVAEEGWRVVGTSENIGGGEKVSDGNMKKRRCGVGLHQAPELDKGRIVSDGGPELFEPLDAKDK

SEQ ID NO: 124198 - protein, 245 aa, Glycine max
  Coding DNA Sequence Number=SeqID_32513
  Homolog annotation: Hit_ID=A5BT79; Match level="QueryCoverage=77%, HitCoverage=21%, E-value=2e-40, Identity=45%"; Hit description =Putative uncharacterized protein
  Pfam annotation: Domain name=Ank; Domain location=112-144; Score=1.6; E_value=19; Accession=PF00023.21; Description=Ankyrin repeat
  Pfam annotation: Domain name=Ank; Domain location=146-178; Score=6.6; E_value=3.6; Accession=PF00023.21; Description=Ankyrin repeat
  Pfam annotation: Domain name=Ank; Domain location=41-73; Score=6.3; E_ value=4; Accession=PF00023.21; Description=Ankyrin repeat
  Pfam annotation: Domain name=Ank; Domain location=77-111; Score=10.8; E_value=0.89; Accession=PF00023.21; Description=Ankyrin repeat
  Pfam module annotation: Pfam domain module=Ank::Ank::Ank::Ank; Domain location=112-144::146-178::41-73::77-111
MAVADSISFQEQLLQRVASAQFRKPLLHLVSTQEDKGRYLTQCVPLHKASLKGDWKEARKLLDQDGSLLKTAITKGGWATLLHIAVGANRVHFVEELLKLMQPEELELQDHKGNTAFCFAAAVGNVQIAEMMERINASLPTIRGGGGLTPLHLAVLQGRKEMAWHLFPKTKEIFEEVDWTILFINCIKSGLYDLALEMLNEKDMLAYARGEENQTGLHVLARTPGCGCQLRCRKHLLHFCKWLYN

SEQ ID NO: 124199 - protein, 18 aa, Glycine max
  Coding DNA Sequence Number=SeqID_32514
MTVDTSFVHLTAVVASLV

SEQ ID NO: 124200 - protein, 45 aa, Glycine max
  Coding DNA Sequence Number=SeqID_32515
  Gene Ontology: Mol. function=methylcrotonoyl-CoA carboxylase activity; Cellular component=mitochondrial matrix
  Homolog annotation: Hit_ID=A7P9K7; Match level="QueryCoverage=93%, HitCoverage=7%, E-value=1e-17, Identity=97%"; Hit description =Chromosome chr3 scaffold_8, whole genome shotgun sequence
MTCPVHGRLCMFVANDPTVKGGTYYPITAKKHLRAQEIAAQCKLP

SEQ ID NO: 124201 - protein, 60 aa, Glycine max
  Coding DNA Sequence Number=SeqID_32516
MGCQWPKAKTVSWKGIYQDTGHCSFDRQVSPFAKRLLLAKCIITYALSHEFKRLVHHPGT

SEQ ID NO: 124202 - protein, 147 aa, Glycine max
  Coding DNA Sequence Number=SeqID_32517
MLRVMRQFGLGQKIPDDPPNLDELHDMDMRYYSGHHHHQSHIEPNVPLVHVSRYMPQHHQPHAQSIYQSTGFFGYMSQGCQQRLSQRFGTTFNTPPSAYNPPPSSSSYCPLLPIQMHDMSYEDEDEDDDNNNTNNNDDGHGGDGAPQ

SEQ ID NO: 124203 - protein, 107 aa, Glycine max
  Coding DNA Sequence Number=SeqID_32518
MISRLSQQIQVQVQEKFDFKIQEKMNSSFKRRIQEDITRGKGTSTWVIVTENKRGYISCGSVQVEDTSLGCYKENKGGYIPCGSLLVKDFTRLKRNLKDRRSLKDWM

SEQ ID NO: 124204 - protein, 308 aa, Glycine max
  Coding DNA Sequence Number=SeqID_32519
ASQGSFVPHGRQDILTAAIGRPEHPGRVRAVGVVVTIKQYIGSASRTSRSSSSMPPEDLEQLTQQIRDQLEESITEKVTRKMMESFSQMQSQFQSQMQSQGLALPPEPEVGPLGPRVSTKESCVAPSGNDPGTVDNIPLLHGQVKVGVEEIKDGEALLPVPTDEVTLVGQALNTFLAWPTHLMKRLLEQAAVSPAKPPEIPDEEVDDPLYLMTLTIPQLFLKPLQVMWDATIFEVFNQNFPLYIKHEDLFEIAHDGQCLSISVIQLWILHLTKTSVRAGNSDVYGFLEPQSIQRSGQSQFESESYIKS

SEQ ID NO: 124205 - protein, 112 aa, Glycine max
  Coding DNA Sequence Number=SeqID_32520
  Gene Ontology: Mol. function=DNA binding; Biological process =regulation of transcription
  Homolog annotation: Hit_ID=Q0PJE3; Match level="QueryCoverage=49%, HitCoverage=36%, E-value=1e-14, Identity=74%"; Hit description=MYB transcription factor MYB167
MVAELGQQTVELSTLVTRAANDKSSDFLFLLNLLFVHRPIGSGDCSPRDSATDKGSYEQRPSSFAPKAYEMEVSCSSKINNTKNDTNLMSNSSNKDMFLDSYTTSWQLHQIF

SEQ ID NO: 124206 - protein, 142 aa, Glycine max
  Coding DNA Sequence Number=SeqID_32521
  Gene Ontology: Mol. function=protein serine/threonine kinase activity; Biological process=protein amino acid phosphorylation
  Homolog annotation: Hit_ID=A2Y546; Match level="QueryCoverage=27%, HitCoverage=4%, E-value=2e-11, Identity=74%"; Hit description =Putative uncharacterized protein
MSFEMDLIAKLHYPYIVEYKDAWVEKDDYICIITGYCEGGDILCCVLGLVLAVLGYSAYTYPKARNINGCLQGKETLSVYLEYVSSNSNVLKLERNESGIHTGNHGFIRDFQARDVLAVELLQKDARLAASGELGKACPGGT

SEQ ID NO: 124207 - protein, 403 aa, Glycine max
  Coding DNA Sequence Number=SeqID_32522
  Homolog annotation: Hit_ID=Q6WAY6; Match level="QueryCoverage=83%, HitCoverage=67%, E-value=2e-17, Identity=26%"; Hit description =Putative uncharacterized protein
KHLEEKAKALVDQGEWTSFVDVLALLVFGIVLFPNVDGLVDLTVIDAFLAYHYSKESPVVAILADAYDTFDPRCKKSSTRIVCCTPTLYVWLVSHIFLHASRPICPLQGDHMVPKRPLDGNEGCINYNLVHAIRQLGYHMRGAPSEESIAQGFSDPNAKMLQRVRKTNAVQRKDKELRGSSNGVISGYHKWLKARMQGITWLPKLKISSGEETEVPEESEEVQALKAELERKRVVKEKFKTTTIRIRKECDKLRDVNMAIAEALERETKRGFMGQQQRTQALKGRKGQVKDGKYDIRGQVEGLSKKLNLAAIHEQKLEDEHAKVSALQAEREARERVIDSLHGEAMKWMDRFAFTLNGSQELPRLLARAKAMADVYLAPEEVHRLFNYCQHMIELLSHIIRNR

SEQ ID NO: 124208 - protein, 290 aa, Glycine max
  Coding DNA Sequence Number=SeqID_32523
HQFRSEEHQCHFEAIKGWSFLKERQVQFREGEYAEFQDEIARRQWTQLAAPMAKYDPETVMEFNANAWPTEEGVRDKRSWVRGRWIPFDEDAINQFLGHSLVLEEGQCCEFSLRRSQASGSSPEAWQGDSNILPNDHNFDLPLPKCQLVYAILSVHVAQLVSDAIYQFKRITPPRNPMDPEKSNRALGFLVLITGLCQFYGVLANPTKLIWPPINRDFILNESFYQYTLHQQSYDPSPFSWPTLEQFGATVAWLGDKPDFQAGVGPVGAPEDEDGAQEDDDMADVMEYFL

SEQ ID NO: 124209 - protein, 130 aa, Glycine max
  Coding DNA Sequence Number=SeqID_32524
MTATLGPLVSMLSSLEKEKVESNKWTARVCLVGMQLLPSDTMTTDQRTTMAPKGTNSPGRAAMVPSALSSINRPEGELRGRFQGPKGEGIEIREKKEEERRENEAEALPNRNRDHSLLRSLFCVLRTIVD

SEQ ID NO: 124210 - protein, 205 aa, Glycine max
  Coding DNA Sequence Number=SeqID_32525
  Homolog annotation: Hit_ID=A5AIH8; Match level="QueryCoverage=64%, HitCoverage=20%, E-value=5e-17, Identity=36%"; Hit description =Putative uncharacterized protein
MPRRRNISTEKFLSKEESRIQAPTKPSKEQHKIQTPTKKANANGTVEEPEKSSKLRTSIGKKSTEVSNSRLPRNLVKVTLSNRKVTDAKVMKHRDAAQIAATEAMQEAAAAESLLQCLSTSEHPERNAKSAPQTAHDNDHKPSPSSETEHDFHKPTPLSTSSPNKQTKKKNKKKTTKTKVAKKKKKLYLGNVATFHGHEEVVQRS

SEQ ID NO: 124211 - protein, 302 aa, Glycine max
  Coding DNA Sequence Number=SeqID_32526
  Gene Ontology: Mol. function=motor activity; Cellular component=cell projection
  Homolog annotation: Hit_ID=UPI00016621D1; Match level="QueryCoverage =92%, HitCoverage=41%, E-value=1e-23, Identity=34%"; Hit description =UPI00016621D1 related cluster
IAVLAFRGLHILDFRGLHILTFRGLHVLDFRGVHVLAFRGLHVLTFRGLHVLTFGGLHALAFRGLQALAFRGLHVLTFRELHVLTFKGLHVLAFRGLHVLTFRGLHALAFIGLHTFTFRGLRIFAFIGLHALAFRGLHVFTFTRLHVLAFRGLPALAFRGVHALAFKGLHILVLRGPHAITFRGPHVLTFQGLHILAFKGLNDLAFRGLHVLTCERLHILAFRGLHILTFRGPHVLAFRGLHVLAFRGLHAIAFKGLHALDFRGLHILPFIGLPILGFGDYMLSISEDYTSSPLEAYASLPS

SEQ ID NO: 124212 - protein, 86 aa, Glycine max
  Coding DNA Sequence Number=SeqID_32527
MANIVKQLLAKPIKEAKAAKAAFYIDSNDLSTSVMTRGGNPGLLNHNIGFMTVFESRFFYIGCLATTDVEWVAFYSGSKAETMLNG

SEQ ID NO: 124213 - protein, 490 aa, Glycine max
  Coding DNA Sequence Number=SeqID_32528
MARTKKTGEMTIEDSFEEQVSQGSFVPYGRQDVLTAAIGRPEHPGRVCVAGVATNPANQGPARGVDHRKSDSAAHGIVQLDAVPVSVPDAISGTYTSSGASGNDPETGDSDKCGLYIEANLARLVALGRVCEGSTIVHNTPSLPGQVKVGVEEVKDPNALIPVPTDETVVSLAKPPQKPNLEVDDLLYLMTLIIPELFLRPCWVTWDATMFGVFNPDFPLYIKHEELSEIAHGAENYDLYGFLEPQSIQRSGQSQFGAESYIKSWMQSSKRDVYLGAYLNGGHWQMVVILPKENLVVWWSLGATMVFDGWVKDIFNLVVMEKFGGKAAWDKKGKKVSNGAHSSEADVGGSEKDSFNFQRHVFDVPFSCLKFYSQNLLCQSSRDDSAPMFGSVVDSFLSSDEDTFCETYREYSELPCHDVSLYEHFRHEEKRLEGDDSAPVIEAEVVCATSGNSASSMVPTRKNRIKWTKDLHEQFVAAVNSLGGPQSKLS

SEQ ID NO: 124214 - protein, 178 aa, Glycine max
  Coding DNA Sequence Number=SeqID_32529
MYKSINSAPCFRKFAKLLFLQVFKEQIEQLKEKEKVLLDENAKLTENGRLSEKIEAVANYQGDSYMGKPVRINCQKAILVMKCSALFSRPLSTSPNQLDGDKITGATNHKSVNLEGSLLVPHLFKDHRRCSYMIANALDKDGKFTTVQVSRKLKQLGLYLPLPKDGKFTTAQGVLLLN

SEQ ID NO: 124215 - protein, 604 aa, Glycine max
  Coding DNA Sequence Number=SeqID_32530
  Homolog annotation: Hit_ID=A5BSR3; Match level="QueryCoverage=19%, HitCoverage=36%, E-value=3e-10, Identity=35%"; Hit description =Putative uncharacterized protein
MEEKSKRGHEEHSCTESPTLNVDPPSPVARHLKWKIARTKRHGQMTSEVAQEIVDKIDSLQEQATQGSFVPHGRQDILNTALGRPEHPGRVHVAGTGVTISQYFGQASRASTTSSPSINQQQLADIIGVIKDDIRKQLQDEIRKEVQDEIRKEVQQEHKQQQEAWMRAIEEKQWKNLEMMKQELKKSLKVELSHIASHQSAPIEAPEIQALLARVSTKGSCAGPKGSGLLKELLSGGDDLMGLFVVVGENTVLAGLGKVFENSSTIQNVRYENDVVKFQVVRTYMPHAEVPIPTSEVHYLEQAVGTFVAWPTHLVREVTNEVVVGPDKPPSRSVGEPNRLTSVATDDPLGELVKKSYVVYTKPMELAWDGAKFGLPNASNGDKCLNIFVLKLWMMFMNDWSTSIGFSPVYGFLEPQSIRCIKDTREECQKYIETWVKESHREIYLGPYFNQAHWQLLVLCPRENIIVWLCSIRRKPDVHIKFAVNKKYAVISKARTMHLHLHLNGLRLSHVQQGGYECGYYVMHWMWCIVSAGLKNELHNYFSDGTALDTDTMTTIHKKWAAYFLEVGKWMSAFDMLLLGSFSPPQPSHTLVQEIIGKATQVLQ

SEQ ID NO: 124216 - protein, 98 aa, Glycine max
  Coding DNA Sequence Number=SeqID_32531
MECTKEDIEHTKDNGGQEPYIGMKFESKEKAYLFYTCYAKIIGFGCEKCFLGGCKCRNDYQEFGDLVSFETTYIMIEVQPARLMILYKDCRSYDKVQD

SEQ ID NO: 124217 - protein, 718 aa, Glycine max
  Coding DNA Sequence Number=SeqID_32532
MGESAASSGTKGLPPCPSAQNLAILEENGQRHQEALSKVAFLEAKVAKWRAIAHTVWRMEHPKVASATIAFTEVMKSNHQLSTKEKDDLAGKVESIRVEKDELAKVVAEAQLKESESELRASKEREANKELEEELMMYKKKDVKDGVLLDEEDIAAKEEATEEEQDIEEKQDLGGLVTHLVMLPFALPNFSLMLVRSWFDLHLVEGLVEEFGGSLLRLVEHGHLTMVVIVPREPCVPVEMELSNKGAYQGTDLEFNEPWIKDVFALGFGEAHQGLTRVDLGFCEPLEKRDSPRADLGFDEPMRLTKDSSRADLGFDEPLENRLAIHPKFWRDSPRVDLGFDEPVRLTKDSPRADLGFDEPLENRPAMCPSWILARLTKGRPWVLRAFGEARLTKGGPWVCCDPEWAFLVGTKLSRSGDLFWLCLGLAIRGHEVEKFMVEPLYCIFLKLKACLLVDSSLTSTGSCHLCNILVKSSAQSLEDYSIGYLCLTVSLRMFNKGVVVDDNGIREAIPAYEVFPATSKYLTAPRAFGSGLSMSIPHMEKGQGELRLWRLLGGEILVGGHSVWFLLFSDHNFLSVYGGSLEHFMDDSLEVSSLFGSSQLGEQVYYGVALLGYVVHLKAFEVVNETFGNVSDIVRAFEDDSCTAPLHIGRIINVEAPPVLGDGKLVADNVGVDSEHDINDVSMLMAGEFLLSCVHYPGLCLSCSLTSSSIGFGHISE

SEQ ID NO: 124218 - protein, 156 aa, Glycine max
  Coding DNA Sequence Number=SeqID_32533
  Gene Ontology: Mol. function=DNA binding; Cellular component=nucleus; Biological process=regulation of transcription, DNA-dependent
  Homolog annotation: Hit_ID=A2Q4T4; Match level="QueryCoverage=62%, HitCoverage=24%, E-value=4e-28, Identity=62%"; Hit description=SBP
  Pfam annotation: Domain name=SBP; Domain location=74-156; Score=74.2; E_value=4.3e-19; Accession=PF03110.5; Description=SBP domain
  Subcellular localization annotation: CTP_CleavageSite=60; ConfidenceScore=5.33e-01
MGSASVTKAPPSSSSSPNSSSTESLDGLKFGQKIYFEEVSVAAAAATTTQGGNKTRGGVSASKKGRGGSVQAPRCQVAGCKVDLSGAKAYYSRHKVCAMHSKSPTVTVAGLEQRFCQQCSRSLPTNVQTNYAYWTHVTFNPFKMQHVLRGKIDLID

SEQ ID NO: 124219 - protein, 349 aa, Glycine max
  Coding DNA Sequence Number=SeqID_32534
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=42%, HitCoverage=23%, E-value=2e-57, Identity=76%"; Hit description =Chromosome chr13 scaffold_17, whole genome shotgun sequence
  Pfam annotation: Domain name=Arm; Domain location=34-74; Score=8.8; E_ value=0.84; Accession=PF00514.14; Description=Armadillobeta-catenin -like repeat
  Pfam annotation: Domain name=Arm; Domain location=75-115; Score=17.7; E_value=0.045; Accession=PF00514.14; Description=Armadillobeta -catenin-like repeat
  Pfam module annotation: Pfam domain module=Arm::Arm; Domain location =34-74::75-115
LSEDAAITLIKLLCEGTPTGKKDVATAIFNLSIYQGNKPRAVKAGLVAPLIQFLKDAGGGMVDEAVAIMAILASHHEGRVAIGQAKPIHILIEVIRTSSPRNRENAAAVMWSLCTGDPLQLKLAKEHGAEAALQELSENGTDRAKIKARSILELLWSEKLEDLWQLKIPLKPTTFAWRLIKDTIPTKGNLRRRQFLWGGGMEQRKIAWVSWKEVCQPKDKRGLGIKDLKNFNSALLAKWKPRLYLMEGPAIKSAATTEPGSQNEKKLEGGRLYRISDQQKQIIMNMGNNTNGGWEWKLSWRRAFLIVKFKWQIISLENYHSSRFSQIGRIGGAGSMIKVDTTQQKADMT

SEQ ID NO: 124220 - protein, 145 aa, Glycine max
  Coding DNA Sequence Number=SeqID_32535
MEINHLKDEYADAYENTFHAKRVKKEKEMELALKNMQNKLNTKANQSELKLTKKIDELTLERDTLKLDVEGLHLMMVKHHWQKTKEWIKTCKEMTDCIQNYVANLTTQVHEAVQEFNANPERKLPWKIYKLLKYFQDLTKSFSTE

SEQ ID NO: 124221 - protein, 69 aa, Glycine max
  Coding DNA Sequence Number=SeqID_32536
MAIVTTVVLKVTVLCPCKGCNNRIHRAVVGEVKRKIEAIVTTVVLKVMPLCPCKGCNNRIHRAVLKNKG

SEQ ID NO: 124222 - protein, 33 aa, Glycine max
  Coding DNA Sequence Number=SeqID_32537
MAGTDSDTTIIDGLGVDGWGVGGIEAEATMLGQ

SEQ ID NO: 124223 - protein, 50 aa, Glycine max
  Coding DNA Sequence Number=SeqID_32538
MEVEESSLGLWLPLHYSVDMGQASFVADLGVAFVDDWVFLVGGVVGNEKD

SEQ ID NO: 124224 - protein, 90 aa, Glycine max
  Coding DNA Sequence Number=SeqID_32539
MLRFKKKLVRGEQLRSMSHVTTYPTMGVWAKSQRSVFQKEKLVGVATHVYSRENGAALAPTYPQAKGHFGAVATRPGELKLNPEVVSSPR

SEQ ID NO: 124225 - protein, 112 aa, Glycine max
  Coding DNA Sequence Number=SeqID_32540
MGADLALVKEFYANLYSSEDYPPKFPTDYREIEVVLCIPGQGFILNSKGHPGKVLRKDLTTLAQVWSVVSYSKLAPTSHTSDLTMDRARLIFGLVSRLNMNIGALISGQMTL

SEQ ID NO: 124226 - protein, 46 aa, Glycine max
  Coding DNA Sequence Number=SeqID_32541
MVIFHHGDAAEDKGEEVASLRSFLKKTSLRSFLEKLELSYTHPSKN

SEQ ID NO: 124227 - protein, 56 aa, Glycine max
  Coding DNA Sequence Number=SeqID_32542
MDAFYKKWREGGSQRSRAREWKLPSSNNNMRWRRGEDGQGNGRRWRRGEDGQWKWK

SEQ ID NO: 124228 - protein, 97 aa, Glycine max
  Coding DNA Sequence Number=SeqID_32543
DNNSSSDTNIDNNSNSVDSDVCDNNNNNGNNDNMVLTVTKVPVLVLDNGNDNNDGDCISSGGDSSNHANDGDSSGDNKMVIVKCKECVYLKLKIKFK

SEQ ID NO: 124229 - protein, 143 aa, Glycine max
  Coding DNA Sequence Number=SeqID_32544
  Gene Ontology: Cellular component=membrane
  Homolog annotation: Hit_ID=A7NVB4; Match level="QueryCoverage=39%, HitCoverage=14%, E-value=3e-14, Identity=64%"; Hit description =Chromosome chr18 scaffold_1, whole genome shotgun sequence
MATSLWIMDRAFELMQRSDIIIQGLTILAPVDSPNTDGIDPVQFGSAGMFIFAMDSIKKGMSHYVFIVYRNAIASVSLAPFAFVLERKVRPKMTFRNNVGPVHRPLGHEIHVGIFPICCYELRSLCYFCDGCHSKICLLPLNL

SEQ ID NO: 124230 - protein, 125 aa, Glycine max
  Coding DNA Sequence Number=SeqID_32545
  Homolog annotation: Hit_ID=A7R463; Match level="QueryCoverage=83%, HitCoverage=65%, E-value=6e-18, Identity=48%"; Hit description =Chromosome undetermined scaffold_621, whole genome shotgun sequence
MYTLFEANHKGCTLPCVHYYNQEATRFLHRILRRFASTYTYTVLASAYSNGGEMEDYGVCPSVDEYDKLIQSLWLEALDWEMAEKLQEEMKESGLRLKSITRGLIRAVKETDKEVVEAESITVVA

SEQ ID NO: 124231 - protein, 33 aa, Glycine max
  Coding DNA Sequence Number=SeqID_32546
MVISLRGYCEEGEVVGEEVVVVGVVRTKRMGLG

SEQ ID NO: 124232 - protein, 111 aa, Glycine max
  Coding DNA Sequence Number=SeqID_32547
LSAIAGNTGAKKGKVHGADLDGGRANLLNDRCSSRKLPRSTTASYLGNLLNEEEEEAQRRHASNEEEGAGRTRKKKQEEEEAGRRRRELIRKKKKQKRQRGEGEREVSFFF

SEQ ID NO: 124233 - protein, 111 aa, Glycine max
  Coding DNA Sequence Number=SeqID_32548
MEREMITMIVDTLPVFYYEKMVGYMPSSFADLVFASERIKVGLRRGKFDYPALMNKKPGANGRNKKEGETHGVVATPTRPNFPLAQQYQFSSNISPSHYPPPYQPKTPNHP

SEQ ID NO: 124234 - protein, 313 aa, Glycine max
  Coding DNA Sequence Number=SeqID_32549
MTNSDGGCDAKVKNNKGATCELKENPTRGLGGKLKTTELERGDQKESKGGTSGVKTIGGRGYGRTAKGFPTSFRNDHGGENSAKLFVSHDHSLLVHGVACKTVLGIIGSAKCCDHGRGLIPCNMPHRGGGGVMVSSSVNHDVLDRPRVVVEAVEMIPLNTTRRAILKDVNNVGLLKFQISTSRDGPMEKFARNKGNQRNSKQKGNKDDQGSRPPTWGVGNDGGAQWKLYGFKSDHQVNMLDLDPRRDFEEWRSTPIEDLKDIMIGEGRIIKIRSTLSPKVEFELLEIEIDSKFMCHQLSLDPKAKPISKSGGS

SEQ ID NO: 124235 - protein, 44 aa, Glycine max
  Coding DNA Sequence Number=SeqID_32550
MDTDMLFHEFGFIAAGMSGEVFDGQDAGYVPENPVSWLTMIKLL

SEQ ID NO: 124236 - protein, 88 aa, Glycine max
  Coding DNA Sequence Number=SeqID_32551
MPKIPIRCSMRTCLIYIRKVSIMVIQFLNALCRNVPFCGRAKERLTGELSKGGKMRGVATNVYLWETSEKPKETGQKENSKFGSCIYA

SEQ ID NO: 124237 - protein, 147 aa, Glycine max
  Coding DNA Sequence Number=SeqID_32552
MTKNNEVTSRQDARRSRIEVHAKCGCEDEEDHVGCSTVSLLFCERHDCNGSSPIHQNFLDCRGTIMTEGPRHDVGSKDSKETLPIVESPRTKLKASYTFPSGTRCPLVLETSVEEATSSITKLRALESKEEEDIERTSHDNLPRSSV

SEQ ID NO: 124238 - protein, 80 aa, Glycine max
  Coding DNA Sequence Number=SeqID_32553
  Homolog annotation: Hit_ID=A2Y2J4; Match level="QueryCoverage=96%, HitCoverage=15%, E-value=3e-07, Identity=38%"; Hit description =Putative uncharacterized protein
MEGGIGPILDLTPKEKKRIEGLKSEERKVPLATLSFQGYALYWWTSLVRERKIHGGPTIEYWNDLKSSLRKRHIPSYYEM

SEQ ID NO: 124239 - protein, 45 aa, Glycine max
  Coding DNA Sequence Number=SeqID_32554
VADSDDEGSTDLRTNPLQEGGDDAILPNPSPEPWLGDSRKIGPGM

SEQ ID NO: 124240 - protein, 125 aa, Glycine max
  Coding DNA Sequence Number=SeqID_32555
MELEATPISTLDSASPMIGSTWCVKKNLEKGKEAINEKSLIASPTIMMIGIRRLAAGVSLSKAYALSENHALSQALSLLSELGEFGGESEKHLRTQRVISSLSEAFVSYRAKRALLAQQIFTNSR

SEQ ID NO: 124241 - protein, 119 aa, Glycine max
  Coding DNA Sequence Number=SeqID_32556
  Homolog annotation: Hit_ID=A5BLQ0; Match level="QueryCoverage=41%, HitCoverage=12%, E-value=3e-13, Identity=73%"; Hit description =Putative uncharacterized protein
MSPNVAEVLDMVMKYAVFHDIQPLTMHIDLTGTASMSKIYDDGYIPKHSVLELQKAWPGSEVRWVTGGHVSSFCPMVNSEGLLLKALIDYRGRSLHCDRDIAQAQEIVLQIVKILFFQL

SEQ ID NO: 124242 - protein, 91 aa, Glycine max
  Coding DNA Sequence Number=SeqID_32557
  Homolog annotation: Hit_ID=A5C9E2; Match level="QueryCoverage=63%, HitCoverage=7%, E-value=5e-10, Identity=55%"; Hit description =Putative uncharacterized protein
MASSNSPWTKLGYDSYGLAYILCKLCKWKFKLYKASKELTDIETQRKQEANEFSFKLESTRRKLKEAIEEIDESKELEMKLVVTILDVDFL

SEQ ID NO: 124243 - protein, 135 aa, Glycine max
  Coding DNA Sequence Number=SeqID_32558
  Homolog annotation: Hit_ID=A5B7U7; Match level="QueryCoverage=99%, HitCoverage=12%, E-value=4e-22, Identity=42%"; Hit description =Putative uncharacterized protein
MVRNMISHSSLPKSLWGESLKTAVYILNRVPDTTLVIEDNVQTIDIVSKQDNNEVLPQIPLEQPQQPQEVPLRRSIREKRSAISNDYVKFFQEHEDGVGLTEDDPINFCQAMCSFNSQKWIDARKDEMKSMNDNE

SEQ ID NO: 124244 - protein, 122 aa, Glycine max
  Coding DNA Sequence Number=SeqID_32559
MIPPTPTQIPLPAPLSAGPTDFIFTPQMLHYMLHTIHRGQSIIIQSLQGLGFPSIMSMEEFDAQEPMTKEPTTPVPSPAAVEEETTPAQTPQPSPPSAPAPEETQPSALDINEDQPQEEQDV

SEQ ID NO: 124245 - protein, 102 aa, Glycine max
  Coding DNA Sequence Number=SeqID_32560
IIPFDKHIAAIGTTSNNMLSKRKTLDEGSLLSSKSEIQHDHKFTSTPYVPMDPVESPTVATYPSAVGRRETHVCIFQERKMRGVAINVYLRKTSENIGKTGK

SEQ ID NO: 124246 - protein, 192 aa, Glycine max
  Coding DNA Sequence Number=SeqID_32561
MTSRHTPPIEVDIQLLAARVSTKGNYAETAANPSGEEYVIDVVPKMGLYVQCHHCTCLVALGKVYNGASTICNVAYEDDVIRDSQIHPKKPIETIQRSNTLGRVEPLGDLIHNLYDVYEKLLELLWDKSKFRILNVEASFFIIYDVNEIIPGLWMSGVQGWVMVRCMNSLSLSPYTMQRIDVLNVNNTLKHG

SEQ ID NO: 124247 - protein, 126 aa, Glycine max
  Coding DNA Sequence Number=SeqID_32562
MPDPQKRSSRDMCSWEKGQWIPFDADALSQFLGDPLVLEEDQQCEFSQRRSQADNFDEEAIALLLCIPRQDFSRTVAGRRVRIMRTSMTTLTQIWMTLLLSNVLPSNHNSDLPLPKCQLVYAILTG

SEQ ID NO: 124248 - protein, 187 aa, Glycine max
  Coding DNA Sequence Number=SeqID_32563
MESGDMRRYLMVIRTFRQPGANELVGAQRLTSSYAPFAIQGQRVRWPVEIPYGHLHLSSTEANEFDGIRMIRPETCKPDDAQDSSLMGGEDQVRWRREVSWLSPFIAFKTPKGVQIAVRPTWAFQGVPIEGGGFCWKQPSSPGEENCFREKNPSRGASVTLPRRFREQFREDSSPFFIILRRSSVFN

SEQ ID NO: 124249 - protein, 371 aa, Glycine max
  Coding DNA Sequence Number=SeqID_32564
MASRKRKAPSTPTQDRFDRSRFTSQEALERYTDIVVPRKLLPERNVVVYYTEFDEFKEELEIHHWDEELTNFLDDNIDVAIVKEFYANLYDPEDKSPKQELAAKLCLLGRGFELNADGQPLKILRKNMTTLAQTWSVLSFSNLIPISHTSNVTLDRAKLIYGIIMKMDMNVGYLISHQIFFIAQHDTSRLGFPALITTLCKARGVQSYSRSLESLSPAINLAYIKKKCWNLDDPIITFRGPRKAMGKRSEAPSSSAPETPAPSSSTAPLPLIQTPVIPPTPTQIPLPAPLSVGGGASAAQEPVTEEPPAPAPVAAAAEGEDELTPPEPFYFDANPYMEQEKGTLTDQIPEPSSAPSPEETQPSTPVAEHKQ

SEQ ID NO: 124250 - protein, 175 aa, Glycine max
  Coding DNA Sequence Number=SeqID_32565
MAKFDPEIVLEFYANAWPTEEGVRDMRSWVRGQWIPFDADALSQFLGDPLVLEEGQQCIAPTRHPLDLDKSNRALGFPALITGLCQSYGVPVTPNKYYTPRQAQGDAHQAADAQPPPRQADPAGSLGVERYLQHLVLQQVANHRGQQGQGSTPFVCPTPEQFGAEVAWPGDWLDA

SEQ ID NO: 124251 - protein, 150 aa, Glycine max
  Coding DNA Sequence Number=SeqID_32566
  Subcellular localization annotation: CTP_CleavageSite=53; ConfidenceScore=5.01e-01
MSSDSPSLDDKGADDDVSLCVSTGSLASGSKGADNHKVSPYVMTHRLWMTKVRMMTLVSACQWARLPLVEIRGITIRYLCMSSNSPSLDDKDADDDVSLCVSMGSLASGSQKVRITIRYLRMSSDSPSLDDKGAADDVSLCVSMGSLASG

SEQ ID NO: 124252 - protein, 79 aa, Glycine max
  Coding DNA Sequence Number=SeqID_32567
MLLIPHDVAPYGACRPWIFFINRFLCFLRSECNGMEKEKDEWRCHFKGMEKEKDDWRCHFKEKMSQEEAHHHRKPWIRA

SEQ ID NO: 124253 - protein, 72 aa, Glycine max
  Coding DNA Sequence Number=SeqID_32568
MNEDMKLTSSGSDSGCEKQHGVGVRKKICDMVEAAQNCDEDDDVEATQSCNAHEETLQTYFLDKPMLTNIMK

SEQ ID NO: 124254 - protein, 1477 aa, Glycine max
  Coding DNA Sequence Number=SeqID_32569
  Gene Ontology: Mol. function=motor activity; Cellular component=cell projection
  Homolog annotation: Hit_ID=UPI00016621D1; Match level="QueryCoverage =99%, HitCoverage=47%, E-value=5e-22, Identity=31%"; Hit description =UPI00016621D1 related cluster
LHTLALGELHVLTFRGPPILAFRGLYVVAFKGVHVLTLRGLHAYAFRGPHVFAFRGQHILAFTRPHVLALRGLHILTFRGLHVLTIRGLHALSLSGLHALAFRGLYVLAFRGLHVVTFRGQHVLTFRGLHVLTFRGLYALAKARATRPRLQRTTCPRLQRTTRPHLQRAICPRLQRTTCPRLQRITRLHVLAFRGMHAFAFRGMQVLAFRGLHILPFRGIDVLGFRGLHTLTFKGLNVLAYRAHVLAFRGILVLTFRGLDALAFRGLHARALRRMHALAFIGLLDLTFRGIHVLDFKGLHLDALAFRGLHAFAFRGLHVLALRREHALAFRGPHVLTIRGLHILVFRGLHALSFRGKHVLAFRGLAARPRLQRVACPRLLRASHPRLQRGARPRLQRVARRRLQSTARRHVLAFRGLHVLTFRGLHVLTFRGLHALALRGLHAFTFRGLHVLELRGLLIFALRGQHALTIKGPHILAFRGLHIHSFRGLHAVTFKGLHVLAFRGLHVLPFRGTHVLTFRGLHSLALRGLHAFTFRGLHVLSFRGLHVLAFRGLHDLYFRRLYVLTFRRLHALAFIGLHALTFIGLHVLTFRELHVLTFKGRHMLAFRGLHILTFRGLHDLAFIGLHAFEFEGLHVFTFTKLHVLAFRVLHAFAFRELHDGTSSPSEYCTSSPSDGRHVLAFRGLHVLTFRGLHVLTFRGLHALALRRLHAFAFRGLHVLELRGLLIFALRGRHALTIRGLHVLAFRGGLQVLAFRGLHVLPFRGTHVLTFRGLHSLAVRGLHALTFRGLQVLAFRGLHVLAFRGVHVFTFRALHVLAFTGLQDLDFRGLYVLTFRGLHALAFIGLHALTLIGLHVLACRGLHILAFRGLHILAFRGLHILAFRGLHALALRGLHALAFRGFDILAFRGLHILAFVGLPNLAFGGLHDYTFSPLEDYTCSPSEDSRSSPSKDCTSSCSNDITSSPLEGYRPSHSEGCLSLPLEGHTGLHAHAFRGSHVLAFKGLHILVFRGLHALAFRGLLSLAFRGLHILAFRVLNILTFRGPHVLAFRGLHILALRGLHALAFRGLQILAFIGLPILAFEGLHVLDFRGLHVLAVRGLHILSFRELHAFTFKGLHVLTFRAQQVLAFRGLHVVPLRGTHRTTRPRLRRAIHPHLQISTRPDLQRTTRPRLQRATRPHLQRSTRPQLQRTTRSQLQRTTRPRLHRTTRPHLQRTIVLTFRGLDALAFIGLHTLTFVGLNVLTFRELHVLTFKGLDELAFRGLYVLTFRGGLHALAFKGLHALAFRGLHVLALRRQHALAFRGPHVLTFRGLHILRTAGLDNLAFIGIAVLAFRGLHILDFRGLHILTFRGLHVLDFRGVHVLAFRGLHVLTFRGLHVLTFGGLHALAFRGLQALAFRGLHVLTFRELHVLTFKGLHVLAFRGLHVLTFRGLHALAFIGLHTFTFRGLRIFAFIGLHALAFRGLHVFTFTRLHVLAFR

SEQ ID NO: 124255 - protein, 215 aa, Glycine max
  Coding DNA Sequence Number=SeqID_32570
  Gene Ontology: Mol. function=motor activity; Cellular component=cell projection
  Homolog annotation: Hit_ID=UPI00006A2D9E; Match level="QueryCoverage =93%, HitCoverage=86%, E-value=5e-19, Identity=16%"; Hit description =UPI00006A2D9E related cluster
GLHVLAIRGLHVLAFRGLDVLAFRGLHALTFRGLHVLAFKGLHSLTFRGLHVLAFRGLHALAFRGLHALTFRGLHVLAFKGLHSLTFRGLHVLAFRGLHALAFRGLHALTFRGLHVLAIRGLYALTIKGLHALAFKELHALTFRGLQVLTFRGLHALAFRGLHILSLSGLHALAFRGLHVLTFRGLHVLACRGLHALAIRGLHIYALRQLKVLRP

SEQ ID NO: 124256 - protein, 349 aa, Glycine max
  Coding DNA Sequence Number=SeqID_32571
MISVNPDPRSQVAGGDTQVHAKTNVVICTLCQQGASEPVDTQRLTSSSAPLSSRDGESDDMRRYPSGHPYKMISVNPDPRSQVAGRDTQVVIKTNVVICTLCQLGASKPVDTQRLMSSSAPLSSRDGEFNDTWRYPSGGDTQVVIRTKRFMLILTQEVRWQAEIPYGASEAVDTQRLTSSSAPFSSRDNESDDMRRYPSGASEPVDTQRLASSSAPLSSRDGESDDMWRYPSGGRRRYPSGYLYKTISVNRDPRKTNVVIYTLCEPGASVTIDTQRLTSSSAPLSSRDSESNDMRRYPSVRWQAKIPQVVIHTNALLLILTREVKWQAEIPQVVIRTHAVLLPQPVRSQ

SEQ ID NO: 124257 - protein, 35 aa, Glycine max
  Coding DNA Sequence Number=SeqID_32572
MTPILDNSLFSQKDKLSRMLKMKSHKWENARIMYE

SEQ ID NO: 124258 - protein, 111 aa, Glycine max
  Coding DNA Sequence Number=SeqID_32573
  Homolog annotation: Hit_ID=Q2HW90; Match level="QueryCoverage=71%, HitCoverage=18%, E-value=5e-07, Identity=35%"; Hit description =Putative uncharacterized protein
MGSDQASSFKKIFYHVKVKNLEVANLRKLGQRMGQIWDLTMIEVSVEAIASHTQYYDQSLRCFTFKDFQLAPTVEEFEGILGCSIGGRKPYLFSGYYPSMARIAGVVKISE

SEQ ID NO: 124259 - protein, 83 aa, Glycine max
  Coding DNA Sequence Number=SeqID_32574
MEILMANTSTPYHKGDMMNETGHGYVMHDKHIYQLDTRGLKDHTFLLTMHWLLPWYPTHATKNAVQTFMLHCDFDNKEKEGKL

SEQ ID NO: 124260 - protein, 96 aa, Glycine max
  Coding DNA Sequence Number=SeqID_32575
MDKSLKVGENGMREKERRSTKFCSSKEQATAACGGHRWSWVVEEDVLGLGWAFGEKRSEKSCFHAAEHIYNLQISLSELVSLSESSLLALSATFGT

SEQ ID NO: 124261 - protein, 186 aa, Glycine max
  Coding DNA Sequence Number=SeqID_32576
MTWLQKLKGLSAEKAKMPEKSEKVQALKTELKKIKVAKEKLKVAVTRVRKECDELKDINMIAAEVLERETKRARKEEWSRNKFQGDLLGSSNELKLRKSEREKSRMESMMLEDKLKSFQRSKRCLTEQLIIHQYKEKVNLAASHSLRRRHHQNVIIVIKKNECALRHPYQTRAKARIMSEIEDVQE

SEQ ID NO: 124262 - protein, 68 aa, Glycine max
  Coding DNA Sequence Number=SeqID_32577
MNMMKVLQEHNKTFINWFKDLILGDDNASKTLRLLAVRTNLNVPTWKNRHKNEETFHDVGYDDSQKLS

SEQ ID NO: 124263 - protein, 143 aa, Glycine max
  Coding DNA Sequence Number=SeqID_32578
MDDLILNEDAHVVDLMVRDKTTSSKKDVHASIVNIAIQLEHLSPIQVEFKEVIPINESNDQKAEETQQAIDKQEEKHHTTIRAFTEQQWTEPEQHTQYMQASMVEQFKNLDNGEGRKMIGDLHFKERMSQEQARHHKKPWIRA

SEQ ID NO: 124264 - protein, 112 aa, Glycine max
  Coding DNA Sequence Number=SeqID_32579
MAHKCGSNAFQGYFDDAKESRVKQIPKIQESSFKNNQDQDSKIKRRGTSTWVVVTENKRGYISCGSVLVEGTSTRLFKENKGGYIPCGSLLVKDFTRLKRNIKDRRSLGDWM

SEQ ID NO: 124265 - protein, 126 aa, Glycine max
  Coding DNA Sequence Number=SeqID_32580
  Homolog annotation: Hit_ID=A5AKH3; Match level="QueryCoverage=87%, HitCoverage=20%, E-value=4e-07, Identity=31%"; Hit description =Putative uncharacterized protein
  Pfam annotation: Domain name=zf-CCHC; Domain location=93-110; Score =21.7; E_value=0.00079; Accession=PF00098.14; Description=Zinc knuckle
MKNGETILELQTRLTHIVNHLLGLGKTFEDDDLNIKILHLSSSKVDCKESSIDDEYVENLSLKVKKFGKFLKRSKERKFSKSSKKIESNNNTITCFECGKQGHIKSKCLIYLRKQLVEKKGKKDRK

SEQ ID NO: 124266 - protein, 171 aa, Glycine max
  Coding DNA Sequence Number=SeqID_32581
MGSNQAHAFKKKFSSSQGQVWKKECALQGPYQTCAKARVMSEIEEVQEQMKVDMEAMKDQMAAMMDAMLSMKKIMESNAAAIATMSAATEVNPTHPSGLNQVNPPVSDMSKILFHHKACLPTMHHPMLYRCPTRMQTTPLLFPLKASNPSWGMHILLSPWRGHMKYPETTL

SEQ ID NO: 124267 - protein, 89 aa, Glycine max
  Coding DNA Sequence Number=SeqID_32582
  Homolog annotation: Hit_ID=A5C9E0; Match level="QueryCoverage=69%, HitCoverage=19%, E-value=5e-07, Identity=36%"; Hit description =Putative uncharacterized protein
MAALDFTYESLCIQYLDEGVPYVLKIGLIHLLPKFHGLAEEHIFLMAFPHSLEGVAKDWLYYLAPRSIFSWDDLKRVFLEKFFPASGIL

SEQ ID NO: 124268 - protein, 85 aa, Glycine max
  Coding DNA Sequence Number=SeqID_32583
MDYTPPIVQPNDFLSNVYGTDCGTPASAREYMHKLQNKVGNFTPPSFNLMFNQDVEENNPSLHDIPNQRPRRNPGRNRRCPPCGT

SEQ ID NO: 124269 - protein, 188 aa, Glycine max
  Coding DNA Sequence Number=SeqID_32584
MSPNLSGMRTITKTMKSVFLRENKPKEGSNLLWNERLPKPFEVGRGGVKMATVVPRVARRSCVHLIGAMRPHPSILETGGQILQSMEANLDKKSSESMGVKACSFIIPEGRITSAQEKLETKEKLIFGFEDTASDIRITLAGLSTHKEGVNQVLVYKNTNPQGVLPLNHVPHKLAKKRGVGVTSYADT

SEQ ID NO: 124270 - protein, 85 aa, Glycine max
  Coding DNA Sequence Number=SeqID_32585
MIALMTLIVAPHMTVIIAVMTTTIMLVGAAAINNHGDGCGGGYDSCGRNGHDNGGGGGHSDNRFLESKCECEVPHRVGMRMLNTT

SEQ ID NO: 124271 - protein, 106 aa, Glycine max
  Coding DNA Sequence Number=SeqID_32586
MCLFKKLFLKFFIGNRLQSVKGTCYWVTKWVGVQSQVRLGDRLGRVRWRQWILGLGISCIESLPGDGFRWHVPWVEQQCKYLEHVGSNGHLGNTDENGYHVNETHT

SEQ ID NO: 124272 - protein, 122 aa, Glycine max
  Coding DNA Sequence Number=SeqID_32587
  Subcellular localization annotation: CTP_CleavageSite=41; ConfidenceScore=5.05e-01
MSRGSGDLGDVRWGAIAQNQAWPIPTQPGHSQSVRTCDVPKQASSWQSTNKRTKSTKQGGLCGGWPSIYLGCYLKNTLWALVINYRLCVIDYIVLPATGNRLPFMGNRLHSVTFRFQCAKAV

SEQ ID NO: 124273 - protein, 362 aa, Glycine max
  Coding DNA Sequence Number=SeqID_32588
  Homolog annotation: Hit_ID=A2Q6B4; Match level="QueryCoverage=32%, HitCoverage=59%, E-value=9e-11, Identity=28%"; Hit description =Ribosomal protein L33; Nucleic acid-binding, OB-fold
MDLKENCTYVMHNFKVLKNNGQYRVCDHQFKLVFIGVTIVADQFKPGLLVDVIGVVEEVVFRQVSGKGRRVVFKLKDLSQQLLSCILWDDYCSQFLKFLDDYEGDGPITVLLSHCRIKEAHGSYPTSINNSFKASKLIINQPVMEIQEFNERLVELGIEAQSGFKSHGEGSTQLSGSIQLSSKESFFGKAEAKTIADINTISEEIVCVTVDTITRIVLDNHSWYRLEVMINQGNESTKFLLWDRECSELIGQSVDAINKLKIEDGDVDLNASPQALDKLLGYELAFKIKVQTKFRNSAVLKCSADSSLINVVMDMLADAETSSKMNIPVSNSNHSAQHESQSLSVTTYHDPLLGLPLTPTKR

SEQ ID NO: 124274 - protein, 72 aa, Glycine max
  Coding DNA Sequence Number=SeqID_32589
MAAEWRRKRERRRHFKEKMSLEEAHHHRRPWIRAWRKKEMNERRGREEHEIFPLIQDQFQDSPLSVLRCHEA

SEQ ID NO: 124275 - protein, 68 aa, Glycine max
  Coding DNA Sequence Number=SeqID_32590
MKMLLIPHDASSIGASEWRRKRERRGHFKEKMSLEEAHHHRRPWIRAWRKKEMNEGRGREEHEILCSK

SEQ ID NO: 124276 - protein, 117 aa, Glycine max
  Coding DNA Sequence Number=SeqID_32591
MAELGLVYGVVIPPKFKVSDFDKYKRTTCPKNHLKEAWANEENKKEGGTHVAIPTWPNFPPAQQYQYSANISPSHYPPHYHPRTLNHPQRPPLNQPQKPPAAHPIPNTTLNTNQNTN

SEQ ID NO: 124277 - protein, 163 aa, Glycine max
  Coding DNA Sequence Number=SeqID_32592
MCFPVGMVERDVPISSYQILCTMNQSIVRMVDVVILQNTIHRGKGVSFTDYVPEPQIPCVLHSFIDSKNSAKDSLDRVIVLILFLEFWNSVIIYKHNIMLIRDFMNKTHSLHILREGNSVADSLAKLGSSDQDNSWIAFDDCPSSSRIHLIADAVGTRYLRLR

SEQ ID NO: 124278 - protein, 69 aa, Glycine max
  Coding DNA Sequence Number=SeqID_32593
  Subcellular localization annotation: CTP_CleavageSite=45; ConfidenceScore=5.02e-01
MFLSSQHVKSISLLAFLLMQAPLELVGLGSSSSMDSFASWKMNGSGMEKEEREETPLQGEDESRRSSPP

SEQ ID NO: 124279 - protein, 58 aa, Glycine max
  Coding DNA Sequence Number=SeqID_32594
MVIFLHGDVAEDKGEEELRHQECVLDKKLEDDASIEAKPERERERGSTELKEEKGERS

SEQ ID NO: 124280 - protein, 105 aa, Glycine max
  Coding DNA Sequence Number=SeqID_32595
MRGYLRVTRTFRQPGASEPVDAQRLTSSSAPFAIQGQRVRWQAEIPYGHLRLSTIEGNEFNGFTLVVQKHSSPTMQEILLCWAGTIECNGVGKCRGCPTLSLSRH

SEQ ID NO: 124281 - protein, 216 aa, Glycine max
  Coding DNA Sequence Number=SeqID_32596
  Subcellular localization annotation: CTP_CleavageSite=60; ConfidenceScore=5.06e-01
MRKPSPSCCAYQGKISPGPLQGAGYGSWCTSMTTLTQTWMTLLLSNVLPSDHNSDLPLPKCMAPTRHPLDPDKSNRALGFSALITGLCQSYGVLVTPSKKYCTPRQAQGDAHQAVGTPPPPRQADPAGPLGVECYLQHLVRQQAANHRGQVQIHECLYQFSLNQQGRFGAEVAWPGDWPDAQAGEEPIGSPGEADESHMDEDMTDLLDFLGGSGAT

SEQ ID NO: 124282 - protein, 54 aa, Glycine max
  Coding DNA Sequence Number=SeqID_32597
MMMIKDDDKGDDKKLKDQSNNNSRESKRQESRFKVQDLKNQDSRFKDEEKTQSR

SEQ ID NO: 124283 - protein, 78 aa, Glycine max
  Coding DNA Sequence Number=SeqID_32598
MFDNTFNTPPSANNPPPSSSCYCPSLPTQTRDMGHEDEEDDDDNNNTNNNDGDDDDNNGGDCLFQQQHTITHEHPKTR

SEQ ID NO: 124284 - protein, 96 aa, Glycine max
  Coding DNA Sequence Number=SeqID_32599
MAADFDLTKLRSEKNFMASVTSVCGNEYMLFILQIVCGKTTVMSALDTFQDESLSLMRILKLAKYRLKSQVEKDEGLSGKGQSPRVENDEGPSGKG

SEQ ID NO: 124285 - protein, 63 aa, Glycine max
  Coding DNA Sequence Number=SeqID_32600
MAAQLIRDCVVMECLEAQSEGNYAEALQNYYDIMPTPEAYSTEESGPGGMANNDDSSSQRTVP

SEQ ID NO: 124286 - protein, 78 aa, Glycine max
  Coding DNA Sequence Number=SeqID_32601
MIEIITLVERGQLPCKDNSKDNIYRGLSKEHKELEKLHELKGPMTRSRSKLLQEEMAKRIKDGLLIKEKEGENHKELN

SEQ ID NO: 124287 - protein, 336 aa, Glycine max
  Coding DNA Sequence Number=SeqID_32602
  Homolog annotation: Hit_ID=Q9M2P9; Match level="QueryCoverage=92%, HitCoverage=87%, E-value=6e-77, Identity=52%"; Hit description =Putative uncharacterized protein T10K17.200
MKASLKFREEHKKPLFRAKVPLSILGKPFQSGIVAGESKELTLNLCTFFESGPSLKVAYRPNDSKNPFSLIVKTGTGPFGSPLKSSMLMSCEFSVPGRTGSPLFMLHFKPRFGDFTFKKTQSSIFDGKGFGSLNTQNDAVELENGTVETPLMESAKVSILGDGASGAVAGMFSGVEVAARTTLPVRGRAAVKFRWGVRVPSEFKGNNAFQKIPFLVMDKIGVEHMMECGVSKEKVSAGEKSRVPASADVAEACFAVKRQMEVLQAENGLLRNAVEDLRREIVGVRTSSSVMGKSPNLRKNEKKTTSDYGNFPGKSTEAEASEKLKKALMGAAAGSS

SEQ ID NO: 124288 - protein, 373 aa, Glycine max
  Coding DNA Sequence Number=SeqID_32603
  Homolog annotation: Hit_ID=Q2HTA0; Match level="QueryCoverage=27%, HitCoverage=16%, E-value=4e-13, Identity=42%"; Hit description=IMP dehydrogenase/GMP reductase, related
  Pfam annotation: Domain name=DUF1723; Domain location=235-284; Score =58.4; E_value=2.5e-14; Accession=PF08330.1; Description=Protein of unknown function (DUF1723)
  Subcellular localization annotation: CTP_CleavageSite=30; ConfidenceScore=5.36e-01
MGVYLGKFRDVNNKCPTSIQSPNSNPFPIRALLGAPSNSMNWHPPLKLLFVSSAIKTKVLPREEPSSACVKVAFGYCSGRRCSSAGGRTLSSADPAEDPAEPSSAGYILLSRKNLRKLLPQGTFPSRGRSCGTSSTDHDVTKRPEDVPQMHEDVPHVSDATPEMTGAADAVQTEGVATNGSLGSPAADEGSSERPDLKLVSHGRKVDKIGRPTPEIEGMIVATGLSPLIRCSVITTDPGLISAFVERWHRKTSTFHLPVGELTITLDGVASLLHVPITGALHTFEPLVTSDTIGLLTELLEGQMMGCSSSHVSGPLGGLYSFRQQEFNPCTCRAPGGFQEPGPGRGIRLGSGYISPHARAFERRVAGLYTAAG

SEQ ID NO: 124289 - protein, 151 aa, Glycine max
  Coding DNA Sequence Number=SeqID_32604
  Subcellular localization annotation: CTP_CleavageSite=61; ConfidenceScore=5.60e-01
MVLYNFLNDDSVQSLSQFHKECSSTITVSPARMMIASPSPSTSPSSSMPSVASSPSPPLKYCSRVEALGLRKIDKGNREGCSRKTMCGLLPEGQARYQLLEVLVGQKALVKVPPYNYKEAQFMVKRSGLVLRSKKSLKHSLKIRFNQDPMA

SEQ ID NO: 124290 - protein, 1471 aa, Glycine max
  Coding DNA Sequence Number=SeqID_32605
  Gene Ontology: Mol. function=nucleic acid binding; Cellular component= nucleus; Biological process=regulation of transcription, DNA-dependent
  Homolog annotation: Hit_ID=Q9LTV5; Match level="QueryCoverage=99%, HitCoverage=70%, E-value=0.0, Identity=64%"; Hit description =Helicase-like protein
  Pfam annotation: Domain name=DEAD; Domain location=516-682; Score= -26.6; E_value=0.0041; Accession=PF00270.20; Description=DEADDEAH box helicase
  Pfam annotation: Domain name=HSA; Domain location=4-80; Score=95.0; E_ value=2.4e-25; Accession=PF07529.4; Description=HSA
  Pfam annotation: Domain name=Helicase_C; Domain location=1090-1168; Score=99.6; E_value=9.4e-27; Accession=PF00271.22; Description =Helicase conserved C-terminal domain
  Pfam annotation: Domain name=ResIII; Domain location=512-676; Score =6.2; E_value=1.5e-05; Accession=PF04851.6; Description=Type III restriction enzyme, res subunit
  Pfam annotation: Domain name=SNF2_N; Domain location=518-804; Score =399.4; E_value=5.5e-117; Accession=PF00176.14; Description=SNF2 family N-terminal domain
  Pfam module annotation: Pfam domain module=DEAD::HSA::Helicase _C::ResIII::SNF2_N; Domain location=516-682::4-80::1090-1168::512 -676::518-804
MALEAPREPRRPKTHWDHVLEEMVWLSKDFESERKWKLAQAKKVALRASKGMLDQATRGEKKMKLYLVQEEEQRLRKVALNISKDVKKFWTKIEKLVLYKHQMELDEKKKKALDKQLEFLLGQTERYSTMLAENLVDPYKSAENNSAEHHMSIQCKDVHDVINEPKEADVVEYQSDAADNDEEYDVQYDDESEDDERTIEQDEALITKEERQEELAALRDEMDLPIEELLKRYAGDKGESVMKESSPEHSEDGGKIVRAGDGKKGLASENGDDLLSVSKIGTSNSSIVSGRRCDESNGDVATPTNNLSQCENGQSENLKEVPSSFGGQCDIHEGERGDKQVVLEVGLLSEDGDFLLGIEDKDDETTLSEEEQLERVDAIDPKDEIALLQKESVMPVEELLARYKRDPSDDEDGEYESDYASALSENNSDSPVHEDAGQKDPAIPMDEDIKSGEHLAAIQSQEEQWESPHENLEKRESEDIIADAAAAARSAQPTGNTFSTTSVRTKFPFLLKYSLREYQHIGLDWLVTMYEKRLNGILADEMGLGKTIMTISLLAHLACDKGIWGPHLIVVPTSVMLNWETEFLKWCPAFKILTYFGSAKERKLKRQGWLKPNSFHVCITTYRLVIQDSKVFKRKKWKYLILDEAHLIKNWKSQRWQTLLNFNSKRRILLTGTPLQNDLMELWSLMHFLMPHVFQSHQEFKDWFSNPISGMVEGEEKVNKEVVDRLHNVLRPFLLRRLKRDVEKQLPMKHEHVIYCRLSKRQRNLYEDFIASSETQATLASANFFGMISIIMQLRKVCNHPDLFEGRPIVSSFDMRGIDIQLSSSVCSMLLPSPFSTVDLRGLGLLFTHLDYSMAAWESDEVQTIETPVTLIMERTDMAELEVIRPHKCQKKLQGTNIFEEIQWAIWEERLKQTKEHAAAIAWWNSLRCKKRPIYSTTLRDLVALRHPVNDIHQVKANPVSYLYSSKLADIVLSPVERFQKMTDVVESFMFAIPAARAPSPVCWCSTSETSVFLHPSYKQKCSEVLLPLLSPIRPAIVRRQVYFPDRRLIQFDCGKLQELAILLRRLKSEGHRALIFTQMTKMLDILEAFINLYGYTYMRLDGSTQPEERQTLMQRFNTNPKYFLFILSTRSGGVGINLVGADTVIFYDSDWNPAMDQQAQDRCHRIGQTREVRIYRLISESTIEENILKKANQKRALDNLVIQSGGYNTEFFKKLDPMELFSGHRTLSIKNMPKEKNQNNGEVSVTNADVEAALKCVEDEADYMALKKVELEEAVDNQEFTEEVIGRFEDDEYVNEDDETAELGESVLNLNKENALMLNGSDHKEDRPPHSVAGKEDDPDMLAEVKQMAAAAAAAGQAISAFENELRPIDRYAIRFMELWDPIIDKTALESEVRIEDTEWELDRIEKYKEEMEAEIDEDEEPLVYESWDADYATTAYRQHVEALAQHQLMEELEYEARQKEAEETCDSKK

SEQ ID NO: 124291 - protein, 300 aa, Glycine max
  Coding DNA Sequence Number=SeqID_32606
  Gene Ontology: Mol. function=aspartic-type endopeptidase activity; Biological process=RNA-dependent DNA replication
  Homolog annotation: Hit_ID=Q69F85; Match level="QueryCoverage=34%, HitCoverage=5%, E-value=5e-18, Identity=42%"; Hit description=Gag -pol polyprotein
  Pfam annotation: Domain name=Retrotrans_gag; Domain location=151-240; Score=34.3; E_value=4.4e-07; Accession=PF03732.8; Description =Retrotransposon gag protein
IRVTTVRGGAHGGASSLGDSANSVRTFGVHHGAEGKLSFRPLGHVNGNPPRQGWLPWEPLKRGTQQTKRVPRGVVLEASKGPKCKFGHNGCNPLDPSDKDQRGSYDESQLLPGWKTLTIDHYNGLSNLDEHVDAFVTQMSMLMNDNAIMCRVFPTNLKGATLHWYTHLLRNSTDSFATIKMCFKVQYAIRIPHHLIAMELANIQQDEYESLRDFMERQPVQEITYNIGRVESKDCQIHPDGRDDQIQRESMWLIIKETNGVRDQDLECNTPDCQLLGGSHITTLHMMTLHSTCLLVRTLH

SEQ ID NO: 124292 - protein, 45 aa, Glycine max
  Coding DNA Sequence Number=SeqID_32607
VAWLRDWPEAQAGEAPPEVPGDGEEAHEDEEMADLLDFLGGSGDT

SEQ ID NO: 124293 - protein, 92 aa, Glycine max
  Coding DNA Sequence Number=SeqID_32608
MWEHIGGLVPKKGVLDRWSWNYQTEKVILRDCLAWWTMWVFVIWALWLLHNEIVFWNAQCDSDLVFDSAKLRAWKWLRNMGKGFNASLLGQL

SEQ ID NO: 124294 - protein, 24 aa, Glycine max
  Coding DNA Sequence Number=SeqID_32609
MDSPPASPPPPPPPPSDASASPSA

SEQ ID NO: 124295 - protein, 107 aa, Glycine max
  Coding DNA Sequence Number=SeqID_32610
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q6PW04; Match level="QueryCoverage=56%, HitCoverage=10%, E-value=2e-20, Identity=76%"; Hit description =Membrane-anchored endo-1,4-beta-glucanase
MENWRRRETFALEPLMATRRRLELEKKRTIEKRSALEEEEKNEKDPWGGPLEIHATDSATNDEHSQNLQELDRGALDETQQSWLLGAGEQKKKKKSYIDLGCINFNP

SEQ ID NO: 124296 - protein, 234 aa, Glycine max
  Coding DNA Sequence Number=SeqID_32611
  Subcellular localization annotation: CTP_CleavageSite=39; ConfidenceScore=5.58e-01
MTSKAFNALPLDAIVHLSPPQWTCPVQPNFFNVSSLACSCSFFHGLFPSGWRRLLPLLLCLPLHLHGGKSPLKDLIEAQRSSLHRSSTSKLPSSLQKLKDKKISQSSISKDLFGKHKEDPLQKVEPPNIEFQKVYLWTPITKLLLVHPVNLNLSKEDSLSFGKSNEQMYLRDQAIAYLSDLHISRATNIKMVADKVSLCLLVWDATKKKGFKLYYNEEMPTGKMRVDIVNFPHN

SEQ ID NO: 124297 - protein, 147 aa, Glycine max
  Coding DNA Sequence Number=SeqID_32612
MGLKEKRLPQRRATRLSIATAEDDAVIEGGAVTAAPPLKFHRGITVVLLFNFAASRHSNPDLTLTPSSKPNHPTQLKAVSISMASNQRPTHPSLNLNVVANKEPPPKHPIEFVIERIRKGMRTFLEQNVIKNPCASDMRASVNRVIK

SEQ ID NO: 124298 - protein, 217 aa, Glycine max
  Coding DNA Sequence Number=SeqID_32613
  Pfam annotation: Domain name=Transposase_23; Domain location=142-202; Score=-8.8; E_value=0.011; Accession=PF03017.5; Description=TNP1ENSPM transposase
MKEKKKKQLEETAKSRSIDTVIDPPSPIKRQVKWKMTRTKKTGQMTSEATKEISKKIASQGSFVTHGREDVLTTPIGRPEHPIRVRATGVGIMIKQYLESAPRTSHTSSSMAPEDLEQLTQKIKGQLEKSITEKPEVGPSAARVSTKESCMDPLGSDLNTGVHNIPLGNDQAKVGVEEVREAGAHIPVPTREVQLVGQTLITFVAWPTHLVKRFLEQ

SEQ ID NO: 124299 - protein, 105 aa, Glycine max
  Coding DNA Sequence Number=SeqID_32614
MALSHLTIHHESLPSKHSNLASKVKTFLDYLNHLTIVSMTPTLPLPSPRPHIKLEVLRFDGHDPLVMQSYPARALDRRIQVDWAKDAREGPRVLMSLRVDFGPMD

SEQ ID NO: 124300 - protein, 125 aa, Glycine max
  Coding DNA Sequence Number=SeqID_32615
MDISEDTDIPIILGRSFMLTASCIVDMGKRKLELGFEDQKIDFDLFVEDKPTPEHNVCLRVMGEGQEVLKARTKTPFAKRIIVHALSHEFQALSAQPWHLRSLSDGFTLAKHDPVSPSTIHCGQN

SEQ ID NO: 124301 - protein, 255 aa, Glycine max
  Coding DNA Sequence Number=SeqID_32616
MVPDCNDIESTIIYTHLPTTVFLLHQKHGGRERAMDIDRAGGGGKRDMVDYMSRWGNGRGGEEDGGKFGNEVLDFGYGVRQFWARVWVVSGVDRPRCNIRAKLHKMTQVVKLHGKSGVVSNLGAQFLQPINAQHHICATNGMDPLAMMTLNGEIASMSSAKNLATRGWMKLWVLPLLIRKVSAKQGITQCFDQENKRIPRKGAKAVMGEGFKGFQGSRVDRRKKEEETKMRRYRIVTVIIPYIVFLFCVPRATIG

SEQ ID NO: 124302 - protein, 474 aa, Glycine max
  Coding DNA Sequence Number=SeqID_32617
  Gene Ontology: Mol. function=protein serine/threonine kinase activity; Cellular component=plasma membrane; Biological process =protein amino acid phosphorylation
  Homolog annotation: Hit_ID=Q7XZK4; Match level="QueryCoverage=95%, HitCoverage=83%, E-value=0.0, Identity=86%"; Hit description=Calcium- dependent calmodulin-independent protein kinase isoform 2
  Pfam annotation: Domain name=Pkinase; Domain location=16-255; Score =299.4; E_value=6.7e-87; Accession=PF00069.16; Description=Protein kinase domain
  Pfam annotation: Domain name=Pkinase_Tyr; Domain location=5-255; Score=-71.6; E_value=5e-08; Accession=PF07714.8; Description=Protein tyrosine kinase
  Pfam annotation: Domain name=efhand; Domain location=302-330; Score =26.9; E_value=7.6e-05; Accession=PF00036.23; Description=EF hand
  Pfam annotation: Domain name=efhand; Domain location=338-366; Score =26.6; E_value=9.1e-05; Accession=PF00036.23; Description=EF hand
  Pfam annotation: Domain name=efhand; Domain location=374-402; Score =27.1; E_value=6.7e-05; Accession=PF00036.23; Description=EF hand
  Pfam annotation: Domain name=efhand; Domain location=410-438; Score =36.5; E_value=9.6e-08; Accession=PF00036.23; Description=EF hand
  Pfam module annotation: Pfam domain module=Pkinase::Pkinase _Tyr::efhand::efhand::efhand::efhand; Domain location=16-255::5 -255::302-330::338-366::374-402::410-438
RAGEEAGGADGAHGPGHRPAEELACKSISKKKLRTAIDIEDVRREVEIMRHLPKHPNVVSLKDTYEDDDAVHLVMELCEGGELFDRIVARGHYTERAATTVTRTIVEVVKVCHEHGVMHRDLKPENFLFGNKKETAPLKVIDFGLSVLFKPGERFNEIVGSPYYMAPEVLKRNYGPEIDIWSAGVILYILLCGVPPFWAETEQGVAQAIIRSIVDFKREPWPKVSDNAKDLVKKMLDPDPKRRLTAQEVLDHPWLQNEKKAPNVSLGETVRSRLMQFSVMNKLKKRALRVIAEYLSLEEAAGIKEGFQLMDTSNKGKISVDELRVGLHKLGHQIPDGDIQILMDAGDVDNDGYIDYGEFVAISIHLRKIDNDEHLHKAFQFFDENQSGYIEIEELHNVLADEIETNSEEVINAIIHDVDTDKDGRISYEEFAAMMKAGTDWRKASRQYSRERFSSLSQKLIKDGSLKLNNDDGR

SEQ ID NO: 124303 - protein, 81 aa, Glycine max
  Coding DNA Sequence Number=SeqID_32618
MYNMIKMIVKCTRCLVGFLMRTRQRNKSKEPLEGLGGPMARARTKKAKEALQQVLTMLFEFRPTLQVEKLRIANCIMFQEL

SEQ ID NO: 124304 - protein, 249 aa, Glycine max
  Coding DNA Sequence Number=SeqID_32619
  Homolog annotation: Hit_ID=A2Q3K8; Match level="QueryCoverage=95%, HitCoverage=77%, E-value=1e-36, Identity=42%"; Hit description =Remorin, C-terminal region
  Pfam annotation: Domain name=Remorin_C; Domain location=186-249; Score=-10.2; E_value=0.0089; Accession=PF03763.4; Description =Remorin, C-terminal region
MLNDQTPSTSHGTEQHHNESAENEPQIREIYALTPPPRREPNFETHTHSHSHDSSSVSIEGGSSENFSMSREFSALVLAGSSIENNITTPSQMSLNTMHGNEEGVNSYTNSNNNYNNNNNINNNSYNNLGRIGEDEMLMMEETNPLAIVADINPLEAVSSSSPPRRGGGTSSGSGGALNEVTVQRVRKEEVEAKISAWQNAKVAKINNRFKREDAVINGWENEQVQKASSWMKKVEHAIQGLDLGHMQA

SEQ ID NO: 124305 - protein, 123 aa, Glycine max
  Coding DNA Sequence Number=SeqID_32620
MKWKMTRTKKTDQMTYEAAKEIVDRIVKHPGCVRAIEVGVTIKNYFGSTLRGSCTSSSIVAEDLEQLTQKIRDQLEKLITQKVEVGSSAAIVSRKESCVNPSGQDPEMGDSDKFGLYVDDSLP

SEQ ID NO: 124306 - protein, 67 aa, Glycine max
  Coding DNA Sequence Number=SeqID_32621
MASLKLRLHAVEEALVVVHCVEARTRTEEVEELDLNSRTNDDNQVKPIKRTSTFRLRPSGKCTGSHK

SEQ ID NO: 124307 - protein, 137 aa, Glycine max
  Coding DNA Sequence Number=SeqID_32622
MMEALKDQMATMMEAMMSIKEIMEVNAAAIVATSTIAKGGLTPPDGVNQINHPTSDMVGLEGKELGGTGGPHLVQKTSMPSRHMACLPNIHHPMWCTLPVRMSITSFPYSLKADNLKLIMHMSLKPRGRRMRYPTII

SEQ ID NO: 124308 - protein, 309 aa, Glycine max
  Coding DNA Sequence Number=SeqID_32623
  Gene Ontology: Mol. function=protein dimerization activity; Biological process=DNA integration
  Homolog annotation: Hit_ID=A3BRV8; Match level="QueryCoverage=61%, HitCoverage=26%, E-value=2e-36, Identity=44%"; Hit description =Putative uncharacterized protein
  Pfam annotation: Domain name=zf-C2HC_plant; Domain location=124-182; Score=-3.0; E_value=0.097; Accession=PF07567.3; Description=Protein of unknown function, DUF1544
MIALGAAADTNKGSEETFKMAIIEAIKLGYKHFDTTSFYGSEEAMGEAIAEALQLGLINNFYGIISKKHGRGTSVACLASDSHRTRMRTRLRCDAVSGASAVTRHEMSASSHSQAKEQDDDTKPLWTYVTKIKSVGGGGNYEIKCNICDVSFNRSYTRVRAHLLKITGKGVRGCQKIKNAKLIDLKKIDNEATLRVEKSKTKPVSLPPVSTQHQMNTNTLGVDPKKRKTLTVESVFNLQARDTLDHEIARMFYSSGLPFHLARNPHYRKAFAYAANNYIGGYQPPGYNKLRTTLLQNERRHVENLLQPI

SEQ ID NO: 124309 - protein, 37 aa, Glycine max
  Coding DNA Sequence Number=SeqID_32624
MTSSNGNFPASIHKWCKKGFKNLKRTQLMHRRWLAMI

SEQ ID NO: 124310 - protein, 399 aa, Glycine max
  Coding DNA Sequence Number=SeqID_32625
  Gene Ontology: Mol. function=kinase activity; Cellular component =intracellular; Biological process=nucleobase, nucleoside, nucleotide and nucleic acid metabolic process
  Homolog annotation: Hit_ID=A2Q3K9; Match level="QueryCoverage=97%, HitCoverage=98%, E-value=1e-172, Identity=80%"; Hit description =Guanylate kinase/L-type calcium channel region; Galactose oxidase, central
  Pfam annotation: Domain name=Guanylate_kin; Domain location=170-274; Score=178.4; E_value=1.8e-50; Accession=PF00625.12; Description =Guanylate kinase
MGEAPTFIPQDLQNGTCNGFELKSGTFETDTIVGNKKYVIGGTYGETFSVKDQILDNNGLGEWVDLIQLGTKPISCNGHSAVLLKDRILILKKNAKPDDCIWFLEVDTPYVRQQKKILGIDVVAWSNGVIGNAEKPVVISGPSGVGKGTLISMLMTEFPSMFGFSVSHTTRAARGMEKDGVHYHFTEKNVMEKEIKDGKFLEFASVHGNLYGTSVEAVEMVSDAGKRCILDIDVQGARSVRASSLEAMFIFICPPSMEELEKRLRDRGTETEEQVLKRLRNAQAEIEQGKSSGIFDHILYNGKLEECYENLKKLLGLDGYVTPPKSAPKKMNLPRDHSVSKIDDKIIIGCISSGLEKESKNLIMLDVSSLKGGAPGRTRGLDFQVIDSFSDGFNGNEPF

SEQ ID NO: 124311 - protein, 74 aa, Glycine max
  Coding DNA Sequence Number=SeqID_32626
MTLPPRTHSRHNPHLDSLAIKANGHGVGVVWMWARRKGAPTIFLVHPTIKDESGVNEEHTDYSDAFNTSQVFAT

SEQ ID NO: 124312 - protein, 249 aa, Glycine max
  Coding DNA Sequence Number=SeqID_32627
MVTTRGLGRALGGVIGRAMGREDNYDLDEASQRQRPIASAPNEVFQQPQEVAIDAQGFPSGPHDHQFWLAIMIMLQSLFGMERSRIEAILPWKEGLEIQEFERYVQTIPPHSLGSRLFLEDIDDKWMHFSKYLAPMGQICVVSGQYPVKHPPIVQDDTYVEPYISRYPAVAIVMEEAPAHAPSHVEQPRHAVEACQAIAERLEWLLNLRIVTKGTKTYDVMKDCLRIARGVIVDHNVYVRLRRRWGMED

SEQ ID NO: 124313 - protein, 90 aa, Glycine max
  Coding DNA Sequence Number=SeqID_32628
MSQKNNDLRLIHRWIVVKFEHHVSNPIPSILTVGNFDIMFELREIPFTLEKKDSHEDSTSGGFNLFSVSLTFVNSIGAVGGITEGISGNR

SEQ ID NO: 124314 - protein, 249 aa, Glycine max
  Coding DNA Sequence Number=SeqID_32629
MSKALLSGYDGCDNVDHQNSIQVLHPVMTYHFDDVCVCFVKDSKDNEFISKQKKLPIIINDIVYDLTKMDERDSKDHTAKEAVEKVVKEQVEKEARAEQQAKDDATKITEVLVDLTISGALQEVEEQAASPAESNAKKADEVVPTSLSELASKQADTSHEATSVEKEVLDAVVVFSSNSDVAPINYVVLAPIVGVVVQQPLIVQQQPSIQQQQCPSILLAPAEPTPPSPTSIPPSSNKSDNDVQSLFFL

SEQ ID NO: 124315 - protein, 161 aa, Glycine max
  Coding DNA Sequence Number=SeqID_32630
MDIHVTYTLNGIIYLSYIRIRQVTLPSLALVATCWEIDEDKTLGNLLPMGHEHSTQINLTSPSTQDLKTSSLWNSLSYILLNLSISTQCETSPFILVLQQSSPLVEPFHNQALKSIREPDTIPMLPLLMLKVDVILTRSGSLDTGHRVWMTSLLERKDKSG

SEQ ID NO: 124316 - protein, 56 aa, Glycine max
  Coding DNA Sequence Number=SeqID_32631
MAYNGKLLVLKLQVILEIVVGRGDFVYQGEKIKLEMKKQAEQDLCLKCYEANPKQA

SEQ ID NO: 124317 - protein, 73 aa, Glycine max
  Coding DNA Sequence Number=SeqID_32632
MIVIQIEGMEWNLVRFPPSEAAKVFSFSEDESGPNATDFHVNVLKRPYCPSGSEVSFVFITGTMTIIYTGYFA

SEQ ID NO: 124318 - protein, 73 aa, Glycine max
  Coding DNA Sequence Number=SeqID_32633
MTNSKGKNIPERVYEAIGGAGSNNQYLKGGFGFGVGTGLVIPYLYPYPTFGYRGKLKPEPIPGQLGYYPSKSG

SEQ ID NO: 124319 - protein, 915 aa, Glycine max
  Coding DNA Sequence Number=SeqID_32634
MQIMFSELVSLSETSLLALSVTSSAEGEITLSALVSLSEFPSRVGNYAKCTRLAKVTSWWSPPYGQVLFGAESGGLGKSETCRCVRGIHDTHAYVSLVEWASIGDVMCGSSLENTLHGASDSESSHSEREPISVIVILPPSTSGEQGEAIGTLGHLPDDVHKYKSSLTFAVIVVALQCQVKLANPNYSYKILVEACGNDDFPFLRAVSGNPPFFFMYRCLFEVLVLAPRLTDFQCALLEHLTMGPSQLPHNSWAMVRAFEILCPFFNIRPSVPIFLNLFQMKLIVKIDWVFLNNVSKKLVEFNSNVFFRFKDCFFKVLATDVVADESGQYAAEIGLIIGVAEVAPYAPSSILAKRKQDDVDAPATFAGPVTTHSSNIVVPLFSAGVATTSAPAMPPPSSSAPLIPPTVVLASTPSSSSSRPHVSLDHLYTFNNPDSLWEHYEFYQSLPLEKFGDSGGEWTRTPRGFAQGVILGGGGYQMEVKPPNCLLRLAVSWPGIVAERDELSKVVTELEAQLKESKSRLEESELRVAKEREANKEIEEELILYKKEVNFFANDLDLGLFDPFKDVKDGVLLDKEDIVAEEEAGEEQDADDVNEDLVDVGRKALVVLCEVLSNSPVIVHLMEPGPLIVIVVVLEERLTKRGALGFERMHNKGLTKDGTWILRALWRTNQGIVRPGFWRDSPRVDLRFDEPLGLTKGKPWVLQALWRTNQGIARPGRTLDFVSPFQTDQGIVRLGFGETHQGWTLGFASPLKKRPGPEDDFVGCLCLAIGLRMFGRGNKHLTRVSKLPMDLGGSPLYQVNATPLRDMGKTQHRIALSMVYRFVWRYVIFHDAVDKAVSTSSQPCRTVDMAETWIIQSVECASQPPADHGQPLAFLASPHGVAPSPKCGFGVVREYQYLAWLLQEDWILQKGSCV

SEQ ID NO: 124320 - protein, 156 aa, Glycine max
  Coding DNA Sequence Number=SeqID_32635
  Gene Ontology: Mol. function=acyltransferase activity; Cellular component=integral to membrane; Biological process=metabolic process
  Homolog annotation: Hit_ID=Q2Z1Y8; Match level="QueryCoverage=80%, HitCoverage=32%, E-value=3e-64, Identity=94%"; Hit description=1 -acyl-sn-glycerol-3-phosphate acyltransferase
  Pfam annotation: Domain name=Acyltransferase; Domain location=2-120; Score=11.3; E_value=8.5e-05; Accession=PF01553.12; Description =Acyltransferase
MGKEHALVISNHRSDIDWLVGWVLAQRSGCLGSTLAVMKKSSKFLPVIGWSMWFSEYLFLERSWAKDERTLKSGLQQLRDFPLPFWLALFVEGTRFTQAKLLAAQEYAASAGLPVPRNVLIPRTKENKKIERSWVFEELAIKVLAKDFEKIELILF

SEQ ID NO: 124321 - protein, 85 aa, Glycine max
  Coding DNA Sequence Number=SeqID_32636
MRIPLRLKHSSGYGGSAASNDDLWWPSVVVGGGEEDLAKRESTFGTKRDNSCSVQFPLGLEFALSTTILVERNSSCAKCNNSHSA

SEQ ID NO: 124322 - protein, 279 aa, Glycine max
  Coding DNA Sequence Number=SeqID_32637
  Gene Ontology: Mol. function=DNA-directed RNA polymerase activity; Cellular component=cytosol; Biological process=transcription
  Homolog annotation: Hit_ID=A5BD07; Match level="QueryCoverage=85%, HitCoverage=20%, E-value=2e-76, Identity=57%"; Hit description=DNA -directed RNA polymerase
  Pfam annotation: Domain name=RNA_pol_Rpb1_2; Domain location=9-138; Score=70.1; E_value=7.1e-18; Accession=PF00623.11; Description=RNA polymerase Rpb1, domain 2
  Pfam annotation: Domain name=RNA_pol_Rpb1_3; Domain location=141-276; Score=-21.4; E_value=0.0048; Accession=PF04983.9; Description=RNA polymerase Rpb1, domain 3
  Pfam module annotation: Pfam domain module=RNA_pol_Rpb1_2::RNA_pol _Rpb1_3; Domain location=9-138::141-276
MNINSQASTKREVPFFDIEEITNLKRGYFASREISDHEFEGKVVYRHLKDGDVVLANRQPTLHKPSIMAHIVRVLKGEKTVRMHYANCRVTTVNNFFVLFFPLRDLCTYNADFDGDEINVHFPQDEISRAEAYNIVNANNQYVKPTSGDPIRALIQDHIVSAALLTKKDTFLSYEEFNQLLYSSGVSMAGLGSFYGKHGQKVISALLYYITRGSPSFTVEKNAKIPSNFFKTRIRKGKRYTQDTSKKKEKPDEDKLLIYKNDLVRGIVDKAQFGDWYDT

SEQ ID NO: 124323 - protein, 569 aa, Glycine max
  Coding DNA Sequence Number=SeqID_32638
  Pfam annotation: Domain name=RRM_1; Domain location=155-225; Score =22.8; E_value=0.0011; Accession=PF00076.13; Description=RNA recognition motif. (a.k.a. RRM, RB
MGPNSKSKKGTRIGKEVKVPEGKGKGVNLETFEFDTTACPKAEGSLEQSFLRTLRVEIIAGLSVFGLLGLLMGNFITLWLLNGIPLSLSWPSLIQNLIEDLQKWNKEEELDGSWREYEQVLALYDMVKRIFQFPYVDKDLNETLITLIPKDTSSFYFTRFSDDTTKKELWHHFKKWGDVRKIFIPNRRNNNGRRYGFVKFEGVKDTHNLAKQLDSIIIGGTPRNKPQDQDDNTQAEVDCSEKQQYTNQGSYAEDAWVGRLTNPAMFDRVEEELLWETGLDISPKYIGDDLILLLGLTDSGAEQLMNGGKHGGISMLGTRSTLGTHWQQWGILVELDDDTEEKRRLDRARVLVKTPWRPTINHTVDVHINGECFKVFVVEDTGGGNLHYRRRRSSLSGSSDDIFSEDTSLGNLTPRTTSSHDLEDDKRLLLAQACGANDSDEGGTAEPESRKTVEDDHQEFLLPSGPRDDSYPLGNAANLRVTERRENYHEKGKSGEGESIGVADALKEKEKASAEVAATSNVAEEKEPGNDARGAADNNQNDSTTEIASTNEDIEEALEILNSQEAFDI

SEQ ID NO: 124324 - protein, 296 aa, Glycine max
  Coding DNA Sequence Number=SeqID_32639
  Gene Ontology: Mol. function=DNA-directed RNA polymerase activity; Cellular component=cytosol; Biological process=transcription
  Homolog annotation: Hit_ID=A7PWB4; Match level="QueryCoverage=100%, HitCoverage=24%, E-value=1e-39, Identity=47%"; Hit description=DNA -directed RNA polymerase
MKVSVVPVTVLGGQICSIYKLVMKLYKSKQYPEYTDITLEDWEETLRTDPQSNYSNSSEDAHDNGSESEKKGQSNDEDDDGVVVEDTEGNEDLGSDAQKRKLQGTDEEIEGDEDGSDVDVNENDNNVTDANNSEGLEKPSKTAKKFCLQNFGKVGECKAITCKESGVIYYGKDDRKGDEISAFEKEEIPALQTSGGDHHQGSTECFHISVNIRHLKLNADFMTHSGGYCLMNRTGSIADSTSLFIKMCFETAAKFIVEAAYHGQVDNLETPSARICIGLPVKMGTGCHDLIQKLEI

SEQ ID NO: 124325 - protein, 54 aa, Glycine max
  Coding DNA Sequence Number=SeqID_32640
MVVVVVAWSNDDGDGQSQVQFLKLWVMVEWNSGNGGHNNNEGTRMVVVTIVAIE

SEQ ID NO: 124326 - protein, 147 aa, Glycine max
  Coding DNA Sequence Number=SeqID_32641
  Gene Ontology: Mol. function=molecular_function; Cellular component =membrane; Biological process=auxin mediated signaling pathway
  Homolog annotation: Hit_ID=A7NVB2; Match level="QueryCoverage=97%, HitCoverage=37%, E-value=4e-34, Identity=49%"; Hit description =Chromosome chr18 scaffold_1, whole genome shotgun sequence
  Pfam annotation: Domain name=DUF6; Domain location=17-143; Score=5.5; E_value=0.033; Accession=PF00892.11; Description=Integral membrane protein DUF6
  Subcellular localization annotation: CTP_CleavageSite=74; ConfidenceScore=5.00e-01
MFTNARPYLLLVAVQFGSAGMFIFAMDSIKKGMSHYVFIVYRNAIASVSLAPFAFVLERKVRPKMTFRVFSEIMALAFFEIMLDQCIALLGMKFASASFLSVVMNSAHSVTFVMSVILRVETYYPVHDKGMGLECSGSSLTEGGLVK

SEQ ID NO: 124327 - protein, 104 aa, Glycine max
  Coding DNA Sequence Number=SeqID_32642
MTRGNPSDLQPFDPEIDRTFHRLVRHHFIPFDHSAHSITGESVHSVIGDFEHPDLEHYNFEHSDSEHSDFAYSENMAQPPPHERTLREMVAPDFTYESLCIQYP

SEQ ID NO: 124328 - protein, 57 aa, Glycine max
  Coding DNA Sequence Number=SeqID_32643
MSQRALLRASEARLTGALSKGGKVDKSGALAPTYPPSKRKSDLRSSFLCVNQVILFT

SEQ ID NO: 124329 - protein, 291 aa, Glycine max
  Coding DNA Sequence Number=SeqID_32644
  Gene Ontology: Mol. function=protein kinase activity; Cellular component=cytoplasm; Biological process=protein amino acid phosphorylation
  Homolog annotation: Hit_ID=Q6T2Z9; Match level="QueryCoverage=86%, HitCoverage=97%, E-value=1e-114, Identity=70%"; Hit description=CDK -activating kinase
  Pfam annotation: Domain name=Pkinase; Domain location=38-233; Score= -83.0; E_value=0.0012; Accession=PF00069.16; Description=Protein kinase domain
MKDVACDTNLIENMVNDLMGHRKEEFLNSAWEVAMFSNHSARILVESGFDAPQENLPPYEDDASNSESSLQHPEAISQLMKTKSYFYDTNKDTNIYNGNTSCLVACTMSDIDDDLCKGSFTYEAEEVGGNELGCLTSCVRTWWFQVAELLYGSTYYGLEIDLWSLGCVFAKILTSKPLFPGTSDVDQLSRIPSSLEACMPNCYPNEVSLVQRLVCYDPTKRTTTMELLQDKYFSEEPLPVPISELRVPLTRNGHDQDSPGGPNEMGLDSDLEEFGTLNITTTSSDLSKQIP

SEQ ID NO: 124330 - protein, 220 aa, Glycine max
  Coding DNA Sequence Number=SeqID_32645
MGDLCSKSMKADKVFAKSDGHSDKHKSDGKNYKSTNMPSDLTSAGDHGLDKKKQEAATAVGNGSNDFYDGIPWFNDSFTHKSSIKASIFETLGVTSLFGKFSPVPAFEEGNESGYLDKKDLDTCGPESESESHPMSKMKSSKDITPYCETTTFFMRGKRLTSSHVKNWQNITNNDTIHRLEALGLFLKKTGQQGFKVFKLVTIGEEMDFAATMSVLCRRS

SEQ ID NO: 124331 - protein, 246 aa, Glycine max
  Coding DNA Sequence Number=SeqID_32646
  Gene Ontology: Mol. function=metal ion binding; Cellular component =nucleus; Biological process=embryonic development ending in seed dormancy
  Homolog annotation: Hit_ID=A7NUQ6; Match level="QueryCoverage=100%, HitCoverage=98%, E-value=2e-56, Identity=49%"; Hit description =Chromosome chr18 scaffold_1, whole genome shotgun sequence
  Pfam annotation: Domain name=ZF-HD_dimer; Domain location=57-116; Score=101.4; E_value=2.8e-27; Accession=PF04770.3; Description=ZF-HD protein dimerisation region
MEFKQHEETELRMPAATTSYDDFGIPPSSQGEEEPTAAAIPVAIPMTPTPPTLAQNNHNEKYHECLKNHTVKTGVHTLDGCIKFLPLGEEGTLDALKCLTCNCHRNFHRKETPNYTYLVPYYRHSSLPLAAYYGEQVGYPHVQGQQCTTLALPSRSRGIGGAQSSREDMEAVSDPTSGATPHGGSSKKRFRTRFTQEQKEKMLAFAEKLGWRILKHDESAVQEFCAQTSIQPHVLKVWVNNNKNTL

SEQ ID NO: 124332 - protein, 61 aa, Glycine max
  Coding DNA Sequence Number=SeqID_32647
MVETVKEKSVKATTRLQACNIGEHEKLSLQRQRGKDVKTQLPRGILRSAPSRLGHRCKRRP

SEQ ID NO: 124333 - protein, 66 aa, Glycine max
  Coding DNA Sequence Number=SeqID_32648
MGFGVREWSLEEESKNEFKIESRTLQGSKRKFDFKNQESSFKIQVPRIKIKIQDSRFKNQEKTQSR

SEQ ID NO: 124334 - protein, 76 aa, Glycine max
  Coding DNA Sequence Number=SeqID_32649
MTQDGYLSYPNFVRGPSFDGMQPSLDRLEFRDILEVKKRHCCAIRKVPRHFGSQEEPCCVIRKVSQHSGKEMGVVT

SEQ ID NO: 124335 - protein, 59 aa, Glycine max
  Coding DNA Sequence Number=SeqID_32650
MSGSKRCWAYVLSTIHSLGSSSSMDSFASWKMNGSEMEKEERKETPLQGEDESRRSSPP

SEQ ID NO: 124336 - protein, 168 aa, Glycine max
  Coding DNA Sequence Number=SeqID_32651
MDLKLSFFFPPEVLVVAGGLIEVAVVVGSTRLSLWWVECLEGVWETLEGNERCRFRGTIRLTATSLVHPEEPARMLQQPVEWILPTPTPYRLVEPVQVIEVSSSEEDPEEDPEELPLEPAVDDLDLPEDDEDPFSDVDSPEDMMSASEADSIEESGPRGTANSEDSSS

SEQ ID NO: 124337 - protein, 104 aa, Glycine max
  Coding DNA Sequence Number=SeqID_32652
MMRCCTLIDWPNSLKKSPVESPTVATYPSAGGRRRAHGCVIQGKKARRVATNVYSRKITEENLHGFAHGNISEGLRKNLGLDFLHGNTRNGEVLAAQRLLEEDF

SEQ ID NO: 124338 - protein, 181 aa, Glycine max
  Coding DNA Sequence Number=SeqID_32653
  Subcellular localization annotation: CTP_CleavageSite=14; ConfidenceScore=5.04e-01
MDPPPPKKSNRLAMSSSYWASSSTLGPPADTHATAPVLGGWPPAGEPHAVGSTILLNEGPSDRRSDDLTGYNGHFVELAEDWVSRGSHTCKNINGVCDQLSHVNAHSRKDGIHQLTLQQGKVRVVVTREDVVEQQHHPHLGQGGHSATRQWPPHQNHQLGPSSGCTHIANPRAHVIQELVE

SEQ ID NO: 124339 - protein, 263 aa, Glycine max
  Coding DNA Sequence Number=SeqID_32654
  Homolog annotation: Hit_ID=A5BEV8; Match level="QueryCoverage=94%, HitCoverage=29%, E-value=1e-24, Identity=30%"; Hit description =Putative uncharacterized protein
MVSRYVLNQIAPEFERVNYVGIDSSRCGCIMRTTHDLPCAYELARYVVGSIPLDTIHMFWKRPSFSDLGLFELEVTITEEMEAISKQFEELDVCGKVTLKSKLWEIAYLYLNSICLSGMKRTASSSEQPKPKRKMPMLDQFHPCIHDFIENIVHVKDDGNCGYPAIAALLSMGEDSWSLVLNHLLKKLAKWSDEYMNLLGGIDKYEDLKRSLLVDGLSMVTMDKWMIITNMDYVIASRYNVILVYLSLQQSEKDDGTQQTKGG

SEQ ID NO: 124340 - protein, 234 aa, Glycine max
  Coding DNA Sequence Number=SeqID_32655
  Homolog annotation: Hit_ID=A5AFY0; Match level="QueryCoverage=90%, HitCoverage=17%, E-value=6e-15, Identity=25%"; Hit description =Putative uncharacterized protein
  Pfam annotation: Domain name=zf-CCHC; Domain location=121-138; Score =20.9; E_value=0.001; Accession=PF00098.14; Description=Zinc knuckle
MPEVTHEDIVNVKRARKHTLVSKYEAFQMKNGETISKLQTRFTHIVNHLLGLGKTFEDKELNINILNCLTRTWEHYKDSSCSEEDANNFNLMVRKFGKFLKKSKDRKFPKSSKKIENNNNFTCFECGKQGHIKFECLIYLRTHVVENKGKKDKKQNKSYIAWEDNASTTSNSSVIEETKVNPEFEEVLEAFNEIDAILPRKGLVTRAMSKRLQEDWARALEEGPRVLMNLRVDF

SEQ ID NO: 124341 - protein, 141 aa, Glycine max
  Coding DNA Sequence Number=SeqID_32656
  Pfam annotation: Domain name=Chromo; Domain location=30-83; Score =6.4; E_value=0.098; Accession=PF00385.15; Description='chromo' (CHRromatin Organisation MOdi
MECLPLIEFTYNNRRLLIEVQVKDNLTYKAQPQKIIDRRMKSLRGKEIALVKVQWGPNEEKRKELEPEKRHANRGRILAFKRSNFSLLVAEYEVTSKGRAPNFAHHFYSKLQKEAIFGVVKRTSTLWDFEFQKTGRDDEES

SEQ ID NO: 124342 - protein, 964 aa, Glycine max
  Coding DNA Sequence Number=SeqID_32657
  Gene Ontology: Mol. function=DNA binding; Cellular component=nucleus; Biological process=chromatin modification
  Homolog annotation: Hit_ID=A5B9Z2; Match level="QueryCoverage=98%, HitCoverage=43%, E-value=0.0, Identity=49%"; Hit description =Putative uncharacterized protein
  Pfam annotation: Domain name=HSA; Domain location=567-632; Score =45.3; E_value=2.1e-10; Accession=PF07529.4; Description=HSA
MNGYKSGSALLVNAEVDSMGGVVDGGIGIGLKISPRRAAIEKAQAELREEYDVREERRRELEFLEKGGNPLDFKSGNAASVSVQSTSLTDQLHEQFVTSEAKGSFALTASPHGDSVDSSARPGAPLASEPNTADNLLLFDGENELPETERRCLHSNRRNNIALSEQSSQIDGSQNAKETEDSAIFRPYARRNRSRSGHGPRGASREVKGLTSETNSQKNLNLSTVSKPKPSCLNGDVGPKYLTTNNTLNNELVGIRDHQSTSGNASVPEDKLDITVNRNLKENHGTLPSEDNTVQDPVLMASGEDNIVELREPVAVVNHEPPPHVPTTKPENGPYCQPNGFGNVEVDRKSVLNEGQNSIATLGKNFNLESSCTKTSLVRDVNIDSDMCTNTKNVDANGNTMEQTFALENKLNFAGCKVVKDRHKTKNANGATVSNEHDAGYQNHSGCGNIVKAEEDVHIKSSCMSNVKGVPHNDSNISKVDKDTILVDQSNFVKENSCERHQVPVDVSLSEPPKTAPDVKGTSAASDDQPCPMHNMKLADKAHEDSILEEAKIIEAKRKRIAELSLHSLSTQNHRKSHWGFVLEEMAWLANDFAQERLWKIAAAAQLGHQTAFTCRSRFEKLNRQLETKILSHRIAKAVMQFWHSAKLLLDNDLGINCIVGCVESGKVDANEALRDQRRNSNMETSKFLEGQNPEKHAALKVHAYALRFLKANRSHGISSQAEAPTTPEKIFDSSTVDMSWDEHLNEENLFYEVPPTAMETYRKAIESHFLQFEKTGSSIQEEVATSVYDTAAEFGSQENAYDEEEGETRTYYLPSVYEGNRSSKSAQKKHKNLKAYTPRFGDAGADFPYVHYATGNQPSMLFEKRPASLNVGSIPTKRMRTATRHRVVSPFTVNIGTVQAQAKADASSGDTNSFHDDQSTLHVGPLIQKSTEVESVADYEKQLSQDCAETFVKTKKKKKAKTL

SEQ ID NO: 124343 - protein, 103 aa, Glycine max
  Coding DNA Sequence Number=SeqID_32658
EELATQLTQASSARPDELGCFLQKAVPPSGGIPERPKTSQIMQQCFLLTSGMLQNFTNCATMFSFDFRHVAEFHGLPNDGCQVPRSGQKRVASQQTDGPRMKL

SEQ ID NO: 124344 - protein, 59 aa, Glycine max
  Coding DNA Sequence Number=SeqID_32659
MTRVIKLPVVNKGTLKSVEDDKDGGIGAGDAPVASVRDVLGVAAKVDEPLRFLDDFAIW

SEQ ID NO: 124345 - protein, 88 aa, Glycine max
  Coding DNA Sequence Number=SeqID_32660
  Subcellular localization annotation: CTP_CleavageSite=31; ConfidenceScore=5.10e-01
MWAQRASTAKRSFSALSVTRESGRTQESRLRAKREISLLRETLRERLWRQQRGVVVQRSLGFYIFRKISDFSIGKCTVALELDRSRTK

SEQ ID NO: 124346 - protein, 176 aa, Glycine max
  Coding DNA Sequence Number=SeqID_32661
  Pfam annotation: Domain name=DUF904; Domain location=38-120; Score= -7.4; E_value=0.098; Accession=PF06005.3; Description=Protein of unknown function (DUF904)
MMLDQLELTKIFHNEGAVFHYESTKLKTLEVGDEKVEYNFLCKEAKLKKNICNKSLLHNKVDKIMQEKANKKKTRSQAQQQEEELIKKEKKTKKKHEQVGVSNPPEIQSDVALCGACRKKDDWRHHFKEKMSQEEAHHHRKLWGPVPRAMSKRLQEDWAKAAEKGPRVLMNLRVDF

SEQ ID NO: 124347 - protein, 164 aa, Glycine max
  Coding DNA Sequence Number=SeqID_32662
MAKFDPEIVLEFYANAWPTEEGVREMCSWVRGQWIPFDADALGQFLGDPLVLEESQQCEFGQRRNRADSNVLPSDHNSDLPLPKCQLVYAILTQMSVHVAQVIADAIYLFAGMPPTRHPLDPDKSNRALGFPALITGLCQSFGVPVTIVFTTYRLVRSFRLPCG

SEQ ID NO: 124348 - protein, 180 aa, Glycine max
  Coding DNA Sequence Number=SeqID_32663
GTKSETGDKLGDQKCNFAKQFKQQNFILKELRRSDFFIASEDIRFPQINVGGNFARFLPWRQTLWPIYFGLFAPPSKGRLRQGLRVVAEGSEMQEQAVVEKTDTKVRELGGNGILHGELGLLNLLALSLGKRFYGLFNHILHLISSDSGRLCIVERSGVGTGRVNDDNIRFALIFRISLI

SEQ ID NO: 124349 - protein, 162 aa, Glycine max
  Coding DNA Sequence Number=SeqID_32664
  Subcellular localization annotation: CTP_CleavageSite=38; ConfidenceScore=5.24e-01
MDTLTTKELAKDQEKSVAKCKSKRKQRGRKQRRRRVPRLMRKRTISMKLLLTVVSRHLRLTFVLKNIMKFMSFPQFIVLFVGEKMKNKKVAVAGVSLSEAYALIEQHPLSETSARLASEENLKENLPCMHALSAPSARPASHLSLLAPSAPDSLSKKSVTCA

SEQ ID NO: 124350 - protein, 76 aa, Glycine max
  Coding DNA Sequence Number=SeqID_32665
  Gene Ontology: Mol. function=voltage-gated potassium channel activity; Cellular component=integral to membrane; Biological process=potassium ion transport
  Homolog annotation: Hit_ID=Q5NT78; Match level="QueryCoverage=71%, HitCoverage=6%, E-value=8e-13, Identity=62%"; Hit description =Potassium channel TORK1
MSCCLGSNNEHFILESKKADLALKVNSASFNGDMYQLRGLIRAGVDPNKEDYDGRSPLVMLATVGSSGLRIIKKGG

SEQ ID NO: 124351 - protein, 129 aa, Glycine max
  Coding DNA Sequence Number=SeqID_32666
MMITKDDDKGDDKKLKGQSKDEFKMFKKESRTIQDSRGKLNSRIKIQGSSFKIKIQDSRFKNSREDLIKIRYILCGTSRGYIYLGLTENKRGYISCGSVLVEGTSTRFKENKRGYIPCGSLLVKGFLQG

SEQ ID NO: 124352 - protein, 130 aa, Glycine max
  Coding DNA Sequence Number=SeqID_32667
MSQNLTDYAIIPSLASEMLQNFTDCALTRPFNSRHVTELHGLPNDGCQVPRSDQARVAPQQTDDPQTKLGCGMTIICLCMSSGSPPLDDKRAQNDHNLSLRAIGHDRIWMAKGARNDHNLSPHVIGHDCL

SEQ ID NO: 124353 - protein, 230 aa, Glycine max
  Coding DNA Sequence Number=SeqID_32668
MSYRMSRHHASEHADYMCPYEQIKQVAHKRLKSQNSQNNSSIPDLVQNSCSLHDYIAVYDSGLQLLDAGGDLSSSEKSADIVSDIVDPAASLLHLTFILHCIATPVFSGRMSGHCIRHRGSCNFTSALDFYLALYSNSSILGQDHVASQQAANHGGQEQLNESFYQYTQHQQSKDPSPFPWSTPKQFGATTAWPGDEPDFEIGARPIGATGDDDGALEDDDMANVLDFFT

SEQ ID NO: 124354 - protein, 141 aa, Glycine max
  Coding DNA Sequence Number=SeqID_32669
  Homolog annotation: Hit_ID=A5BBZ3; Match level="QueryCoverage=85%, HitCoverage=17%, E-value=3e-13, Identity=36%"; Hit description =Putative uncharacterized protein
VAQVSKSKKVESRFSDEEYQEYLKLKSEKPSNQAQSSSVPCFSTACISESIEGSSPWKLDSGASDHISGNKSSFSSFSFPKILHLVTVANGSKVASQGSGQERGTGRLIGEEHESRGLYYLELSPPGLVLQSQSPNFCMIV

SEQ ID NO: 124355 - protein, 95 aa, Glycine max
  Coding DNA Sequence Number=SeqID_32670
MDIVGGNFLGLSPHIIAAELRGHEKFTEKVTNRGLGRCQIVADEWEYQKVAHAPVKKRHVAMDNGGLGGVLVVRGRQLWGCGRVGVRGSRWNRDL

SEQ ID NO: 124356 - protein, 264 aa, Glycine max
  Coding DNA Sequence Number=SeqID_32671
  Gene Ontology: Mol. function=DNA-directed RNA polymerase activity; Cellular component=mitochondrion; Biological process=transcription
  Homolog annotation: Hit_ID=A7PAG7; Match level="QueryCoverage=55%, HitCoverage=14%, E-value=1e-71, Identity=86%"; Hit description=DNA -directed RNA polymerase
  Pfam annotation: Domain name=RNA_pol; Domain location=1-214; Score= -26.0; E_value=2.5e-11; Accession=PF00940.10; Description=DNA -dependent RNA polymerase
MDILEESGLLYGKLVDTPINPSIKLFAKLGDIAKFQFKWQLAYILTRSLGKLHVTGTVIAATNQAVRWITPLGLPVVQPYRQFGRHLIKTSLQILTLQRETNKVMVKRQRTAFPPNFVHSLDGSHMMMTAVACKKAGLNFAGVHDSYWTHACDVDEMNRILREKFVELYDAPILENLLESFQKTFPALNFPPLPERGDFDLQEPQPWRRKKCVKQELGCQISTFRNLVLLFYACFKQAYFLEEMSHSWYSSCLPNPLFYRGYKE

SEQ ID NO: 124357 - protein, 234 aa, Glycine max
  Coding DNA Sequence Number=SeqID_32672
MASNPSRAHKKEKSSKRKQGECSQAIINRLDTWFTDEGKKSDYKVIYAIRNVRVSKYLDLELFSQQGFNFPNLLEVQRLTKCLYTCARVDLEGKLFSTVNGVDMVIYVVVWKEVDGLDMGGVCKFDETADGYNKMQAYKGMLLDPRRRLRRCLRDDGLTVEDNMLIYLITYILTPRFIDYFKVDVSNEIVDYTKASSEITESHLRKFGMRYVDHEWIMIAEPVAGNIEKMEKDD

SEQ ID NO: 124358 - protein, 300 aa, Glycine max
  Coding DNA Sequence Number=SeqID_32673
MLVMLCAEIAYGKLLEMKGRVNLGLESENMNSSTIFELIQRLTNWNEGNVTGSMMIGCGITWMLWKLGRIDGDPALRGTRIRATWEYVSSVGGGQQGMVGYTVVPGDMSRGSGDLGDVRRAPDSQQIKGTKTTKQGGLLENEVRKLGGLLVIDYQGRDRPLVIDYQIVMAAQLIHDRVEMECLEGAWETLEGNTRCRFRGTIRFTATSLVHPDEPARMLQRTVEWILPTPTPYRLVEPVQVIEVTSSEEDPEEDLEELPPKPAVDALDFLEGDEDPLPEVDSPEDIMSASEADSTEDSGP

SEQ ID NO: 124359 - protein, 76 aa, Glycine max
  Coding DNA Sequence Number=SeqID_32674
MAAEWRRKRERRRHFKEKMSLEEAHHHRRPWIRAWRKKEMNEGRGREEHKILCSKRALIYEPTNPRSIPRFSTKCA

SEQ ID NO: 124360 - protein, 45 aa, Glycine max
  Coding DNA Sequence Number=SeqID_32675
MMVTWEDIYSSSSENEEEHVVNLCLIEDLDKEDMCSLKRATFLCA

SEQ ID NO: 124361 - protein, 98 aa, Glycine max
  Coding DNA Sequence Number=SeqID_32676
MEEFEAQVAWLEDQPFSSRGGGASVTQELDTEEPLAPAPTPTVAEEDETTPDQTPQPSPAPAHIPEDVAPVAEPEQLILESSVALALLIVKECINRIM

SEQ ID NO: 124362 - protein, 391 aa, Glycine max
  Coding DNA Sequence Number=SeqID_32677
  Homolog annotation: Hit_ID=A7P2D1; Match level="QueryCoverage=87%, HitCoverage=27%, E-value=1e-60, Identity=41%"; Hit description =Chromosome chr1 scaffold_5, whole genome shotgun sequence
  Pfam annotation: Domain name=FYRC; Domain location=74-154; Score =12.5; E_value=0.0011; Accession=PF05965.5; Description=FY rich C -terminus
MAKTRSAEKAAQVDAEDRTDGLEIISIGSLYKGSWDKKYWTTSRGKDRYPYPVGYQAVRAYNGTTYKMEICEGVNGPRFLISSDDGSSSSGKTPDQAWEEFQKKGCPRIKIWHGKRLSSKMDGLELFGFKNQFIQRLLRELVTDVNGIAERSLVSPNICDGVTRTDHDNCTNVGTYPDLLTCLGKPRVTGKRSRCELKNKKLNVRARSQSPELTCSRPSIVQNEKSLGQRSSTIHYGSEVLEVHNQIGVPVLLQRISSVCKSSNCISSKNELLLNPIEISDEKKVGAVPSRGWTGFLYSEDCKTTELTAEDLPQDVELKISNLLVTPEDKKLMPLCSKESVGCIDIDLCAPDTIDFVQGDRTHDLSALFFSLNHLTHLISPAILNSVFFIE

SEQ ID NO: 124363 - protein, 80 aa, Glycine max
  Coding DNA Sequence Number=SeqID_32678
MVLKSWNVNLLGEPLALNFVASMADNLAMELRQKECTEPVKLIKLSYKGAVVFQQSDKILGSFNVQFQFSDSNLEDKVDF

SEQ ID NO: 124364 - protein, 336 aa, Glycine max
  Coding DNA Sequence Number=SeqID_32679
  Homolog annotation: Hit_ID=A7P2D1; Match level="QueryCoverage=65%, HitCoverage=17%, E-value=1e-50, Identity=49%"; Hit description =Chromosome chr1 scaffold_5, whole genome shotgun sequence
MATLAEKTQDEVVGQTGNAEMMIMSSNLPKLVYTRKKLRNDIPFQENCSVMECTEYDKFKHVTPEMYTAKDTLHPSEIILVNNSNDKPCETDDTAGLCVQTPQIRSDVLGGHSNLVDPNPTSSQNLTLFADENKCFGTKEVQLISEPMPLQNQELKNNLGSSVKFVGRYLHPMPVSSLFLSTREDEIHVCVLCGYLTGQYRTLFTYKVAIAEPTLGCPSVMAHSSILLPDPKHNFIKETMVERSGVQLTPGGQYVVLIGSIKTPNCREGKIDCHCSTCKSVCSEKNALKIVQVEHGYVSVVTTLETVDNVHCILVCEPNRLVSVGESGKLQLTACI

SEQ ID NO: 124365 - protein, 152 aa, Glycine max
  Coding DNA Sequence Number=SeqID_32680
  Gene Ontology: Mol. function=RNA-directed DNA polymerase activity
  Homolog annotation: Hit_ID=Q2HV58; Match level="QueryCoverage=95%, HitCoverage=39%, E-value=6e-13, Identity=33%"; Hit description =Putative non-LTR retroelement reverse transcriptase, related
MRLFKNRLPTRDNLRKRQETLPSYSCPLCEYEEESVTHLMFICSKTRSLWWEPMRWVNRVGPLPIDPKNNFLQFSQWNRQSCTVKRWEFLWIALSLCIWHHRNGMVFNNQPFNPEKVMDEALFHTWSWLKCVEKGFQLHFNFWSTNLKDAFS

SEQ ID NO: 124366 - protein, 140 aa, Glycine max
  Coding DNA Sequence Number=SeqID_32681
MDTKTRSQMMMHGMEEIFVQIEGLHHTCHQDHIQDLRRLQQHGTLAEFNNAFDAISGFLYSSFNCNSLRLKCKTLRERVFLWGRGIDIKTSYPIAQRLFAMRRYGERCCTQPYPFICKEAVSGFEPMTNKSPRHNFMSIS

SEQ ID NO: 124367 - protein, 146 aa, Glycine max
  Coding DNA Sequence Number=SeqID_32682
  Homolog annotation: Hit_ID=Q2HTA0; Match level="QueryCoverage=74%, HitCoverage=17%, E-value=3e-09, Identity=35%"; Hit description=IMP dehydrogenase/GMP reductase, related
MPYGEHRPVREFDLISCFFGQLRWGPVAARHRPERVVRQFGYVQSIPSEAVNSWVSFEEIDDRWMHYSNHLAPTGEICFMPGQCALEYMDWFFIISHPFMTPHIPQVPEPLVGALTHARPHVDQPRHVVMLAMRSLKGCSVCSTLG

SEQ ID NO: 124368 - protein, 154 aa, Glycine max
  Coding DNA Sequence Number=SeqID_32683
  Homolog annotation: Hit_ID=A5ANP1; Match level="QueryCoverage=48%, HitCoverage=21%, E-value=8e-10, Identity=44%"; Hit description =Putative uncharacterized protein
MSHPPQLLYAFQLLHVKIIYLQHRYVESSEILFKGLLPDVEQHMPEFLKHARISYILKVAQDHSFSKMDFKQITFKEGASLNRPPLFDGGHFSFWQKRMKIFIQSIGLSAWNAIVKGSFISTKVVNGELVPKEWDEMKDDEERKVQDDQKAKNI

SEQ ID NO: 124369 - protein, 229 aa, Glycine max
  Coding DNA Sequence Number=SeqID_32684
MVVIPCRYVDEDTLLAARGGSDDKEVVLDDDTLDNVESIVDDPLCPTVVISREERRKMYEPWKRVIIIKVLGRKVSLNFLRARLARMCIPKGVMKRMPRVSPWVFGCFGIPSCPNISSMDELWEEMIQLSTDRNDPWLAIGDFNVYPHPHEKSEGGPVNVYHAGFDDDKVLLKDAWIVMQALLELVGLGSSSSMDSFASWKINGSGMEKEEREEMPLQGEDESRRSSPP

SEQ ID NO: 124370 - protein, 263 aa, Glycine max
  Coding DNA Sequence Number=SeqID_32685
  Gene Ontology: Mol. function=SNAP receptor activity; Cellular component=late endosome membrane; Biological process=intracellular protein transport
  Homolog annotation: Hit_ID=Q3HRZ4; Match level="QueryCoverage=84%, HitCoverage=80%, E-value=4e-89, Identity=78%"; Hit description =Syntaxin-like protein
  Pfam annotation: Domain name=SNARE; Domain location=185-255; Score =31.9; E_value=2.3e-06; Accession=PF05739.10; Description=SNARE domain
  Pfam annotation: Domain name=Syntaxin; Domain location=13-116; Score =56.3; E_value=1e-13; Accession=PF00804.16; Description=Syntaxin
  Pfam module annotation: Pfam domain module=SNARE::Syntaxin; Domain location=185-255::13-116
MSFQDIEAGRPFGSRRGLMNGKQDPTQAVAAGIFQINTAVSTFQRLVNTLGTPKDTLDLREKLHKTRLHIGQLVKDTSAKLKQASDIDHHAEVNASKKIADAKLAKDFQAVLKEFQKAQRLAAERETAYTPFVPQAVLPSSYTASEVDVGSDKSPEQRALLVESRRQEVLFLDNEIAFNEAIIEEREQGIQEIQQQIGEVNEIFKDLAVLVHEQGAMIGNLFHSLLFFLMILAPTLRTPMQQQHKQNLNFQKLQKPKDQIPLW

SEQ ID NO: 124371 - protein, 151 aa, Glycine max
  Coding DNA Sequence Number=SeqID_32686
  Homolog annotation: Hit_ID=UPI00006A2D9E; Match level="QueryCoverage =76%, HitCoverage=88%, E-value=2e-10, Identity=17%"; Hit description =UPI00006A2D9E related cluster
LHALAFIGLHALTFRGLHILAFIGLHFLAFRGLHILTFRGLHALTFRGLHVLAFRGLHALTFRGLHALACIGLHAITFRGLHVLAFKGLHVLAFRGLHILAFRELHICAFRELKEEAITKLLCISGQDFARAAAKRRVQIMRTEITTLTQI

SEQ ID NO: 124372 - protein, 61 aa, Glycine max
  Coding DNA Sequence Number=SeqID_32687
  Subcellular localization annotation: CTP_CleavageSite=49; ConfidenceScore=5.00e-01
MHPRYRRGMHLVSGCWLSAIQSARKLGLAQRKMSSLSALVTSGLAPVTLAQPGGEDGALIE

SEQ ID NO: 124373 - protein, 281 aa, Glycine max
  Coding DNA Sequence Number=SeqID_32688
MAEPSKKRKGTSSRSQRHSETQETPIPSSIPSASLFSSKEQRIWYTNLFSSRSIVDPKLIDMDFFSNESFECIQAFENSNLIPFMSLKLHVYSELVKVFYSNLEIQEGTLISEVYGIKMVIDQSLFYELAQLSSEGVPFEGTLIDDWKYEFSVHDARRLVCTNQANMTGKLLAGSLAFESRILHYLIVRILLPRSSNLAQVKKGARPVDEEGHGGEDSSLLQKILDRFDGLQTFVGERFDTLELQVDMRFNEMESRITKVEEDVSYIRTSFDLPPPPPPSS

SEQ ID NO: 124374 - protein, 186 aa, Glycine max
  Coding DNA Sequence Number=SeqID_32689
  Gene Ontology: Mol. function=nucleic acid binding
  Homolog annotation: Hit_ID=A7PWK4; Match level="QueryCoverage=86%, HitCoverage=11%, E-value=7e-28, Identity=43%"; Hit description =Chromosome chr8 scaffold_34, whole genome shotgun sequence
MTMIKVMKARQSLTAMEIQPSKECDSNGNVHEKEVNLFKKRRWSLYSDNEENNSFYGAHMTGERYQSMLGKHIQKYKRRFKGTLSSLAQNQAATPLVKSNTGLKAPKSGNEHMGGGLHVAKSTWEWMNDSSSQKLGNYHDVDFLPQYGTDRIMYEHASLDIGDGIIYKIPPIYDKLAGALNLPSFS

SEQ ID NO: 124375 - protein, 202 aa, Glycine max
  Coding DNA Sequence Number=SeqID_32690
MIETQTTPIPPFISSSTLFSLKEQRIQYTSFLSSRSILDPKFLDLKFFDDEMFDCFQAFQNSGLIQFMSMKLLFYPELVRAFYSNLEIQEGTLVSEVYGIKMVIDESLFFELTQFSSDGVPFEGTIDEDWKFDFSSHDARRLVCTNQANMTGRLLVGSLAFECRIMHYLIVRILLPRSSNLAQVFEEDLVVMWVLLTDRQID

SEQ ID NO: 124376 - protein, 44 aa, Glycine max
  Coding DNA Sequence Number=SeqID_32691
MVIKSGTFDINSRPNSSQQGGYDRGLSKEKEFGLGGLNMDGQIT

SEQ ID NO: 124377 - protein, 36 aa, Glycine max
  Coding DNA Sequence Number=SeqID_32692
MTVFQPSFSLRAFFAMAEEFVKDSVHQNGVAAKLGI

SEQ ID NO: 124378 - protein, 788 aa, Glycine max
  Coding DNA Sequence Number=SeqID_32693
  Pfam annotation: Domain name=RRM_1; Domain location=47-117; Score =17.4; E_value=0.0037; Accession=PF00076.13; Description=RNA recognition motif. (a.k.a. RRM, RB
MSRGEGRREGGRGCRERDREGGRVDHREETKRYQPANWRDKATITTFYFTRFPDHITEKDLWAQFKRWGDVREIFIPNHRNKGGRRYGFVRYFGVSDERELERKLDNIIVGGLKMYVNVPKYGRGKKKLQEHTNRHGTKPEGHHTKMCHRNPSMTYAKVVSTRSTDAGLRRTFQPPHHTTTAPHSHIQLDVSEQRRRKYMDTWVGRLKNLGAFERVEEEIPWELGVNVMPKYIGDDMVLLLGLLDSEAEEIISDEHQHGTSPFYSLQKWNPQMRPCNRLVWVQCWGVPLEAWDETHTVFIVEEGLSDVGTRAHRRFGVVESTKEIESQDTNNDVPSAAVEPVDDFRHPLQGFDGDRDTHLTDHWSKMLHHGPSPMDDPANNSKSSWRYLPSSEVSARTEERIAEPQDPMNHSEVDPVEHDGGDRVRESPNRNGKGIRPKPTLSKGGTDCMYKESLIDHRTDDPDSPFEAAMIQIGPSKSHIFKNGPSTEVGFSKHTITSSPHTPMNSPIKLVTPSTPLAPPKISNVTQPIEAGQHIELGSTIHTAPFKPIHPFDSPKHQTAAKEREWKVYVKSKGCKQKQAQETKKHNFLEDPNPPPHHQSTLGASTPPSEMRCQLSATHSSNQSMRNNPGPSSTVEGPNEELIKEASSQWELAKLMGVHTDADQATIINKFTAMEETKKEQLDKTLCQALWGDLTVGWEFQPAINTAGGLLCLWNEQSFKVDHRVCGRGFIVLDGRDYGASWETLTVLDTTLREVAHRGLEANNISEFNEWLADLEVEEIPSVGNTL

SEQ ID NO: 124379 - protein, 347 aa, Glycine max
  Coding DNA Sequence Number=SeqID_32694
MASYDGSFFLAHLLLEVDSIDEEDPRPTSSTWSYIKIDSSYDDFLLPFLCPNYPLGIHIIPTTTIKFMLDHIAPRFPPLDLMKKKGKVPPHSKPMPYPGPMDNVALRLIPYHWSRYFTRDVAKKIFAFKPDVEFDQNDVMLFYFKDMYENSRLVYTSKYNKEDTSNHIHMEIMSSINVSSMIFLLFALDLSLTCTSAQKLVEAKQQQEKLKFEKLFNNLHAHLGPQVDVVEPPLVEVTSQPPQIIKDTLAMLTLPIHLTNLLIKNTLKSSLKSFNDYVLFNMNMIMQQRLPPSIQPPPPPPTTIMQSQPAVPASKATITADLVSAPPPSPPKSQPTIPLSLSTEGSL

SEQ ID NO: 124380 - protein, 178 aa, Glycine max
  Coding DNA Sequence Number=SeqID_32695
  Homolog annotation: Hit_ID=A5C0G0; Match level="QueryCoverage=32%, HitCoverage=8%, E-value=1e-11, Identity=57%"; Hit description =Putative uncharacterized protein
MGQSIEGESNEVFFKYEKLGPFFFYCGKLGHVDELCEMLFSKGVDDGNYHWGPNLKGLQAWMITNNMLPARDKVINEAGIFKNPKIISPQSNQESLHIKTPNNDEMNVEESVVNDLVEDKPIWRIIGFYGHPDRENREDSWNLLRFLAEDTSLPWFTIGDFNDLLNNDEKIGLVDLDY

SEQ ID NO: 124381 - protein, 155 aa, Glycine max
  Coding DNA Sequence Number=SeqID_32696
  Homolog annotation: Hit_ID=Q6L477; Match level="QueryCoverage=45%, HitCoverage=11%, E-value=9e-09, Identity=33%"; Hit description =Putative uncharacterized protein OSJNBa0009L15.8
  Subcellular localization annotation: CTP_CleavageSite=25; ConfidenceScore=5.81e-01
MGSPPASTTAPPPSPPSPPPTSDASASTSAVKRTRKASRLRSLSTRPPGVERPVVHVDLATGKADGPHKKKLRTYLGIVTCDKVDITYENWKEVPTAQKDLIWEDIQAEFDILEASDSRTKRKLLQTVGERWRQFKSDLTRKWALAADQDGVEDT

SEQ ID NO: 124382 - protein, 89 aa, Glycine max
  Coding DNA Sequence Number=SeqID_32697
MKTKETIKGPVRLRKEERFQMVVTARVTVRLQRAANEGDSDVVAPQEVQMSSVTELQCRERLQIRVPKRLSESNQNESKSDESERFRSY

SEQ ID NO: 124383 - protein, 109 aa, Glycine max
  Coding DNA Sequence Number=SeqID_32698
  Homolog annotation: Hit_ID=A5B3J2; Match level="QueryCoverage=58%, HitCoverage=14%, E-value=8e-08, Identity=45%"; Hit description =Putative uncharacterized protein
MTDPYAHLAMFIEICNTVKVVDVLDEAIRLSLFSFSLAREAKRWFHSFKGNSLKTREEVVEKFIEKNSHLMQSYPTRALDRRLHVDWARDAREGPRILMSLRVDFGPMD

SEQ ID NO: 124384 - protein, 54 aa, Glycine max
  Coding DNA Sequence Number=SeqID_32699
MASYGEAKDSIDEEYLRPTSSTWSYIIFGKVKGDTYKRHFNAQMRIWFKTIKGI

SEQ ID NO: 124385 - protein, 150 aa, Glycine max
  Coding DNA Sequence Number=SeqID_32700
MTSMLSFEDIDDRWMHYSDYLTVVGLICVVPGQCASDYMQWFFMISHPFMTPAQPVDPARHPPVTQDDTYVEPHIPEVPVAPSATPAHAPSDVEQPRHAVEAFQTIIERLERLLNLRIVIACTKIHEVMEDYLRIARGVTPDDNVYVRSQ

SEQ ID NO: 124386 - protein, 77 aa, Glycine max
  Coding DNA Sequence Number=SeqID_32701
MTVLCKSKRRHQRAIIVIFVKNLDISRRIAQSVSVGLKRKGFLTIQTISPNEKFIFIGNRVKAPVEAVGTYRLKLRH

SEQ ID NO: 124387 - protein, 412 aa, Glycine max
  Coding DNA Sequence Number=SeqID_32702
  Gene Ontology: Mol. function=nucleic acid binding
  Homolog annotation: Hit_ID=A5B1P9; Match level="QueryCoverage=30%, HitCoverage=9%, E-value=2e-15, Identity=35%"; Hit description =Putative uncharacterized protein
ADEDIFLGYSLHSKAYRVFNSRTLSVEEYVHVVCDETKSIVQDNSLEEEDVGFQEKDSSLENDIKSEELEQSKEISTAMPKESPRGWRTQKDLSLDNIIGEISKVVSTHSRLRVLCNNMDFVSQATLTPSQVTPTPLITYFLTQPSSTSKSTFSLLKIASNLSRVQKKAKSFKRKQGEYSQATLNRLDTWLMDESKKNYIKMIYAAKNVMQSYPARALDRRLQEDWAKDAREGLRVLMSLRTHLLLEVASPLSIPSPFRCHSSSKKQRNSLMKKILGLQTPMELTSECENTQVSGLGVVLSQDANLQRYAEDRMLVYRIAYILTPRSSNNAQEWIMAGEPPATTNMNHMEEEAEAKAQQEPAHQSSPFKSLIIQKMDVMLHLHQEHSANVHNTLENITTHLENIETRLTLSN

SEQ ID NO: 124388 - protein, 148 aa, Glycine max
  Coding DNA Sequence Number=SeqID_32703
MASRKRKATTSRPQEPFDTTRFISEASWERYSLNVHSRNILPERNVILYIVEYNEFHWELERRCWHKALTRKPDGDIDVVLVKEFYANLYDPEDKSPKQVQVQGKLIKFDAASLNAFLETPPVIQPGEQYTSYSLFCRTRTNPQELAL

SEQ ID NO: 124389 - protein, 74 aa, Glycine max
  Coding DNA Sequence Number=SeqID_32704
MNPLMKKILGLQAPHGATSCGNFLLRIVSVLLGTDAILPRKGPVTRAMSKRLQEDWARAAEEGPKVLINLRVDF

SEQ ID NO: 124390 - protein, 93 aa, Glycine max
  Coding DNA Sequence Number=SeqID_32705
MKGEAGYRQSRTTLNGNLSQHAPSRASEGEAHGCAFQRRKDARSRHQRLFVENVGKTEGNRSKMKILSSGVIFTLEEGISTSHVCLKGQQPIF

SEQ ID NO: 124391 - protein, 71 aa, Glycine max
  Coding DNA Sequence Number=SeqID_32706
MELAFCVFKSDVVVEGGCFYIDRKRTVLETRHKRSHAYNNTDVESTAFFIVVGLSATLFVMCSTTVILRPM

SEQ ID NO: 124392 - protein, 676 aa, Glycine max
  Coding DNA Sequence Number=SeqID_32707
  Homolog annotation: Hit_ID=A5C2X9; Match level="QueryCoverage=93%, HitCoverage=93%, E-value=4e-42, Identity=29%"; Hit description =Putative uncharacterized protein
  Pfam annotation: Domain name=DUF593; Domain location=276-369; Score =147.4; E_value=3.9e-41; Accession=PF04576.6; Description=Protein of unknown function, DUF593
MASQETHSWTLGGLIGAFIDLVLAYFLLCGSAFAFFVSKWFRFLGFCLPCPCKGTFGFRSSRFCVHRLMFQWPSRKICSIQVMAVKRFPFDLVRVKDHSRSANDRVAAERTHDNRVVELEDEASCSSCSAPRLLPFVDRENVYDAKGKRVMSMKRRSGVRRRRRASYDCTKVSSAVPSENLQSDVVLTPCSPCDGSIIRDKTSAGISPTSGKGVSVDDAEVDQADHDLDEKTCHSYEFSGSMVDSPGQDKYLLSLEHYINNVCDHVQIVGNGEDRIKMLENALEEEKAAYAALYLELEKERAAAATAADETMAMISRLQEEKASMELEMRQYLRMIEERVAYDEEEMDILQEILIRRERENHFLEKELATYRQMDSKGSDQSYGKAKVQHDQWGQKPPISVGTYENRSTISFVKKDEIKDISSNYMVAQTCINMKDGQELEKNTECKDQVHNNLHSSFYDTDLDVFDVHVINDNIKLKEEENEKLSSSSLSTVTNELTNRYLEFGSQTVQSSDVLSNRRRTDKPENGNSVDGPTSQLSMFSNTRRKTLSLDSGRDSSSAVENEKLKIGNEIEILGERLRMLKHEKEKLSFFAENGESEKGQLKLLEEIANHLQRIKQTRNPVRGASLPPSSSKFGIWTEQGSELSPVVVDLIWIVELYSLKLKFSYLMMKGFMIVE

SEQ ID NO: 124393 - protein, 90 aa, Glycine max
  Coding DNA Sequence Number=SeqID_32708
MGVEGRSPEYEEPRDLRSNPFQGGGNDAILPRKVTSSPGRARLLQVEATAHLGELQINQVPAFPINRREGIEGKGPRSSLHILKELREMR

SEQ ID NO: 124394 - protein, 57 aa, Glycine max
  Coding DNA Sequence Number=SeqID_32709
MGCKWQPSPLGPSRMFLQKAVASGGSNLARLGELGGKLLPYFPINRGRSGGERVQPF

SEQ ID NO: 124395 - protein, 202 aa, Glycine max
  Coding DNA Sequence Number=SeqID_32710
  Pfam annotation: Domain name=zf-CCHC; Domain location=51-67; Score =15.9; E_value=0.006; Accession=PF00098.14; Description=Zinc knuckle
  Pfam annotation: Domain name=zf-CCHC; Domain location=74-91; Score =32.1; E_value=2e-06; Accession=PF00098.14; Description=Zinc knuckle
  Pfam module annotation: Pfam domain module=zf-CCHC::zf-CCHC; Domain location=51-67::74-91
  Subcellular localization annotation: CTP_CleavageSite=38; ConfidenceScore=5.21e-01
MKERQARGVGGPQRNHPFRGNGNKRMKPYASNKGKQPMAASNMSQSRGTGVQCFQCGGPHLKRNCPQLQQTQENRCYVCGKVGHYARECRVTGRPTVTANSNTVNRGPTNSTRSGNVSNNNTMVEDQKYFSSQVVSSFPTEVCARSGRAIRYRVSLAASRRPVGTPLRVQLKCSICVSGRIFYRGFMDFCKNLTRSKFRWRL

SEQ ID NO: 124396 - protein, 98 aa, Glycine max
  Coding DNA Sequence Number=SeqID_32711
  Subcellular localization annotation: CTP_CleavageSite=37; ConfidenceScore=5.34e-01
MDHFKVQRLKMIPLKLPSLVTDVWGANTFPARKYNSRAFHLKVRRSRLFRFFRRFPQINVGGDSARIPFVEHASRESRVALPPKGRLRQLATPLGNVF

SEQ ID NO: 124397 - protein, 98 aa, Glycine max
  Coding DNA Sequence Number=SeqID_32712
MLTPTSARKVNRPRGRLGFFVRAEPRLCFGRHWHALIYSAGKTLAHLGQKKLIHGTDRKEFQPTSARKDDRSRFRKEASPDDADRTFPNRRHQILFRD

SEQ ID NO: 124398 - protein, 93 aa, Glycine max
  Coding DNA Sequence Number=SeqID_32713
MAQPPPRERNLREMATPDFTYESLCIQYPDEGVPYVLKTGLIHLLPKFHGLADHHTDLCPSLQQFGVNEQPEAYAANIYNRPPQQKNQQQQNN

SEQ ID NO: 124399 - protein, 126 aa, Glycine max
  Coding DNA Sequence Number=SeqID_32714
  Homolog annotation: Hit_ID=A6FJQ2; Match level="QueryCoverage=30%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPGEKVDSAQDLGWRSKGEDHCKSCRETCRASCINESANARGEAVCVLGALPLPRSLTRCARSFGCASGISSLKG

SEQ ID NO: 124400 - protein, 172 aa, Glycine max
  Coding DNA Sequence Number=SeqID_32715
MTGRLLAGSLAFESRILHYLIVRILLPRSSNLAQALRLNAPLPYPHLVTLFLQHFNIPLDFEPYVPIKRSFLIGAAVIASFGYRIEHNGSWVKKGAQPIDEEGHLHGGEDSSLLQKILDRFDGLQTFVGERFDTLELQVDMRFNEMESRITMVEEDVSYIRTSFDLPPPPPP

SEQ ID NO: 124401 - protein, 99 aa, Glycine max
  Coding DNA Sequence Number=SeqID_32716
MTCDHSLVLVRCLAPIIRQFVKFQDMPKNQKILMHNPSPKTAEGVYLVKWGCNSTHAHLGPPEDPPEGGCFCRKQPARLGELSSPGRAGRQPPPLFCYK

SEQ ID NO: 124402 - protein, 137 aa, Glycine max
  Coding DNA Sequence Number=SeqID_32717
MANQGDWVPFMDVLALLIFGVVLFPNVDGLIDLAAIDAFLAYHHSKESPVVAVLADLFDTFDRRCEKSSARIICCLPALCVWTRGCINYNPTLAIRQLGYPMRGAPTEESMSPFLVRDLGAQNSKTIQRIHKHGKPR

SEQ ID NO: 124403 - protein, 38 aa, Glycine max
  Coding DNA Sequence Number=SeqID_32718
MYQGHNDSLTSKYFNDPRPLEPERLKALRSSGHSFISS

SEQ ID NO: 124404 - protein, 212 aa, Glycine max
  Coding DNA Sequence Number=SeqID_32719
  Homolog annotation: Hit_ID=Q6WAY4; Match level="QueryCoverage=87%, HitCoverage=33%, E-value=2e-21, Identity=35%"; Hit description =Putative uncharacterized protein
MGTNQNGKRFYQVKVKSLDVTSLKELGRLMGPLQRQAFCKVYGKILNLTAAEVFTEAVISLAQYYDQSLRCFMFGDFQMVPTIEEFEEILGCPLGGRKPYLFSGFLPSLSKIAAVVGDSARELDRMKQTHNGVVGLPRKYLEGKARDMESQEKWGPFADILALLILGVVLFPNMDGLVDLAAIDAFLAYHHSKESPVVAILADLFDTFDREM

SEQ ID NO: 124405 - protein, 119 aa, Glycine max
  Coding DNA Sequence Number=SeqID_32720
MGAYAKDEELLIHSFQESLTGVAVTCKRIDVGPKRGKFSHPAWTNEKIGANEEGEDEVEAHAVTAIPIWPSFPPTRQCHYSASNNPSPYPPHSYPQRPSLNHTTKPTYYTTNAKTPLLA

SEQ ID NO: 124406 - protein, 152 aa, Glycine max
  Coding DNA Sequence Number=SeqID_32721
  Homolog annotation: Hit_ID=Q9KHC4; Match level="QueryCoverage=27%, HitCoverage=8%, E-value=2e-07, Identity=69%"; Hit description=SocE
DAGSRQARQGASAGVGGCRGWLNYAASEQIVLRVHHMRAIGAGLFAITPAGERGMCCKAIKLGNARVFPVTTFRETCRASCINESANARGEAVCVLGALPLPRSLTRCARSFGCGERYQLTQRRNRKKAALLAFFHRLRPPDEHHKIDAQVR

SEQ ID NO: 124407 - protein, 153 aa, Glycine max
  Coding DNA Sequence Number=SeqID_32722
  Gene Ontology: Mol. function=structural constituent of ribosome; Cellular component=ribonucleoprotein complex; Biological process =translation
  Homolog annotation: Hit_ID=P56791; Match level="QueryCoverage=86%, HitCoverage=48%, E-value=3e-60, Identity=85%"; Hit description =Chloroplast 50S ribosomal protein L2
  Pfam annotation: Domain name=Ribosomal_L2_C; Domain location=5-130; Score=211.1; E_value=2.6e-60; Accession=PF03947.9; Description =Ribosomal Proteins L2, C-terminal domain
MSDSADLDSYIPTRAARNTYIEITLGKGGQLARAAGAVAKLIAKEGKSATLKLPSGEVRLISKNCSATVGQVGNVGVNQKNLGRAGSKCWLGKRPVVRGVVMNPVDHPHGGGEGRAPIGRKKPATPWGFPALGRRSRKRKKYSDNLILRRRTK

SEQ ID NO: 124408 - protein, 265 aa, Glycine max
  Coding DNA Sequence Number=SeqID_32723
MAPRKLASKRSRKDKAAEGTSSAPEYDSHRFRSVVHQQRFEAIKGWSFLRERRVQLRDDEYTDFQEEIGAGGGHHWLLLWQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQGQ

SEQ ID NO: 124409 - protein, 243 aa, Glycine max
  Coding DNA Sequence Number=SeqID_32724
IAGARGRVLSGRCGCSVEPRHGIESSKWAIFGKQNWRCGMNRKLGYGAQLRANLDPTKGVGRLRQQDGGHGSRNPLRTPMSRRARRSLQNPGASPGGAVVVQILVVVANIQMRTLKAEEGKGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQN

SEQ ID NO: 124410 - protein, 73 aa, Glycine max
  Coding DNA Sequence Number=SeqID_32725
MTRKAFRNLTKELTSIVFSHNENSSKFCEENSFREENPSRGTSIMFPWVISRRFSTVLRRSSFVLRRSSAFNR

SEQ ID NO: 124411 - protein, 57 aa, Glycine max
  Coding DNA Sequence Number=SeqID_32726
MKRRFLEKFFPASRTTSIRKEVCGIRQQPRETLYEYWRDSTSCVLAVLTIKSPVEVL

SEQ ID NO: 124412 - protein, 69 aa, Glycine max
  Coding DNA Sequence Number=SeqID_32727
MSKPKVNIGSLLNPGSSTFAQSRGLYNFKLGETNDIGEPQFDPPRIPTHVHVNPNCDELIPYLEAGSHV

SEQ ID NO: 124413 - protein, 61 aa, Glycine max
  Coding DNA Sequence Number=SeqID_32728
MEKEFEMSMMGELKFFLGLQVKRVTRGSQVRLPRKKNARSRHQRLFEENVRKTGKGVVYEI

SEQ ID NO: 124414 - protein, 101 aa, Glycine max
  Coding DNA Sequence Number=SeqID_32729
  Homolog annotation: Hit_ID=Q51617; Match level="QueryCoverage=45%, HitCoverage=66%, E-value=1e-15, Identity=91%"; Hit description =Putative uncharacterized protein
MVWQHCIISYCHAIRKMLFCDCIYQGYCLMSGYIFECVSRGPFVSRVSVMTVKTSDTCSSRRRSQLVCKRMPGADKPVRARQRVLAGVGAGLTMRHQSRLY

SEQ ID NO: 124415 - protein, 272 aa, Glycine max
  Coding DNA Sequence Number=SeqID_32730
MERSMIDAASGGALGDMTPAEARNLIEKMASNSQQFSARNDAIVIRGVREVATNSATSYETKKLEGKLDALVNLVTQLALNQESVPVARVCGLCSSADHHTDLCPCMQQPGAIEQPEAYAANIYNRPPQPQQQINHSRTTCSFLQNVAGPSRPYIPPPIQQQQQPQKQPTVEAPPQPSLEELVRQMTMQNMQFQQETRASIQSLTNQMGQLATQLNQQQSQNSDKLPSQAVQNPKNVSAISLRSGKQCQGPQPVAPSSSANEPAKLHSTPEK

SEQ ID NO: 124416 - protein, 38 aa, Glycine max
  Coding DNA Sequence Number=SeqID_32731
MDPYRILGCLAATFSACPVSGRDDDLSVVTLSSICIRP

SEQ ID NO: 124417 - protein, 113 aa, Glycine max
  Coding DNA Sequence Number=SeqID_32732
MTQELVARGDTLRLSAPRHSVTPKAAGPMIRGDTLRLSAPFCHPEAAGPMTSRDQVWSFCTLVSSRGGGPDDTRRYLTVIRTLLSSRGDGPDDKQRPNLVILHPCIIQRRRAR

SEQ ID NO: 124418 - protein, 208 aa, Glycine max
  Coding DNA Sequence Number=SeqID_32733
ATNVHVVYLEALRDLSMTERYAWGVAALCWIYEQFPSIADSTADQEYDEDSPRAWSAWTDSGFRMSVGSLMGSTGRFGTSMSDHAIPTILAPPVDSWVSYDDIHDRWMHYEDHIVPAGEVCVVPGQCSSDYMDWFFRISHPFMTPGHALDPLPHGYAPQPRVVPQAPQTDIPHVPEPGASSTSAEEPRHAVVGASSESRGGHAWLIDT

SEQ ID NO: 124419 - protein, 55 aa, Glycine max
  Coding DNA Sequence Number=SeqID_32734
MDEMAPKKLSAKRSRRDATAEGTSVAPKFDSHRFWSAVHQQRFEAIKGWSFQGIL

SEQ ID NO: 124420 - protein, 204 aa, Glycine max
  Coding DNA Sequence Number=SeqID_32735
MHYIIVRILLPRSSNLAQASEEDLILMWDFVTGRQIDWAHLVRYRMHKALRANAPLLYPQLVTLFLRHFQIPLDDEPFVQVKRYFAIGAGAVTSFGYRKDHDGQWLKKDVHPPQDERTPSPPPQRDDSSALMNKVLSEFRGLRTYVGEHFDSLDGRFGGMDTRITQLEEDEFNCHHQKGGDCRSKDFDFDVLMMPYDHALLKFN

SEQ ID NO: 124421 - protein, 29 aa, Glycine max
  Coding DNA Sequence Number=SeqID_32736
MARIADKIKTIDGSKETLKLVVRITELCR

SEQ ID NO: 124422 - protein, 28 aa, Glycine max
  Coding DNA Sequence Number=SeqID_32737
MPMLDQFQPFIHDFTDNIVDVKVDGYCG

SEQ ID NO: 124423 - protein, 263 aa, Glycine max
  Coding DNA Sequence Number=SeqID_32738
  Homolog annotation: Hit_ID=UPI00006A2939; Match level="QueryCoverage =81%, HitCoverage=100%, E-value=7e-11, Identity=27%"; Hit description= UPI00006A2939 related cluster
LHVLTFRGLHALAIRGLHVLTFVGLHAFTFRGLHVLANRGLHALTLRGLHVLALRGLHVLTIRGLHALTSRGLHVFALRGLPALALGLHALAIRGLHVLTFVGLHVLTFRGPHVLTFRGLHALAIRGLHVLTFVGLHALTLRGLHALAIRGLHVLTFRGLHALTLRGLHVLAIRGLHALTSRGLHILVLRGLHALTFRGLRVLIFSVLHIYTLREFKGQLCEHNQRRRLSHSYYAYPGQDFTRAAAKRRVRIMRTNMTTLTQI

SEQ ID NO: 124424 - protein, 67 aa, Glycine max
  Coding DNA Sequence Number=SeqID_32739
EKREVVATQLAQASSPHPSEIVQQCFFSTSGMSWNFTDYLTVGVKYLKAVKRRLDATKQWSLDEIRV

SEQ ID NO: 124425 - protein, 162 aa, Glycine max
  Coding DNA Sequence Number=SeqID_32740
  Homolog annotation: Hit_ID=Q8H6W2; Match level="QueryCoverage=33%, HitCoverage=58%, E-value=2e-07, Identity=50%"; Hit description=Gag -protease polyprotein-like protein
  Pfam annotation: Domain name=zf-CCHC; Domain location=138-155; Score =31.8; E_value=2.5e-06; Accession=PF00098.14; Description=Zinc knuckle
MASSNPLFPEGNSIYRPPIFNGEGYHYLKTRMQIFIEAIDLNIWEAIELGPHIPTIVDEHEMELQRLNQNEENEKKKRSIALKASSSIQEENEEEDSDDEEDFSFFVKKFQKFIKKRRIDRRQNYNNGRKSQDDSQVLRCYKCNQIGHIKANCPSNEEWSEK

SEQ ID NO: 124426 - protein, 108 aa, Glycine max
  Coding DNA Sequence Number=SeqID_32741
MFLHGKMPRKWVFRPYLTSIYQTPLIHIVATYPSAGGRRVTRGMRVPRKEYARSRHQRLFEENVGKTGKDEIYELFSERFGSCIYARGRVFSFAPTYSSICDEEIRPT

SEQ ID NO: 124427 - protein, 311 aa, Glycine max
  Coding DNA Sequence Number=SeqID_32742
  Homolog annotation: Hit_ID=A7UQU7; Match level="QueryCoverage=36%, HitCoverage=20%, E-value=8e-15, Identity=40%"; Hit description=IMP dehydrogenase/GMP reductase, putative
  Pfam annotation: Domain name=DUF1723; Domain location=130-179; Score =40.5; E_value=6.1e-09; Accession=PF08330.1; Description=Protein of unknown function (DUF1723)
MVRTRGLGRALASARRQREAADVAENEPVVAADEPVVVADEPVVAADVHAPGADIADDAKGFPGGLRDPLVLTKYADHVVINVWNREDHPKLKLSSHGRKVQKFGRPAPEIEGLVVATGLSPLIACSIDIGDRGLIFAFVERCHRETSSFHLPVGEVSITLDDVASLLHLPIVGAFYTFKPLHVDEAMLMLVELLEEQQLTACWLHHSLIVAECMDDPDYDEVSPRACRWISMKATMKSISTVTYRQRLDGLRIPDVCWMPYGDHRPVREFDSISCFSEVVDSWVSFEEIDDSWMHYSDHLALAGDICLVP

SEQ ID NO: 124428 - protein, 174 aa, Glycine max
  Coding DNA Sequence Number=SeqID_32743
  Homolog annotation: Hit_ID=A5AMP0; Match level="QueryCoverage=51%, HitCoverage=10%, E-value=8e-13, Identity=33%"; Hit description =Putative uncharacterized protein
  Pfam annotation: Domain name=GRP; Domain location=122-172; Score= -30.3; E_value=0.1; Accession=PF07172.2; Description=Glycine rich protein family
  Subcellular localization annotation: CTP_CleavageSite=27; ConfidenceScore=5.35e-01
PSGLKSKSSVMHPHTLLPSACVDLTCRRNAVAPPSSSLSVPSGFTPAPVELWFLGQEYHDHLEKDVNEIPAESRAHWQELDCQLCAVLWQSVDPDLLEILSWHSDYDHVCDQILFGDHIPSMNNLVTRLLHVSTLVNGENAAATVEISAMVASHGWGRGGHCNRGGGRGGRGGN

SEQ ID NO: 124429 - protein, 65 aa, Glycine max
  Coding DNA Sequence Number=SeqID_32744
  Gene Ontology: Mol. function=aspartic-type endopeptidase activity; Biological process=proteolysis
  Homolog annotation: Hit_ID=A5BXY0; Match level="QueryCoverage=76%, HitCoverage=4%, E-value=6e-11, Identity=66%"; Hit description =Putative uncharacterized protein
MEEAEKEILEIFRKVDVNIPLLDAIKQIPRYAKFLKELCTHKRKLKGNERISIDRFHRGRAGSGW

SEQ ID NO: 124430 - protein, 85 aa, Glycine max
  Coding DNA Sequence Number=SeqID_32745
ILLKLSQDLKEISKPTLLPLQTQAMIQFQTTCLRTLLAIAASKKWSLYQLDVQNAFLHGENIALVGSTPCDPSFSAIRGPIAMNV

SEQ ID NO: 124431 - protein, 44 aa, Glycine max
  Coding DNA Sequence Number=SeqID_32746
MPTSPERAQMTTLASAHQSTWESGVVDKSEAFAPAYPPMRNSDL

SEQ ID NO: 124432 - protein, 139 aa, Glycine max
  Coding DNA Sequence Number=SeqID_32747
MRGSGEFVPFLDTTSRGSEMPQRTFLRRRHGPSVGLFTVGIKTEPICNAYAKDTMRECAQYEYLPNISKRSPVESPTVATYPSAGGRRVTRGMRVPRKEYARSRHQRLFEENVGKTGKDAIYELLSERFGSCIYARGRY

SEQ ID NO: 124433 - protein, 53 aa, Glycine max
  Coding DNA Sequence Number=SeqID_32748
MGEVEEIQEKMKADKEAIKEKMATMMEAMMSVKKIMEANEVAVAATSVAAINS

SEQ ID NO: 124434 - protein, 159 aa, Glycine max
  Coding DNA Sequence Number=SeqID_32749
MWAFHTGRQIDWAHLIRYRMHKALQLNAPLSYPHLVTLFLQHFNIPLDSEPYVPIKRSFLIGAVVIASFGYRKERDDSWVKKGAQPNEDEGHLPVGEDSSLLRSILDRFDGLQTYFGERFDVLEQQVDMRFDEMDSRITKVEGNVTYIRTSFDLPPPPS

SEQ ID NO: 124435 - protein, 191 aa, Glycine max
  Coding DNA Sequence Number=SeqID_32750
  Homolog annotation: Hit_ID=Q6WAY3; Match level="QueryCoverage=39%, HitCoverage=3%, E-value=4e-08, Identity=44%"; Hit description =Gag/pol polyprotein
MNFAARKPVEFTPIPVSYADLLPYLLDNSMVAITPTKVHQPPFLREYDSNTTCDCHGEALGHSIEHCRGLKRKVQGLIDAGWLKFEENRVIFNFHRNWVQAIGLFAQATCAPEFGLPRPFNQRLLVLHIGGAAVRQQEQPFPCVQESPTTRDPRSLNPFSEIGRREEEISLKRDRLYNEDQSKFLIEYASG

SEQ ID NO: 124436 - protein, 161 aa, Glycine max
  Coding DNA Sequence Number=SeqID_32751
  Homolog annotation: Hit_ID=Q2HVA2; Match level="QueryCoverage=86%, HitCoverage=45%, E-value=3e-08, Identity=27%"; Hit description =Putative uncharacterized protein
MGHFNHNSWRWDMRWRRNLFDHESHLAVQFMEEISFVPIQRQEDVCHLFFNCKLTNGLWWESMHWVRVVGPLSITPVHHFYQFCDGFGANMNHSTRCGWWVALTSSIWQHRNHLIFQGKPFDPCKVMDHAIFLAWSWLKAKDKKFSTTFHYWSSNISNFLA

SEQ ID NO: 124437 - protein, 280 aa, Glycine max
  Coding DNA Sequence Number=SeqID_32752
GYLEGKARDMASQEKWGPFADILALLIFGVVLFPNVDGLVDLAAIDAFLAYHHSKESPVVAILADLFDTFDRSAINWFPRWKEGKEGVLFSCGDYPNVPLIGTRGKGKTRQGEVQVSCYTHPKECTELQRKTRPLQKPLNKKPKGPERRNMVERNSEEHCGVVTMSSSSEERREIGHGSLVQHLEATEQSMLAIIGQYKEELNQSVAHEQKLVEDFARVYAKKEARGRVIDALHQEATLWMDRFALTLNGSQDLPRLLAKAKAMAEVCTAPEEIHGLINY

SEQ ID NO: 124438 - protein, 77 aa, Glycine max
  Coding DNA Sequence Number=SeqID_32753
MAVLAEIKLWLSSHKKTSPTYIENFMGDTQQQHILYLKELLSANVSRKKLAQCRMKNSSRGYLTTDVGYCFFYSIPE

SEQ ID NO: 124439 - protein, 42 aa, Glycine max
  Coding DNA Sequence Number=SeqID_32754
MGTNQTGKRFYQVKIKGLDITSIKELGRLMGPLDAILLRKGI

SEQ ID NO: 124440 - protein, 157 aa, Glycine max
  Coding DNA Sequence Number=SeqID_32755
  Homolog annotation: Hit_ID=Q84VH5; Match level="QueryCoverage=60%, HitCoverage=13%, E-value=1e-33, Identity=80%"; Hit description =Envelope-like protein
MLSQHPNILNNIDSVKKRESALSLHYKLFEGTHVPDIVSTSGKAAASGAVSKDALIAELKDTCKVLEATIKATTEKKMELERLIKRLSDSGIDDGEAAEEEEEAAEEEEEAAEEEEDAAEDTEILLSPLQIPLCLITLIMKVADPTCITARTCSGSV

SEQ ID NO: 124441 - protein, 67 aa, Glycine max
  Coding DNA Sequence Number=SeqID_32756
MFMTPRLCILAILGKKTRFREEKASRSAFVTLSRHFREQICEDFPPFFTVLHPFFVRSSFFNRRYLA

SEQ ID NO: 124442 - protein, 122 aa, Glycine max
  Coding DNA Sequence Number=SeqID_32757
MRWWGADRLAACGASTPEPVSGYIRYFSKPTGEGGRLSTSNGRCNGTEHWPESHVIPMRENPGCPSWTLHLVQVPGASTGRNYDRAGCLRSNVIPPYLGSGGAVGAHDSHSPPCSSPGKILP

SEQ ID NO: 124443 - protein, 69 aa, Glycine max
  Coding DNA Sequence Number=SeqID_32758
MKKVVKDQQTMKDMRDEEEKLENQKKKKDSKALSSKAKRKEKEEKDSSKKIVKKKNHFATKCDIKSTHP

SEQ ID NO: 124444 - protein, 167 aa, Glycine max
  Coding DNA Sequence Number=SeqID_32759
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q8MBP6; Match level="QueryCoverage=46%, HitCoverage=16%, E-value=3e-34, Identity=96%"; Hit description=ATP synthase subunit beta
  Pfam annotation: Domain name=ATP-synt_ab_C; Domain location=30-114; Score=59.4; E_value=1.2e-14; Accession=PF00306.18; Description=ATP synthase alphabeta chain, C terminal domain
ISGKGIYPAVDPLDSTSTMLQPRIVGEEHYETAQRVKQTLQRYKELQDIIAILGLDELSEEDRLTVARARKIERFLSGGATLEFSCLESLDNLGKIGLFGGAGVGKTVGILVREIDLYYGNSGQESGVLRPNMPIAHKELVDIGQFENDVFRCRRPMVNDGSDGRFC

SEQ ID NO: 124445 - protein, 205 aa, Glycine max
  Coding DNA Sequence Number=SeqID_32760
  Gene Ontology: Mol. function=electron carrier activity; Cellular component=integral to thylakoid membrane; Biological process =electron transport
  Homolog annotation: Hit_ID=P49161; Match level="QueryCoverage=99%, HitCoverage=96%, E-value=6e-50, Identity=82%"; Hit description =Apocytochrome f precursor
  Pfam annotation: Domain name=Apocytochr_F_C; Domain location=115-204; Score=166.6; E_value=6.6e-47; Accession=PF01333.10; Description =Apocytochrome F, C-terminal
MQTRNAFSCIKEGITRSISISIMIYIIIRAPISNAYPIFAQQGYENPREATGRIVCANCHLANKPVDIEVPQAVLPDTVFEAVVRIPYDMQVKQVLANGGNRGRGQIYLDGSKSNNNVYNATAAVDALDGREVIDIIPPGPELLVSEGESIKLDQPLTSNPNVGGFGQGDAEIVLQDPLRVQGLLFFFASIILAQIFLVLKKKQQ

SEQ ID NO: 124446 - protein, 194 aa, Glycine max
  Coding DNA Sequence Number=SeqID_32761
  Subcellular localization annotation: CTP_CleavageSite=68; ConfidenceScore=5.32e-01
VWSVLSYSNLAPTSHTSDLTVDRARLIFGLVTQLDMNVRALISGQITSMAQSNSSRLGFPALITTLCRSRGVASDSLVFERLSPVINLAYIRKNCWNPDDPTVIIRGARRPRARPIEAASTLVAPHPASTSSAPPPARMIAAPSTLPLADFQWTQPPLHREDEDPAAQEAAATSEKSLEATLEPPTPLADTTSP

SEQ ID NO: 124447 - protein, 51 aa, Glycine max
  Coding DNA Sequence Number=SeqID_32762
MEHETFLATWLAEIDFSLNGLERFSNLQPQPSYHEKPMKNLWYVGGTSLIP

SEQ ID NO: 124448 - protein, 257 aa, Glycine max
  Coding DNA Sequence Number=SeqID_32763
  Gene Ontology: Mol. function=DNA-(apurinic or apyrimidinic site) lyase activity; Cellular component=intracellular; Biological process= DNA repair
  Homolog annotation: Hit_ID=Q1GYD8; Match level="QueryCoverage=99%, HitCoverage=99%, E-value=1e-115, Identity=76%"; Hit description =Exodeoxyribonuclease III
  Pfam annotation: Domain name=Exo_endo_phos; Domain location=1-255; Score=161.2; E_value=2.8e-45; Accession=PF03372.14; Description =EndonucleaseExonucleasephosphatase family
MRIITLNLNGIRSACNKGFLPWLANSGGDIVCLQELKAQVGDMQPEMLQPPGYHGYFHYAEKKGYSGVGIYSKQPADKVIIGLGHAHIDAEGRYLECQYGNLSVVSLYLPSGSSGEERQQFKFQVMDLFLPHLEQLIASGREVVICGDWNIAHQEIDLKNFKGNRKNSGFLPEERSWMTDVLGRVGWVDTYRGLYPDTTDECYTWWSNRGQVYAKYVGWRIDYQLATPALGAKVVAASVYKAERFSDHAPLIVDYAD

SEQ ID NO: 124449 - protein, 177 aa, Glycine max
  Coding DNA Sequence Number=SeqID_32764
MPLSPMILVTLADSELMSMAPSFLLLGGAYLHGTAWLFLYENGISLTTEGCWGVWGAASLVKCITKGLGFLRPSSSADCMHMCCSSPPSSPTSSQPWSIICCNRNLSRAHRGELCPPFVGPRRYTFWGSSRPSEVALGLYHFGKGGWWILLGDITTIWLATRDGKRSTYVIGIGVNS

SEQ ID NO: 124450 - protein, 101 aa, Glycine max
  Coding DNA Sequence Number=SeqID_32765
  Subcellular localization annotation: CTP_CleavageSite=31; ConfidenceScore=5.46e-01
MGQLATQLNQQQFQYSDRLPSQSVQNPKNVSAIALRSGKQCQGPQTATSSSSANEPAKLHSTPEKDDDKNLKKVAYPSSVPSKRNFQQKNGRDREGDIGNI

SEQ ID NO: 124451 - protein, 294 aa, Glycine max
  Coding DNA Sequence Number=SeqID_32766
MRSWVRGQWIPFDADAIGQLLGYPLVLQEGQECEYGQRRNRSDGFDEEAIAQLLCIPGQDFARTAAGRRVRIMRTNMTTLTQIWMTLLLSNILPSDHNSDLPLPKCQLVYAILTRMSIHVAQLIADAIYIFAGMAPTRHPLDPDKSNRALRFPALITGLCQSFGVPVAPSKVIRPPITRAFIEKYCQQRQVQGDAPTGRGRAATSSGCKRPTHRAHVQTHDCLYQMSLSLQSQGFTSFPCPTLDQFRAEVAWPGDFPEAQAGEAPAEAPDEANEAREDEEMTDLIDFIGGSGVT

SEQ ID NO: 124452 - protein, 85 aa, Glycine max
  Coding DNA Sequence Number=SeqID_32767
STLEDPLAAEAARAVHRQPTGSGLGPPCPALRANPFPEYDRAWEALGPPDFQGPPGAHRTPRDVRCSSSRWTLPPAEPFPGWAGC

SEQ ID NO: 124453 - protein, 64 aa, Glycine max
  Coding DNA Sequence Number=SeqID_32768
MYKAGYSLCCRSMIIGVETWIKMKSATRSSRCVGYRMGELAFEEQDEASLSQGSHTMETLKRVK

SEQ ID NO: 124454 - protein, 170 aa, Glycine max
  Coding DNA Sequence Number=SeqID_32769
  Gene Ontology: Mol. function=nucleic acid binding
  Homolog annotation: Hit_ID=Q1SKZ9; Match level="QueryCoverage=92%, HitCoverage=31%, E-value=6e-10, Identity=26%"; Hit description=Zinc finger, CCHC-type
MKFSPPPSDDEVLLEETVLQPLEEAWGHSLIGYMIGRFPGKKALLDCCQKWGVKFSFSAHESGWLVFKFEAEDDLNQVFSAGPYFIFQRPLLLKVMPAFFDFGNEELSKIPIWVKLRNLPLKLWNPQALGKILSKIGSPIRSDHLTASKRSISFARALVEIDASLEFIDE

SEQ ID NO: 124455 - protein, 107 aa, Glycine max
  Coding DNA Sequence Number=SeqID_32770
  Subcellular localization annotation: CTP_CleavageSite=60; ConfidenceScore=5.67e-01
MHTQSFTIPQFPKIGLTHKNSPQWSRQLSQPTLSRASEARLTGASSKGGKCAESPPTFICGKRRKNRRKPVMKNIPDSRAVFTFEEGRQKRGSCSYIPSIEEEIRPT

SEQ ID NO: 124456 - protein, 71 aa, Glycine max
  Coding DNA Sequence Number=SeqID_32771
MSLGFNQYGCFFSPESSIGSILWVTILPYMFFSFRRKDINFTGIDAYDLPLYDPAVMIPLALRPLPQRCCP

SEQ ID NO: 124457 - protein, 50 aa, Glycine max
  Coding DNA Sequence Number=SeqID_32772
MERGIGPILDLTPKEEKRMEGLKSEERKVPLATPSFQGYALFDGLPLLGK

SEQ ID NO: 124458 - protein, 66 aa, Glycine max
  Coding DNA Sequence Number=SeqID_32773
MGELNCAIARSPPGTTYDGVVPGDMSRGSGDLGDVRWGAIAQNQGDRALVIDYQLGVIDYTVLPAT

SEQ ID NO: 124459 - protein, 132 aa, Glycine max
  Coding DNA Sequence Number=SeqID_32774
MHKALRLNAPFPYPHLVTLFLQHFNIPLDSKPYVPIKRSFLIGATVIASFGYRKEHDGSWVKKGAQPIEEEGHLPVREDSSLLQKILDKFDALELQVDMRFNEMDSRITKVEGDVSYIRTSFDLPPPPPPSS

SEQ ID NO: 124460 - protein, 102 aa, Glycine max
  Coding DNA Sequence Number=SeqID_32775
MDNEEGVQEQMKADLSALKDQMASISEVMLKLQKTIEDKATTTASSIVREAEPVLQPTLNPGLDRNTAVFGRRYSLQAYPYGLPPDFTPRATPGRVKPSPFF

SEQ ID NO: 124461 - protein, 239 aa, Glycine max
  Coding DNA Sequence Number=SeqID_32776
  Homolog annotation: Hit_ID=A5C7C5; Match level="QueryCoverage=92%, HitCoverage=33%, E-value=5e-17, Identity=26%"; Hit description =Putative uncharacterized protein
  Pfam annotation: Domain name=zf-CCHC; Domain location=168-185; Score =31.8; E_value=2.5e-06; Accession=PF00098.14; Description=Zinc knuckle
MQIFIEEIDLNIWEAIELGPHIPTIVDVSTSTATQKPRDKWTEEDRRKIQYDLKAKNIITLALGIDEYFRVSNCTNAKDMWDTLQLTHEGTTDVKREWQPKVTAISESKDLSSMSLATLFENEKEDSDDEEDFSFFVKKFQKFIKKRRIDRLQNFNNGRKSQDDSQVLRCYKCNQIGHIKANCPSNEEWSEKSEKKRFDERRTKKAYIAWDDNDSSNGSEKEINLLTKDYESDENISLG

SEQ ID NO: 124462 - protein, 72 aa, Glycine max
  Coding DNA Sequence Number=SeqID_32777
MEKEKHVSYSSHEFCKSLSEELSDYYRGRHRSHPRPHSQRREKDRRPQEVNISLPYFHGKDNVEAYLDWEMK

SEQ ID NO: 124463 - protein, 370 aa, Glycine max
  Coding DNA Sequence Number=SeqID_32778
MAPRKLASKRSRKDKAVEGTSSAPEYDSHRFRSAVHQQRFEAIKGWSFLRERRVQLRDDEYTDFQEEIGRRRWASLVTPMAKFDPEIVLEFYANAWPTEEGVRDMRSWVRGQWIPFDADAIGQLLGYPLVLEEGLECEYGQRRNRSDGFDEEAIAQLLCIPGQDFARTAAGKRVQIMRTNMTTLTQIWMTLLLSNILPTNHNSDLPLPKCQLVYAILTRMSIHVAQLIVDAIYLFAGMAPTRHPLDPDKSNRALGFPALITGLCQSFGVPVTPSKVIRPPITRAFIEKYCTQRQVQGDVPQATNPPPPHQAGPAGLFDTEQYLRHLVRQQAANHRAHVQTHDCLYQMSLSLQSQGFTFFSVPYSGPVQGR

SEQ ID NO: 124464 - protein, 69 aa, Glycine max
  Coding DNA Sequence Number=SeqID_32779
MARKPRQDFGISKGQIFLFMWLSMSHIKRKPTFQKLSLPLPHVAFLPPSFSIEAPHKASTFGAHFCPKS

SEQ ID NO: 124465 - protein, 95 aa, Glycine max
  Coding DNA Sequence Number=SeqID_32780
MGKIDLLEERLRAVEGLGNYPFSDLADLCLVPDIIIPPSLKSSSDVLPKDGGIFYERKAVNAFLSRQLSQSSGGMVHQSGSFSDPVLERLGNCLH

SEQ ID NO: 124466 - protein, 186 aa, Glycine max
  Coding DNA Sequence Number=SeqID_32781
  Homolog annotation: Hit_ID=Q84VH5; Match level="QueryCoverage=100%, HitCoverage=27%, E-value=6e-80, Identity=82%"; Hit description =Envelope-like protein
  Subcellular localization annotation: CTP_CleavageSite=21; ConfidenceScore=5.25e-01
MATSPKDTSSPGSPSVPSSPSSTKAPSNQEQPEFHIQPIQMIPGQAPVPEKLVPKRQQGVKISENPSLATSPREVDPEMDKKIRSIVSNILKNASVPDADEDVPTSSTPNVSVPDADKDVPTSSTPNAEVLSFSSKERSTEEEDQATEKTPAPRAPEPAPGDLIDLEEVESDEEPIANKLAPGIAE

SEQ ID NO: 124467 - protein, 148 aa, Glycine max
  Coding DNA Sequence Number=SeqID_32782
  Homolog annotation: Hit_ID=A5AEQ1; Match level="QueryCoverage=43%, HitCoverage=15%, E-value=9e-12, Identity=55%"; Hit description =Putative uncharacterized protein
MADNNSFIPNPHEPSKPLACITFTNVTKLLPNNYPNWKQQVEALLDGYDLLQYPDGSFPAPSEMILTAPTSSTPTPSKMTPTTGITSGNNSESCLPNLASTGPPYIWCSPHHSLMKWPPWCLKPRPRMISGSFSKTPMPKHLAAISSS

SEQ ID NO: 124468 - protein, 352 aa, Glycine max
  Coding DNA Sequence Number=SeqID_32783
  Homolog annotation: Hit_ID=A5B9F0; Match level="QueryCoverage=32%, HitCoverage=5%, E-value=1e-10, Identity=28%"; Hit description =Putative uncharacterized protein
MEDVSKQFSWKVGRGDQALFWEHSWVDGWVPLKDQFPELYQISSQRLHIVEDMGYFSDHGREWNFSWRHNLFDSEMVVASTFLDNIAAITIHGNLKDTWLWGAEPNGIFTKSAYADEALFGAIGQPEDWCVSAVAYLNCALLQLPFCYLGILIGVNPRRRVVWEPIIRKFEAKLSKWNQRNISMAGLGRGVKWAAVRRVIKKENVDFICLQETKKESIDKGMCQAIWGSADVSWELQPATNSAGGIRCMWNNNAFKLQNKVIGDFNSIRAPAKRIGTSDRGSGVSNIKEFNDWIDDLEVLEIPCLAYLTVATCPIAGEQGRGSWVRFRKEERCAESPPTFICGKRRKNRRKP

SEQ ID NO: 124469 - protein, 152 aa, Glycine max
  Coding DNA Sequence Number=SeqID_32784
NFASSVFKLAQASEEDLILMWDFLTGCQINWAHLVRYRMHKALRANAPLPYPHLITLFLRHFQIPLDDEPFVQLKKDALPPQDEHTPSPPPQRDDSALMNEVLSELRGLHSYVGDRFNSLDTRFAGMDIRLTQLEEDVGYIHQSFDLPPPPS

SEQ ID NO: 124470 - protein, 122 aa, Glycine max
  Coding DNA Sequence Number=SeqID_32785
MDIIEVPTFYHQQWAPEYPEFVNFRYDGTIYQIRLRQHRKKVYFAEGLKEFRKDLSIYESVIIKFLACNSKSMFDLYFVPSLECQTCVRPEVMSRQHIWTLEITQSILGAPGPLVTMKTSSM

SEQ ID NO: 124471 - protein, 71 aa, Glycine max
  Coding DNA Sequence Number=SeqID_32786
MSVATCPSRASEGEAHGCASQRRKDARSRHQRLFVENVGKTEGNRSTKAGLLLVRTLHQRGNQTYVVLPYA

SEQ ID NO: 124472 - protein, 40 aa, Glycine max
  Coding DNA Sequence Number=SeqID_32787
MRPPPKSLELCFVIDLKEEGVETRVVITERAGRTKSMSYK

SEQ ID NO: 124473 - protein, 105 aa, Glycine max
  Coding DNA Sequence Number=SeqID_32788
  Homolog annotation: Hit_ID=A6FJQ2; Match level="QueryCoverage=36%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLSTLEDPRHEESVSRELAPQFNPGAVRRRLWEWGETEDALLISGIVSSY

SEQ ID NO: 124474 - protein, 132 aa, Glycine max
  Coding DNA Sequence Number=SeqID_32789
MASMMDAMLGMRHLMENNVATAAAVSSAAEADPTLPATAHHPLPNVSCVMTRVMSLPPSLMGNLLDSRTRFTRIVESMPKETSISTPRSPSRGRHPTYCLSPTSQHNQYSCPQKDHPRQRKNEGNSISSKRD

SEQ ID NO: 124475 - protein, 112 aa, Glycine max
  Coding DNA Sequence Number=SeqID_32790
VVSNPWRFTVGNWLCDSDLVSPTGIERVLTEKDLLADSYSDLEASILDEKEFLLLKVISTFPELSCLICSMVGAGREIDGFNRTLDAQVFMTLYWILYIKAAGIDPSFMSRP

SEQ ID NO: 124476 - protein, 78 aa, Glycine max
  Coding DNA Sequence Number=SeqID_32791
MGFFPVTLSCLKPIVTRSIRFRDVSEGNKPNTQNGGELINLGGVLQPWAHLGPSRSFYMKQPARLGKPVTSGLSHQLA

SEQ ID NO: 124477 - protein, 76 aa, Glycine max
  Coding DNA Sequence Number=SeqID_32792
  Homolog annotation: Hit_ID=A5ASK4; Match level="QueryCoverage=52%, HitCoverage=9%, E-value=6e-08, Identity=65%"; Hit description =Putative uncharacterized protein
  Pfam annotation: Domain name=RVT_2; Domain location=1-71; Score= -163.6; E_value=0.00055; Accession=PF07727.5; Description=Reverse transcriptase (RNA-dependent DNA pol
MLLTIVARKGWKICQLDVKPQELGTTGLMIIGNNVELIQQFNDDMMQVFEMTDLGEMSYFLGMEVKHIEGDMQRRS

SEQ ID NO: 124478 - protein, 20 aa, Glycine max
  Coding DNA Sequence Number=SeqID_32793
MASVINLSCYHHHHIHLLSP

SEQ ID NO: 124479 - protein, 121 aa, Glycine max
  Coding DNA Sequence Number=SeqID_32794
  Homolog annotation: Hit_ID=A0ST23; Match level="QueryCoverage=40%, HitCoverage=100%, E-value=7e-12, Identity=69%"; Hit description =Putative reverse transcriptase
DAGSRQARQGASAGVGGCRGWLNYAASEQIVLRVHHMRAIGAGLFAITPAGERGMCCKAIKLGNARVFPVTTLMEGTELEFVIMVIAVSFGKPVVPAALMNRPTRGERRFAYWALFRFLAH

SEQ ID NO: 124480 - protein, 172 aa, Glycine max
  Coding DNA Sequence Number=SeqID_32795
MEAIKEQMATMMKAMMSMKKIMEANAVIVAAISAVAKVNPTSPSGLKQMNHPTSNMVGKDLGSMGGPHDVQIQNEHAFPSYGLPLNYTPPNVAYTPNKNTHEIPHHNLADFEPWLGYTTEGQAVGGIPLQNPLEGPQYHPQLHLLHSTAVKSPHDYGRNGKVGSSRGKAQGH

SEQ ID NO: 124481 - protein, 135 aa, Glycine max
  Coding DNA Sequence Number=SeqID_32796
MFGSRGMLQQMIDQGRLEVSSEGREEQRICMQSTDGSGVARPKPLVIYFTKGTASQKPGHPLAAKPVPFPYQNSHAVPWRYTPPREKEEEATNASSLSAKVTNIMGLSGVTRSGRRASARTYQCPPATQGKEKSR

SEQ ID NO: 124482 - protein, 77 aa, Glycine max
  Coding DNA Sequence Number=SeqID_32797
GEADLRTNTFEEGESDVDMARTKGKEPLEGLGGPMTRARIKKAKEALQQVLTMPFEFRPKLQVEKLQIVNCTMFQKE

SEQ ID NO: 124483 - protein, 135 aa, Glycine max
  Coding DNA Sequence Number=SeqID_32798
  Homolog annotation: Hit_ID=A5C7Z4; Match level="QueryCoverage=58%, HitCoverage=28%, E-value=9e-09, Identity=37%"; Hit description =Putative uncharacterized protein
MFTDILTHIRLHYSEHWQMVVILPKEHLVVWFCSLHNRPDNYLKGIINSALKGLDDAPQPKSKTPARWIVAKCNRQKGSTECGYYVMHWMSTIILGSFRNNWEAYFNNPRLLEPERLKALWIQWAQYYLRVRDQT

SEQ ID NO: 124484 - protein, 97 aa, Glycine max
  Coding DNA Sequence Number=SeqID_32799
MGKLNSSKHGNEKEVHPNLKFRGPTRRDVLHDSENALLSRFGAEMMTKGWSFVGASMVEEEEENGNLCHMSPFEWSKKGPLSLLIVTHTQPQKVRKF

SEQ ID NO: 124485 - protein, 179 aa, Glycine max
  Coding DNA Sequence Number=SeqID_32800
MASRKRNSIGTRPTSQYDTRRFSSLDAWTRYTDNVLGRNILPERKVELYHTELDDFKAELERRNFHKHLTNLADGSIDLALVKEFYANLYSSEDRPPKQSRVRGHLVKIDADSLNAFLETAVVLAEGETLPAYSRYCRLPTDFSEIEATLCIPGRGCILNSKGHPGRILRKDLITLAQV

SEQ ID NO: 124486 - protein, 85 aa, Glycine max
  Coding DNA Sequence Number=SeqID_32801
MSLATLFGKLQEHEIELMRLNQHEENDKKRKEKSERKTFNDKKAKKAYITWEDNDMDSFGDSKNEVVNLSLMARNYESEEEKKKF

SEQ ID NO: 124487 - protein, 114 aa, Glycine max
  Coding DNA Sequence Number=SeqID_32802
  Subcellular localization annotation: CTP_CleavageSite=38; ConfidenceScore=5.29e-01
MAKVLIDNGLSLNIIPKSTLDKPPFNASHLRPSSIVVRAFDGSRRDLPFRLTLDSLSRGTPFNAPPKVEIYGGRVVNHSLRGGRHSCKLSFFYAICGSRRGVLRDILSSFGSGK

SEQ ID NO: 124488 - protein, 210 aa, Glycine max
  Coding DNA Sequence Number=SeqID_32803
  Gene Ontology: Cellular component=outer membrane
  Homolog annotation: Hit_ID=A9DMY2; Match level="QueryCoverage=92%, HitCoverage=22%, E-value=5e-39, Identity=43%"; Hit description =Putative uncharacterized protein
MERNDGGGVITSPQRTIFGVPYAQFVKFDIDVRKYFKFNGNQTLVLRQFVGVGIPYGNSSSMPVIRSYFNGGSNDIRAWVAFGGLGPADSQIDERVRTYMTDNLKLTTNIEYRLPFNDMYEGALFTDIGNTWSLRDYNDGYGDEFKFNKFLGQVGIGSGFGLRVNIAYITLRLDFAYKIYDPNKPTGDRWRFKDFQPFKPTLNVAFGYPF

SEQ ID NO: 124489 - protein, 88 aa, Glycine max
  Coding DNA Sequence Number=SeqID_32804
MFLHGNMPRKWVFRPDLTSTYQTPLIHIVATYPSAGGRRVTRGMRVPRKEYARSRHQRLFEENVGKTGKDAIYERLSERFGSCIYARG

SEQ ID NO: 124490 - protein, 36 aa, Glycine max
  Coding DNA Sequence Number=SeqID_32805
MGLKEHSNPMTPKAYTPKSPSEPLPPDSGPTQKENI

SEQ ID NO: 124491 - protein, 278 aa, Glycine max
  Coding DNA Sequence Number=SeqID_32806
  Homolog annotation: Hit_ID=Q84VI1; Match level="QueryCoverage=100%, HitCoverage=40%, E-value=1e-91, Identity=65%"; Hit description =Envelope-like protein
MATSPKEISASGSPAVPSSPHQEQPEFNVQPIQVIPGQASVPEKLVPRRPQGVKIAENPGPATSPREVDTEMDKKIRGIVSSILKDASVPDAEKDVPTSSTPSVSVPDAEKDVPTSSAPNAEAFPSPSEEESTEEEDQASEETPAPRAPEPAPGDLIDLEEVESDEEPIANRLAPGIAERLQNRKGKTPLKRSGRIKTMAQKKSTPITPATSRRSKVVIPSKKRKEISSSDSDEDVELDVSTSKRAKKSGRKVPGNVPDAPLDNISFHSIGNVEKWKY

SEQ ID NO: 124492 - protein, 78 aa, Glycine max
  Coding DNA Sequence Number=SeqID_32807
MRDGKRSLYIIGIGLNSGIGFGGKFLIALELTPKWALPAGRVVFGAGAWGASLWIGAGALGYTGAELKEFSARAEKLG

SEQ ID NO: 124493 - protein, 88 aa, Glycine max
  Coding DNA Sequence Number=SeqID_32808
IRPSKVGMIPPSGIVPVAGEVIVILLWLILLLSISFRLFNCFRLLHRRAKASWVTRLTKASSLPSSFLVSADEDEFVATSWTPLRTIA

SEQ ID NO: 124494 - protein, 286 aa, Glycine max
  Coding DNA Sequence Number=SeqID_32809
  Subcellular localization annotation: CTP_CleavageSite=41; ConfidenceScore=5.55e-01
MAEPSKKRKGSSSTVAAAAHRRHGPSEAFTAPTHPSFSSPRSSTLFSSDDQRLRYLSQFSSRIILDPKYLDVEFFNDETFDCYQVFQNFGIVDFMSLKLSYYPELVKVFYCNLKIQDGIIISEVHSIPMVIDQSQFFSLTNLPSQGAPFEGTIVDDWKFDYSSHDARRMVCNDQAEMTAQASEEDLILMWAFLTGRQIDWAHLVRYRMHKALRANAPLPYPHLITLYQRHFQIPLDDEPFVQVKRSFAIGAGAVTSLGYRKDRNGQWLTMDALPPQDERTPSAPPQ

SEQ ID NO: 124495 - protein, 156 aa, Glycine max
  Coding DNA Sequence Number=SeqID_32810
MSLATLFGKLQEHEMELLRLHQHEENDKKKKGIALKVSSSIQEESDQDNDPDDDDDLSLFVRRFNKFLKKKMEKSEKKNHSEKKLKKAYITWDENDMESSEDSENEEINLCLMAKSYESDEEVSLRKKWYIDSGCSKHMTGDASNFTHISPKKSGH

SEQ ID NO: 124496 - protein, 76 aa, Glycine max
  Coding DNA Sequence Number=SeqID_32811
MAAEWRRKRERRCHFKENMSLEEAHHHRRPWIRAWRNKEMNEGRGREEHEIFCSKRALKSEPTNPRSSPRFSTKCA

SEQ ID NO: 124497 - protein, 83 aa, Glycine max
  Coding DNA Sequence Number=SeqID_32812
  Homolog annotation: Hit_ID=A6N1H4; Match level="QueryCoverage=87%, HitCoverage=82%, E-value=7e-24, Identity=64%"; Hit description =Retrotransposon protein
MPLEPRASWFSPKCVEAQQLTRHLGLKHCFGAGRESGSRSASETMGDKLHRREGNSPDHQLRPLNDRSVIKEVRGAETTRRFA

SEQ ID NO: 124498 - protein, 117 aa, Glycine max
  Coding DNA Sequence Number=SeqID_32813
MVRTRGLGRVLGQVTGRGVGRGDRDDSDDAPQGRRPTASTRRQLVAVTADHVDEPVIPAPDVQDDPMEAPAAVEDIPADTGAEAAEDEHEGFPGGPSDLSVLTLYADHVACSVWTGE

SEQ ID NO: 124499 - protein, 143 aa, Glycine max
  Coding DNA Sequence Number=SeqID_32814
MARDGDNGGVYHQLDESQRLFLDAWTTQMQRLLNRNKEKPYRRIAKSSSFTLKPLSPRECDDQIRMGEKREQEKENSEAPQRNMKKKSDTPEEKSDTHERKFNYFAEASEVTKVLPAHEPLNLQNLKMSFLRRFLMDYHLQEA

SEQ ID NO: 124500 - protein, 210 aa, Glycine max
  Coding DNA Sequence Number=SeqID_32815
  Gene Ontology: Mol. function=helicase activity; Biological process =viral genome replication
  Homolog annotation: Hit_ID=Q2A9E0; Match level="QueryCoverage=78%, HitCoverage=11%, E-value=3e-40, Identity=53%"; Hit description =Putative uncharacterized protein
MARDRLADNQLDNVKLRLIAGREKDGRTYNLPNVSEVAALIVGDFDADSRRDIIVETQNGELQRIHELHSSYLGLQYPLLFPYGEDGYRPDILHRCAPSSRKRKRNRLTMRQWFAYRLQSRSNEAQTLLHSRKLFQQFIVKAYTMVESERLSYIRNNKKNLELTKCLHLLMRIMKLAKYRLKAQVEKDEGPSGEGQSPRVEKDEGPSGEG

SEQ ID NO: 124501 - protein, 31 aa, Glycine max
  Coding DNA Sequence Number=SeqID_32816
PDFTSGNAPDPLQNRNLNGLGREYLRNGRPP

SEQ ID NO: 124502 - protein, 148 aa, Glycine max
  Coding DNA Sequence Number=SeqID_32817
  Homolog annotation: Hit_ID=Q2HUU9; Match level="QueryCoverage=89%, HitCoverage=88%, E-value=1e-09, Identity=29%"; Hit description=Helix- turn-helix, Fis-type
MWLSKKCGYVFTWRLLKDRLPTKGNLLRRNVAIQEAVCPLCGQVQEEESMRWIQAVGPLPASPTSHFAQFCDGFGADINDSSWCGWWVALTSAIWQHRNLLIFQGNPFDSSKVMEEAMFLVWSWLKPRDKGFNTSFNHWSSNISDSFG

SEQ ID NO: 124503 - protein, 135 aa, Glycine max
  Coding DNA Sequence Number=SeqID_32818
MNGFPRGHLWSNFDITHNVSYFTPCQNVAVFDPPTDDMRCHMKQLHLTTMVENQIINKILVDGGTVFSILPRSMLQRKQLKVGELAEEVTQFMSRREKYFVEVEAQEESPVKEHESREKDEEQALWKQSFMMNQQ

SEQ ID NO: 124504 - protein, 155 aa, Glycine max
  Coding DNA Sequence Number=SeqID_32819
MDNEEGVQEQMKADLVDFKDHMASVTKAMLKIQKSIEDNATAAASNTAREAEPVLQPAMNLGRDRSATGFNRRYSPQAYPYGLPPDFTPRTALDDLSQAPTFEGQLPPHADYPLQEDDEGDAHLGPLLPPKEPAPHELPQPNIIHHAPSQSAPVK

SEQ ID NO: 124505 - protein, 76 aa, Glycine max
  Coding DNA Sequence Number=SeqID_32820
MAAEWRRKRERRRHFKEKISLEEAHHHRRPWIRAWRKKEMNEGRGREEHEILCSKRALKSEPTNPRSITRFSTKCA

SEQ ID NO: 124506 - protein, 177 aa, Glycine max
  Coding DNA Sequence Number=SeqID_32821
MASKKRKTPSIPTQDKFDRSRFTSQEAWERYTDVVVPRKLLPERNVVIYYIEFDEFKEELERCHWDEKLIDFYDSSIVIAIAKEFYANLYDPDDKSPKQVRVIGHLVKFGEDTLNTFLKTPVVLEEGENLCTYSRFSLLRPDPQELATKLCIPGRGFELNADGQPWKILRKNMTTLA

SEQ ID NO: 124507 - protein, 147 aa, Glycine max
  Coding DNA Sequence Number=SeqID_32822
DAGSRLARQGASAGVDGCRGWLNYAASEQIVLRVHHLRCEIPHRCVRRKYRIRRHSPFRLRNCWEGRSVRASSLLRQLAKGGCAARRLSWVTPGFSQSRRCKTTASAKLACLQVDSRGSPIYIYYIGSSSKNCSKIFYRLQTGAVVL

SEQ ID NO: 124508 - protein, 89 aa, Glycine max
  Coding DNA Sequence Number=SeqID_32823
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
MARQARTTMILLEGKTTMWKRLTLDGEIVGVQSRPAGMQAWHWPSFYNVVTGKTLALPNLIALQHIPLSPAGVIAKRPAPIALPNSCAA

SEQ ID NO: 124509 - protein, 55 aa, Glycine max
  Coding DNA Sequence Number=SeqID_32824
MLATGNRLLPSGNRLPESKTLWNWKGGLVSSLEEFESRSKGPTTIRAIGLRSTPN

SEQ ID NO: 124510 - protein, 60 aa, Glycine max
  Coding DNA Sequence Number=SeqID_32825
MGVQIAPRSTWALQNIPPEGGCFWRKQPARLGELGGNHLPYFAINRGGKNLSRGASETFP

SEQ ID NO: 124511 - protein, 74 aa, Glycine max
  Coding DNA Sequence Number=SeqID_32826
MSAIGIRPTEPPDVLQKAVALEEATGSPRQAELAWASWIFNRSLTFFVRSSSFFGLQLHPLISVKMKSDRSVMP

SEQ ID NO: 124512 - protein, 206 aa, Glycine max
  Coding DNA Sequence Number=SeqID_32827
  Homolog annotation: Hit_ID=Q2HTA0; Match level="QueryCoverage=49%, HitCoverage=15%, E-value=1e-15, Identity=42%"; Hit description=IMP dehydrogenase/GMP reductase, related
  Pfam annotation: Domain name=DUF1723; Domain location=95-144; Score =50.8; E_value=4.8e-12; Accession=PF08330.1; Description=Protein of unknown function (DUF1723)
RALGHVTGRGVGRGDRDDSDDASQRRRPTAFVRRQRATVIAAHDEPVVPAPDVGADVFSNDPMVPADVEDIVVDIPANTGAEAAEDEHEGFLGDTGDRGLLSLFVDRWHWETSSFHLPVGELTITLDDVSSLLHLPVVGDLHAFQPLHVDDAVQMLVNLLMVSTESARADTTQCRGPYVRLQWVHDIYKRRCQAGHWTVLDQVASE

SEQ ID NO: 124513 - protein, 165 aa, Glycine max
  Coding DNA Sequence Number=SeqID_32828
AFTNSDYEERSPRAFRWTSTKTLLASTYGKRLDRLTTADICWMPYGNHYAQFGYVQTIPPRSSGSRLSFEDIDNKWMHFSKYLAPVGQICVVPRQCASDYIYWFYMISHQFMTLTQLGDPPRHPPIMQDETYVEPDMPEFPMATTAIEEAAAHAPSDVDQPRHVV

SEQ ID NO: 124514 - protein, 155 aa, Glycine max
  Coding DNA Sequence Number=SeqID_32829
  Gene Ontology: Mol. function=transporter activity; Biological process= transport
  Homolog annotation: Hit_ID=B0IZP4; Match level="QueryCoverage=100%, HitCoverage=37%, E-value=5e-49, Identity=59%"; Hit description =Extracellular solute-binding protein family 1 precursor
MMIDSLAHINLIRETNPDLKFSISAIPAEDGYDGERGIPYASWGIGVAENSEHKEAAFKLVSFLMSEQTNSELSTMAKAFPGNSKSVPDFVNDDELFKTAFDIYQAGYPANEFTGLPVAEDLMRQFGEQLQAALDGQQSITDALKKAQASWEAEF

SEQ ID NO: 124515 - protein, 70 aa, Glycine max
  Coding DNA Sequence Number=SeqID_32830
MKKQQWRRSHGVAAKDKGEKHMGSFLEKQGDAILPRKRPLTRAMSKRLQEDWARDAEEGPRVLMNLRVDF

SEQ ID NO: 124516 - protein, 87 aa, Glycine max
  Coding DNA Sequence Number=SeqID_32831
MVTLRLLSSRGGRPDDMREPLGPALFHLLSFRGGGPDDMREPFGPVLFQLLSSRGGGPDDMREPFGLALFQLLSSRGGEPDDMREPF

SEQ ID NO: 124517 - protein, 114 aa, Glycine max
  Coding DNA Sequence Number=SeqID_32832
AADALPPHQAGPAGLFDTEQYLQHLVRQQAANHRAHVQTHDCLYQMSLSLQSQGFTSFSCPTPDQFRAEVAWPGDWPEAQAAGAPAEAPDEADEACEDEEMTDLLDFLGRSGAT

SEQ ID NO: 124518 - protein, 230 aa, Glycine max
  Coding DNA Sequence Number=SeqID_32833
  Gene Ontology: Mol. function=ATP-dependent helicase activity
  Homolog annotation: Hit_ID=A7PJ84; Match level="QueryCoverage=35%, HitCoverage=36%, E-value=1e-11, Identity=37%"; Hit description =Chromosome chr12 scaffold_18, whole genome shotgun sequence
MKGLDAVGYWWQRIRVAVEANKLLKYNPTIGVEVVIGGTRLALEQKRMQPNPCQVLRLVIISGLQVEGFKSWLLDTWSACTHKKKVMASSLMAFWNLSSKIDKFEASTLISTHVVPFLLLGVEYGHLIVGNFISQGFKSWLLDTWSACTHKKKVMASALMAFWNLSSIKTRMFTGLILGQKGILNPKEICFLARYRQKVIYSVKLVYIIELMVSYRVDGLIIVRHFHLFS

SEQ ID NO: 124519 - protein, 82 aa, Glycine max
  Coding DNA Sequence Number=SeqID_32834
MGYLEIIIQVQGSIIDKIIQLIKGANDTIIIQEAILLSWVMENSSLTVNHLIQPYFNLLSEKQLRVVNIGIRQHIPQLALRP

SEQ ID NO: 124520 - protein, 67 aa, Glycine max
  Coding DNA Sequence Number=SeqID_32835
MRTTRPRQQRAARPHLQRTTFTLTVERTTHPRLERTTRPHHQRAACPHLQRTTCPRLERATRPHLGY

SEQ ID NO: 124521 - protein, 31 aa, Glycine max
  Coding DNA Sequence Number=SeqID_32836
MEYLLVGDEQKRKTESKNARKDDLGCKSSSR

SEQ ID NO: 124522 - protein, 125 aa, Glycine max
  Coding DNA Sequence Number=SeqID_32837
MASITEAMLKLQKTLEDNATATASNAVREAEPVLQPTINLGRVRNPTVFDRRYSPQAYPYGLPPDFTPRDAPEDVSQAPTFEGHLPPYVDYPLQEDDEEDTHLGPLLPLKDPSPYELPQPNIVCH

SEQ ID NO: 124523 - protein, 157 aa, Glycine max
  Coding DNA Sequence Number=SeqID_32838
MEAITQLLCIPGQDFTRAAAKRRGSHPQRHLVDLKKSNRALGFPALVTGLCWPYRVPVPPSKFMSLWHRDCARKTPSGPKEGQQGLGVASSKYGSLSVLQSARRPNKVIRPHINRAFIKKYCAPRRAQGETPHQHWDGRWRAIDTPPPPLEFTSAHP

SEQ ID NO: 124524 - protein, 68 aa, Glycine max
  Coding DNA Sequence Number=SeqID_32839
MVLITPLICWAGSCSYGGCCSRYCCWCLCLPQSSALSLLLSASWFLCCSSWCPPGLALAWWLFGLLDN

SEQ ID NO: 124525 - protein, 93 aa, Glycine max
  Coding DNA Sequence Number=SeqID_32840
VDSRGSPPPLDDKRVRITIRYLRVSSGPPPLDDTRITVRYLRVSSGPPPLDDTRVHVTQPQGQYDKDYGAADKSKALAPTYPPMRNSDLRSSR

SEQ ID NO: 124526 - protein, 42 aa, Glycine max
  Coding DNA Sequence Number=SeqID_32841
MELWRGKNRSLEEGARTLLNETKLQNYFWADVVRTIYYTLYK

SEQ ID NO: 124527 - protein, 147 aa, Glycine max
  Coding DNA Sequence Number=SeqID_32842
MGSKSTLRLMRTLGPSLGSLANLLGVFYPMPLRGRIASLGLHQYWFGHNPCLCPVPKQPPILEISNNLVKSFTSKDPQGMYPPLFSLNNQVDGKQKISQAVSPLKYFVKGKRKNQKNSQAVSPLNSSGKRETNEEKNSTSFWSMNFS

SEQ ID NO: 124528 - protein, 207 aa, Glycine max
  Coding DNA Sequence Number=SeqID_32843
LHNPVHLRPIRGGVMMVDFEILAHFLHRFVIQIGAIVSNDLPRESIPTNQLPLYESDHHDPRDIGVGSRFDPFGEIIYRHENEAMTVRSLGFDGPFDIYPPHGKRPRGGHDIQRMWRNIDIVCERLTFMAFPYLGAAIAFHSEPVITCSENLPGHSMPIGMRPKRTLMDFLDHVVRLFGIYASQEGHVMVSFVQDGTTHKETSSQSP

SEQ ID NO: 124529 - protein, 178 aa, Glycine max
  Coding DNA Sequence Number=SeqID_32844
MRGAPTEESLSPFLVRDFGAQNFKVIQRVHKAWESLLRKDKELRGIRNGIIGCYHEWLKVRTRGLDWLSKLKIINEENFEAPEEDEEVRALKTDLGKARLAKENSSWSLQTSEKSVSGYKKKMQLPQKPLNKKPRGLARKSMAVKNSMERCGATTVSSSFEGKRETHHEHIAWFQKKS

SEQ ID NO: 124530 - protein, 203 aa, Glycine max
  Coding DNA Sequence Number=SeqID_32845
  Homolog annotation: Hit_ID=Q6WAY4; Match level="QueryCoverage=70%, HitCoverage=29%, E-value=4e-08, Identity=30%"; Hit description =Putative uncharacterized protein
KCLEEGQRPWKIKANGLSFIDILALLIFGVVLFPNMEGLVDLAVIDAFLAFHHGKESPVVAILAMYDTFDRGCEKSDARIFCCALALYVWLVSHPFLQEGRPVYPLQGRKNQDSIFMRRMSKCSLDGTRGCINYNPVLAIRQLGYPMRGVPSDESITPFIARGFGDHTRGYSKEFARHGMRREERTESLREAVMGSSAAIISG

SEQ ID NO: 124531 - protein, 67 aa, Glycine max
  Coding DNA Sequence Number=SeqID_32846
MRVVVGGDTEGLPKCFQGVYHQLLAFQWHIRAKARSRLDCDGEFHVSPPRFKRHVHDQFGVVGSQWV

SEQ ID NO: 124532 - protein, 128 aa, Glycine max
  Coding DNA Sequence Number=SeqID_32847
  Pfam annotation: Domain name=zf-CCHC; Domain location=95-112; Score =26.9; E_value=7.3e-05; Accession=PF00098.14; Description=Zinc knuckle
MEIFIQSIDLGAWNVIVKGPLIPTKEVNGELKKQKRKGIAPKVNFSKEDYKESFSSEEEAENFNLMVKKFGKFLKKSKDRNFSKSSKKVESNNTFTCFECGKQGHIKSECPINLRKQVGEKKGKNDRK

SEQ ID NO: 124533 - protein, 66 aa, Glycine max
  Coding DNA Sequence Number=SeqID_32848
MGRPFPPASSCRRGIGSACRPQQGHQAPLPIELSSRSTAPPGRRRAKHHISIGMAGSAQQTHRHHL

SEQ ID NO: 124534 - protein, 285 aa, Glycine max
  Coding DNA Sequence Number=SeqID_32849
  Homolog annotation: Hit_ID=Q6WAY6; Match level="QueryCoverage=27%, HitCoverage=13%, E-value=8e-11, Identity=41%"; Hit description =Putative uncharacterized protein
STLEDPQGKEGVLFSCGDYPSVPLIGTRGCINYNPALAIRQLGYPMRGAPTEESLSPFLVRDLGAQGLKVIQRIHKAWRSPLRKDKELRGIRNGVIGVINEENFKAPEEDEEVRALKLELGKARHAKEKFKSATTHIRKECTELQEENAATARALEQETKRACKEEYGREKFRGALWGSNNELKLRREERDRSRVQKELAQHLEATEQSMLAIIGQYKEELNQSMAHEQKLVEDFAQVYVEKEARGRVIDALHQEATMWMDRFALTLNGCQDLPRLLAKAKAMAK

SEQ ID NO: 124535 - protein, 96 aa, Glycine max
  Coding DNA Sequence Number=SeqID_32850
MEEFDAQVDWPGDQPSSFGGGGASTTQEPVTKEPQHPHHHQQQQRRLIVKECINHIPVVGEHHPQKMVQGKFVPNLEEALGMKAKCLRKRASMGKE

SEQ ID NO: 124536 - protein, 98 aa, Glycine max
  Coding DNA Sequence Number=SeqID_32851
MAPKKLSAKRARKATAGEGSSAVPQKEIEFDGHRFQSEEHQRRFEVIKDWSFLKERQVQSKKESWTNTPGCGANGSHMTQMPSIILRASIGLRRGSTM

SEQ ID NO: 124537 - protein, 102 aa, Glycine max
  Coding DNA Sequence Number=SeqID_32852
  Gene Ontology: Mol. function=transporter activity; Cellular component= membrane; Biological process=oligopeptide transport
  Homolog annotation: Hit_ID=Q7XAC2; Match level="QueryCoverage=45%, HitCoverage=14%, E-value=6e-13, Identity=73%"; Hit description =Peptide transporter 2
MVLVLITTCIPSIIIAQTTTLFIRQGTTLDRRMGPHFEIPPACLIALNSNKVSKHHNRDRPLNSGRMEFFLIRRDTDSLGVLRQPQCTSKIDSDPFRDSFLS

SEQ ID NO: 124538 - protein, 161 aa, Glycine max
  Coding DNA Sequence Number=SeqID_32853
  Homolog annotation: Hit_ID=A5C6C3; Match level="QueryCoverage=62%, HitCoverage=22%, E-value=2e-32, Identity=62%"; Hit description =Putative uncharacterized protein
  Pfam annotation: Domain name=DUF821; Domain location=11-155; Score= -198.5; E_value=7.2e-09; Accession=PF05686.3; Description=Arabidopsis thaliana protein of unknown function (DUF821)
MTSADPLSLLWIGAIITSKGHIKLARWHSRRGKVIGRRTFFEGADPQSSATTPARNIKMDYVYDYMFHLLNSYAKLFRYKPSISANATELCVESMVCGAEGSVKKFMMESLVKVPANTDPCTMPAPFDPPTLYATLQRKESSIQQVESWEKSYWDNQTITS

SEQ ID NO: 124539 - protein, 376 aa, Glycine max
  Coding DNA Sequence Number=SeqID_32854
  Gene Ontology: Mol. function=metal ion binding; Cellular component =intracellular
  Homolog annotation: Hit_ID=Q1H124; Match level="QueryCoverage=57%, HitCoverage=94%, E-value=5e-79, Identity=64%"; Hit description =Putative uncharacterized protein
DIVTEADLIKYVEQAKADALHSFNFLKETGTLSATWTYHITHKIPGHDKLLNIRFPWPWEKSRDPVVSIDTFSEKKEHILHESRIDADTVIHAHTPYLAAWSLAQINFPILYVAAQRHLLAREIPNHLDRTRSILSIISERLDSHPELAPPPALLESNGGANIWGKGIIGTSQLVLLIEEAARFQSLAEQVGGAKEYTPGALEVQWKRTGLVEKAKQYSVLIMSQSKKRQLALNVFLLRYGHHPAGWLHPTWKENGRPDLQWWIRAAQIAEAAKFDTFFVADFIGRSGVIDKQAVKNPNNFHFEPFTLLSAIAAHTKNIGLVATVNTNFSDPYNVARQFTSLDHLSGGRAALWDSWDDDAFDHPKRQSGQFYDPVS

SEQ ID NO: 124540 - protein, 57 aa, Glycine max
  Coding DNA Sequence Number=SeqID_32855
MEEKLRSFNGDFPPWRCSGRKRRRGERRHHPQGNKSRKKELRHQDEPWIRSLEMMLQ

SEQ ID NO: 124541 - protein, 97 aa, Glycine max
  Coding DNA Sequence Number=SeqID_32856
MGIAPTRHPVDPEKSNRALGFPALGSHLQTPSGPEEVQQGLGVSSSNYGSLSVLRSTCNLQQGHQAPTDRASSRSTAPSGRRRARHHSSIRMAGSGQ

SEQ ID NO: 124542 - protein, 28 aa, Glycine max
  Coding DNA Sequence Number=SeqID_32857
ELLLKHQSSIQEESDQDNDPDDDDDSLF

SEQ ID NO: 124543 - protein, 129 aa, Glycine max
  Coding DNA Sequence Number=SeqID_32858
TLVSTVTPLGLEVIPQVKELLDEGLVRKSLNPCALLVPKIGIINMKIQKKRVPADPKRIKVIPEWPTPPSVEGRSLEYEEPRNLRSNPFQGGGDDAILPPRVLDRTLQEDWARATKEGPRVLMNLRVDF

SEQ ID NO: 124544 - protein, 143 aa, Glycine max
  Coding DNA Sequence Number=SeqID_32859
MLLSSNVIHICVRVVMLARMICTRLFAAARVKSCPGMHSSCVIPSSSHCARIVGPPPGSGGGPGVATCPFVGERGEAHGSAFQMRKDARSRHQRLFVKNVGKTERKPIKMKILSSGVVFTLEEGRQSGALLYVPSIEEKIRPT

SEQ ID NO: 124545 - protein, 52 aa, Glycine max
  Coding DNA Sequence Number=SeqID_32860
MVFIKSSLRILEKMIEKGDILIILRLLLGIWFFSNVKPGHCLLSNWFINPTT

SEQ ID NO: 124546 - protein, 51 aa, Glycine max
  Coding DNA Sequence Number=SeqID_32861
MSVRGTIDVDDSAIGFDEMLTTDLSSDRMIARWPLLSWRAPFLEAKEIQES

SEQ ID NO: 124547 - protein, 111 aa, Glycine max
  Coding DNA Sequence Number=SeqID_32862
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=59%, HitCoverage=64%, E-value=1e-32, Identity=100%"; Hit description=LacZ protein
ASRVAPGAGAPPVAPRDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 124548 - protein, 164 aa, Glycine max
  Coding DNA Sequence Number=SeqID_32863
  Subcellular localization annotation: CTP_CleavageSite=45; ConfidenceScore=5.37e-01
MNSLPSAGHVSSAFESGAPRIDCLALFANSPFSTFIHRPMNSLPSAVHASSTNESGGLRIDCLALFPSYPFSIFIRSPMNLLPSAVHVSSTFESGAPRIDCLALFANSPFSTFFRSPMNSLPSAVHASSTFESGAPRIDCLALISANSPFSNFIRSPMNSLPRR

SEQ ID NO: 124549 - protein, 91 aa, Glycine max
  Coding DNA Sequence Number=SeqID_32864
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPINVSFSPKVGPGLPGINRDTRIYLFLRSDLPSQVLQWLLFLSAVPPVQLLTGWCVTAKAPPDISAGKCSGHAARNHHTRRA

SEQ ID NO: 124550 - protein, 128 aa, Glycine max
  Coding DNA Sequence Number=SeqID_32865
MNEKTGANEEGENEGETHVATAIPTWPNFPPAQQCHYSANNKPSPYPPPSYPQRSSLNQPQSLSIALPMTNTTFSTNQNTNQEMNFAAKKPVEFTPISVSYADLLPYLLDTAMVAITPARFPQPPFFR

SEQ ID NO: 124551 - protein, 156 aa, Glycine max
  Coding DNA Sequence Number=SeqID_32866
MEDSAKGPHHPRPEVERPQLLKPHPYLSHLRPQHRPRLTDIWASDDDGHRFGQHHFFPDYANHLVQPTLFLAEAAHPHDVEPPPWLVPSHPKPLPALHSTLHPATVDDAGGFPGAIRLARGLASLYRGKGVTPLVLEMMLMSQMPMLMMIMLWTSW

SEQ ID NO: 124552 - protein, 339 aa, Glycine max
  Coding DNA Sequence Number=SeqID_32867
  Gene Ontology: Mol. function=binding; Biological process=pathogenesis
  Homolog annotation: Hit_ID=Q7N7K0; Match level="QueryCoverage=94%, HitCoverage=11%, E-value=2e-96, Identity=55%"; Hit description =Complete genome; segment 4/17
MPDGSRGDEFYEYQYQRTVVETQVVESDPGKILSGGRLIINSDKLNNYDSQIIAGGALGGVIGELNNVATTGKRVTTDVGTQTRWYEKKTSRPFGGTKTSQGKKSSEYEPTPTVQTIDLQTMEWQGNTQIDGHSGVINPRDRADETGEIPAGRLVEVTPVNADGTVIRVVTPDTRLPVSSLYQIDPQAKAGYLVETDPRFTNGKAWLASDYMQNQLGVDQAMKRLGDGYYEQRLVREQIVKLSGGRYLQGYSNDEEQYRALMDAGVAFAKQYNLMVGVALTPAQMALLTSDMVWLVAREVTLTDGSVQQVLVPQVYARVKAGDLDGSGALLGGENVAFS

SEQ ID NO: 124553 - protein, 98 aa, Glycine max
  Coding DNA Sequence Number=SeqID_32868
  Homolog annotation: Hit_ID=Q84VH5; Match level="QueryCoverage=46%, HitCoverage=6%, E-value=2e-15, Identity=95%"; Hit description =Envelope-like protein
VDSRGSPAVSKDALIAELKDTCKVLEATIKATTEKKMELERLIKRLSESGIDDEAAEEEEEAAEEEEEAAEEEDDAAEEENEAAEDTESDDDDSEATP

SEQ ID NO: 124554 - protein, 312 aa, Glycine max
  Coding DNA Sequence Number=SeqID_32869
  Homolog annotation: Hit_ID=UPI00016621D1; Match level="QueryCoverage =79%, HitCoverage=36%, E-value=1e-09, Identity=33%"; Hit description =UPI00016621D1 related cluster
MSKSFEFGMTGSLDESISCFLIRMDPRRAARPHLQRTTCPHFQRTAYPQLQRATRPRHQRTACLHLLGLHALTFRGLHVLANKGLHALTLRGLHVLANRGLHALTLRGLHVLANKGLHALTLRGLHVLANRGLHALTLEKATRPRQQRTARPHLERTTRPRLERTTHPHHQRAARPHLIFRGLHVLTFRGLRSLAFVGLHALTFRGLHVLTFRGLRALTFVGLHALTIRGLHVLTFRGLHALAIRGPHVLTFVGLHALTFRGPHVLTFRGLHALAIRGLHVLTSVGLHALTFRGLHVLANRGLHALNLRRLN

SEQ ID NO: 124555 - protein, 274 aa, Glycine max
  Coding DNA Sequence Number=SeqID_32870
  Homolog annotation: Hit_ID=Q6WAY6; Match level="QueryCoverage=30%, HitCoverage=14%, E-value=3e-08, Identity=40%"; Hit description =Putative uncharacterized protein
MRTRGCISYNPVLAIRQLGYPMRGAPLEEELAPVIARGFNKTNVEALQKVRKAWEMVQKKDKELRGSNNGPIGGYRKWLKAHVQGLDWLQSLRTTKREEVEVPEEDEEVQVLRAELEQAQTVKERFKSAALKIRKKNVKLRDVNIAPPMVEREMITMMVDTLPVFYYEKLVGYMPSSFVDLVFTRERIEVGLKKGKFDYVSSTSANAKRIGATGAKRKERDTYAITSTPVWVKPPQTSHGTHQYVQHHPSFSARAGISSNSAPVQPKAPRPGIL

SEQ ID NO: 124556 - protein, 162 aa, Glycine max
  Coding DNA Sequence Number=SeqID_32871
MSHHSSSVNGEGTSHKDPLSRILDELICLKLWKEKLERKEKGKEKVEISQDEREQIREEERTKILKELRKEKHASYSSHDSRKSLSEEPKHRSHPRPHSHRREKERKPQEANINLPYFHGKDSVEAYLDWATKVEQLFVCHYTSEERMVPLATLSFQGYALY

SEQ ID NO: 124557 - protein, 32 aa, Glycine max
  Coding DNA Sequence Number=SeqID_32872
FLGMLGGSRKWEAGNWRIEDSESVIVYEVVQC

SEQ ID NO: 124558 - protein, 128 aa, Glycine max
  Coding DNA Sequence Number=SeqID_32873
MVDTLPAFYYEKLIGYMSANFADLVFAGERIEFGLRKGKFEYASNVAPNNNRRAPVVGTRKKGWRYPRGHHRPNMDESAPKCPKLIPTQPPELFDPSRKFPPNSSGRASRNRKNACLTHSSNHSPASQ

SEQ ID NO: 124559 - protein, 97 aa, Glycine max
  Coding DNA Sequence Number=SeqID_32874
  Subcellular localization annotation: CTP_CleavageSite=27; ConfidenceScore=5.16e-01
MHALLGSFNSGNWSDSKVLDSVGLSCRAFMRNRGVIIKFCISPTGNLVPLDLEIEASLQRNRVERRRKLLQDITVASILEKETHFSDLLSPDSPSSR

SEQ ID NO: 124560 - protein, 171 aa, Glycine max
  Coding DNA Sequence Number=SeqID_32875
MTSRDQVWSFCTLVSSRGGGPDDTRRYLTVIRTRLSSRGGGPDDKQRPKAAGPMIRGDTLRLSTPFCHPEAAGPMTSRDQVWSFCTLVSSRGGGPDDTRKYPSGYPYKHSFAICKTERLIDAEADTVFCTFCSSGNNKSFTCGNFMVTRDSRQPRGAKLVSYTDFRPGTFA

SEQ ID NO: 124561 - protein, 126 aa, Glycine max
  Coding DNA Sequence Number=SeqID_32876
  Subcellular localization annotation: CTP_CleavageSite=53; ConfidenceScore=5.81e-01
MATPPSSPPPPPPPPPPSPTNAASQSSSTLKRTRKTTRLRSLVTRLAGAERPVAHVDPATGKVDGPHKKKLRTYLGIVACDKVDVTYENWKQVHAAQKDLIWKDIQAEFDIPEASDVRTKKKILQT

SEQ ID NO: 124562 - protein, 99 aa, Glycine max
  Coding DNA Sequence Number=SeqID_32877
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=Q67GW6; Match level="QueryCoverage=60%, HitCoverage=14%, E-value=3e-28, Identity=95%"; Hit description =Photosystem II CP43 protein
MAAQDQPHENLIFPEEETTGFAWWAGNARLINLSGKLLGAHVAHAGLIVFWAGAMNLFEVAHFVPEKPMYEQGIGAFLLVFKALYFGGIYDTWAPGGGD

SEQ ID NO: 124563 - protein, 118 aa, Glycine max
  Coding DNA Sequence Number=SeqID_32878
MEETHGMPHHNLADFEPCLGYATEGQAVGGIPLQNTLEGPQCHPQPQPSHSTAVKNPHAMAEMGKRKGSGPLKEIGCNYRTCAKRETIIVMVDTLSVLYYEKMVGYAPSKLCGFGLRQ

SEQ ID NO: 124564 - protein, 124 aa, Glycine max
  Coding DNA Sequence Number=SeqID_32879
MTRGNPSNLRPFYPEIDRTFHRLVRHHFISLEHPEHSVTGEFVHSVVGDFEHLDFKHYNFEHSENMAQPPPHERTLREMAAPDFTYESLCIQYPDEDVPYVLKTGLIHLLPKFHGLAVKTRTNI

SEQ ID NO: 124565 - protein, 193 aa, Glycine max
  Coding DNA Sequence Number=SeqID_32880
MILKEELAACARSKRSLAQHLEATEQSMLAIIGQYKEELNQSVTHEQKLVEDFAQVYAEKEARGRVIDALHQEATMWMDRFALTLNGSQDLPRLLAKAKAITEKTLEDNATATASNAIREAEPVLQPTINLGRDRNLTVFGRRYSPQAYPYGLPPDFTPHAALEDVSQAPTFEGNSLLMPITPCKKATKEIPI

SEQ ID NO: 124566 - protein, 167 aa, Glycine max
  Coding DNA Sequence Number=SeqID_32881
MDASDHTIMHDRTDIPTKRSLLELSSQDALLAQNKLLSKQLETLTETLSKLPNQFNANQPSHSDVLQVEGCSICGGAHESRCCIPFDDSAQEVNYMGGSQPIQGQWRAYPDNQFNKEHGGPFNRPQQQGPSLYERTTKLEKTLDQFMQVSMSNHKRTKSAIKNLEIQ

SEQ ID NO: 124567 - protein, 144 aa, Glycine max
  Coding DNA Sequence Number=SeqID_32882
  Gene Ontology: Mol. function=phosphoprotein phosphatase activity
  Homolog annotation: Hit_ID=A5AU60; Match level="QueryCoverage=65%, HitCoverage=9%, E-value=3e-16, Identity=47%"; Hit description =Putative uncharacterized protein
  Pfam annotation: Domain name=DUF1723; Domain location=32-81; Score =25.6; E_value=0.00018; Accession=PF08330.1; Description=Protein of unknown function (DUF1723)
VTRACLMNNGNKEMQEASAHGNKEMHEPNLLRKNRKRQMKLMNADENPKLTFHFPHGETTITLQDVALQLGLKIDKLSVIGAITGDVRVACQTLPSDTPPDKYIKGKMIHLTWLRQNFRQLPIDANDVVIAQHARAHIMMLIGG

SEQ ID NO: 124568 - protein, 268 aa, Glycine max
  Coding DNA Sequence Number=SeqID_32883
RFLDEWSSTLGHASVYGFLEPQSIHDAKDRRAECEHYLQAWLKESQREVYLGAYLNQGHWQLVVLCPTTNFVAWFCSLRKKPDTHIKTAINNAMKTANTTADGTNNQPTPKWIEVKSHVQSGGYECGYYVMHWMWNIVSGGLKNDWSMDSYTSLPKPIDFGQELRVGMLFELYKKFLAIVGEIDVDYLNHVERKPDMAFEAEVQIFVVIILLSLSYCTLSTGSYSLINLIFVVIILLYFRLKHVQMLLKEEESSPWGRHIQAKVGVNV

SEQ ID NO: 124569 - protein, 191 aa, Glycine max
  Coding DNA Sequence Number=SeqID_32884
  Subcellular localization annotation: CTP_CleavageSite=53; ConfidenceScore=5.41e-01
MVAPRRSPPQSDGNTEPQPKKTRQSTRLRRLTLRSLDQPRPTVTVDPATGRASGQEKQKFHSFLGVVARKKIPNRPQQLEKCAGNSKGHGMGGNLMRIMKLAKYRLKAQVEKDEGPSGEGQSPRVEKGEGPKFLSGFLVEPIIRLIKVILVASTLTYLPSLEVASSKTSVARIKRSAPTQVCIIWYHSFGS

SEQ ID NO: 124570 - protein, 616 aa, Glycine max
  Coding DNA Sequence Number=SeqID_32885
  Homolog annotation: Hit_ID=A5C3T2; Match level="QueryCoverage=22%, HitCoverage=14%, E-value=2e-36, Identity=58%"; Hit description =Putative uncharacterized protein
  Pfam annotation: Domain name=zf-CCHC; Domain location=591-608; Score =9.3; E_value=0.06; Accession=PF00098.14; Description=Zinc knuckle
VLGLLGGNQLNSAINSEKAVKMDSAAVAELLDLIDTALADDLFGNFMNSGVASESLKNDDPFADVSFHSNDNKEHVDIFSSMTVVDDKLDHHVSHENMGRKWAKEIHAPELTIDALLLHLVQVCGVGLDVFTSEPAGYITTACTFSTSATAMACKTSATASMLQSPSLSSQHGLVDSAISSIINSSARYYNPNNALNFSTHQVSRPQQFYFPNSSISTLNSHPTITLDLTTPSTSSSNSSFTCMPKYSSTNLNFSSSFSPLHSSMPQSPWNRYSGYSNSGTLYQNRHQGGNYMLNTGNQNQPHSLGHLNQPIYMSNNSTISQHSFPNPIVAATEAIIRSNPKFQSALATALTTYVGNEASSGRTRENHVLESAELMKLKLLRSENSIGNSTMHDKKRKPGWGAMGFLILVALCFQQSNDEVKEVRSMPKKGASMEEGVGLQCQRAEVNVKERSKQKGVGFTVRRKQAERSRVHSKEKASRKRSNRLSMMFIKTKILAVIRDSVNQHEKARDLLKVIDDQFITLDKTLASTLIMKFSFLRLTSVKEEERLVMEMGENALLTTTCGKNKVTESQANQKGNGRIPLQANIKKVENCFFCKKKGYMKKNCPRFQIWLEKK

SEQ ID NO: 124571 - protein, 153 aa, Glycine max
  Coding DNA Sequence Number=SeqID_32886
MQSQVLTVPREAEVGPSVACVDPSRQGPKMGDSKKCGLYVNDSPPRLVGVEKVQDADAHIHVPIQEDKQVAEGMTKPVDMSDPNIDPLYLMTLTILQLFLKPLQVSWDASVFGVYNDNFPLVVRERIVARLKGESESESKTEVLRTKRVRVRV

SEQ ID NO: 124572 - protein, 220 aa, Glycine max
  Coding DNA Sequence Number=SeqID_32887
  Homolog annotation: Hit_ID=A7UQU7; Match level="QueryCoverage=79%, HitCoverage=32%, E-value=3e-11, Identity=30%"; Hit description=IMP dehydrogenase/GMP reductase, putative
  Pfam annotation: Domain name=DUF1723; Domain location=133-182; Score =60.2; E_value=7.1e-15; Accession=PF08330.1; Description=Protein of unknown function (DUF1723)
MSQDVHQPEVPRRHRPTASVRRQWVHVTEDVTQTLEDVPQLNEDVPHVSDATPEMTSATDAADAEGVASDGSLGSPATNEGFPSRPHDPLERPGLKLVSHGRKVDKFGRPAPEIEGMIAATGSSPLIRCSVITTDPGLISAFVERWHRETSTFHLLVGELTVTLDDVSSLLHLPITSALHAFEPLVTSDAVGLLTELLEVTPEEATAETRQASGPYVRLS

SEQ ID NO: 124573 - protein, 124 aa, Glycine max
  Coding DNA Sequence Number=SeqID_32888
MNADIDDRWLHFSDNLMPAREICVVLGQVAPDYMDWFFWISHPFVTSTEDSAELRHPPTPHDEELIEPPILEVSVASDLFTHSVDLGAIAEDLERVINLGMVTKGTDLYDIMTRCLRRARGDAA

SEQ ID NO: 124574 - protein, 195 aa, Glycine max
  Coding DNA Sequence Number=SeqID_32889
MKNKKVEAVGVSLSEAYALSEQHPLSEALSSLSGLRESGRESVIHARAQHAISSLSKGSSRPLTFESLSPAINLAYIKKNCWNPDDPSITFPGTRKARARGPEGPFSSTSFTPASTSSVPAPIPAPSIHNLAQHWPIISMEDFMAQESQPEAEAQPEVTSEATPQTSPATTPFVEVSEEEEGAEETDYATNMAAA

SEQ ID NO: 124575 - protein, 155 aa, Glycine max
  Coding DNA Sequence Number=SeqID_32890
  Subcellular localization annotation: CTP_CleavageSite=55; ConfidenceScore=5.48e-01
YILLENNGINPVLLLPPPHPPPPSSQNTLGGSLLNQTVGVPASMRSFNGDFPPWRCSGRQRRRGERRRHPLGNKPWKKELHHQDEPWIRSLEGCFNGGKERGRERERGENEIEGIKEGEKWNFEVCLTRLSFIKVTTSVTHASIYRLGSFLEKIS

SEQ ID NO: 124576 - protein, 162 aa, Glycine max
  Coding DNA Sequence Number=SeqID_32891
  Gene Ontology: Mol. function=protein serine/threonine kinase activity; Biological process=protein amino acid phosphorylation
  Homolog annotation: Hit_ID=A7Q5B4; Match level="QueryCoverage=54%, HitCoverage=8%, E-value=5e-16, Identity=48%"; Hit description =Chromosome undetermined scaffold_52, whole genome shotgun sequence
MSFSFIPKSQHIANPTPNSYLLGSCCCSGDEIKLLVEATVKGELSLIPWAPSSPPNQDPFALNLMSTTHGNSKIVATTFDISLFMLIIVWAHCFHNNYNSWFSDEVGSWKLTMFQHLNFAAEGVLECSSMSDKILEMGSMEMIYRVEMLGSKIFTIKNLWLK

SEQ ID NO: 124577 - protein, 79 aa, Glycine max
  Coding DNA Sequence Number=SeqID_32892
MPYPPIKVSSWNFFWLLLQALGRGAVSEGVEGNNEGGLVMVHFTAEGEEASQGDGAERGASIGEGAGVKEGRGEKCELF

SEQ ID NO: 124578 - protein, 307 aa, Glycine max
  Coding DNA Sequence Number=SeqID_32893
MAFRKRKAIASRPQEPYDTTRFISEVAWECYEQNVYSQNILLERNINLFIIEYDEFRRELERRQWHKALTRQPDGYIDVALVKEFYANLYDPEDKSPRQVRVRGKLIKFVGESLNTFLETLVVLDQGEHYTTYSRFCHTHPNPQELASKLCIPSKGSTTQHIPGSATRIRTHRSLHPSSAFQDGHGCGLVYLWTDLTDGPVQLFQARIPRSHHCIAREVVPDSLTFESLRLAINLAYIRKNCWNPNDPTITFSGTHKTRVRGPDIYAPSSSTPSTPASTSAPPASIPAPPAPSGTSAQSTDAMVLML

SEQ ID NO: 124579 - protein, 238 aa, Glycine max
  Coding DNA Sequence Number=SeqID_32894
  Gene Ontology: Mol. function=RNA-directed DNA polymerase activity; Biological process=regulation of transcription, DNA-dependent
  Homolog annotation: Hit_ID=A7PYY2; Match level="QueryCoverage=63%, HitCoverage=14%, E-value=1e-27, Identity=41%"; Hit description =Chromosome chr4 scaffold_39, whole genome shotgun sequence
MGIDVAVLMCLKDIRHNKFEDSLIRTVETSLGQGPVYFNCYPNKTMSLMNRNILDSLFLKIHFHGLDMKEGSIPATLIYRIQYKVMNICASRVLLKPQRGETTLFITDMTKANVSLSRTIKWDEVTIPKKWVMNKATPSVPLPGPTIEQIKQDNFGFKQKQSMTKQNCWGKGSELAVLLAGSKSKESLAKNLKEVLQMLQQEEEGSSSKKEETSSSEEEEDPFYQNEDGCFGISLNDD

SEQ ID NO: 124580 - protein, 299 aa, Glycine max
  Coding DNA Sequence Number=SeqID_32895
  Gene Ontology: Mol. function=oxidoreductase activity; Biological process=electron transport
  Homolog annotation: Hit_ID=A7PK63; Match level="QueryCoverage=87%, HitCoverage=68%, E-value=1e-23, Identity=41%"; Hit description =Chromosome chr15 scaffold_19, whole genome shotgun sequence
MSTIQVVLGMVLVLLMHVFNVLALRSRSPRGKLHRQGIHGPSPHFYFGNIPEMKTLLLQVQSAPTTQVKDKDQHVSLSHKWPFTLFPHIQKSLILVFYWDYTVANGDRYKNGEGNHHVYLFGFREAYLFVQRSGTTLGPRHIVSKWANLAHQRKIIAPELYLDKVKKELNSKISKLIKHHQKETHEHDLLQMILEGAKNCTGSSDGLLSNSMSHDRFVIDNCKNILFAGHETIAITASWCLMLLAAHQDRQDCARAVVLEVCGRGALDASMRRSLKTVFYTLYVLKLNVSMKCIRIISP

SEQ ID NO: 124581 - protein, 232 aa, Glycine max
  Coding DNA Sequence Number=SeqID_32896
  Homolog annotation: Hit_ID=A2Q6B4; Match level="QueryCoverage=47%, HitCoverage=59%, E-value=4e-13, Identity=31%"; Hit description =Ribosomal protein L33; Nucleic acid-binding, OB-fold
MDLKENCTYVMHNFKVLKNNGQYRVCDHQFKLVFIGVTVVRECVLGDIPFRKYRFARFADVVDGQFERGLLVDVIGVVEEVFGKFQEKFVKFLDDYEGDGPIAVLLSHCRIKEAQGLQSWALRPGHFLNPMVKGVHNFQEIVCVTVGTITRIVLDNHSWCYTSCIQCHKKSDAEMTPFTCACGKYNKEVVLRYRLEVMINQGNASTQFLLWDRECSELIGQSADAVNKLKIE

SEQ ID NO: 124582 - protein, 72 aa, Glycine max
  Coding DNA Sequence Number=SeqID_32897
MSLACFRPRPIGKALGRRGASDDDNDAPTGESLPHLPVGSNKRRMLKKEHPEQKLSSHGRKMTKFSWPAPEI

SEQ ID NO: 124583 - protein, 286 aa, Glycine max
  Coding DNA Sequence Number=SeqID_32898
  Gene Ontology: Mol. function=protein binding; Cellular component=NuA4 histone acetyltransferase complex; Biological process=regulation of transcription, DNA-dependent
  Homolog annotation: Hit_ID=A7PGQ2; Match level="QueryCoverage=94%, HitCoverage=55%, E-value=1e-111, Identity=77%"; Hit description =Chromosome chr17 scaffold_16, whole genome shotgun sequence
  Pfam annotation: Domain name=Actin; Domain location=1-286; Score =78.4; E_value=2.3e-20; Accession=PF00022.10; Description=Actin
MGLSVCSYFLLCLQLKAVATSPIGGEFLTDCLMKSLESKGITIKPRYSFRRKEIRPGEFQTVDLEFPNTTESYKLYCQRVIASDIKECVCRAPDTPYDESAYSNIPMTSYELPDGQTIEIGADRFKIPDVLFNPSLVQSIPGTESFAEIAPSVRGLPQMVIESINKCDVDIRRELFSSILVMKHFISMHHFLLAGGTASMQQLKERLEKDLLEQCYRVFLNPMTPNFHYLILEGWEFGRLSESPQAARVKVLASGNATERRFSVWIGGSILASLGSFQQMWFSKSE

SEQ ID NO: 124584 - protein, 30 aa, Glycine max
  Coding DNA Sequence Number=SeqID_32899
MTINKSQGDLRMKQGWLSTPIGVALIDPVV

SEQ ID NO: 124585 - protein, 133 aa, Glycine max
  Coding DNA Sequence Number=SeqID_32900
MAETSSSAQEAVGKGGKLKSQKAQTSKIQKSMTELNITINALRKLNAGGHCRNTGCYTQPASINYHSYTGCTYVLQLELEHTMKSMEKLKDLIKQVAPIGVPPNGIHESQLVRRLFFRKPGHVLSTIISVTII

SEQ ID NO: 124586 - protein, 49 aa, Glycine max
  Coding DNA Sequence Number=SeqID_32901
  Gene Ontology: Mol. function=transferase activity
  Homolog annotation: Hit_ID=A5B4U2; Match level="QueryCoverage=100%, HitCoverage=12%, E-value=2e-14, Identity=77%"; Hit description =Putative uncharacterized protein
YLAIRERVKEKKVVIEHVNTKLMIAYPLTKGMPPKNFKDHVVRIGLGSM

SEQ ID NO: 124587 - protein, 72 aa, Glycine max
  Coding DNA Sequence Number=SeqID_32902
  Subcellular localization annotation: CTP_CleavageSite=55; ConfidenceScore=5.14e-01
MDKSIFPFSLYLSPSIQKHRCPPSLSSPLQPPYTVEIVVSPNDNNCLIGNNALMKAKKTNNTNLENQDSPLS

SEQ ID NO: 124588 - protein, 714 aa, Glycine max
  Coding DNA Sequence Number=SeqID_32903
  Gene Ontology: Mol. function=nucleic acid binding; Cellular component= ribonucleoprotein complex; Biological process=mRNA processing
  Homolog annotation: Hit_ID=A7PK71; Match level="QueryCoverage=68%, HitCoverage=67%, E-value=1e-130, Identity=79%"; Hit description =Chromosome chr15 scaffold_19, whole genome shotgun sequence
  Pfam annotation: Domain name=RRM_1; Domain location=132-203; Score =94.3; E_value=3.9e-25; Accession=PF00076.13; Description=RNA recognition motif. (a.k.a. RRM, RB
  Pfam annotation: Domain name=RRM_1; Domain location=212-289; Score =23.2; E_value=0.00097; Accession=PF00076.13; Description=RNA recognition motif. (a.k.a. RRM, RB
  Pfam annotation: Domain name=RRM_1; Domain location=309-382; Score =42.4; E_value=1.6e-09; Accession=PF00076.13; Description=RNA recognition motif. (a.k.a. RRM, RB
  Pfam module annotation: Pfam domain module=RRM_1::RRM_1::RRM_1; Domain location=132-203::212-289::309-382
MGIVSTRNDDEEEVKESIDEYEKDERLDLEDNDPEYEPEEYGGVDYDEKEIEQDEGHEVGNEVEEEEAEDNVGEEEGDTGEEEVEDVHDELEGEEEHEHAGEEREHPDFADVEEEEHREVVKERQKRKEFEVFVGGLDKDATESDLRKAFGEVGVVTEVRLMMNPQTKKNKGFAFLRFETVEQAKRAVAELKNPVINGKQCGVTPSQDSDTLYLGNICKTWTKEALKEKLKHYGVTNVEDLTLVEDTNDEGKNRGFAFLEFPSRSEAMDAFKRLQRRDVVFGVDKPAKVSFADSFIDPGDEIMAQVKTVFIDALPPSWDEDYVRDLLRKYGEIEKIELARNMPAARRKDYGFVTFGSHDAAVKCADSITGTELGEGDKKAKVRARLSRPLQRGRGKHISRGDYRSSRGSGMMTRPSWSRPAPRSFPSRSVRGVGSRAPPVRPVSVRDRRPMMSIPARSRPVPPPSRSYDRRPVAPAYPKSSMKRDYGRREDIPPPRSRVAVDYGSRVASERRTSYRDYPARGPGYTELPRSTSRAAPRRGYVDDGYGQRFERAPPPPPPPHLSYREGRPRDYDALSGSKRSYAAIDDVPPRYADTGARQSRARLDYDYGGSASQYGDAYGDRLGRSSMGYGGGSRSSISSQDSHGLYSSRQGMSYGGGSFGSGDVGGMYSSSYGGDYISRGSDVGGSSYSSMYSGRGVGGGSSYMGGGGSGSYY

SEQ ID NO: 124589 - protein, 288 aa, Glycine max
  Coding DNA Sequence Number=SeqID_32904
  Subcellular localization annotation: CTP_CleavageSite=69; ConfidenceScore=5.45e-01
MGARVSSFMNRGASWAGRVAFIGVATGVTSGVSSGVTSGSGYGSWAVGASPPPAGEGWTPVEGLDGAVSAGGAGAGAGGGAGAEVEAGVEVEASEGPRALVLGVPEKVIVGSSGFQQFFRIYAKLMARHIDSKAICEIWPEMMEPNSMSIFITNLALSILRSDELLGCSLNIQYKTSPWNRQSGGELLRVWVHAVETGGHIYVVIRLPGQGFMPSPPLELLAELVILGHVQVNIPLWEDVSGMHVLLITFLGDLGHKSRRVIWLLRSRGGCFSLSGGHMYQKNHREEN

SEQ ID NO: 124590 - protein, 194 aa, Glycine max
  Coding DNA Sequence Number=SeqID_32905
  Homolog annotation: Hit_ID=A8MR93; Match level="QueryCoverage=67%, HitCoverage=18%, E-value=2e-08, Identity=35%"; Hit description =Uncharacterized protein At1g02145.3
MALFCIGLTILVDSIMWKSCCLWKGISFRILELVYHLEEVNFSKSDLAGLIVDSYVVSSIVSLDVVKLYGAPSHTWEFLWVTHAFHWYFTSALPRSLLAAYPLSLRKKDRREGDLIICRLSISSRFPTKPHCFQDSDFHKKIVMVKRKSFMKVVGTTMVLESWNVNLLGEPLALNFVASMADSLAMELRQKECT

SEQ ID NO: 124591 - protein, 225 aa, Glycine max
  Coding DNA Sequence Number=SeqID_32906
MGHVFDYPLCEKFRMVTIWEVVALVNMYDNLNDVSKSTVKQLAGYITLSQCWIYEYFPSVGSVVVVEDYDERKPRAWHWKSGKALPVSTYCRRLDRLTSDVTIPQHHVTPSLCIEGIDDRWIWFSEYIAIVGQICVAPGQCSLDYMDWFYLISHPFMSPTQLGDPPRHPPMQHHDTFVEPDVAQHTVVTMAMNEAPKDAHADIKQSRHVVEACQGIVERLEKLLN

SEQ ID NO: 124592 - protein, 801 aa, Glycine max
  Coding DNA Sequence Number=SeqID_32907
  Gene Ontology: Mol. function=catalytic activity; Cellular component =nucleus; Biological process=metabolic process
  Homolog annotation: Hit_ID=A7QMS3; Match level="QueryCoverage=97%, HitCoverage=97%, E-value=0.0, Identity=59%"; Hit description =Chromosome undetermined scaffold_127, whole genome shotgun sequence
  Pfam annotation: Domain name=PPR; Domain location=191-225; Score =36.8; E_value=7.9e-08; Accession=PF01535.11; Description=PPR repeat
  Pfam annotation: Domain name=PPR; Domain location=294-328; Score =36.5; E_value=9.9e-08; Accession=PF01535.11; Description=PPR repeat
  Pfam annotation: Domain name=PPR; Domain location=395-429; Score =39.8; E_value=9.8e-09; Accession=PF01535.11; Description=PPR repeat
  Pfam annotation: Domain name=PPR; Domain location=430-464; Score=7.3; E_value=1.1; Accession=PF01535.11; Description=PPR repeat
  Pfam annotation: Domain name=PPR; Domain location=496-530; Score =49.6; E_value=1.1e-11; Accession=PF01535.11; Description=PPR repeat
  Pfam annotation: Domain name=PPR; Domain location=531-565; Score=2.6; E_value=3.8; Accession=PF01535.11; Description=PPR repeat
  Pfam annotation: Domain name=PPR; Domain location=567-601; Score =13.6; E_value=0.19; Accession=PF01535.11; Description=PPR repeat
  Pfam annotation: Domain name=PPR; Domain location=90-124; Score=7.8; E_value=0.93; Accession=PF01535.11; Description=PPR repeat
  Pfam module annotation: Pfam domain module=PPR::PPR::PPR::PPR::PPR::PP R::PPR::PPR; Domain location=191-225::294-328::395-429::430-464::496 -530::531-565::567-601::90-124
  Subcellular localization annotation: CTP_CleavageSite=55; ConfidenceScore=5.19e-01
MVTCNSHLSSAPPSPLPISIHSFQNTNQYHSPTLKFTQSQPKPNVPHIQQELHINLNETQQLHGHFIKTSSNCSYRVPLAALESYSSNAAIHSFLITSYIKNNCPADAAKIYAYMRGTDTEVDNFVIPSVLKACCLIPSFLLGQEVHGFVVKNGFHGDVFVCNALIMMYSEVGSLALARLLFDKIENKDVVSWSTMIRSYDRSGLLDEALDLLRDMHVMRVKPSEIGMISITHVLAELADLKLGKAMHAYVMRNGKCGKSGVPLCTALIDMYVKCENLAYARRVFDGLSKASIISWTAMIAAYIHCNNLNEGVRLFVKMLGEGMFPNEITMLSLVKECGTAGALELGKLLHAFTLRNGFTLSLVLATAFIDMYGKCGDVRSARSVFDSFKSKDLMMWSAMISSYAQNNCIDEAFDIFVHMTGCGIRPNERTMVSLLMICAKAGSLEMGKWIHSYIDKQGIKGDMILKTSFVDMYANCGDIDTAHRLFAEATDRDISMWNAMISGFAMHGHGEAALELFEEMEALGVTPNDITFIGALHACSHSGLLQEGKRLFHKMVHEFGFTPKVEHYGCMVDLLGRAGLLDEAHELIKSMPMRPNIAVFGSFLAACKLHKNIKLGEWAAKQFLSLEPHKSGYNVLMSNIYASANRWGDVAYIRRAMKDEGIVKEPGVSSIEVNGLLHEFIMGDREHPDAKKVYEMIDEMREKLEDAGYTPDVSCVLHNIDKEKKVSALNYHSEKLAMAYGLISTAPGVPIRIVKNLRVCDDCHNATKLLSKIYGREIIVRDRNRFHHFKEGSCSCCDYW

SEQ ID NO: 124593 - protein, 206 aa, Glycine max
  Coding DNA Sequence Number=SeqID_32908
MSINEFATSVSREKDEEIEGAVVGVSLSEINALSEYHPLNEASARLASQGESGRESVTQARTQCAISLSSESFVSSALSAPCSLSQKEFLEEKKRKERSVKNREQKRKADQIQVDVPSTCTTKDVPSNVLRQRSQAGKGRIKRILRLCRFEFFDKGEGRHKRIQAGEENEKMNSTSFQGLENQKTLESFWHKEEEEVQRDSRLVKD

SEQ ID NO: 124594 - protein, 79 aa, Glycine max
  Coding DNA Sequence Number=SeqID_32909
MSPPPLETYKSLLNLGVEAKLHGESKVIQRCFDDNNDDDKGDDKGNDKKLKGQSKNNSSESKINQRTTQVNQEQFKSSR

SEQ ID NO: 124595 - protein, 74 aa, Glycine max
  Coding DNA Sequence Number=SeqID_32910
MKESKGGNIRGHRHYALSSRRQRRRGERRRHPLGNKPWKKELHHQDEPWIRSLERVLQWRKRKREKKREGGARN

SEQ ID NO: 124596 - protein, 78 aa, Glycine max
  Coding DNA Sequence Number=SeqID_32911
  Gene Ontology: Cellular component=plastid chromosome; Biological process=positive regulation of transcription, DNA-dependent
  Homolog annotation: Hit_ID=A7NVI7; Match level="QueryCoverage=60%, HitCoverage=34%, E-value=7e-12, Identity=51%"; Hit description =Chromosome chr18 scaffold_1, whole genome shotgun sequence
MKELDNKKDFDIEYDPLVPIIVIDDDNIVVVESKSFVSMQGWDSDPDNDVYDFIEMYVTPPDTNVYLIPKVLTLMPQK

SEQ ID NO: 124597 - protein, 59 aa, Glycine max
  Coding DNA Sequence Number=SeqID_32912
MEEDEGECLLQPLSPIFLCFSHSNNLAGLWLLDFSVHASSLSEHVSLSETFQCSIPGLL

SEQ ID NO: 124598 - protein, 115 aa, Glycine max
  Coding DNA Sequence Number=SeqID_32913
MVRTRGLSRALGAGRGRGISEDAHEADVPRRRRPTASARRQRVRLREDITERHEDVPQLHEDMTGAADAVQTEGVATDGSLGSPAADEGFPGGPHDPSILTDFAEHVAHSIWSGQ

SEQ ID NO: 124599 - protein, 910 aa, Glycine max
  Coding DNA Sequence Number=SeqID_32914
  Gene Ontology: Mol. function=protein serine/threonine kinase activity; Cellular component=cytoplasm; Biological process=protein amino acid phosphorylation
  Homolog annotation: Hit_ID=A7PK90; Match level="QueryCoverage=50%, HitCoverage=94%, E-value=1e-140, Identity=55%"; Hit description =Chromosome chr15 scaffold_19, whole genome shotgun sequence
  Pfam annotation: Domain name=Pkinase; Domain location=447-881; Score =101.2; E_value=3.2e-27; Accession=PF00069.16; Description=Protein kinase domain
  Pfam annotation: Domain name=Pkinase_Tyr; Domain location=447-881; Score=-131.5; E_value=0.00023; Accession=PF07714.8; Description =Protein tyrosine kinase
  Pfam annotation: Domain name=U79_P34; Domain location=122-356; Score=- 104.8; E_value=0.1; Accession=PF03064.7; Description=HSV U79  HCMV P34
  Pfam module annotation: Pfam domain module=Pkinase::Pkinase_Tyr::U79 _P34; Domain location=447-881::447-881::122-356
MAESEFEPNRVHDLEEKSWHLLALLFRIGHAVYPQRLAAQCRLFAASPDFVCYVSTLPGSPLSVTDNGLVTPSVSAVFALGSFFSLRFSPPQTHRFRKRKLLFDSAEDGRERKRLAIRHGLREFSFQSFADAAEALMRSNFPVIKFESQNIGSGNFVFLLRIDKNEECSGCPMSNFEHRGANNDASTTMSNGEVSKSIIEVLTKKISIIKTSYLNCPKLVDKNRFMECNLFVVDPPCKEGIVNNLGIGKKIDYFDTFTHDCAEQNSIHHVDEDGIGKSNTCKDQPREPNEDDEVESGSKKGLIDSGTNRVKEDVAQRVNAALCGEALTNGLEQKNHVHAMNLEKESERNTGTKSTNKISNSSSTPKRPLKSSSILKGGQKNDLHPKSQILKESLVSNKFGNVPKNVDQRKNEQNLTARKQNHKENMAGNIATTTKVEKRAYPSFEAFTIEEEEGSGGYGTVYRAQRTTDGKRVAIKCPHTNAHKNHVNNERSMLERFGGKNYIIRYEGSFKNGNSDCFVLEHVHHDRPEVLKKEIDIVQLQWYGYCMFRALYCLHKEGVVHRDIKPGNFLFSRKLSKGYLIDFNLAMDLKQKHNIGSKSKPSHDAASNIVSFSSGSAPLVRDKNLGGSKSLTSNKRALADYKNYSELNRHVKQKDCTGPLKNCPDKAGGSFLRAQGTDGSGVTSAKDPSTRTASAERLREPLPSHGRKELISFVNTMKCANNSSTIGPSSQRKRVTAPSSKVDGKIFNITPMPLHSSTVGGGLMRSKGDGKKKEGSCVGTKGFRAPENLNETIFGQVLLRSQHQGHKIDIWSAGVTLLYMELLDDRYLQSWDLEGWCKIHTKRPEFLEQIPKSLFDLIDKCLTVNPRNRLSAEDVLRHEFFDSLHESLRKQRMLHRHRALRSDAAASRAI

SEQ ID NO: 124600 - protein, 64 aa, Glycine max
  Coding DNA Sequence Number=SeqID_32915
MTPIANTLKKRSLKRRNTFEQTQTASWKRCSGKPNLFSYFRLRIKKKKVEAAGVSLSEAYALSE

SEQ ID NO: 124601 - protein, 60 aa, Glycine max
  Coding DNA Sequence Number=SeqID_32916
MGHGDDDNNNTNNNNSDDDEGNGGRGRRTRGQQSPPNPVQQDERPRCISRRIRCGKIFHY

SEQ ID NO: 124602 - protein, 45 aa, Glycine max
  Coding DNA Sequence Number=SeqID_32917
MWHHKTGGAELPCTVLHVAPQDKRHTARQEAQCTRAPWVAPLTRA

SEQ ID NO: 124603 - protein, 148 aa, Glycine max
  Coding DNA Sequence Number=SeqID_32918
MENVFSSLSTLNLSVFHEARLSLLPLTASLGALSARRDSVLAGRASWALGAQIYDLSSSRVSHPLSKLDASLSQIALLSMSSAAFTFSSLDEYFRIWAYSSSSNPETPVKDAEGDTPSLIVRPMGQNAAKRKSKGKGVRTSTNPVDLT

SEQ ID NO: 124604 - protein, 104 aa, Glycine max
  Coding DNA Sequence Number=SeqID_32919
MEEHQQEQHQPSTLFTQYFTLQTRKHRLKIEGQTQFINERRSTKRQWHQRLQQAGSANGNGVSLHLSYLALHLLLLPDGTRRVKAPTPLAFCNSWSNRQSGSFM

SEQ ID NO: 124605 - protein, 115 aa, Glycine max
  Coding DNA Sequence Number=SeqID_32920
  Gene Ontology: Mol. function=oxidoreductase activity; Biological process=electron transport
  Homolog annotation: Hit_ID=Q0H210; Match level="QueryCoverage=40%, HitCoverage=9%, E-value=5e-14, Identity=85%"; Hit description =Abscisic acid 8'-hydroxylase
MINLRKLVQRSLSLEALRNLVPHIEALALSAMNSWGGDGQVINTFKEMKKWDSDSNSATEHHIGHIAEATNRPRRVSKKPTYLLCAKAPSACRIFQSLLQHSTSLLVVIINYTTI

SEQ ID NO: 124606 - protein, 307 aa, Glycine max
  Coding DNA Sequence Number=SeqID_32921
  Subcellular localization annotation: CTP_CleavageSite=32; ConfidenceScore=5.08e-01
MAEPSKKRKGSSSRSQRYSEAQDTPIPSSISSSSLFSSEEQHTRYTNFFSSRSIIDPKFIDMNFFSDESFKCIQAFHNSNLIPFMSLKLLVYSELVKAFYYNLEIQESTLISEVYGIKMVIDQSLFYDLTQLSSDGVPFEGALDDDWKFDFSVHDAHRLVCTNQADMIGRLLASSLALESRILHYLIVCILLPRSSNLAQVSEEDLIVMWAFHTGRQIDWAHLVRIVIIKKGEIGEAMTSKIILMMPKNQELSKFQRIRSQKDSRIKFQDSRFKNNQVSRIKIQEQSRSRFKTQDSRIKRRLNQDKN

SEQ ID NO: 124607 - protein, 161 aa, Glycine max
  Coding DNA Sequence Number=SeqID_32922
MGAKYLEVVKRKLHATNQWSPDEIRISLHATDSLSLDDKGAEFVYAHLPPNMLLLNDKGKNAGPIGSRMSSGPPPLDDKSMTEIVCPEDDVNLRVSTDLLAAIDKGMTEIVCTEDDVNLRVSPGLLAAIDKGNCGAADKSEALAPMYPQCGTQTYVVLDNL

SEQ ID NO: 124608 - protein, 129 aa, Glycine max
  Coding DNA Sequence Number=SeqID_32923
MTETVCMDTRLGISVRHLTSRVKMTETVCTDNHLGISICHLTSRVRMIESAEDDVSLRMSTGSTEIVCEDNNLVISACHLTSRVRMTKTVCTDNHLGISVRHLTLRVRMTEGTEGDVSLRMSTGSLAPD

SEQ ID NO: 124609 - protein, 107 aa, Glycine max
  Coding DNA Sequence Number=SeqID_32924
  Homolog annotation: Hit_ID=A5BTR2; Match level="QueryCoverage=99%, HitCoverage=6%, E-value=4e-12, Identity=38%"; Hit description =Putative uncharacterized protein
  Pfam annotation: Domain name=zf-CCHC; Domain location=51-68; Score =14.9; E_value=0.0085; Accession=PF00098.14; Description=Zinc knuckle
MYVQEEERLVMEMAESALLTTACGNNKAAKSQANQKGNAKIPPQADIKKVAKCFFCKKKGHMKKNYPRFQKWLEKKDLLSILQILYQGMQNLRKLGGSEQSILSSNN

SEQ ID NO: 124610 - protein, 147 aa, Glycine max
  Coding DNA Sequence Number=SeqID_32925
  Homolog annotation: Hit_ID=Q6UUU1; Match level="QueryCoverage=40%, HitCoverage=40%, E-value=1e-18, Identity=78%"; Hit description =Putative uncharacterized protein
MEPRGEIVAASLGGVGSGVKRLWRKPGEERIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124611 - protein, 71 aa, Glycine max
  Coding DNA Sequence Number=SeqID_32926
MKGAQAYDAMMQRVLFEPCGRRVRWRARDRVHPHMSLYGLCDPSASPSHKKSLAGKQQQSWFVGESGPVYG

SEQ ID NO: 124612 - protein, 136 aa, Glycine max
  Coding DNA Sequence Number=SeqID_32927
MHRSPTGNLVPLDLEIEATLRRNRAERRRKLLQDRTVASILEEETHFSDLLSPDSPSSMESATQLPEVITMAEEHDQRITLEDYSSSSIPQFFTSIARPEVQANNINYPHSLIHLIQGTYFKDYLMETPMHTWHVH

SEQ ID NO: 124613 - protein, 106 aa, Glycine max
  Coding DNA Sequence Number=SeqID_32928
MTKPPPRERTLREMAAPDFTYESLCIQYPDEDVPYVLKTGLIHLLPKFHGLAGLSNMERSMIDAASGGALRDMTPVEAKNLIEKMASNSQQFSARSDAMSLEECMK

SEQ ID NO: 124614 - protein, 127 aa, Glycine max
  Coding DNA Sequence Number=SeqID_32929
MMPAAWSALTSGYDRQTACRLKPREEDFILMWAFLTGRPIDWAHLIRYHMHNTLRSGAHLPYPQLVTLLLRHFEIPLNFEPLVQVQRSFAIAASAVTSFGYRKDMDGKWLKKDAQPLQDERTPSPLP

SEQ ID NO: 124615 - protein, 124 aa, Glycine max
  Coding DNA Sequence Number=SeqID_32930
  Subcellular localization annotation: CTP_CleavageSite=74; ConfidenceScore=5.21e-01
MRNNNSYLLLHRIQQRGMPTRTLFLLTSSKPNSKKAESPLCAGPFAGTKARSRVPFQKHFEERARPKSPPTFICGKRRKNRRKPVKMKILSSGVVFTLEEGRQSGAFAPTYPPLERKSDLRSSS

SEQ ID NO: 124616 - protein, 103 aa, Glycine max
  Coding DNA Sequence Number=SeqID_32931
CLAPIIRKFVKFRDMPKKKRNIDAQSVRFRDTPEIKWKHRCTISEVPGGANSTQPTWALQNIPPEVVASGGSNPARLGELGGKHLPYFDINRGGSEEEKGSAP

SEQ ID NO: 124617 - protein, 72 aa, Glycine max
  Coding DNA Sequence Number=SeqID_32932
MERMRKENKKSLGRIDMSKEALSVRIENIKRIRDDKPSNFSHGDDDGHELDEGGRRNERYRERRNHRREGDR

SEQ ID NO: 124618 - protein, 103 aa, Glycine max
  Coding DNA Sequence Number=SeqID_32933
MAQERTWMSCVLLEQVRNQPNTEGGYFCGRPAMPFRVCFMRSKPLAESLTTVAILLKEGRHPEERYGFLPPRGHPRISSNSSMVGTNWKSPNVKHLKAGRSIG

SEQ ID NO: 124619 - protein, 146 aa, Glycine max
  Coding DNA Sequence Number=SeqID_32934
MDGALNASELPIPGEASSGQGPGPSPGVGGRERQRVLKLGGEARLIALCALCLRKGIGLNGESRDVAADGNVGVRRRRAMVAPERVFCCMPSWRRHHRDCGWQRAPLACLGTCALLASACGLPIRPVLKHGPRSLTCVRVNGRVNP

SEQ ID NO: 124620 - protein, 107 aa, Glycine max
  Coding DNA Sequence Number=SeqID_32935
  Subcellular localization annotation: CTP_CleavageSite=38; ConfidenceScore=5.55e-01
MHTQSFTIPQFFKIGLTHKTSPQWSRQLSQRALRGRARARLTGALSKGGKMHGVATNVYLWKSQENQRKLVKMKILSPGVVFTLEEGRQKRGFCSYVSSIEEEIRPT

SEQ ID NO: 124621 - protein, 66 aa, Glycine max
  Coding DNA Sequence Number=SeqID_32936
MMEGDLIKGLSQFLDIGFIGYQLGISSFPIPSQLMDSNAESAPFTLWPVGALVRDILSLANHIFGR

SEQ ID NO: 124622 - protein, 234 aa, Glycine max
  Coding DNA Sequence Number=SeqID_32937
  Homolog annotation: Hit_ID=Q6WAY6; Match level="QueryCoverage=88%, HitCoverage=33%, E-value=2e-20, Identity=33%"; Hit description =Putative uncharacterized protein
MVEEFEEIIGCPSRGKETIPLLRELDHRKQVENGVVGIPRKYLEAKTRILVGKGEWAPFIDILALLIFGGILFPNVDGLVDLAAIDAFLAYHDHKESPVVAMLADLYDTFDRRCEKSSTRIVCCTLALYVWLVSHLFRQEVRHACPLESHRSCTEKGGANWDQLLANKEGASVNWFHRWKEGRIRVLISCGGFPNVPLMGTRSCISYNPVLSIRQLGYPMRGAPLEEEITPVIS

SEQ ID NO: 124623 - protein, 64 aa, Glycine max
  Coding DNA Sequence Number=SeqID_32938
AYFLDIHCKVKHIRTRKGKQGSKGLTKELIQASTRIKPRLLCKQLMGQDTPNDYDDGWLIFSQE

SEQ ID NO: 124624 - protein, 143 aa, Glycine max
  Coding DNA Sequence Number=SeqID_32939
AWDPRTDHRTLPVVGVPVAPTKVIRPPITRAFIEKYCTQRQAQGDAPQVAGAPPPPHQASQAGAFDMEQYLRHLMSLSMQSQGFASFSCPTPDQFRAEVAWPGDWPEAQAGEAPPEAPGDGEEAHEDEEMADLLDFLGGSGDT

SEQ ID NO: 124625 - protein, 110 aa, Glycine max
  Coding DNA Sequence Number=SeqID_32940
  Homolog annotation: Hit_ID=A5AKE5; Match level="QueryCoverage=64%, HitCoverage=4%, E-value=1e-07, Identity=39%"; Hit description =Putative uncharacterized protein
MIKKELNALENVLNDRPLSQVEVTLKKSLQVQLWEAAYAYESMLRQKARIKWLKEGDNNSTYFHRLINHRRRKKCYSRVKNAAVLYFKTDFWRIVLTGQHWMVFTSPLWI

SEQ ID NO: 124626 - protein, 174 aa, Glycine max
  Coding DNA Sequence Number=SeqID_32941
MSLAVDDMYWSRNARKRAHQGWTLGFKSLGGTTMDALVLIREMRKGRDVGCDPKGTFPVGAKLSCLRIFSCFTLDSQYEVAELKGSWLNLCIVSFGCSKLGSFFLNPHRFANFFGGFNLLVDGSLTSMRIMASMPYALRLVESSLQGPEDDSVSYLFLSVSLRMFDKGDQVLDA

SEQ ID NO: 124627 - protein, 86 aa, Glycine max
  Coding DNA Sequence Number=SeqID_32942
  Subcellular localization annotation: CTP_CleavageSite=31; ConfidenceScore=5.33e-01
MNALKHSVTTYSSAGGDTRLTGASSNEENARVATNVYSSGKRRKNRRKPVMKNIPNSGVVFTFDEGRQKRGSCSYVPSIEEEIRPT

SEQ ID NO: 124628 - protein, 335 aa, Glycine max
  Coding DNA Sequence Number=SeqID_32943
  Gene Ontology: Mol. function=catalytic activity; Cellular component =cAMP-dependent protein kinase complex; Biological process=intein -mediated protein splicing
  Homolog annotation: Hit_ID=A7MQ22; Match level="QueryCoverage=61%, HitCoverage=93%, E-value=2e-93, Identity=70%"; Hit description =Putative uncharacterized protein
  Pfam annotation: Domain name=PP2C; Domain location=96-328; Score= -57.3; E_value=0.013; Accession=PF00481.12; Description=Protein phosphatase 2C
MVLDDANNPFKLLPTGKTVLIQMFGTPMPGFMPPTKSVRDALIDLQAHQLGMISGIRAIIAAMLQSFNPEQLEEQAKQNGMTSRLALPGSRKAALWDYFVRSYGETAGEIEDDFHTLFGEAFLHAYDMEDQTGETIGERSACFVVCDGIAGLPGGEVAAELARNSIISRFDGNKHLNAQHIRDYVQTANRTILSEQQAVQDYRRMGTTLVSLFIDRDYGLAYWAHAGDSRLYLFRRGWLWHVTTDHSLVQQMKDAGHQTDNLNSNLLYLALGIENGGPEASYSDVVQVEDGDAFLLCTDGFWHGVSEEQMKQSLHMDTTLLHTLSDAAHFFPATD

SEQ ID NO: 124629 - protein, 140 aa, Glycine max
  Coding DNA Sequence Number=SeqID_32944
GGGPDDKQRPSLVILHPRYAEIPYGYLHPFARQTQLCPMASRDQVWSFCTQDTRRYLTVIRTLLSSRGGGPDDKQRPSLVILHPRYAEIPYGYLHPFARQTQWSDGKQRPSLVILHPRYAEIPYGYCTLFAICKTERLIA

SEQ ID NO: 124630 - protein, 115 aa, Glycine max
  Coding DNA Sequence Number=SeqID_32945
MEVLRWRAAAMSEGLGVGSKPWKGILSGTATALRPKRPDGLKVTKGPQLHRSLGNINAEHDYSCQHSNIPKIPPLSGVITCATSETHSRKDTMIIPPSYLMFPSSPGVGLISPLT

SEQ ID NO: 124631 - protein, 161 aa, Glycine max
  Coding DNA Sequence Number=SeqID_32946
TYGYSHPLSSRGGGPDDKQRPKTKFGHSAPLYHPEAAGPMIRGDTLRLFAPFCNPEAAGPMTSRDQVWSFCTLVSSRGGGPDDTRRYLTVIRTLLSSRGGGPDDKQRPKAAGPMTSRDQVWSFCTLVSSRGGGPDDTRRYLTVIRTLLSSRGGGPDDKQRP

SEQ ID NO: 124632 - protein, 40 aa, Glycine max
  Coding DNA Sequence Number=SeqID_32947
MSAIQFSIQSVNEVCMMSVKWWLDRNIEMTITEATRLQMR

SEQ ID NO: 124633 - protein, 55 aa, Glycine max
  Coding DNA Sequence Number=SeqID_32948
MLQPCGIGTDLKEHSNRVTPKAYAPKSPSGPLPPDSDAAHELYNTHDLTLVFKHV

SEQ ID NO: 124634 - protein, 77 aa, Glycine max
  Coding DNA Sequence Number=SeqID_32949
MATAEALEQETKKARKEEHDQSKVEKKFVPTVKARLKGNMWAIIDECKEKLNLAATHEQRLEDEYAKISAEREAREG

SEQ ID NO: 124635 - protein, 248 aa, Glycine max
  Coding DNA Sequence Number=SeqID_32950
ATRLGFRGLHVLTSEDYTPHFRGLHVLAFRGLHVLTIGGLHVLPFRGLYALAFLGIHALTFRGLHVLAFRGLHTLPFRGLYALTLRTTRPCLQRAARPHLHRIAHPCLHRTSYLRLERTQVHGPPPDIGGRPTVRAKIEREAIVQLLCIPGQDFTQPLQGDECGSCTPPQLRSPLAEVSVGLCRHDIGPWGFQLWLWASVNPTGCPSPPARSRHRDIGIAPARHLVDPEKSNTVLGFPALITGLCQFY

SEQ ID NO: 124636 - protein, 74 aa, Glycine max
  Coding DNA Sequence Number=SeqID_32951
LADRPSSSFSANTEKNPKEECKAVMTRSRMETHVDEGKAEKKVEEHIQQLAAEPTLEPIFYFAELEEILEDEDD

SEQ ID NO: 124637 - protein, 221 aa, Glycine max
  Coding DNA Sequence Number=SeqID_32952
WLRRGNQHIGNDDLRVFLHKLDIMKRHEFVWEPYTATMMAALPPICVVGSVAWFAVGEVVETLQYMVSPQGRNTWTVDDLVPYVEKLAILFEEQKRITEPVSHGPASECQFPTQEFHIHQSSFETRGIGRRREAVEAEEYSQQMMEHGHGMYYTPTTFSQYPSQMYQYPFEGHHTDTSASEHSFGGVAETHPHFSWPTMTPSQQHDAPMATPNAPLAPQWN

SEQ ID NO: 124638 - protein, 109 aa, Glycine max
  Coding DNA Sequence Number=SeqID_32953
MSHNNSFQNCPMYGVACQCYDSTSDSPQISASPYQLDFTLYASGSYNAQWNPPGLLHDKHTLRSSRILRKMEVEEPWLGYGIKFSIGHWNWGEFYRLSRCKIHFLVDVF

SEQ ID NO: 124639 - protein, 72 aa, Glycine max
  Coding DNA Sequence Number=SeqID_32954
  Gene Ontology: Biological process=transposition, DNA-mediated
  Homolog annotation: Hit_ID=Q1J7G7; Match level="QueryCoverage=47%, HitCoverage=48%, E-value=7e-12, Identity=97%"; Hit description =Transposase
  Subcellular localization annotation: CTP_CleavageSite=47; ConfidenceScore=5.05e-01
MVKVGTSYVPINVSFSPKLAQGFPVLQWLLFLSAVPPVQLLTGWCVTAKAPPDISAGKCSGHAARNHHTRRA

SEQ ID NO: 124640 - protein, 42 aa, Glycine max
  Coding DNA Sequence Number=SeqID_32955
MAYTHIPVKVENPEPYNAQWNAPGLLRDKHTLRSSRISEKWR

SEQ ID NO: 124641 - protein, 142 aa, Glycine max
  Coding DNA Sequence Number=SeqID_32956
MAAQLIHDRVEMECLEELGDPRRQHEVPISGTIRFTVTSLVHPDEPTRTLQRTVEWILPTPTPYRLVEPVQVIEVTSSEEDPEEDPEELPPEPAMDALDFLEDAEDPLPEVDSPEEVMSTSEADSTEDSGPREMATSGGSSS

SEQ ID NO: 124642 - protein, 83 aa, Glycine max
  Coding DNA Sequence Number=SeqID_32957
MASMDDWVIGNEKGRYWLSNDIVGLVVWPYTSRAYVQYSSNPLEISTIFVKSFTTSEPHRDNSSLVFRNPYNSRDPRSLNQFH

SEQ ID NO: 124643 - protein, 266 aa, Glycine max
  Coding DNA Sequence Number=SeqID_32958
  Gene Ontology: Mol. function=nucleoside-triphosphatase activity; Cellular component=integral to membrane; Biological process =chromosome segregation
  Homolog annotation: Hit_ID=Q2KDV9; Match level="QueryCoverage=73%, HitCoverage=25%, E-value=1e-17, Identity=71%"; Hit description=Cell division protein
  Subcellular localization annotation: CTP_CleavageSite=62; ConfidenceScore=5.48e-01
VVDVPFDAHTHAPQTAPIVRTPVPPVVARVPVQPTRAPLLPIVRTPVQPAVPVQVAPLPEAPAAAEPYHAAGELASISDFAFWEVMAFEDGAVPAAPQFQPVPMPRVEVSPESIIASFRVMEWHPHRRTETAPVVASIAVAPAPVAVAPQPVAPALVVAPPVAKPVEAAAPAPQPVPVEARIQPIAPIPVRTPAVAPVTMPAPRLAAAKPVAAKVDASGYEFPPNELLQQPPERLGEIMTQEALEQNAGLLESVLEDFGIKGEIIH

SEQ ID NO: 124644 - protein, 103 aa, Glycine max
  Coding DNA Sequence Number=SeqID_32959
  Homolog annotation: Hit_ID=A5C8G9; Match level="QueryCoverage=80%, HitCoverage=22%, E-value=2e-12, Identity=40%"; Hit description =Putative uncharacterized protein
MLIGLESKGGYPKIKKDSSSCVVKVVQPTLKMLNDENLEAIWDAAVHLLCTTITSFPFSIRNHYDSLELQTEMVESAIALKLLSGGCSLDMSKVNQFFTSVLT

SEQ ID NO: 124645 - protein, 225 aa, Glycine max
  Coding DNA Sequence Number=SeqID_32960
  Gene Ontology: Mol. function=sequence-specific DNA binding; Cellular component=nucleus; Biological process=regulation of transcription, DNA-dependent
  Homolog annotation: Hit_ID=Q9FXS1; Match level="QueryCoverage=95%, HitCoverage=66%, E-value=2e-18, Identity=33%"; Hit description=WRKY transcription factor NtEIG-D48
MAVSDGYAIAVKEAASAGIHSVEKLVNMILNQHREGGSELEAVADVAVNRFSEVISLLEKPTTTRTTGHARFRRAPTTAPPVPVVQLQQMVHDSKHKLQQQQNETEQKQQTSAFKVYCPPPPPPLPQNQNHQEQPFILPLHNNEANGSTTNSYVSTLSMDTESLQRSCLSSSGFQISHMSHQGGSFVRKPPLSTNSVKRKCNSTGFPDTKCGSSSAQCHCYKKRF

SEQ ID NO: 124646 - protein, 50 aa, Glycine max
  Coding DNA Sequence Number=SeqID_32961
MADSMDDSLTIEETEVCLKARNSLWYLDSGCSRHMTSDKSKLIDFVSKEG

SEQ ID NO: 124647 - protein, 23 aa, Glycine max
  Coding DNA Sequence Number=SeqID_32962
HVRHFGEENTETIFSLTVSKNYI

SEQ ID NO: 124648 - protein, 77 aa, Glycine max
  Coding DNA Sequence Number=SeqID_32963
MKNVEERSKTFAKSLTETLRKRLGLDFLHGTNFPQQIRKREKKLGEKLATQLAQASKVASSRSNSLLEESSGGPKWA

SEQ ID NO: 124649 - protein, 138 aa, Glycine max
  Coding DNA Sequence Number=SeqID_32964
  Subcellular localization annotation: CTP_CleavageSite=24; ConfidenceScore=5.33e-01
MRTRSPLKARACSTLQARMCSPLMARTYGPLKVIGTSTQGSTFMREQENDPSRGCRSSTRMLDTRCLRPAWGCSYFLMIDCREHCMQPCCGVKVARVKSCPGMHSKCVIASLSGCARTVGRPPILGVAQELIKETIGP

SEQ ID NO: 124650 - protein, 126 aa, Glycine max
  Coding DNA Sequence Number=SeqID_32965
MYPPLELIHKRCTLSCSQSTTQVDVPSTCTTKDVPPMEKGDTKEFRRLVLRSFGKGRREAQKEFRRLVLGEFFLAKGEEMKRMNSTSFPGLENQKTLESFWHKEEEEVQRDSRLVKDCIRLIGKVH

SEQ ID NO: 124651 - protein, 60 aa, Glycine max
  Coding DNA Sequence Number=SeqID_32966
MPKDRGTCLDFRYCHHQKGGDCRQRIKLNVLMMPKDHMFLKALFKTKKSKIFKMEDQDSL

SEQ ID NO: 124652 - protein, 82 aa, Glycine max
  Coding DNA Sequence Number=SeqID_32967
  Gene Ontology: Mol. function=aspartic-type endopeptidase activity; Biological process=DNA integration
  Homolog annotation: Hit_ID=A5AQZ7; Match level="QueryCoverage=47%, HitCoverage=4%, E-value=2e-09, Identity=71%"; Hit description =Putative uncharacterized protein
MSWPRGHIASQMVPAYRITLETDMSWQDIYEKGGPREPYKLQWLNEKGEMIVNQQVKVPFSIGTYKDEVICDVVPMEENTFS

SEQ ID NO: 124653 - protein, 79 aa, Glycine max
  Coding DNA Sequence Number=SeqID_32968
MALFEENLDEHRDKWTMWFNGPLASNVLGRQLSTGVWWLCSPIMILTAGEVFITAEREGKLEGPQKVDSILTKPISEEC

SEQ ID NO: 124654 - protein, 228 aa, Glycine max
  Coding DNA Sequence Number=SeqID_32969
  Homolog annotation: Hit_ID=Q2HW90; Match level="QueryCoverage=84%, HitCoverage=39%, E-value=7e-21, Identity=33%"; Hit description =Putative uncharacterized protein
MGPLQRQAFCKVYGNILDLTTEEVFTEAVVSLAQYYDQPLRYFTIGDFHIVPTVEEFEEILGCPLGGRKPYLFSGFLPSLSKIVAVVGDSARELDRMKQNRNSVVGLPRKYLEGKARDMANQEEWVPFADILALLIFGVVLFPNVDGLVDLAAIDAFLAYHHSKESPVVAIMANLFDTFDRRCEKNSARIVCCLPALCVWLVSHLFQQDIRHPCSAPKLFARASKKGE

SEQ ID NO: 124655 - protein, 103 aa, Glycine max
  Coding DNA Sequence Number=SeqID_32970
MGTTKTAAPKLPLLSFCFPFHALFHSPQAYVALWSNGACHIAPILLLFMPKHAPTKCSVKCLNDIWAWFGDMKDLNECLNAILSLGTQAFNFNTRKHDLRLGI

SEQ ID NO: 124656 - protein, 82 aa, Glycine max
  Coding DNA Sequence Number=SeqID_32971
MHSRPMFGWQLLVWEILRDGLEFDYDASLCVTQEEVDVFLVVEEPVWSFACNDIFLPLEKISDDLGVHYTFRKKYSRIRVVR

SEQ ID NO: 124657 - protein, 78 aa, Glycine max
  Coding DNA Sequence Number=SeqID_32972
MAIRRSISTRDRVEMLYSRMKLQKLEQERGIIAQRRVEEGNNTEDNNTLEQNNAKRAEDNINGDLLDPDTMPRDKKPP

SEQ ID NO: 124658 - protein, 84 aa, Glycine max
  Coding DNA Sequence Number=SeqID_32973
MQKARHQANIVEEHDQEQCMFYATQDSIKEKGGAKTAKEAWNTLQEELFKEDCKSTAVKLQSLRRDFELLKRRTSETVKGPTHP

SEQ ID NO: 124659 - protein, 134 aa, Glycine max
  Coding DNA Sequence Number=SeqID_32974
METISKRFEELDVCGEVTLKSKLWEIAYPDQKSMCVPPSKVNTKDAPKKSMNKNQRSTNNSSVKRSASSSDQPNPRRIMSMLDQFQPFIHDFIDNIVDVKADSNFLYQSIATLLGMGEDSWSLVCNHLLKELAK

SEQ ID NO: 124660 - protein, 42 aa, Glycine max
  Coding DNA Sequence Number=SeqID_32975
ICNTVMIAGVPDKAIRLSLFSFSLAGEAKRWLHSFKGNSPKI

SEQ ID NO: 124661 - protein, 237 aa, Glycine max
  Coding DNA Sequence Number=SeqID_32976
MAPKKLSTKRSRRDAAAEGSSAAPVFDSHRFWSAEHQQRFEAIKGWSFHRERRVQLREDEYTDFQEEIARRRWAPLVTPMAKFDPEIVLEFYANAWPIEEGVRDMRSWVIGQRNRADGFDEEAIAQLLCIPGQDFARTATGRRVRIMHTIMTTLTQTWMTLLLSNVLPSDHNSDLPLPKCQLVYAILTRMSVHVAQAPSGPRSVQQGSRVSGTDHGPLPGDAHQAADAPPPPQLVDP

SEQ ID NO: 124662 - protein, 336 aa, Glycine max
  Coding DNA Sequence Number=SeqID_32977
  Homolog annotation: Hit_ID=A5C169; Match level="QueryCoverage=44%, HitCoverage=13%, E-value=3e-08, Identity=28%"; Hit description =Putative uncharacterized protein
MAEPSKKRKGSSSRSQRHSEAQDTPIPSSISSSSLFSSEEQRIWYTNLFSSHSIIDPKFIDMDFFKSHSLYLIESTLISEVYGIKMVIEKSLFHDLTQLSSDGVPFDDALDDDWKFDFSMSDARRLVCTNQADMIERLLAGSLALEIRILHYLIVRILLPRSSNLAQVSEEDLIVIWAFHTSRQIDWAHLVWYHMHKALRLNAPLPYPHLVTLFLQNFNIPLDSEPYIPIKRSFLIDATVVASFGYRKERDGSWVKKGAQPNDDEGHLPVEGDSSLLQSILDRYDGLQTYVGERFDALERQVDTRFDEMDSRITKEEEDVTIIRDCLDLPSPPPSV

SEQ ID NO: 124663 - protein, 80 aa, Glycine max
  Coding DNA Sequence Number=SeqID_32978
MTKEGCGRPCVVSARHWTCRLWMTKGADNNKVCPRATRPSGHDNRIETFSRSWSEDADISGKGADDHIGLCVSTGLLASS

SEQ ID NO: 124664 - protein, 241 aa, Glycine max
  Coding DNA Sequence Number=SeqID_32979
  Subcellular localization annotation: CTP_CleavageSite=41; ConfidenceScore=5.23e-01
MAEPSKKRKGSSSTAAVAAHRRHGPSEASTTPIHPSLSSPRSSTLFSSDDKHLRQGAPFEGTIVDDWKFDYSSHDARRMVCNDQAEMTGRLLAGSLTFDNRIMHYIIVRILLPRSSNLAQASKEDLILMWAFLTGHQIDWAHLVRYQMHKALRANAPLPYPQLITLFLRHFQISLDDEPFIQVKRSFAIGVGAVTSFGYRKDRNGQWLKKDALPPQDERTPSPPPQHEDSALLNEVLSKLR

SEQ ID NO: 124665 - protein, 256 aa, Glycine max
  Coding DNA Sequence Number=SeqID_32980
  Homolog annotation: Hit_ID=Q6WAY4; Match level="QueryCoverage=58%, HitCoverage=26%, E-value=8e-11, Identity=32%"; Hit description =Putative uncharacterized protein
MEPIASLSQYYDQPLRCFTFEDFQLVLTVKELEEILGCQLGGRKPYLFFGFYPSTTRVAKVVKSQHRSWNVKQNRNGVVGVPRKCWRKGQRPWKIKANGLSFIDILAFLIFGVVLFPNMEGLVDLAAIDAFLAFHHGKESPVVAILAMYDTFDRGCEKSSARIVCCALALYVGPSIRYKVTARASKRERVIDSLHQETTMWMDRFALTLNRSQELPPLLAKAKAVANTYSAPEEIHGLLSYCQHMIDLMDHIIGNH

SEQ ID NO: 124666 - protein, 133 aa, Glycine max
  Coding DNA Sequence Number=SeqID_32981
MVTQNNESGKFLLWDRECAELIGQTADGVNRVKIEDGDLDLNASPQALDKLLGHVLAFKACSKIDPSNVDCNDATHVECQFLSATTDHDPVAGLPLTPKKRMSSDEADDELGSSQISPAQLSSNKLTRHSHRS

SEQ ID NO: 124667 - protein, 145 aa, Glycine max
  Coding DNA Sequence Number=SeqID_32982
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=72%, E-value=2e-24, Identity=70%"; Hit description=LacZ protein
  Subcellular localization annotation: CTP_CleavageSite=14; ConfidenceScore=5.18e-01
MSGNSRTSVALNFKAAARGPISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 124668 - protein, 307 aa, Glycine max
  Coding DNA Sequence Number=SeqID_32983
MAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPTDHNSDLPMPKCQLVHPLDPDSPTGPGIPALITGLCQSFGVPVAPTKVIRPPITRAFIEKYCTQRQGQGDAPQAAGAPPPPHQAGQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 124669 - protein, 113 aa, Glycine max
  Coding DNA Sequence Number=SeqID_32984
  Gene Ontology: Cellular component=mitochondrion
  Homolog annotation: Hit_ID=Q5MA28; Match level="QueryCoverage=53%, HitCoverage=55%, E-value=4e-23, Identity=85%"; Hit description =Putative uncharacterized protein orf108
MSPEQFQYIWRKTIPHIEVGMGSGVFTSHRSARISIQPQVPLRLPCYDFTPVEDPTVVCANKTTKSLCGTSGTQKSWVIIGPMLRRNPISKGVTGGVYRARVHIHCGMLIRDY

SEQ ID NO: 124670 - protein, 53 aa, Glycine max
  Coding DNA Sequence Number=SeqID_32985
MPKLGGIGVGGSDIIDKSLKLKSGTKRTLWMIKSGVNFMLPEMWDWTVDPLGK

SEQ ID NO: 124671 - protein, 83 aa, Glycine max
  Coding DNA Sequence Number=SeqID_32986
MMAHQKPPYLAFCTPGQNETKNKIQGYQRETNENIHMFLNEHQGMKGMGLLKVVMGPRTRYGKIWNKWLNPKGIEEQWGISAY

SEQ ID NO: 124672 - protein, 75 aa, Glycine max
  Coding DNA Sequence Number=SeqID_32987
MWYHFSVKNLVGCLGVHDRTRLTMGRPVRVTLFARMFQPCGIGTGLQEHSNWMTPKAYTPKSPSGPLPLDSVRLK

SEQ ID NO: 124673 - protein, 237 aa, Glycine max
  Coding DNA Sequence Number=SeqID_32988
  Homolog annotation: Hit_ID=A9CGR8; Match level="QueryCoverage=18%, HitCoverage=15%, E-value=1e-17, Identity=95%"; Hit description =Putative uncharacterized protein iolB
EGDGKAGRVHCPGPKRKFEARAIIQSRMFPRRAQSGSINQLGHPPSPRIVADGKFRNEGISYDGHGLLCYAAQCGRKACGADRLSVAATLSSVIPALSRIQPAQVFGLKRVFPPRGRASAGFRLKAGMTVEHHHDLTSAQAGRDKRQGARYHAPKRGLGLCRFRPLPPEAGRDGGGKDRRYGSHPRAGRRQGDDSADGKDFGELGDRMNVFERKPPHCVYVPAGSDWSLTATTDCTV

SEQ ID NO: 124674 - protein, 94 aa, Glycine max
  Coding DNA Sequence Number=SeqID_32989
RDSNVSMTDLVSAEDDVNLRVSTGLSTAKKNVYTDNHSGISARQRDSNVSMTDLVSADDDTAKNNIFTDNHSGISARQRDSNVCITDLVSAEDD

SEQ ID NO: 124675 - protein, 65 aa, Glycine max
  Coding DNA Sequence Number=SeqID_32990
MSAEKYQSRLYSGRCRPVFSIQSLNNIWMMSIRKCAIGAIRKCSIGVIWRCFFFNLDRSLSWRVG

SEQ ID NO: 124676 - protein, 80 aa, Glycine max
  Coding DNA Sequence Number=SeqID_32991
  Gene Ontology: Biological process=transposition, DNA-mediated
  Homolog annotation: Hit_ID=Q1J7G7; Match level="QueryCoverage=41%, HitCoverage=47%, E-value=7e-12, Identity=100%"; Hit description =Transposase
GPLRADQRLISPKVGPGLPGINRDTRIYLFCEVLQWLLFLSAVPPVQLLTGWCVTAKAPPDISAGKCSGHAARNHHTRRA

SEQ ID NO: 124677 - protein, 94 aa, Glycine max
  Coding DNA Sequence Number=SeqID_32992
MERKIAQRELKESKLEPELEVYTKEKMLSRRLLFQDSMTSQLQFSPTKSSAQQSIQKYQGNVSSSPCTSIKSYLTSVYARLRLASPAKRLMSSK

SEQ ID NO: 124678 - protein, 201 aa, Glycine max
  Coding DNA Sequence Number=SeqID_32993
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=98%, HitCoverage=34%, E-value=5e-93, Identity=75%"; Hit description=DNA -directed RNA polymerase subunit beta'
  Pfam annotation: Domain name=RNA_pol_Rpb1_1; Domain location=5-142; Score=-170.6; E_value=0.082; Accession=PF04997.3; Description=RNA polymerase Rpb1, domain 1
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKMWMPREIAIELFQTFLIRGLIRKHFASNIGIAKSKIREKEPIVWEILQEVMQGHPRIAE

SEQ ID NO: 124679 - protein, 102 aa, Glycine max
  Coding DNA Sequence Number=SeqID_32994
MEKSEKKNHSEKKLKKAYITWDENDLESSDDSENEEINLCLMAKSYESDEEGINLKNYKRFIKTFPLPHKNVILILSLVLTVEEEDMAYQLATSRKITVTLK

SEQ ID NO: 124680 - protein, 241 aa, Glycine max
  Coding DNA Sequence Number=SeqID_32995
  Homolog annotation: Hit_ID=Q6WAY6; Match level="QueryCoverage=53%, HitCoverage=23%, E-value=2e-15, Identity=34%"; Hit description =Putative uncharacterized protein
MGSVLIPTVNKPTEGPCRLLKNVRWGISLPLDVVSKKGTNSPDPRIPRLHLCHMHSIMHSSIPPMRYRSFDLHQLLSHFSKPSARLTERSRVTIAEVSIEAIASLTQYYDQPLRCFTFGDFQLVPTIEEFEEILGCPLGGRKPYLSSGCLPSLSRIATVVKDSARGLDRIKQTRNGMAGLPQKYLEDKARGMANQGEWVPFMDVLALLIFGVVLFPNVDGLVGLAAIDAFLAYHHSKESPV

SEQ ID NO: 124681 - protein, 91 aa, Glycine max
  Coding DNA Sequence Number=SeqID_32996
LYIEENPPPLVALERVYEGSTTVHNIPLLHDQVKVGVEEVRDADAPIPVPTEEGAVGPAKPVDRLNRDVDDPLYMMTLTIPQLFLKPLQVM

SEQ ID NO: 124682 - protein, 164 aa, Glycine max
  Coding DNA Sequence Number=SeqID_32997
MGEAEEVQEKMKANMEAMKEKMATMMEAMMSMKKIMEAKCARLPIIWLASQLYTTQCGIHSHENLNNSTPILIESQQPQSDHAHVSRPMEETHEIPHHNLADFEPWLGYATEGQAVGGIPFGNTLEGPQFRPQPQPLHFCGGKNPHDYGRNGKVGSSRGKAQGH

SEQ ID NO: 124683 - protein, 146 aa, Glycine max
  Coding DNA Sequence Number=SeqID_32998
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=71%, E-value=3e-24, Identity=67%"; Hit description=LacZ protein
MTRSLFPNSSCCPSTHPIDSSNTVIPGDPLVLERPPPRWSSNSPYSESYYNSLAVVLQRRDWENPGVTQLNRLAAHPPFASWRNSEEARTDRPSQQLRSLNGEWDAPCSGALSAGGVWGVTRSGTATLASADVRRVLFAVTHPPRQ

SEQ ID NO: 124684 - protein, 39 aa, Glycine max
  Coding DNA Sequence Number=SeqID_32999
MKHTAGRRLETAVPDDVMATAGIRNSNRGRSRSGAIHKY

SEQ ID NO: 124685 - protein, 188 aa, Glycine max
  Coding DNA Sequence Number=SeqID_33000
  Gene Ontology: Mol. function=aminoacyl-tRNA ligase activity; Cellular component=cytoplasm; Biological process=arginyl-tRNA aminoacylation
  Homolog annotation: Hit_ID=A9CK39; Match level="QueryCoverage=94%, HitCoverage=24%, E-value=3e-92, Identity=98%"; Hit description =Glycyl-tRNA synthetase, beta chain
MGRKYAALQGENESVAAAIEDHYKPQGPSDRLPADKVAITVALADKLDTLVGFWAIDEKPTGSKDPFALRRAALGVVRILLEKNVRLPLLSVAKDPDLLSFFHDRLKVYLRDLGARYDLIDAVLTPESDDLLMIARRVEALTAFITGEDGRNLLAGAKRATQLLAAEEKKGTVVADGVYRIPAARGIH

SEQ ID NO: 124686 - protein, 99 aa, Glycine max
  Coding DNA Sequence Number=SeqID_33001
MENNMTCQSLCFIGAQNRYYEAPNPYDRWNNQHENTEKSDQGVPTNPKRLKVIPKWPTPPSIRKIWSFHDLINFYKSTMGRCPGNGFSDLTLLQHTKHH

SEQ ID NO: 124687 - protein, 174 aa, Glycine max
  Coding DNA Sequence Number=SeqID_33002
  Gene Ontology: Biological process=transposition, DNA-mediated
  Homolog annotation: Hit_ID=Q1J7G7; Match level="QueryCoverage=26%, HitCoverage=78%, E-value=1e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLESHQAYRYRRPRGGARYQLLFPLVRVNFELGVIMVIAVSFGKPVVPAALMNRPTRGERRFAYWALAECILAYYVGTDEGVSEVLHVAGEKGCT

SEQ ID NO: 124688 - protein, 22 aa, Glycine max
  Coding DNA Sequence Number=SeqID_33003
STAVAAALELVDPPGCRNSIVI

SEQ ID NO: 124689 - protein, 88 aa, Glycine max
  Coding DNA Sequence Number=SeqID_33004
MTVDTLPVFYYEKIVVFAGERIEVGLRRGKFDCLTLTSKKPRANGQNEEEGGTHVVTVIPTWPSFPPSQQCHYSANIIPSHYPPPNHP

SEQ ID NO: 124690 - protein, 403 aa, Glycine max
  Coding DNA Sequence Number=SeqID_33005
GTKAGTGPPLEVDGIDKLDFGRSVPGYGKRMQLPQEPLNERPRGLAKKSMAGTNFAELYGELIACSRSKRSLSQRLGETETNMLAIIAKYEEELGLATAHEHRIADEYAQVYAEKEARGRVIDSLHQEATMWMDRFALTLNGSQELPRLLAKAKAMADTYSAPEEIHGLLSYWKNTITKRAARDPYRTRSKSRTMGDQEETQEQMKADMSALKEQMASMMEAMLSMKQLIEKNAATAAAVSSAAEADPTLLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAASPIVLSMEGPPPATEERRKLDLLEERLRAVEGFGDYPFADMTDLCLVPD

SEQ ID NO: 124691 - protein, 61 aa, Glycine max
  Coding DNA Sequence Number=SeqID_33006
MVGAFSQNIVTLTGLPMILLSESDLTNPWCGVSCYVLLSAPGPREFGSCDDLELVFVGADE

SEQ ID NO: 124692 - protein, 55 aa, Glycine max
  Coding DNA Sequence Number=SeqID_33007
NPGKRDRDDGDLKKVVSTEKALALPSGNLGGQLAEPMVDVGWVVDDYDHSKAFFH

SEQ ID NO: 124693 - protein, 105 aa, Glycine max
  Coding DNA Sequence Number=SeqID_33008
MPISPCKSIRALGFPALCRPYMGAPPASSCYRDLGIVPARHLVDPEEVQQGLGFQALITGLCQFYRVPVTSSKGIRPPTNRAFIKKYCAPRRAQGETPHQHWDGR

SEQ ID NO: 124694 - protein, 36 aa, Glycine max; identical to SEQ ID NO: 105848
  Coding DNA Sequence Number=SeqID_33009

SEQ ID NO: 124695 - protein, 145 aa, Glycine max
  Coding DNA Sequence Number=SeqID_33010
  Homolog annotation: Hit_ID=A8UNW1; Match level="QueryCoverage=61%, HitCoverage=9%, E-value=9e-09, Identity=40%"; Hit description =Putative uncharacterized protein
KLEDRNTDLHFAKPEQLGKLLQFSIKGPDDEATPVNNLSAENLFIPLNAPLQPGKSIRLKLQYQIQLPDKKFTGYGTADRNIALKYFFIVPDHFDPDNILGRYYHDIEESMQKRQISIIWELSPKKFLTKVLLQINRIITGLRMD

SEQ ID NO: 124696 - protein, 128 aa, Glycine max
  Coding DNA Sequence Number=SeqID_33011
  Homolog annotation: Hit_ID=Q8H6Q8; Match level="QueryCoverage=100%, HitCoverage=4%, E-value=2e-07, Identity=25%"; Hit description=CTV.20
MTKANVSLPRTIKWDEVTLPEKWVMDKATPSVPRLAPTIEQIKQNNSGKVEITFNRRNSFSSRIEASRSEYESTRRSFSVRTRSILVGLSRSESQNQFPSIKLQGLDTTSSIPRTTYNQEQEDDQKSI

SEQ ID NO: 124697 - protein, 146 aa, Glycine max
  Coding DNA Sequence Number=SeqID_33012
MGDQEETQEQMKADMSALKEQMASMMEAMLGRGRDTLGTMAALTWDTTERLTLMDCRPTIHHPSCKKMRATLLLPSMKKNLLSSPTKSIKTLKIMLGGMSSFIPRSPKGRHQARCPNPHRSIAIVLSMEGPPRQLEEGRSRSLRKD

SEQ ID NO: 124698 - protein, 79 aa, Glycine max
  Coding DNA Sequence Number=SeqID_33013
MAPVTMGLCTVIVQIQCWLDIVMLIGLEVQMTEKALLQEAELCVPIYCRSRVYCSRKQLFTTSLDEADAEGSTMSNKMS

SEQ ID NO: 124699 - protein, 171 aa, Glycine max
  Coding DNA Sequence Number=SeqID_33014
  Gene Ontology: Mol. function=phosphoprotein phosphatase activity; Biological process=intracellular signaling cascade
  Homolog annotation: Hit_ID=A7PHV0; Match level="QueryCoverage=85%, HitCoverage=46%, E-value=4e-25, Identity=38%"; Hit description =Chromosome chr13 scaffold_17, whole genome shotgun sequence
MWAWKRCTTLAPKRTPPVIQNKPLGHRWLRRGNQHIGNDDLIVFRRKLDIMKRHEFLWEPYTATVMLLLPPICLVGSVVWCTVVPQICFHVVEWHQPDRVLRQFGMQQPIPECPSQPLNIHGLTLKGKQSENWFQLLAPMISQWNNRAELKVDVYPRQEGLLSFNSHYMCV

SEQ ID NO: 124700 - protein, 102 aa, Glycine max
  Coding DNA Sequence Number=SeqID_33015
MKDKRDEEEKLEKQKKKKDSKALSSKAKGKEKEEKDSSKKIVNKENHFATKGDIKIALLLKQSFYLLLSRETSLSIAIPLELEVIPQVLLGTNPYDSGMMNV

SEQ ID NO: 124701 - protein, 43 aa, Glycine max
  Coding DNA Sequence Number=SeqID_33016
MESIDEEDPRPTSSNGAYINKWESSLTNLEISLMLHSGIHQGT

SEQ ID NO: 124702 - protein, 172 aa, Glycine max
  Coding DNA Sequence Number=SeqID_33017
MIVAVRPERVVRQFGYIQSIPPPPVASARLSQDQIDDRWMEFADHLLPAGQPCLVPGQVSADYIEWFFRISHPFMTPTQAADQQRDAPAADPEDYIQPPSPQVPVAFDPPPYVDDYEGYEAIAQRLERVLNLRIVTAGTELYDIMQDCLTIARGGPSADGTVRARLGRRTDH

SEQ ID NO: 124703 - protein, 319 aa, Glycine max
  Coding DNA Sequence Number=SeqID_33018
  Homolog annotation: Hit_ID=Q84VH5; Match level="QueryCoverage=100%, HitCoverage=57%, E-value=1e-129, Identity=65%"; Hit description =Envelope-like protein
MIPGQAPIPEKLVPKRQQGVKISENPSLATSPREVDTEMDKKIRSIVSSILKNASVPDADKDVPTSSTPNAEVLSSSSKEESTEEEDQATEETPAPRAPEPAPGDLIDLEEVESDEEPIANKLAPGIAERLQSRKGKTPITRKEISSSDSDDDVELDVPDIKRVQEIREKVPGNVPDAPLDNISFHSIGNVERWKFVYQRRLALERELGRDALDCKEIMDLIKAAGLLKTVTQKVFVRGKCIRFSPAVINKYLGRPTEGVVDIAVSEHQIAKEITAKQVQHWPKKGKLFAGKLSVKYAILHRIGTANWVPTNHTSTVAT

SEQ ID NO: 124704 - protein, 172 aa, Glycine max
  Coding DNA Sequence Number=SeqID_33019
  Homolog annotation: Hit_ID=Q6UUU1; Match level="QueryCoverage=34%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNSLQAGLYARTPRSVRPLRLIRGVSLEVMRRVKAKLKGQVFGDCAPPSQLPRFKELVAQRTFEKPPCKG

SEQ ID NO: 124705 - protein, 75 aa, Glycine max
  Coding DNA Sequence Number=SeqID_33020
EPVQVIEVSSSEEDLEDDPEELPPEPAVDAPDFPEDDENPLLDVDSPEDVMSASDADSIEESGPGGIANSDDSSS

SEQ ID NO: 124706 - protein, 216 aa, Glycine max
  Coding DNA Sequence Number=SeqID_33021
  Pfam annotation: Domain name=G-patch; Domain location=1-42; Score =21.9; E_value=0.00043; Accession=PF01585.14; Description=G-patch domain
MVARVMLRNGFEPGMGLGKDGLGNADVVDIKGNPYKYGLGYEPGMPGRRNVPSRLRANRVWPGRISQCFTSAGMVSEEEVAAIRNKEFPSRTHQVFGKAMPFLRSFHKGNGCKAKYGPRLSLRKNLSTMETHQVEWKPKTTTLEKLPFSASRLKPSSMVVRAFDGTRREVMGEIDIPIQIGPHTCNVTLDSYTGSGPFNASPEIEVRSSGLLVIVS

SEQ ID NO: 124707 - protein, 88 aa, Glycine max
  Coding DNA Sequence Number=SeqID_33022
MEMALVRPTYNSKPQETQHKDAQAKVEYVKRLYDQVKVQIAKKNESYAKQANKKRKEVVLEPNDDPGLLRANVFQEGGNDENPETGQI

SEQ ID NO: 124708 - protein, 240 aa, Glycine max
  Coding DNA Sequence Number=SeqID_33023
  Homolog annotation: Hit_ID=Q6UUU1; Match level="QueryCoverage=25%, HitCoverage=40%, E-value=3e-18, Identity=78%"; Hit description =Putative uncharacterized protein
ISVTGIYSAQSASAVPPVQLLTGWCVTAKAPPDISAGKCSGRVPFAIQAAQLLGRAIGAGLFAITPAGERGMCCKAIKLGIRSFAASIAFKIFLELPDVDNPNKTSPSLPTASTSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124709 - protein, 148 aa, Glycine max
  Coding DNA Sequence Number=SeqID_33024
MDYSTDDSSTIKEIEEVKEAFNEMHQEAQKLTILNNKLRSNLKWDLTKLASTQREEQLEDFGVNLKQLEVVAERNNLKTLGRAKRTLWAQRASTAKHSFSALSVTKESGRAQESRPHTKCEISLLSEMFVFSQAQRTTGAKPKSTYSR

SEQ ID NO: 124710 - protein, 230 aa, Glycine max
  Coding DNA Sequence Number=SeqID_33025
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=98%, HitCoverage=89%, E-value=2e-64, Identity=51%"; Hit description =Photosystem I P700 chlorophyll a apoprotein A2
EFDLFSGRGYWQELIESIVWAHNKLKVAPATQPRALSIVQGRAVGVTHYLLGGIATTWAFFLARIIADPLHVRPIAHAIWDPHFGQPAVEAFYSRSSLAWTGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHK

SEQ ID NO: 124711 - protein, 88 aa, Glycine max
  Coding DNA Sequence Number=SeqID_33026
  Homolog annotation: Hit_ID=A7MKW8; Match level="QueryCoverage=38%, HitCoverage=10%, E-value=2e-07, Identity=73%"; Hit description =Putative uncharacterized protein
MAEQKDRFPQTALFNVNDAFGGWPQVMKTHFASGETRSARLWPQPRHQPAVYLPDSAAADQRANHAAVADDAGAVLAGDQQSATGGGV

SEQ ID NO: 124712 - protein, 74 aa, Glycine max
  Coding DNA Sequence Number=SeqID_33027
MAKEDALSLDNIKCGVCAEYTDAGVYGRRNSGSNKEAFEMGERRLHLSWTHSERNYGTLLNPSIWQKMPQVTNS

SEQ ID NO: 124713 - protein, 151 aa, Glycine max
  Coding DNA Sequence Number=SeqID_33028
EFDCAPRSLTRKGDMLSSVGAPLMGSGHGCLVSCWNKCETNQTQRAGKQQMIRALLLSHLRSNVSNRSAKTATTGLSFAMVAAMPFQVCFMRSKPLAESLTTVQFCSGRGDIRRKDMVFFPREDILEFLQILSMVGTNWKSPNVKHLKGWS

SEQ ID NO: 124714 - protein, 89 aa, Glycine max
  Coding DNA Sequence Number=SeqID_33029
MESGDMRGYRMVIHTFRHLGANEPIDAQRLTSYSAPFVILTHGVRVFTLVVHRHASPTMHKILLCWAWGDQVRRRGEVSWLSHFIAFRH

SEQ ID NO: 124715 - protein, 188 aa, Glycine max
  Coding DNA Sequence Number=SeqID_33030
  Pfam annotation: Domain name=G-patch; Domain location=25-64; Score =24.3; E_value=0.00022; Accession=PF01585.14; Description=G-patch domain
FEVVSISPWTPLWATCLSDAAVMMARVMLGNGYEPGMGLGKDNGGITSLIKTQGNRGKYGLGYKPTQADMKRSIAGGQNSGSELPCGSAKVLRRRSSGRDIFEDDVQVLSEVLIGTRLHDSPSKKVIGERSISSDGCCAFYTPPKAEIRSGGALGHRVSEEDILVSCPSSMPYVEAAEESLEPLSSLL

SEQ ID NO: 124716 - protein, 119 aa, Glycine max
  Coding DNA Sequence Number=SeqID_33031
  Homolog annotation: Hit_ID=A2Q4Y1; Match level="QueryCoverage=48%, HitCoverage=80%, E-value=2e-09, Identity=48%"; Hit description =Cyclin-like F-box
  Pfam annotation: Domain name=F-box; Domain location=7-54; Score=37.5; E_value=4.7e-08; Accession=PF00646.24; Description=F-box domain
MRLEKKPWSPLLCDELIEEILSRLPVKPFIQFKCVCKGWNSLMSDPYFIKLHLSKSAAKDDLEHLQLIKNVCLGSIPEIHMESCDEKCLGILETLNRNLIGRRILYGGENFVFLLDTNV

SEQ ID NO: 124717 - protein, 383 aa, Glycine max
  Coding DNA Sequence Number=SeqID_33032
  Homolog annotation: Hit_ID=Q6WAY6; Match level="QueryCoverage=65%, HitCoverage=41%, E-value=3e-25, Identity=34%"; Hit description =Putative uncharacterized protein
MKAVKNGVVGIPRKCLEAKARILASRGEWAPFIDILALLIFRGVLFPNVDGLVDLAAIDAFLAYHDHKESPVVAMLADLYDTFDRRCVKSSTRIVCCTPALYVWLVSHLFHQEVRHACPLESHHSCTEKGGANWDRLLANKEGASVNWFPQGKKGRTGVLISCGGFPNVPLMGTRDCISYNLVLAIRKLGYPMRGAPLEEEFAPVISRGFNKTNVETFQKVRKAWEVLQKKDKKLRGSNNGPIGGYRKWLKAHVQGLDWLPRLRTAKREEVEAPEEDEEVQALRAELEQAQTVKERFKSAALMIRKENAKLRDINVATTKALEQETKRACREEHGRNKFRGALWGSNSELKLWREERDQSRVDSLILKDELKVCSRSKRNLSQ

SEQ ID NO: 124718 - protein, 24 aa, Glycine max
  Coding DNA Sequence Number=SeqID_33033
NLAKVSTRSSTFFIRSSSFFDLQR

SEQ ID NO: 124719 - protein, 248 aa, Glycine max
  Coding DNA Sequence Number=SeqID_33034
MRSWVRGQWIPFDADAISQFLGYPLVLGEGQECEYGQRRNRPDGFDEEAIAHLLCIPGQDFARTAAGRRVRIMRTNMTTLTQIWMTLLLSNIQPSDHNSDLPLPKCQLVYAILTRMSIHVAQLIANAIYLFADVPPPHQAGPVRSFDTEQYLRHLVRQQAANHRAHVQTHDCLYQMSLSLQSQGFTSFPCPTPDQFRAEVAWPGDWPEARAGEAPAEAPAEAPDEADEAREDEEMADLLDFLGGSGAT

SEQ ID NO: 124720 - protein, 69 aa, Glycine max
  Coding DNA Sequence Number=SeqID_33035
MEAIKEQMATMMKAMMSMKKIMEANAVIVAAISAVAKVNPMLPSGLKQRESSNLKYGTGQTPLEVERYR

SEQ ID NO: 124721 - protein, 138 aa, Glycine max
  Coding DNA Sequence Number=SeqID_33036
MTDPGSLLLKLGKEDKSPKQVRVRGYLIKFDEDALNTFLKTPMIIEEGETLLAYSRFALLRPDPQELAVKLCIPGRGFELNADGQPLKILRKNMTTLAQTWSVLSYSNLIPTSHPSDITLDQAKLIYGIIMKMGMNLG

SEQ ID NO: 124722 - protein, 125 aa, Glycine max
  Coding DNA Sequence Number=SeqID_33037
VFGKKNRVEVLPETPTVRDFVKILSSFFTVPSFVLSQFFGLQPEVSLDQLTNNQSETKVKINSKIKLCPQKITKNLSYANFVWGLLLDDMQPLISRFEILGTLCCTICEVPRRAGNQKKAWLHNP

SEQ ID NO: 124723 - protein, 234 aa, Glycine max
  Coding DNA Sequence Number=SeqID_33038
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=42; ConfidenceScore=5.14e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPEFDPNFTIELNQENYRGRRNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124724 - protein, 218 aa, Glycine max
  Coding DNA Sequence Number=SeqID_33039
MKEFYTNLYDPEDKSPKQVRVRGHLVKLDEDTLNTFLKTLVVLEEGENLCTYSRFALLRPDPQELATKLCIPGRGFELNADGQPLKIMRKNMNTLAQTWSVHSFSNLILSSNTSNVTLDRAKLIYGIIMKMDMNLGYLISHQISLIPQHDTSKLGFPALITALCKARGVQSDSRSLENLSPAINLAYIKKKCWNLDDPTVTYRGPRKARGNRSEVPTT

SEQ ID NO: 124725 - protein, 34 aa, Glycine max
  Coding DNA Sequence Number=SeqID_33040
VDGIDKLDSSIAMRKSDLRSSFLCVNQVIVFYLK

SEQ ID NO: 124726 - protein, 63 aa, Glycine max
  Coding DNA Sequence Number=SeqID_33041
MGSAGALKWIPRAAGILTKEFYHFRIEICSLRIPEHKGRVVPVWFRLCKMSFTKRVENLKWAA

SEQ ID NO: 124727 - protein, 58 aa, Glycine max
  Coding DNA Sequence Number=SeqID_33042
EVCDDIVERLERHLSLGVVTPGSSTHEVIEECLRMARSVTQDHLVYVRSRRRRHTDQT

SEQ ID NO: 124728 - protein, 257 aa, Glycine max
  Coding DNA Sequence Number=SeqID_33043
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSIDKGTYICLYLLTRFLCLCEGQPAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124729 - protein, 59 aa, Glycine max
  Coding DNA Sequence Number=SeqID_33044
MKEREQKIFRPDKFSARSFSTGDIPPHMNEEEKTETPSVLSKNTTLETILLIRDRTCDL

SEQ ID NO: 124730 - protein, 223 aa, Glycine max
  Coding DNA Sequence Number=SeqID_33045
MRAQREEEGITQLLCIPGQDFTRAAAKRRVQIMRTNMTSLTQIWMTLLLSNILSSDHNVDLSLRKYQLGSPPQDTQWTRRSPTGPWGFQLWLRASVSPIGCLSPTARSCHRDIGIAPASHPVDPKKSNRVLGFPALITSLCQFYGVPITPSKVIRPPTNRAFNKNYCTPRQAQGETPQQPGDGRQRAINAPPPPPEPFSSSTKAEALPTTRGRPTSDQVQSQR

SEQ ID NO: 124731 - protein, 68 aa, Glycine max
  Coding DNA Sequence Number=SeqID_33046
MLASPERVQTTTLDSACQSDLGSPNDQDGMVDKSGAFAPTYPQLEMRNSDQHSSCERHESKIVSAFFH

SEQ ID NO: 124732 - protein, 61 aa, Glycine max
  Coding DNA Sequence Number=SeqID_33047
MASDQEIQMMETNALQALAQVIGNPNRGEAGGAVEYQGLDRFQRNNPPSFNGGYNPDGAQN

SEQ ID NO: 124733 - protein, 57 aa, Glycine max
  Coding DNA Sequence Number=SeqID_33048
MWKRIMRVELISIGEIKRKMKKKKIAIYGSRFDEEMSEIGRFGGLGMEERRKEEGAA

SEQ ID NO: 124734 - protein, 107 aa, Glycine max
  Coding DNA Sequence Number=SeqID_33049
MVFLLRLVVSFKTRKGKQGSKGLSKELIQGKSIWLEAYKNKIASIISKYACELGRINKNQAKAIVQAINGASTPMNMMMDGSILTKRESRIQVTKCQELYFKQLPIS

SEQ ID NO: 124735 - protein, 256 aa, Glycine max
  Coding DNA Sequence Number=SeqID_33050
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRVISCSENEKTALIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124736 - protein, 281 aa, Glycine max
  Coding DNA Sequence Number=SeqID_33051
  Homolog annotation: Hit_ID=Q6WAY6; Match level="QueryCoverage=74%, HitCoverage=36%, E-value=1e-10, Identity=25%"; Hit description =Putative uncharacterized protein
AAQELFVVHWLSMCGWFHTFFSKKVGPSIRYKEGRIRILSSCEGCPNVPLMGTRGCINYNPVLAIRQLGYPMRGVPSDESITSFIARGFSDHNARDRELRGSSNGIIGGYHKWLRVRTQGLDWLPNLKTVRDNEVKASEESDEVQALKAKLERARVVKEKFKAAIVSSSSEEVKGIITGQRHDLEGRAKGNMWAIIDKCKEKLNLAATHEQRLEDEYAKISAEREARERVIDSLHQEATMWTDRFALTLNRSQELPRLLAKAKAMADTYSAPKKIHGLLSY

SEQ ID NO: 124737 - protein, 79 aa, Glycine max
  Coding DNA Sequence Number=SeqID_33052
MSSDSPSLDDKGAEENRKSVYMDNHLGISACHLTSRVRINRNRLCGQPLGYLHMSSDSQVTMAKGGVIDKSGAFAPTYP

SEQ ID NO: 124738 - protein, 67 aa, Glycine max
  Coding DNA Sequence Number=SeqID_33053
LHRGGGRSRTSGSPGLQEFDPSSGPLGPTEARNQSWKPQGPVGLLQVHWVSLWGEIGIAVAGQNVAK

SEQ ID NO: 124739 - protein, 172 aa, Glycine max
  Coding DNA Sequence Number=SeqID_33054
  Homolog annotation: Hit_ID=A0ST23; Match level="QueryCoverage=15%, HitCoverage=55%, E-value=2e-08, Identity=100%"; Hit description =Putative reverse transcriptase
ISVTGIYSAQSASAVPPVQLLTGWCVTAKAPPDISAGKCSGRVPFAIQAAQLLGRAIGAGLFAITPAGERGMCCKAIKLGNARVFPVTTLNSMRIRPGGAHGCRRIKLIDTVDLEGGPVGKPVVPAALMNRPTRGERRFAYWALAECILAYYVGTDEGVSEVLHVAEKKGCT

SEQ ID NO: 124740 - protein, 99 aa, Glycine max
  Coding DNA Sequence Number=SeqID_33055
MAAGKYQSRLYNDRCRIGESSFHPRWANVFVSEQMKACRCRSNLMRIMKQAKYSLKAQVEKDEGPSGEGQSPRVEKDEGPSGEGRRPKWRRTKPPSGEG

SEQ ID NO: 124741 - protein, 69 aa, Glycine max
  Coding DNA Sequence Number=SeqID_33056
  Homolog annotation: Hit_ID=A0PAV3; Match level="QueryCoverage=55%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCFYQLSLLSSLSIPSTSRGGP

SEQ ID NO: 124742 - protein, 181 aa, Glycine max
  Coding DNA Sequence Number=SeqID_33057
  Subcellular localization annotation: CTP_CleavageSite=60; ConfidenceScore=5.60e-01
MPMPSLQHPHGSNPSKHLMPKAPTQREAPQVPTPNTARPAGNSNTTRNFPPRPLPEFTPLPMTYEDLLPSLIANHGGGAVNAVESDGPHGSKPLRDVATPRRFIFEALQKGGVIPHSGCKEDSCLLHPGKMHDMETCLEVEELLQRMIDQGRLEVGIKGKEEPHICMQSTEGSGVAKPKPW

SEQ ID NO: 124743 - protein, 96 aa, Glycine max
  Coding DNA Sequence Number=SeqID_33058
LTKGTKAGTGPPLEVDGIDKLDICSHSGFIEKYCTPRQAQGDAPEVADAPPPPHQADPTGSLGMERYLQHLVCQQAANHRGQVQIHDCLYQLSLSQ

SEQ ID NO: 124744 - protein, 32 aa, Glycine max
  Coding DNA Sequence Number=SeqID_33059
EFDRSIEHCRALKRKVQGLIDAGWLKFEENCV

SEQ ID NO: 124745 - protein, 76 aa, Glycine max
  Coding DNA Sequence Number=SeqID_33060
NSIPYMPYLLFMPSLHVGWIRSPFNSHYGKEAQMVWGLTSPAQDCLISQSRSGFVEDLWSEPDIIASLPPSTSVFH

SEQ ID NO: 124746 - protein, 136 aa, Glycine max
  Coding DNA Sequence Number=SeqID_33061
  Homolog annotation: Hit_ID=Q6UUU1; Match level="QueryCoverage=44%, HitCoverage=40%, E-value=1e-18, Identity=78%"; Hit description =Putative uncharacterized protein
STAVAAALELVDPPGCRNSMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYP

SEQ ID NO: 124747 - protein, 286 aa, Glycine max
  Coding DNA Sequence Number=SeqID_33062
  Homolog annotation: Hit_ID=Q2HW90; Match level="QueryCoverage=92%, HitCoverage=55%, E-value=8e-16, Identity=27%"; Hit description =Putative uncharacterized protein
MGTNQNGKRFYQVKVKSLDVTSLEELGRLMGPLQRQAFRKVYGKILDLTAAEVFTEAVVSLAQYYDQSLRCFTFGDFQMVPTIEEFEEIFGCPLGGRKPYLFSGFLPSLSKIAAVVGDSAKELDRMKQTRNGVVGLPRKYLEGKARDMAKPREVGAPPLTLSSRITIARRVQWWPSWQICLIPLTGDVRKIVHGLSVVYPLSLCGWFHTYSDKTQDTHVRFKAIAHAPKKEESIGDQHLAGIGGNAINWFPRWKEGKEGVLFSCGDYPNVPLIGTRGVLIIIPHSP

SEQ ID NO: 124748 - protein, 64 aa, Glycine max
  Coding DNA Sequence Number=SeqID_33063
MKTSWLSCPSSMPYVEAAEESLETAFQSFEVPCVCDAAVMMARVMLGNGYEPVNGFRQRQRRHN

SEQ ID NO: 124749 - protein, 235 aa, Glycine max
  Coding DNA Sequence Number=SeqID_33064
  Homolog annotation: Hit_ID=Q6WAY6; Match level="QueryCoverage=47%, HitCoverage=19%, E-value=1e-13, Identity=37%"; Hit description =Putative uncharacterized protein
MVGFTPFSPRGEACLPVRKPPFMHRERKGELGPTLSKQRRASVNWFPRWKEEERSFISCGGFPNVPLMGTRGCINYNPILAIRQLGYPKRKAPLEEDLAPVISRGFSKTNVETLRKVRKAWEVVQKKDKELRGSNNGPIGGYREWLKAHVQGLDWLPSLRTAKREEVKASEEEEEVQALRTELEQAQTVKERFKSVALRIRKENAELRDEYVATTKALEQETKRPRREEHGRNKL

SEQ ID NO: 124750 - protein, 250 aa, Glycine max
  Coding DNA Sequence Number=SeqID_33065
MDVGWLTFQEDRSNVKTNPLANHGGGAVNAIGSDRPRRSKPLKDVATPRRFIFEALQKGGVIPHGGHKEDSDLLHPGELHSMETCLAVEGLLQRMIDQGRLEVGDEGREEQQIWMQSVDERSFGRPKPLVIYFTKGAASQKPQHPSAAKPVPFPYQNRHAVPWRYTPPNKEGEEATDINSLLAKVTNITGLSGVTHSGRVFVPLDLPIQPTKIKGKAKVVEEQDDKMPLTPNKDTPVIKLIDTVDLEGGP

SEQ ID NO: 124751 - protein, 175 aa, Glycine max
  Coding DNA Sequence Number=SeqID_33066
  Homolog annotation: Hit_ID=A0ST23; Match level="QueryCoverage=14%, HitCoverage=51%, E-value=4e-07, Identity=100%"; Hit description =Putative reverse transcriptase
VPPVQLLTGWCVTAKAPPDISAGKCSGRVPFAIQAAQLLGRAIGAGLFAITPAGERGMCCKAIKLEVLLPPCADEVAIVALASLPYSYCQAFCIVDAVLNQAYRYRRPRGGARYQLLFPLVRVNFELGVIMVIAVSFGKPVVPAALMNRPTRGERRFAYWALAECILAYYVGTDE

SEQ ID NO: 124752 - protein, 290 aa, Glycine max
  Coding DNA Sequence Number=SeqID_33067
  Homolog annotation: Hit_ID=Q84VH5; Match level="QueryCoverage=100%, HitCoverage=46%, E-value=8e-96, Identity=65%"; Hit description =Envelope-like protein
VPTSSTPNAEVLSSSSKEESTEEEDQATEETPTPRAPEPAPGDLIDLEEVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVERDHGPHQAAGLLKTVTKLEIAMKSSQGILHIPSDIQTERVMISEVLSRKCVRFSPAVINKYLGRPTEGVVDIAVSEHQIAKEITAKQVQHWPKKGKLSAGKLSVKYAILHRIGTANWVPTNHTSTVAT

SEQ ID NO: 124753 - protein, 95 aa, Glycine max
  Coding DNA Sequence Number=SeqID_33068
AVASGGSNLARLGELGGKLLPYFAINRGRSEEEKGSAFLALLSLSKLLRKIISVKKIQAEALPSRFRNVSVSNYAKIIDRSSTFIVRSSFSSVFN

SEQ ID NO: 124754 - protein, 148 aa, Glycine max
  Coding DNA Sequence Number=SeqID_33069
WLRVRTQGLDWLPNLKTVRDDEVKASEESDEVQALKAELERAWVVEEKFKAAIVSSSSEEVKGIITGQRHDLEGRAKGNMWAIIDKCKEKLNLAATHEQRLEDEYAKISAERGSKGKGSQELPPLLAKAKAVADTYSAPEEIHGLLSY

SEQ ID NO: 124755 - protein, 84 aa, Glycine max
  Coding DNA Sequence Number=SeqID_33070
MGISISPITSRRLPLKARTTIELGFRCDALKRSFSKVVIGITFKLEPLSMSTLATTWSMHLTDTCRALLCPLPSTGISSSVNVS

SEQ ID NO: 124756 - protein, 228 aa, Glycine max
  Coding DNA Sequence Number=SeqID_33071
MKGWPFLRERQVQLRDDEFPDFQEEIGCRRWAPLVTPMVKFDPEIVMEFYANAWPTEEGARYMRSWVSSFDEEAIAQLLCTPVKDFAQTAVGRQVWIMRTSMTTLTQIWMTLLLSNILPSDHNSDLPLLKYQLVYAILTQVSVHVAQLISDTIYQFAGTVPTRHPMDSERSNRILGFPALIAGLCQFYGVPVATSKVIQPPITRAFIEKYCIPRQAQGQAPQEPEEDQ

SEQ ID NO: 124757 - protein, 138 aa, Glycine max
  Coding DNA Sequence Number=SeqID_33072
  Subcellular localization annotation: CTP_CleavageSite=41; ConfidenceScore=5.26e-01
LQWLLFLSAVPPCSATDGVVRNGKKHRRTSALARRVPFAIQAAQLLGRAIGAGLFAITPAGERGMCCKAIKLGHQAYRYRRPRGGARYQLLFPLVRVNFELGVIMVIAVSSECILAYYVDTDEGVSEVLHVAEKKAAP

SEQ ID NO: 124758 - protein, 53 aa, Glycine max
  Coding DNA Sequence Number=SeqID_33073
MKHPNDKKACFDLDKVDQEIELAAIAMLVEENRRGSAGADFEETQNCNWMAHI

SEQ ID NO: 124759 - protein, 219 aa, Glycine max
  Coding DNA Sequence Number=SeqID_33074
  Homolog annotation: Hit_ID=A0ST23; Match level="QueryCoverage=11%, HitCoverage=51%, E-value=7e-07, Identity=100%"; Hit description =Putative reverse transcriptase
MVKVGTLRADQRLISPKVGPGLPGINRDTRIYLFCEVISVTAVPPVQLLTGWCVTAKAPPDISAGKCSGRVPFAIQAAQLLGRAIGAGLFAITPAGERGMCCKAIKLGNARVFPEFDQTISYCLLTSFYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 124760 - protein, 74 aa, Glycine max
  Coding DNA Sequence Number=SeqID_33075
EFDPVGGLPHESERKRPTKKSYMQKEKGNGYAARIGVATNLTAELWAWAVRTGLRIALARSFEKGYSKKKDRAD

SEQ ID NO: 124761 - protein, 18 aa, Glycine max
  Coding DNA Sequence Number=SeqID_33076
EFDNSSPICERYSLEMEG

SEQ ID NO: 124762 - protein, 185 aa, Glycine max
  Coding DNA Sequence Number=SeqID_33077
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=58%, HitCoverage=12%, E-value=2e-10, Identity=38%"; Hit description =Gag/pol polyprotein, 3'-partial, putative
  Pfam annotation: Domain name=G-patch; Domain location=104-148; Score =13.1; E_value=0.005; Accession=PF01585.14; Description=G-patch domain
MALHVSVKYMEHVMAKVLIDNSSSLNMMPKSTLEKLPFNASHLRLSSMVVRAFDGEEDVLVSCSSSMPYVKAAEELLEMTFQSFEVVSIASVDSLPRQPRLSGVAMMVAWVMLGHGYEPEMGLGKNNGGRAGLVKVRGNHGKFGLSYKPTQVDVRKNISERKNKGQSPRSGQIKLIDTVDLEGGP

SEQ ID NO: 124763 - protein, 265 aa, Glycine max
  Coding DNA Sequence Number=SeqID_33078
  Gene Ontology: Mol. function=chloramphenicol O-acetyltransferase activity; Biological process=response to antibiotic
  Homolog annotation: Hit_ID=P62577; Match level="QueryCoverage=82%, HitCoverage=100%, E-value=1e-130, Identity=99%"; Hit description =Chloramphenicol acetyltransferase
  Pfam annotation: Domain name=CAT; Domain location=6-209; Score=521.4; E_value=1e-153; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELHQYCDEWQGGAWLLPVVLLHVFPGWTQDDSYRIRRSGRTERGVRAYSPAWSELPTRN

SEQ ID NO: 124764 - protein, 265 aa, Glycine max
  Coding DNA Sequence Number=SeqID_33079
STAVAAALELVDPPGCRNSILVRNLGAQSLKAIQRVHKAWRSPLRKDKELRGIRNGVIGGYHGWLRIHTRGLDWLSKLKVIDEEDFEAPEEDEEVRALKLELGKARLAKQKFKSAATHIRKECTELQEENAATAKALEQETKRARKEEYGREKFRGALSKRSLVQHLEATEQSMLAIIGQYKEELNQSVAHEQKLVEDFARVYAKKEARGRVIDALHQKRLCGWIVGVWIDKDLASQRSLLRNLLKEATRKPLNEASRESYMELP

SEQ ID NO: 124765 - protein, 131 aa, Glycine max
  Coding DNA Sequence Number=SeqID_33080
MCSSPSRADPLDWEMLSLLFSRLDSSILQCVLHRQELSYPNFVRGPLLDDVRPFFGPREKAVASGGSNPARLGELGGNHLPYFAINRGGNEEGRAEALPKRFRNVFREESRKGFNRSSTFFIRSSSFFDLQ

SEQ ID NO: 124766 - protein, 43 aa, Glycine max
  Coding DNA Sequence Number=SeqID_33081
MVQLSTHHYDKPNIFTKVLSATCRAKPQMLTGFYNFKLGLARC

SEQ ID NO: 124767 - protein, 162 aa, Glycine max
  Coding DNA Sequence Number=SeqID_33082
MLVRMIRTRLFAAARGKSCPVALQCQDVAQELIKGNYWPLNRERKSRTLKTRTRSPLKARACSPLQARMCSPLMARTYSPLKVIGTSTQGSTFIMRAGVVVGDTEGLPKGFVGVYHQLLALQWHIRAKARSRLDCDGEFHVSPPRFKRHVHDQFGVVGSQWV

SEQ ID NO: 124768 - protein, 130 aa, Glycine max
  Coding DNA Sequence Number=SeqID_33083
LSGLDPRRAFSLVMPRRPLSGDLSIWYFDLLLGWRQVRIQTFFPNQSLFISFVVLLAQWSNLEEGSWMFFSIYHHYGPYGQIDVVRIIVCPFEKDECPTHVISAKGFVSEVRISALSLLRGSTSLSGQRA

SEQ ID NO: 124769 - protein, 273 aa, Glycine max
  Coding DNA Sequence Number=SeqID_33084
  Subcellular localization annotation: CTP_CleavageSite=41; ConfidenceScore=5.63e-01
MAEPSKKRKGSSSTAAAAAHRRHGPSGAPTAPFPPSLSSPRSSTLFSSDDQRLQYLSQFSSRIILDPKYLDVEFFNDETFDCYQVFQNSGLVEFMSLKLPYYPELVKVFYCNLKIQDGIIMSEVHGISMVIDQSLFFSLTHLPSQGAPFEGTIVDDWKFDYSSHDARRMVCNDQAEMTVTSFGYRKDRNGQWLKKDALPPQDERTPSPPPQREDSALMNEVLSELRGLRSYVGDRFDSLDSRFAGMDIRLTQLEEDVGYIRQSFDLPPPPPSS

SEQ ID NO: 124770 - protein, 414 aa, Glycine max
  Coding DNA Sequence Number=SeqID_33085
  Subcellular localization annotation: CTP_CleavageSite=43; ConfidenceScore=5.01e-01
MFVRKKWPRGNLPQRDPGRIKRPKELVLLPSMTVTALGALNTSSASRPSRDGHFSESDASNSGTTSIPISRKMGIISYPHGQVRPRHSPRILCQCLAYGGGRARYEILGEGSVDPVRCRCYQPVPGISFSAGRGPECEYGQRRNRSDGFDEEAIAQLLCIPGQVLPDCCRSECESCAQHDHLTQIWMTLLLSDILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVQTHDCLYQMSLSMQSQGYASFSCPTPDQFRAEVAWPGDWPEAQAGKAPPEAPGDGEEAHEDEEMADLLDFLGGSGDT

SEQ ID NO: 124771 - protein, 167 aa, Glycine max
  Coding DNA Sequence Number=SeqID_33086
  Homolog annotation: Hit_ID=Q6UUU1; Match level="QueryCoverage=35%, HitCoverage=40%, E-value=1e-18, Identity=78%"; Hit description =Putative uncharacterized protein
SLDKKELRRSDFLIAIEEYVGVKGNTHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124772 - protein, 81 aa, Glycine max
  Coding DNA Sequence Number=SeqID_33087
MRSSQKPSLKKRFYQVKIKSLEVTSLRKLGQLMGQLQQQAFRKAYGQIWDLARVEMMQSYSARALDRKTPSRLGQRCKRRP

SEQ ID NO: 124773 - protein, 167 aa, Glycine max
  Coding DNA Sequence Number=SeqID_33088
  Homolog annotation: Hit_ID=A5B939; Match level="QueryCoverage=48%, HitCoverage=64%, E-value=6e-12, Identity=43%"; Hit description =Putative uncharacterized protein
  Subcellular localization annotation: CTP_CleavageSite=43; ConfidenceScore=5.23e-01
SPETSAGPGKELSFCLTACPPWKRLSREVGSSGWKSTARRVVSASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 124774 - protein, 315 aa, Glycine max
  Coding DNA Sequence Number=SeqID_33089
  Gene Ontology: Mol. function=alcohol dehydrogenase activity; Cellular component=membrane; Biological process=electron transport
  Homolog annotation: Hit_ID=Q2L0V9; Match level="QueryCoverage=42%, HitCoverage=29%, E-value=3e-54, Identity=71%"; Hit description =Alcohol dehydrogenase cytochrome c subunit precursor
WVMFQMSGIGPMFGQLGFFHKFAGKDYEDKRPRDRYVAESKRLLGVLDKRLDGRDWVMGEQYTIADIAILPWERGPRAGNLRGASGRGEGPDDPGLTAPNWCRSGGSSRPAGAARSAHSGDRSPYEHPDVRAGRQQRRDGMKHFGIKAVALLALAGLGGGIGGAHLLTAVRKTDSTAVVDPQDRRLAEAGAYIARTADCIACHSAPGDKPFSGGLAMQTPVGTMYSSNITPDKRTGIGAYSYADFKNAVQYGIRKDGATLYPAMPYPSYAIMPDADIQALYAYFMSQVEPVDKPSADSTIPWPLNMRWPMAWWQL

SEQ ID NO: 124775 - protein, 228 aa, Glycine max
  Coding DNA Sequence Number=SeqID_33090
  Homolog annotation: Hit_ID=Q6WAY4; Match level="QueryCoverage=35%, HitCoverage=14%, E-value=1e-09, Identity=41%"; Hit description =Putative uncharacterized protein
NCNCGQGFSKRFGPRKTDSKRHIGRTTEVPRRQGEGYGQSRRLGPVYGCVSIANFWGRPLQERYNYFGDLLLKPRGMHSINIRFPPMKDRKGGSPFCLISKGYPNQIPANRDEGCILQVKVKRQLGYPSIKELGRLMEPLQMQAFRKTYGKILELTIAEVSIEAIASLTQYYDQPLRCFTFGDFQLVPTIEEFEEILGCPLGGRKPYLSSGCLPSLAELQLWSRIQPE

SEQ ID NO: 124776 - protein, 108 aa, Glycine max
  Coding DNA Sequence Number=SeqID_33091
MEHSSKLENGGHMNDIRNSFMGLRKRVRMEDCLEGPHLGNHETQLQTRNWRTHEHPQVITFMWLWKRARMEDCLEGPLLGNHETQLQTRKWRTHEQPQVITFMWLGKG

SEQ ID NO: 124777 - protein, 205 aa, Glycine max
  Coding DNA Sequence Number=SeqID_33092
MGTNQTGKRFYQVKVKSLDTTSIKELGRLMEPLQMQAFRKIYGKILELTIAEVSIEAIASLTQYYDQPLRCFTMQLWSRFSKRFGPHKTDSERHSGLPQKYLEDKARGMANQGDWVPFMDVLALLIFGVVLFPNVDGLVDLAAIDAFLAYHHSKESPVVPVLADLFDTFDRRMDWDQLLAGIGGRTISWFPRWKEGKEGVLFSCG

SEQ ID NO: 124778 - protein, 110 aa, Glycine max
  Coding DNA Sequence Number=SeqID_33093
MPSFIHELHRTQNMSSIHCSSTQNMSFIALVELHSSALPTGKNNNVFIYKPIVAFQHSKHELQYCSRGAVFVSSANVDAANEYARQGEVAVATKDDVELFAEVGDAIVRP

SEQ ID NO: 124779 - protein, 116 aa, Glycine max
  Coding DNA Sequence Number=SeqID_33094
MLWKLGRIDGDPVLRETRIWATWEYVSSVGGGQQGMVDLCAHCGCGKLVCTIARPPPSTTCDGYPIILQVWDEEVLKEWYLEICRGGQETLGTSGGVLLPKTKLDQSRPTPGIVGQ

SEQ ID NO: 124780 - protein, 241 aa, Glycine max
  Coding DNA Sequence Number=SeqID_33095
  Gene Ontology: Mol. function=zinc ion binding
  Homolog annotation: Hit_ID=A7PFU6; Match level="QueryCoverage=80%, HitCoverage=26%, E-value=7e-17, Identity=27%"; Hit description =Chromosome chr6 scaffold_15, whole genome shotgun sequence
  Pfam annotation: Domain name=SWIM; Domain location=18-54; Score=16.5; E_value=0.0074; Accession=PF04434.8; Description=SWIM zinc finger
  Pfam annotation: Domain name=zf-CCHC; Domain location=182-199; Score =13.7; E_value=0.013; Accession=PF00098.14; Description=Zinc knuckle
  Pfam module annotation: Pfam domain module=SWIM::zf-CCHC; Domain location=18-54::182-199
MATFSIYTVVKYYSGSVWLVSYCPSTVDFSCSCMRMQSIGLPCDHILVVLVSLNFMELPSSLVLNRWSKVATENIKDKYPNSAMYWDSQLMARYATLVEVSRQVCEAAYYDEDEYDKMLCFLSNEVKRLKSKKNSEPCIDDNDEQADQQGHNYDGILDPVVVRTKGCGQVGVNESGKQRRIQKCGQCGGSGHNKRSCTNRPRNANVCVCGSFISSSEQTNTMCQPIDEYNYQLVFENATQI

SEQ ID NO: 124781 - protein, 95 aa, Glycine max
  Coding DNA Sequence Number=SeqID_33096
  Pfam annotation: Domain name=zf-CCHC; Domain location=22-39; Score =22.6; E_value=0.00058; Accession=PF00098.14; Description=Zinc knuckle
MALTLIPKKDQGQGILGKTSSIKCFKCLGRGHITSQCPTKKPMIMRGQDIYSRQDEATTSPSSSESEEAKGEESSEEIYPQEEGRPLMVKEECKE

SEQ ID NO: 124782 - protein, 86 aa, Glycine max
  Coding DNA Sequence Number=SeqID_33097
RVPFAIQAAQLLGRAIGAGLFAITPAGERGMCCKAIKLGNARVFPVTTLNSIKGGYIPCGSLLVKVFTRLKEISRTAGCLGTGCRH

SEQ ID NO: 124783 - protein, 259 aa, Glycine max
  Coding DNA Sequence Number=SeqID_33098
MRGQDIYSSQDEATISPSSSKSEEAKGEESSEEIYPQEEGQPLMVKEKCKDVSVSSKRLAKKERHFEVKTNIKEISLLRQPPHFLLCKKTLVSIATSLGLEFIPQVKEFLDEGLVRKSLNPCALLVPKIGIIRHQIPKIGGMMNVLSGATLFCEITRAPNNFMICVHRDSLGCDQGVPMNSKRIKVIPKWPTPPTPLIELVRNHVPSWEDAQEMGFQTLPYFNIPNTTNTYVFVLFTCVGGRSPEYEEPQDLRSNPFQG

SEQ ID NO: 124784 - protein, 18 aa, Glycine max
  Coding DNA Sequence Number=SeqID_33099
MVLREIACLSSSKGENVN

SEQ ID NO: 124785 - protein, 124 aa, Glycine max
  Coding DNA Sequence Number=SeqID_33100
  Gene Ontology: Mol. function=aspartic-type endopeptidase activity; Biological process=proteolysis
  Homolog annotation: Hit_ID=A5BCQ8; Match level="QueryCoverage=66%, HitCoverage=15%, E-value=1e-11, Identity=45%"; Hit description =Putative uncharacterized protein
MEEGFSQESDRTNNFFEEVTILHWNFLYTEQIPRYAKFLKELCTNKRKLKGSERISMGRNVSALIGKSVPQIPEKCKDPANRSVAYPAGFIEDVLVRVGELIFPVDFYILNMEEGFSQDQFPSF

SEQ ID NO: 124786 - protein, 81 aa, Glycine max
  Coding DNA Sequence Number=SeqID_33101
DNVDANLDWEIRVEQQLKKKSTSKSYGSHTYPKKYQGQGDLRGDPSKLTFIVSQEEALFTLESKRKSWEANLGKNHPLPIC

SEQ ID NO: 124787 - protein, 156 aa, Glycine max
  Coding DNA Sequence Number=SeqID_33102
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=92%, HitCoverage=20%, E-value=6e-69, Identity=90%"; Hit description=DNA -directed RNA polymerase subunit beta'
  Pfam annotation: Domain name=RNA_pol_Rpb1_1; Domain location=5-143; Score=-169.4; E_value=0.07; Accession=PF04997.3; Description=RNA polymerase Rpb1, domain 1
MDSSLIEWKELGEEGSPDNENEWEDRKVGRRKNFLVRRIELAKHFLRTNIEPEWMVLCLLPVLPPELRPIIQIDGGKLMSSDINELYRRVIYRNNTLIDLLTTSRSTPGELVMCQEKLVQEAVDTLLDNGIRGQPMRDGHNKVHHFHYIDVDCPAK

SEQ ID NO: 124788 - protein, 233 aa, Glycine max
  Coding DNA Sequence Number=SeqID_33103
  Homolog annotation: Hit_ID=A5B939; Match level="QueryCoverage=27%, HitCoverage=54%, E-value=3e-09, Identity=45%"; Hit description =Putative uncharacterized protein
NWRCGMNRKLGYGAQLRANLDPTKGVGRLRQQDGGHGSRNPLRRRGGRCKTQGASPGGAVVGADLGGTGEARLIALCARTPKGNRPAHPGNGSAEVGSSGWKSTARRVVSASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGKEDP

SEQ ID NO: 124789 - protein, 362 aa, Glycine max
  Coding DNA Sequence Number=SeqID_33104
  Gene Ontology: Mol. function=motor activity; Cellular component=cell projection
  Homolog annotation: Hit_ID=UPI00016621D1; Match level="QueryCoverage =45%, HitCoverage=44%, E-value=4e-16, Identity=35%"; Hit description =UPI00016621D1 related cluster
DYTVSPSEGCMPLPSEDYTSSPSKDYTSSPSEGYTPSPSEDYTSSPSEGYVPSPSEDYTSSPSEDYTCLPSEGIHALAFRGLHVLTFRGLHVLAFRGIHALTFVGLHVLAFVGLHVLVFRGLHILAFRRLHVLTFIGLQALTFRGLHVLPFRGLHVLAIRGLHVLPFRGLHILAIRGLHVLAFRGLHALTFRRLQVLAFKGLHALAFIGLHVLAFIGLHIFPGPPPDIGGRSTLRSQPEEEAIVQLLCIPGQDFTRAAARRRMQIMRTNMTTLTQIWMTLLLSNIMPSDHNVNLPLWKYQIAPTRHPIDPKESNKALGFPALITSLCQFYGVPVAPSRVTGPYNMDFIKKYYALRQAQGEAS

SEQ ID NO: 124790 - protein, 132 aa, Glycine max
  Coding DNA Sequence Number=SeqID_33105
MERSIIDAASGGALGDMTPAEARNLIEKMASNSQQFSVRNDAIVLRGVHEVATNSSSPTENKKLEGKLDALVNLVTQLAMYQKSTPVARVCGLCSSADHHTDLCPSVQQPGAIEQPEAYATNIYNRPPQPQQ

SEQ ID NO: 124791 - protein, 120 aa, Glycine max
  Coding DNA Sequence Number=SeqID_33106
MTQPKVYTDNHSGISARQRDSKVSMTDLVSAEDDVNLRVSTGFRPRLMKGTEDDVSLCVLSGFSCYRQQKVYMDNHSGISARHRDSKVSMTDLVSAEDDVNLRVSTGLSAAIDERRRRQR

SEQ ID NO: 124792 - protein, 152 aa, Glycine max
  Coding DNA Sequence Number=SeqID_33107
MDFFSNESFECIQAFENSNFIPFMSLKLPVYSDLVKAFYSNTEIQEGTLMYEVYGIKMVIDQSLFYDSTQLPSKGVPFEGTLIDDWKFDFSVHDARRLVCTNQADMTERLLAGSLAFESRILHYLIVRILLPRSSNIAQVSEEDLIVMWGFS

SEQ ID NO: 124793 - protein, 107 aa, Glycine max
  Coding DNA Sequence Number=SeqID_33108
PLIELVRNHVPSWEDAQEMGVEGRSPEYEEPQDLRSNPFQGGGNDAILPRKALARRLQVDWARDPRKGPRVLMSLRVSLAIRELLKEVFSKKLLKEVFSRKLLKEAT

SEQ ID NO: 124794 - protein, 336 aa, Glycine max
  Coding DNA Sequence Number=SeqID_33109
  Gene Ontology: Mol. function=cysteine desulfurase activity; Cellular component=mitochondrial matrix; Biological process=cysteine metabolic process
  Homolog annotation: Hit_ID=A7ZPX4; Match level="QueryCoverage=100%, HitCoverage=83%, E-value=0.0, Identity=95%"; Hit description =Cysteine desulfurase
  Pfam annotation: Domain name=Aminotran_5; Domain location=1-301; Score=263.7; E_value=3.9e-76; Accession=PF00266.10; Description =Aminotransferase class-V
  Pfam annotation: Domain name=Beta_elim_lyase; Domain location=9-229; Score=-118.4; E_value=0.012; Accession=PF01212.12; Description=Beta -eliminating lyase
  Pfam module annotation: Pfam domain module=Aminotran_5::Beta_elim _lyase; Domain location=1-301::9-229
IVFTSGATESDNLAIKGAANFYQKKGKHIITSKTEHKAVLDTCRQLEREGYEVTYLAPQSNGIIDLKELEAAMRDDTILVSIMHVNNEIGVVQDIATIGEMCRARGIIYHVDATQSVGKLPIDLSQLKVDLMSFSGHKIYGPKGIGALYVRRKPRIRIEAQMHGGGHERGMRSGTLPVHQIVGMGEAYRIAKEEMETEMARLRTLRNRLWDGVKDMEEVYLNGDLEQGAPNILNVSFNYVEGESLIMALKDLAVSSGSACTSASLEPSYVLRALGMSDELAHSSIRFSLGRFTTEEEIDYTIQLVRKSIGRLRDLSPLWEMFKQGVDINSIEWAHH

SEQ ID NO: 124795 - protein, 111 aa, Glycine max
  Coding DNA Sequence Number=SeqID_33110
MAALARQPAFPPGRCARSPRGNWWCPDRYPPPDDAALLRSLSRKRSLRTVSAATSQVFVQLLHHLLMAGIEHALHARDEAFQTRFVFGLFNLIQALREAPAVPIRNAVSRT

SEQ ID NO: 124796 - protein, 219 aa, Glycine max
  Coding DNA Sequence Number=SeqID_33111
ASVNAVKEDGPSRAKRLGDVATSRRFIYQSLQAACMVSRGGGEKDECLFHLGESHDMETCPVVEELLQRLMDWGQLEVSIGGREEPQSCMQSEEKKAPLTPKALAISWKYTPPASSERVATEVDSLSTKVTNITGLSGVTRSGRVFASPHPAELPSKGKAPMVQEPKDIATPSKEVDPPVGRGAEKKEGLQGKTVTLEEAHEFSASSNKASLRYKDLLA

SEQ ID NO: 124797 - protein, 66 aa, Glycine max
  Coding DNA Sequence Number=SeqID_33112
MAERGHGMYYTPQTFAQYPTQMLTKKKRGDIRAEEILITKLEDGIDHVTHPHGITDTKMNDLHVSV

SEQ ID NO: 124798 - protein, 119 aa, Glycine max
  Coding DNA Sequence Number=SeqID_33113
  Gene Ontology: Cellular component=integral to membrane; Biological process=photosynthesis
  Homolog annotation: Hit_ID=P49179; Match level="QueryCoverage=90%, HitCoverage=53%, E-value=4e-44, Identity=84%"; Hit description =Photosystem I assembly protein ycf4
  Pfam annotation: Domain name=Ycf4; Domain location=1-110; Score=89.4; E_value=1.1e-23; Accession=PF02392.7; Description=Ycf4
MAFYGIAGLFSSFYFGSIIFWDIGGGFDIFNKKGKKVRFVRWGFPGKNRRIILEIPMNELHSIRIITEVKEEGIFTRTSTFESIVYLETIEQGFIPLTRIEDNLNGNQAYRYRRPRGGA

SEQ ID NO: 124799 - protein, 158 aa, Glycine max
  Coding DNA Sequence Number=SeqID_33114
  Gene Ontology: Mol. function=nucleic acid binding
  Homolog annotation: Hit_ID=A5BIE2; Match level="QueryCoverage=29%, HitCoverage=13%, E-value=1e-10, Identity=60%"; Hit description =Putative uncharacterized protein
MTHVNMSDPSMPSHYGKRMIRALQVIQAMKKRQIFFLWKMVKLKVLRYGVPNGRYKWIPKRIGKVRLDAKELMWYLDNGCSRHMMGDKNKFVSLKAKEGGYVTYGNNNKGKILSIAYGPDIYPKAHKNPRAFSCISGPIYLEFSIQCPCGIGLHHKFS

SEQ ID NO: 124800 - protein, 53 aa, Glycine max
  Coding DNA Sequence Number=SeqID_33115
HLTETSMRAGNSDLYGFLEPQSIQSYIRVEYRVQNAIGHWQMVVIVPKEHLVV

SEQ ID NO: 124801 - protein, 41 aa, Glycine max
  Coding DNA Sequence Number=SeqID_33116
EPEGSTISSHINHEPFNLATSYGESREEAKKDPRAGKLSPN

SEQ ID NO: 124802 - protein, 67 aa, Glycine max
  Coding DNA Sequence Number=SeqID_33117
MTKLGLCLPTDTTVSEWQRGADNRKVRITVRCLRGLPALESWHKRRCGRQSEALAPTYPPMRKLRPT

SEQ ID NO: 124803 - protein, 176 aa, Glycine max
  Coding DNA Sequence Number=SeqID_33118
MVSYNVLGQKILLERNVKLYITEFDEFKREVERRNWHKELTNFSEGSIDVAIVKEFYANLYDPEDKSLKQVRMRGHLNKFDVDSLNTFLKTPVVIEKGESLPAYSRFANLRPVPQELAARLCILGRGFELNADGLPLTFESLSLAIKLAYIKRNCWNLDDPSVTFRGTQKSRARRS

SEQ ID NO: 124804 - protein, 154 aa, Glycine max
  Coding DNA Sequence Number=SeqID_33119
  Subcellular localization annotation: CTP_CleavageSite=59; ConfidenceScore=5.27e-01
MKHFTDTLISAQHSKPVYTPLAPNTQTASPRALADSLMQLARQIKAKSEVLSIFKEFKVLSEKQSGKAIKPGGSTSSRAAATAVELQFALYWRNSEEARTDRPSQQLRSLNGEWDAPCSGALSAAGVVVTRSVTATLASADVRRCFCRYAPPRQ

SEQ ID NO: 124805 - protein, 72 aa, Glycine max
  Coding DNA Sequence Number=SeqID_33120
MDNEEGVQEQMKADMSTLKDQMASIMKAMLKIQKSIEDNAAAASSNTIREAEPVLQPALNLGRDRSATSFNR

SEQ ID NO: 124806 - protein, 130 aa, Glycine max
  Coding DNA Sequence Number=SeqID_33121
  Homolog annotation: Hit_ID=A5BEV8; Match level="QueryCoverage=60%, HitCoverage=11%, E-value=4e-10, Identity=39%"; Hit description =Putative uncharacterized protein
  Subcellular localization annotation: CTP_CleavageSite=36; ConfidenceScore=5.04e-01
MCPPPSKVNTKGALKKPMKRSQRSTKRDPSYWEYVDAFHSVQSSNSPVKRSFIRDVVDVKADGNCGYRSIATLLGMGEDSWSHEYMNLFGGTERFEQLKLSLLVDGFSKVSVDKWMDITDIGYVIASRYN

SEQ ID NO: 124807 - protein, 155 aa, Glycine max
  Coding DNA Sequence Number=SeqID_33122
  Subcellular localization annotation: CTP_CleavageSite=47; ConfidenceScore=5.27e-01
KPLGSLAHILAADVQLSGHYPAKPILQKLNFCNFRQLSGPCLAKRPMASRKRKSIGSRPTAQYDTRRFSSLDVWTRYTNNVLGRNILPERKVEIYHSELDEFKVVSYPNFVWIFLQKAVASGGTNLARLGELGGNHLPYFAINRGGSEEEKGSAP

SEQ ID NO: 124808 - protein, 21 aa, Glycine max
  Coding DNA Sequence Number=SeqID_33123
MGVNSSVMGENNNSLFELMRP

SEQ ID NO: 124809 - protein, 103 aa, Glycine max
  Coding DNA Sequence Number=SeqID_33124
RSFLIGASVIASFGYQKEHDDSWVKKGAHVDEEGHGGEDSSLLQKILDRFDGLQTFVGERFDTLELQKDMCFNEMESRITKVEEDVSYIRSSFDLPPPLPPSS

SEQ ID NO: 124810 - protein, 161 aa, Glycine max
  Coding DNA Sequence Number=SeqID_33125
  Homolog annotation: Hit_ID=A5BJP5; Match level="QueryCoverage=83%, HitCoverage=15%, E-value=2e-07, Identity=28%"; Hit description =Putative uncharacterized protein
MLGHTQDRCFKLHGYPPNYKRTSFSSEVKKHYSSSEPPHKVAQQVSVDMSHSPSSSGDSGSQFQLTAQQYSQLMNLLESHATNVVIPQGVSSTSDSGANIHISCSLHHFRSYQLVSHKTVTLPNNDVIPIIAIGSEKQACKRIGKGALIQGLYVFRSQGHS

SEQ ID NO: 124811 - protein, 25 aa, Glycine max
  Coding DNA Sequence Number=SeqID_33126
TRLPPSSASLTSLAGRLMACRSGIL

SEQ ID NO: 124812 - protein, 94 aa, Glycine max
  Coding DNA Sequence Number=SeqID_33127
  Subcellular localization annotation: CTP_CleavageSite=76; ConfidenceScore=5.23e-01
MLVATAAFIVVAYPPIAVGDSFMTTNASARQPQNGADENTQHRAMSKELRQSNQRRPPSQPTLNPSVCYRVTKRFCVSYVTSGPWATWEYPQNL

SEQ ID NO: 124813 - protein, 172 aa, Glycine max
  Coding DNA Sequence Number=SeqID_33128
  Gene Ontology: Mol. function=protein transporter activity; Cellular component=membrane; Biological process=protein secretion
  Homolog annotation: Hit_ID=Q69HW3; Match level="QueryCoverage=56%, HitCoverage=24%, E-value=3e-44, Identity=91%"; Hit description=OqxA
LVDPPGCRNSIALLDNSQRLFTPGLFARVRLPGSAEFKATLIDDKAVLTDQDRKYVYIVDKEGKAQRRDIAPGRLAAGLRIVKQGLNPGDKVIVDGLQKVFMPGMPADFCRRAVDSDFYHRLDRHSAVAGAGGISRRQPESDRRNRGDAIGRSHQRRRNMMYMKSVAALTAY

SEQ ID NO: 124814 - protein, 173 aa, Glycine max
  Coding DNA Sequence Number=SeqID_33129
  Homolog annotation: Hit_ID=A5ZQM3; Match level="QueryCoverage=32%, HitCoverage=51%, E-value=1e-20, Identity=82%"; Hit description =Putative uncharacterized protein
EPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPVWALEH

SEQ ID NO: 124815 - protein, 176 aa, Glycine max
  Coding DNA Sequence Number=SeqID_33130
MPQNVLYDAIGIYQRCDLISLWGKVGTFLRADQRLIFAKSWPRASPVSTREHQDLFILRSDLPSQVLQWLLFLSAVPSCSATDGVVRNGKKHRRTSALASVAVTLRVTTTPAALNAPLQGASHSPFRLRNCWEGRSVRASSLLRQLAKGGCAARRLSWVTPGFSQSRRCKTTASEL

SEQ ID NO: 124816 - protein, 66 aa, Glycine max
  Coding DNA Sequence Number=SeqID_33131
  Subcellular localization annotation: CTP_CleavageSite=34; ConfidenceScore=5.10e-01
MGNQQRQGYTSGGFLGFQQGPYSQQGQWRSHPSNQFNKDQGGPSNRPIQQGPNIFQRNTKLEETLT

SEQ ID NO: 124817 - protein, 281 aa, Glycine max
  Coding DNA Sequence Number=SeqID_33132
  Homolog annotation: Hit_ID=Q652R5; Match level="QueryCoverage=32%, HitCoverage=36%, E-value=1e-16, Identity=53%"; Hit description =Putative uncharacterized protein P0603C10.50
GDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRVRQGPGTTGLSPSLAPPSRGLGPGPPLRTLLQTTIRTPRATDFHGRRALGLMASGATCVQRLDGSRDSAIHTKYRISLRSSSMQEPRYPLPRVIVCKCCVVTTPAGHRLRAPGSRT

SEQ ID NO: 124818 - protein, 198 aa, Glycine max
  Coding DNA Sequence Number=SeqID_33133
MPTGRKEAISPSRFYLSTTRVAKVVKISAQELDQVKQNRNGVVGVPRKCWRKGQRPWKIKVNGLSFIDILALLIFGVVLFPNMEGLVDLAVIDAFLTFHHGKESPVIAILAMYDTFDRGCEKSDAIIFCCALALYVWLVSHPFLQEGRPVYPLQGHRSCVEKGKANWDQLLASMERRLLICSLARRKEELGFYLHAED

SEQ ID NO: 124819 - protein, 924 aa, Glycine max
  Coding DNA Sequence Number=SeqID_33134
  Gene Ontology: Mol. function=transcription regulator activity; Cellular component=nucleus; Biological process=regulation of transcription
  Homolog annotation: Hit_ID=Q2HVX8; Match level="QueryCoverage=98%, HitCoverage=96%, E-value=0.0, Identity=58%"; Hit description=Helix -loop-helix DNA-binding
MRLLIWEDYYYEPLPSPFPPRDGEGCWFSSESQLIQEEDRVCVLINKMMVNNSVSIAGEGIVGRAAFTGNYQWILLNNFTRDAYPPEVYPELHYQFSAGMQTVAVIPVLPHGVVQLGSFLPIMEDIGFVNDVKNLFLQLGCVPGALLSEDYSAKVSNKKFAGPVTVNPPLITSDCTPSVANGSNQLTNSPLASRPVAQPPYPLRGGINNYQGSLLTPQAHNPNLIFDGICQPKAHSMIKTNVCGQPKKTVVEAEAKVIPANFDSCLQQHSVYNARSEFNELSSFNQSNLSDCCLKYIEQQTSGVGRQSHVNPNMNLSSALNMPLLKTNGGKILQQNQSSSSSSLLGGIPICSGSNLLRTNMINCSVSNPPKVSTSDFSGTHKVGFGLQSNNATTNAGLCSVPNFTNQSVTSHMNLEGSDQKNQAYDAFASADQRQDDDLLQAALKIPSLNLEEHVPMGDQIPGFVQDCLNKDVTSQHMMKMNVKHEEAYAQLPSGDDLFDVLGMDLKRRLLNGSWNKLLATDSDDNTEHLDKKATCMNLQGVGPDNSYSVNEAISESGIFSGTGTDHLLDAVVSKAQSSAKQNYDEMSCRTTLTRISTASIPSPVCKQVMPDHVVPRGLFDFPKTGVKTAAAETSSLRSGCSKDDAGNCSQTTSIYGSKLSSWVENSSNVKRESSVSTGYSKRPDEVCKSNRKRLKPGENPRPRPKDRQMIQDRVKELREIVPNGAKCSIDALLEKTIKHMLFLQSVTKHADKLKQTGESKIVSKEGGLLLKDNFEGGATWAYEVGSQSMVCPIIVEDLNPPRQMLVEMLCEERGFFLEIADLIRGLGLTILKGVMEARNDKIWARFAVEIIFRLNRNLHISISIANRDVTRMEIFMSLVRLLDQTVKGGGASSSNAIDNNMMVYQSFPQATQITATGRPSSLQ

SEQ ID NO: 124820 - protein, 82 aa, Glycine max
  Coding DNA Sequence Number=SeqID_33135
MATTAMEEAPAHAPSDVEQPRHAVEACRAIGERLEWLLNLMIVTEGVETYDVMQDCLRITRSVTVDRNVYVRSRRRRRTDHT

SEQ ID NO: 124821 - protein, 249 aa, Glycine max
  Coding DNA Sequence Number=SeqID_33136
  Subcellular localization annotation: CTP_CleavageSite=29; ConfidenceScore=5.40e-01
MDDHKNESSSSPPLHHPLDDSTTSNLATTAATTTTTTTTLFAFVGEWMILFITFSIALFFIPLTPAFTLHSTTASVLNITQNNFTANLGVSFFVETTNPFEGSINYASFNASLFHNNQKLSTLVSLQQETTTLLAMFHNVSLTIDEWGHHHHRDGASSSCGFAFMDLWFSVDAKRDKLQGHCGEVKFELCTSSEATNIVAVPSFLASCDVYSALVHKVRLGVLLLLMILLLVSAAPVPLLVEQFSCFDS

SEQ ID NO: 124822 - protein, 42 aa, Glycine max
  Coding DNA Sequence Number=SeqID_33137
MDGDQDLKDEESCEKGQSKLKGKLLSAPPITFFSLTYLIRKQ

SEQ ID NO: 124823 - protein, 197 aa, Glycine max
  Coding DNA Sequence Number=SeqID_33138
  Homolog annotation: Hit_ID=A7QF54; Match level="QueryCoverage=92%, HitCoverage=66%, E-value=1e-19, Identity=34%"; Hit description =Chromosome undetermined scaffold_87, whole genome shotgun sequence
  Pfam annotation: Domain name=DUF623; Domain location=113-172; Score =77.2; E_value=5.4e-20; Accession=PF04844.4; Description=Protein of unknown function, DUF623
  Subcellular localization annotation: CTP_CleavageSite=56; ConfidenceScore=5.42e-01
MSSNKKSLLRTVFTANGSCGCSKTKSSEVHEPTPKSKTTHIHQKANNNNNNNHNLSSMASSTTSPEQVDEEEFTSTTISESETFHDHNNNNNDDNVVLKRSPLVNSVAIEKDSSNPYHDFRHSMLQMIFEKEIESEDDLQDLLQCFLQLNAQCHHHVIVKAFNEICKEAFPHKVSTTPAVSEPSPSHRSPLIVQKSR

SEQ ID NO: 124824 - protein, 285 aa, Glycine max
  Coding DNA Sequence Number=SeqID_33139
  Gene Ontology: Mol. function=phosphoinositide phospholipase C activity; Biological process=intracellular signaling cascade
  Homolog annotation: Hit_ID=A7UQU7; Match level="QueryCoverage=89%, HitCoverage=46%, E-value=2e-23, Identity=31%"; Hit description=IMP dehydrogenase/GMP reductase, putative
  Pfam annotation: Domain name=DUF1723; Domain location=130-179; Score =56.8; E_value=7.2e-14; Accession=PF08330.1; Description=Protein of unknown function (DUF1723)
MVRTRGLGQRVAVTADHVDEPVIPAPDVQDDPIEAPAAVEDIPTDIPVDTGAKPAEDAHEGFSGGPSDPSMLTLYADHVACSVWTGEERPELKLSSHGRKVHSLGRSVPAIEGLVAGTGLSPLIACSVDTGDRGLLSAFVERWHQETSSFHLPVGELTITLDDVSSLLHLSIIGDLHAFEPLHVDDAVQDAGGLVDGLSRVLLGLRQSSVTDCTYACNGYVIYSSADARQSATNVHVVYLEALCDLSMTERYAWRVAALVHMYDQLNDASMSHSRQLGGYITLLQ

SEQ ID NO: 124825 - protein, 133 aa, Glycine max
  Coding DNA Sequence Number=SeqID_33140
  Gene Ontology: Mol. function=aspartic-type endopeptidase activity; Biological process=RNA-dependent DNA replication
  Homolog annotation: Hit_ID=Q6WAY3; Match level="QueryCoverage=45%, HitCoverage=2%, E-value=5e-09, Identity=46%"; Hit description =Gag/pol polyprotein
MVIYRKRPFGVGAAHPGELAQASWFLIVEGISSPRDLMDAFIRQYQYNFDMDPDRMQLLNMCKRDNESFKEYAQSFADLVFADERIEASLRKGKFNYVAFVNPGNGGFGRSGERKNKGEPHVVNVVPDSQTFH

SEQ ID NO: 124826 - protein, 51 aa, Glycine max
  Coding DNA Sequence Number=SeqID_33141
MEEEKRRKRKKKRKSEVEALPNRNRESFPTSFLLLALYPVQQLNSSRSLVP

SEQ ID NO: 124827 - protein, 374 aa, Glycine max
  Coding DNA Sequence Number=SeqID_33142
MGNEHIGTIVEGPRSNQILTSNGNTSYVDFLTRLAIKHLVTFIERPQTNDQAKTTNTVILRALCIRPNKYMGLWKEELPRKLGPNWEGQFRVVASLDSRVYMLPELDGTSNPMSTLGESHSSKGLSNPRLVLDSITQGPPLVSLVSPKACQTQGPSLVSLTGSSNPKSALGVSRSSKGFSNPRFILGSSNPRFTLGESHFSKGSSNPRFVLGKSHRLIKLEAHQTRGPPLASLASLKALQTQGSSLVSLTGSLNPRSALGESRFSKGSLNPRSVLYESHRLVKPMSDETHCRSNGGSILQNIVPYPLKASNDRGDNGDPALWLRRAWGYALTSPPPLLHAPPMKGCALLRRREMPPPGLLNQTPGVTVAHAHGG

SEQ ID NO: 124828 - protein, 116 aa, Glycine max
  Coding DNA Sequence Number=SeqID_33143
QINLTTLADQPNYSSAKVEEMETALTLTVDSGEALHGNLLNAPHCNSTSLQMTMPRKKNTKIAQGNKDHGTQGNEKLGEEEEEYESRERESEALGEEEEEYKKWERESEALGAQMF

SEQ ID NO: 124829 - protein, 169 aa, Glycine max
  Coding DNA Sequence Number=SeqID_33144
MRQFGCVQSIHDLPVDSWVSFDEIDGRWMHYSDHLVPAGEMCVVPGQCAPDYIDWFFVISHPFMTATQTSNPSQDAPATQPKRIPHIPQVPEPAAASTLARSDVDEPRHAVEACHAIAERLERHLNLGVVAPGRLTHEVIEQCLRIVRGVTEDRIVYVRSRRRRRTDQP

SEQ ID NO: 124830 - protein, 75 aa, Glycine max
  Coding DNA Sequence Number=SeqID_33145
MSHPSIRLNILQSRIYEHFPKFGNIIADEDYYERKPCACRWKCEKTLLAMTYSRLPKDSRKLGTHDKYEDGHYYN

SEQ ID NO: 124831 - protein, 66 aa, Glycine max
  Coding DNA Sequence Number=SeqID_33146
MAPPPALEVPAVVWGEREIICEELRSWILKGREKAYSKTIRMKRLSLDYQYNYYGQHGTRHSTPYC

SEQ ID NO: 124832 - protein, 191 aa, Glycine max
  Coding DNA Sequence Number=SeqID_33147
MVSVKGGFHNVVNIHQYLIVTLEEIKLGEPSRVTELVNTELPRAVVFFNEQDQGRERTNIDRFSTGDEVNSVISGSRGEGGLGRRKLFRDNPKAGVRVAFELNCMPFSDELHVSGIHLARHIARLVGWETLEEDQFEMCSPNAQPARPASLRKLKGPRAFKTLKLAKIKHRVRESALEEAEKTERKQLREL

SEQ ID NO: 124833 - protein, 125 aa, Glycine max
  Coding DNA Sequence Number=SeqID_33148
MTTPSDTSDVGPSNLQLSTIVHRFEASFRVEKHGTKILLSMWTSWDLYIGKHTKDCGRGRLYEWMITMNNDLSCVAKSWIQYLTDDHLKAGDEVVFYYNFNQNLWEVLYRKQVKWDEEEDEANSI

SEQ ID NO: 124834 - protein, 92 aa, Glycine max
  Coding DNA Sequence Number=SeqID_33149
  Gene Ontology: Cellular component=chloroplast thylakoid membrane
  Homolog annotation: Hit_ID=A2Q4U4; Match level="QueryCoverage=94%, HitCoverage=37%, E-value=4e-33, Identity=78%"; Hit description =Rhodanese-like
MNNSSRSDAAASKLEEASLKNIACITSGLQTVKPGTFDSVGSTELENVGKAGLVTIQGKISTVLGTILVCAYIFVTFFPDQAEKLFQLASAG

SEQ ID NO: 124835 - protein, 500 aa, Glycine max
  Coding DNA Sequence Number=SeqID_33150
  Gene Ontology: Mol. function=hydrolase activity, hydrolyzing O -glycosyl compounds; Cellular component=endoplasmic reticulum; Biological process=protein processing
  Homolog annotation: Hit_ID=A7QF73; Match level="QueryCoverage=94%, HitCoverage=80%, E-value=0.0, Identity=74%"; Hit description =Chromosome undetermined scaffold_87, whole genome shotgun sequence
  Pfam annotation: Domain name=Nicastrin; Domain location=132-358; Score=-75.6; E_value=0.00057; Accession=PF05450.6; Description =Nicastrin
MAEYIAESKPLGGLIFLLPRMFSFENKDGMGSNHQDESKEPLKNVLDELEKILIHANLPYPVYFAFEDDNIDAVLTDIKKNDVTGQPATATTGGYKFVVSATEPKKVVSPPITNIQGWLAGLKTDDDAHQLPTIAIVASYDTFGAAPALSVGSDSNGSGIVALLEVARLFSLLYSNPKTRGQYNLLFGLTSGGPYNYNGTHKWLRSFDQRLRESIDYAICLDSIGSWENELWIHVSKPPENAFIKKIHEDFSSVAEELGFKVNLKHKKINISNPRLPIGFHFLFLIISACASCLIEVAWEHEQFSRLRVTAATLSELSTAPEFLEKTGGLVDGRHFVNEAAIVRSVKLIAESLARHIYGHQGKNIQIFADNSNLAVNPSYVRSWLDVLSQTPRVAPFFSKSDPFVMALKKELEDHTDDVNLHRDVLDGIVTFYDSTSTKLNIYQVASVTFDLLLLLVLGSYLIVLFSFLVITTRKRVAISSNSIPTISKFPNYKSLKFTM

SEQ ID NO: 124836 - protein, 152 aa, Glycine max
  Coding DNA Sequence Number=SeqID_33151
MCPNQSMNFRRDSSSACHRLASTANVIRCDRLVAYYALKHSTRVSKMSMDLGESPPYQVNVAPLRDVEKTQHKIALSLVYRFSWVRKESKCSSGSMVSSYYSRLSGFQPRAFLAPPQGVTPSPQCGFGVVGEYQYLASLLQEDWSLQKGSRV

SEQ ID NO: 124837 - protein, 335 aa, Glycine max
  Coding DNA Sequence Number=SeqID_33152
  Homolog annotation: Hit_ID=A7QF78; Match level="QueryCoverage=97%, HitCoverage=77%, E-value=1e-134, Identity=71%"; Hit description =Chromosome undetermined scaffold_87, whole genome shotgun sequence
  Pfam annotation: Domain name=DUF1022; Domain location=2-328; Score =582.2; E_value=5.3e-172; Accession=PF06258.2; Description=Protein of unknown function (DUF1022)
MICGYSQLMLKSQEKKLVPLPSENGVGAGLLAVLEADVKEIVSFARETYEKEGPLLVVACGRDTISTASSIKRLASENAFVVQIQNPRLHLNRFDMVITPKHDYYPLTPEGQKQVPWFLRSWITPRDPPDCHVVLTMGALHQIDFSSIRSVAASWHDEFAHVPRPLLVVNIGGPTRNCRYGVDLAKQLAASLLSVLASCGSVRISFSERTPQKVSNIIVKELGSNPKVYIWDGQGHNRHMGHLAWADAFVVTADSVSMISEACSTGKPVYVLGAEHCKWKFTEFHKSLREQGVVRPFTGSEDISESWSYPPLTDTADAAKKVHEALAARGWKLKV

SEQ ID NO: 124838 - protein, 103 aa, Glycine max
  Coding DNA Sequence Number=SeqID_33153
  Subcellular localization annotation: CTP_CleavageSite=66; ConfidenceScore=5.47e-01
MAENLTCGIFVGFLRFIASVFSVSVCFTVWFAAVFSLVAGSQVWFATVFSLVVGSEVWFVAVFSLVAGSEGSVNCHAVALLVKWVYAPKGDLYKKSQKCQYFS

SEQ ID NO: 124839 - protein, 253 aa, Glycine max
  Coding DNA Sequence Number=SeqID_33154
  Homolog annotation: Hit_ID=A5B204; Match level="QueryCoverage=90%, HitCoverage=98%, E-value=6e-20, Identity=33%"; Hit description =Putative uncharacterized protein
  Pfam annotation: Domain name=DUF584; Domain location=93-233; Score =95.2; E_value=2e-25; Accession=PF04520.4; Description=Protein of unknown function, DUF584
MDPFGPNRFPNRKLSATERFLGVPSHAPPHFSNSAASSNDELLEDDVVFFGGDYGAEHNHHSASTPSSSLSLSSSATPNNNLHNHSHGILAALPENETSHNLRNVSQHFHKASISSISSASSSSSSSRVIPAIPRPPPPAQPSSVMFHQSAPVKVPILSMKARRRYRDVDDDDEDGEEDDEEEMVPPHEFVARNSAQSPMLAYSVLEGIGRTLKGRDMRQVRNAVWRQTAPLVGKRPLFSFEVSESSVRGFVP

SEQ ID NO: 124840 - protein, 142 aa, Glycine max
  Coding DNA Sequence Number=SeqID_33155
  Gene Ontology: Mol. function=4 iron, 4 sulfur cluster binding; Biological process=metabolic process
  Homolog annotation: Hit_ID=A0EIJ3; Match level="QueryCoverage=73%, HitCoverage=27%, E-value=1e-11, Identity=39%"; Hit description =Chromosome undetermined scaffold_99, whole genome shotgun sequence
MAGTDSHTTMIDGLGVVGWGVGRIEAEATIFGQTCVVLTIGGLIVRNIYLSHIFAAHEHGPTKCCWVQIIRQTPRWCHSYLLGVDCYTNAKKTLGCWRVCRVLWILVDVLTVVRCHKYVGSTKLCHLLSSSIYTAVFGKSLL

SEQ ID NO: 124841 - protein, 493 aa, Glycine max
  Coding DNA Sequence Number=SeqID_33156
  Gene Ontology: Mol. function=GTPase activator activity; Cellular component=intracellular; Biological process=signal transduction
  Homolog annotation: Hit_ID=A7QF98; Match level="QueryCoverage=82%, HitCoverage=100%, E-value=1e-121, Identity=58%"; Hit description =Chromosome undetermined scaffold_87, whole genome shotgun sequence
  Pfam annotation: Domain name=PBD; Domain location=87-149; Score=47.3; E_value=5.5e-11; Accession=PF00786.19; Description=P21-Rho-binding domain
  Pfam annotation: Domain name=RhoGAP; Domain location=166-316; Score =92.2; E_value=1.7e-24; Accession=PF00620.18; Description=RhoGAP domain
  Pfam module annotation: Pfam domain module=PBD::RhoGAP; Domain location=87-149::166-316
  Subcellular localization annotation: CTP_CleavageSite=43; ConfidenceScore=5.45e-01
MTEVLHFSSSSSPATSSSDGILQEPPPPSSVSVVVDGFSTVTDCDARRVTVTDRTHQELSLLAILVTLLRKSLIACNKSDEGQGAMEIGWPTNVRHVAHVTFDRFNGFLGLPREFEPEVSTRPPSASVSCRPSLGHLPKEVACATVFGVSTESMQLSYDTRGNSVPTILLLMQRHLYALGGLQAEGIFRINADNSQEEYVRDQLNRGLVPEDVDIHCLAGQIKVYDIGFDNLVLFKAWFRELPTGVLDSLSPEHVMQCQTEEDCAELASQLPHTEASLLDWAINLMADVAQEEHLNKMNARNIAMVFAPNMTHMADPLTALMYAVQVMNFLKNLILRTLRERKDCVVESSPGFCLEPSDENGDSSLPESCQQDDDVAAENEEAGETFVSEKTELECSPESLQSKYSTEGGCGSLIGSPENLVCEEDLYCEFPSKGNIGKSKSVQSSNSSSKKGSQKTRGMLQPVIHATVAADKKGISNLSRIDSRSERIEAWR

SEQ ID NO: 124842 - protein, 90 aa, Glycine max
  Coding DNA Sequence Number=SeqID_33157
MAGDATMVGGVDASEGDARHYHGRRWWRKVKVRPEEGVAVVVGGVDADEGDARRRDDGEASGPFVNVGRFWTIWNAHFINEDESGPLNSL

SEQ ID NO: 124843 - protein, 186 aa, Glycine max
  Coding DNA Sequence Number=SeqID_33158
MDHENPYTHLSTFMEMCSIMEMCNIIRAFTFSLAGKAKTWLQSHLNKSLNTQEEVEEKFIASGLKPQTKMILDASARDTIMSKSLEEPTNSHYSALGDYQQEEKAHYLQNQAKPQQNYQGYRGGSSSNQPYGQRPQNNNAYSGPTNTSYVGPSNNSYVGYSNRGPQQPQAQPNRISKMEDTLTQFM

SEQ ID NO: 124844 - protein, 203 aa, Glycine max
  Coding DNA Sequence Number=SeqID_33159
  Subcellular localization annotation: CTP_CleavageSite=50; ConfidenceScore=5.56e-01
MARLGEYVTSALSNNSSAHIVTSPSSPPPPPESAPSASSPKKTRKTARLRSLAIRPIKMERLVVHMDPTTRKANCPQRKKLRMHLGIVARDKAKFDIPEAFDQRTKKKNLKTEEDDDTVYEKYGINKEKWQQFCHIRRDPSCEEVRKKARVIQKLNTAPYVLSRGGYDLLEEKLMEEKNDWIKHPNPTAQKQSLILYLPLDDI

SEQ ID NO: 124845 - protein, 70 aa, Glycine max
  Coding DNA Sequence Number=SeqID_33160
  Subcellular localization annotation: CTP_CleavageSite=50; ConfidenceScore=5.16e-01
MAINLWIGLQVTLALSSQLASPSHLHGTMTRVAITPLRPRTAPHLAVKAPSSQIWGNHWEEDEKRDLDEK

SEQ ID NO: 124846 - protein, 401 aa, Glycine max
  Coding DNA Sequence Number=SeqID_33161
  Gene Ontology: Mol. function=nucleic acid binding; Cellular component= ribonucleoprotein complex; Biological process=mRNA processing
  Homolog annotation: Hit_ID=A7QFA8; Match level="QueryCoverage=43%, HitCoverage=38%, E-value=6e-83, Identity=84%"; Hit description =Chromosome undetermined scaffold_87, whole genome shotgun sequence
  Pfam annotation: Domain name=RRM_1; Domain location=127-197; Score =74.3; E_value=4e-19; Accession=PF00076.13; Description=RNA recognition motif. (a.k.a. RRM, RB
  Pfam annotation: Domain name=RRM_1; Domain location=206-281; Score =28.1; E_value=3.2e-05; Accession=PF00076.13; Description=RNA recognition motif. (a.k.a. RRM, RB
  Pfam module annotation: Pfam domain module=RRM_1::RRM_1; Domain location=127-197::206-281
MPREKAISSSAAKPSEPEEPVESDEKVDFEEANDPEEAMEEEVEYEEVEEEEEVEEIEEEVEEVEEEEEVEVEEDEEEEEEEEEEVEEVEEDDAMQNHSSDETKVEDEDEKKKHAELLSIPPHGSEVYIGGIPHASDEDLKSLCERIGEVAEVRIMKGKDSSENKGFGFVTFRSVELASKAIEELNNTEFMGKKIKCSKSQAKHRLFIGNVPRSWGVEDLKKIVTEIGPGVTGVELVKDMKNTNNNRGFAFIDYYNHACAEYSRQKMMSPTFKLGENAPTVSWADPKNAESSAASQKSSPSTTAIIFSGLPLPPRSTSTLTRQHPTKPSATILGLSPTTLTNSTTSKTNQRTNQSFFFGGGGEHAGDCSHRKLEKLGLAFLRIFQGKEKLDSKLELIVRGA

SEQ ID NO: 124847 - protein, 73 aa, Glycine max
  Coding DNA Sequence Number=SeqID_33162
MKNDHGIDHENEMRGGGCTTAHPGELLASFESNLARPSELVASALSFVVGPGAEKCPKNDPFALLLNILHISL

SEQ ID NO: 124848 - protein, 73 aa, Glycine max
  Coding DNA Sequence Number=SeqID_33163
MQHVTSQQAANHRGQSQDHSLFPWPTPEQFGATVAWPGDEPDFETGERPAGAPRDDDGAQEDDDMADMLDFFT

SEQ ID NO: 124849 - protein, 97 aa, Glycine max
  Coding DNA Sequence Number=SeqID_33164
MASKKLPAKRFKKDVAGEGSSAAPQERRVQLRDEEYTEFQEEIARRQWTQFVSPMAKYDPEIVMEFYANAWPTEEGARNKRSWVRGQWIPFDEDAIN

SEQ ID NO: 124850 - protein, 63 aa, Glycine max
  Coding DNA Sequence Number=SeqID_33165
ATLNRLALISEFWLSACFSRSANGLKQCTLLDDPPLSANAQLILLPDVSSRSAEECCAQRMAH

SEQ ID NO: 124851 - protein, 343 aa, Glycine max
  Coding DNA Sequence Number=SeqID_33166
  Homolog annotation: Hit_ID=Q6WAY6; Match level="QueryCoverage=72%, HitCoverage=41%, E-value=7e-28, Identity=32%"; Hit description =Putative uncharacterized protein
MAQISTAQELDRVKQNRNGVVGIPRKDLEEKVKALADQGEWASFIDVIELLVFRVVLFPNVDGLVDLAVIDAFLAYHHSKESPVIAVLADAYDTFDQRCEKSGARIVCCTPALYVWLVSHLFHHESRPVCPLQGHCMCTKKREANWEQLLVGMHGASINWFPRWKEGGARVLSSCEGFSNVPLMGTRGCINYKPVLAIRQLGYPMRGASSEESVTPFITRGFSDPNARTFQKVRKAWGAVQRKDKELRGSNNGIIGGYHKWLKARTQEISWLPKLKISSEEEAETPEESEEVQALKAELERARSIGTRNKEGPKGRMRPKQVPRGFEGASTTSSSFEGPRETS

SEQ ID NO: 124852 - protein, 37 aa, Glycine max
  Coding DNA Sequence Number=SeqID_33167
MDLWREIRGVYFIGYILGENKSKGSAVATGEAETALA

SEQ ID NO: 124853 - protein, 117 aa, Glycine max
  Coding DNA Sequence Number=SeqID_33168
  Homolog annotation: Hit_ID=A9JQS7; Match level="QueryCoverage=65%, HitCoverage=10%, E-value=2e-26, Identity=74%"; Hit description =Subtilase
MTSVAVMKAPRKALERKYYVIFQLEWKFIGLSYSYYGEEPTMYHASVENPSGENVKVTLEELKFWKIGENITFRIDFFPFKNSNGNLVFGGLIWNNGIQSVRSPIGLNLLFVTPHLS

SEQ ID NO: 124854 - protein, 59 aa, Glycine max
  Coding DNA Sequence Number=SeqID_33169
  Gene Ontology: Mol. function=catalytic activity; Biological process =metabolic process
  Homolog annotation: Hit_ID=A5BM21; Match level="QueryCoverage=94%, HitCoverage=11%, E-value=1e-14, Identity=71%"; Hit description =Putative uncharacterized protein
MELGSITHFLQCKNIFVTGATGFLAKIFVENVLKVQQNVNKLYLLLRATDVESATQIAQ

SEQ ID NO: 124855 - protein, 334 aa, Glycine max
  Coding DNA Sequence Number=SeqID_33170
  Gene Ontology: Mol. function=catalytic activity; Cellular component =endoplasmic reticulum membrane; Biological process=metabolic process
  Homolog annotation: Hit_ID=A7R0D9; Match level="QueryCoverage=99%, HitCoverage=67%, E-value=1e-124, Identity=64%"; Hit description =Chromosome chr6 scaffold_305, whole genome shotgun sequence
  Pfam annotation: Domain name=NAD_binding_4; Domain location=11-159; Score=8.2; E_value=2.4e-09; Accession=PF07993.3; Description=Male sterility protein
  Pfam annotation: Domain name=Sterile; Domain location=232-334; Score =33.1; E_value=3.1e-07; Accession=PF03015.10; Description=Male sterility protein
  Pfam module annotation: Pfam domain module=NAD_binding_4::Sterile; Domain location=11-159::232-334
MPSAYVCGERGGLIIEDSCQLGVSLNGVPGLDIDMEKKAVEDKLYQLQQEGATEDDIKMAMKDFGMKRATIYGWPNTYVFTKAMGEMLIETLKENVSVVIVRPTMVTSTYREPFPGWVEGVRTIDSLIVAYGKGKLTCFLADIKATFDVIPADMVVNAIISTMVAHANKPCDNIIYHVGSSLENPVRYHNLQDYGFRYFKAKPYVNKEGNYVMVRKVTVLDSMASFQRYMFIRYFLPLKGLELANAAFCQYFQRTYLDIRRKIYTVMRLVDLYRPYLFFNGVFDNMNTKKLRIAARESGVEMEEYLFYFDPKMIDWEDYFMNIHIPGIVKYVFK

SEQ ID NO: 124856 - protein, 56 aa, Glycine max
  Coding DNA Sequence Number=SeqID_33171
MEGIRREKVASLWRAEWKGFEWFRMMKKENEEGGWKNHSSRIGVTHKVVFLDKPIS

SEQ ID NO: 124857 - protein, 240 aa, Glycine max
  Coding DNA Sequence Number=SeqID_33172
  Gene Ontology: Mol. function=nucleic acid binding
  Homolog annotation: Hit_ID=Q1SKZ9; Match level="QueryCoverage=52%, HitCoverage=27%, E-value=3e-23, Identity=43%"; Hit description=Zinc finger, CCHC-type
MATRDVVFSANVDGNGGSGKEPPGSGDSYTPQRPTVDLIKEKVAKIVFEEDNPSKPMVHIEEFVFQGLCAPWQDALVVKLLGKNIDFHTMKDLLGRIWKLKVGFDILDIGNNFYMVKFDIADDRQKGTTTAKQTPVTINTTIIPLVVTPPNVKENNGDITIGANIDEEREYLHWQWLVVKGRSRSKSHKNQSKSGNESITKNQRQSTINYKKEKGVAAKPKACTGYFVWASRRRYANNLQ

SEQ ID NO: 124858 - protein, 170 aa, Glycine max
  Coding DNA Sequence Number=SeqID_33173
MSGYTRDSPQISASPHQLDLAPYASEPYNAQWNAPGLLRDKHTLRSSRILGEMEVDEPWLGLSRCKIHFLVGVLVYAKGMAFVDNWAVGKEKTHIDPFTGEDQIRKALKVPLELLGSPPLGVFFERSVPPFLHMFCSCILSEAIIPTLPNKGNIRSSQEWTREGSKLVYQ

SEQ ID NO: 124859 - protein, 259 aa, Glycine max
  Coding DNA Sequence Number=SeqID_33174
  Homolog annotation: Hit_ID=Q6UUU1; Match level="QueryCoverage=23%, HitCoverage=40%, E-value=3e-18, Identity=78%"; Hit description =Putative uncharacterized protein
  Pfam annotation: Domain name=Ins_element1; Domain location=48-109; Score=-20.7; E_value=0.014; Accession=PF03811.4; Description =Insertion element protein
MVKVGTSYVPINVSIFAKSWPRASRYQQGHQDLFILRSDLPSQWLLFLSAVPSCSATDGVVRNGKSTAGHQRWQAAQLLGRAIGAGLFAITPAGERGMCCKAIKLGNARVFPEFDGSSVAASATSLASFESIPRLIDEGIIDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124860 - protein, 61 aa, Glycine max
  Coding DNA Sequence Number=SeqID_33175
MGHLSDQGIPIDSKRIKVIPDWPTPPSVEGRSQEYQEPWYLRSYPFQGGGDDAILTPKGIG

SEQ ID NO: 124861 - protein, 119 aa, Glycine max
  Coding DNA Sequence Number=SeqID_33176
ASEVRNVLPAHEPLNLQYCKDKHQVDLLPGASLPYRPTYKSNPQETQRKDAHAKVEYVKRLYDQVKVQIAKKKESYVKQAHKKRKEVVLEHGDDPEHLRTNVFQEGGNDENHETGQIQG

SEQ ID NO: 124862 - protein, 41 aa, Glycine max
  Coding DNA Sequence Number=SeqID_33177
KITPWHKYIVMQSYPARALGSRLQVDWARDPREGPRVLMSL

SEQ ID NO: 124863 - protein, 145 aa, Glycine max
  Coding DNA Sequence Number=SeqID_33178
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MKHFTDTLISANIVHNNIGFESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 124864 - protein, 108 aa, Glycine max
  Coding DNA Sequence Number=SeqID_33179
MEAGSLSFNEVFQWRRGERRRHPLGNKPWKKELRHQECALDKKLGEDASMEEKKERERERGEHEIKGGKGGEKLNFELCLTRLSFIKATTSVTHASIYRLGSFLEKLS

SEQ ID NO: 124865 - protein, 163 aa, Glycine max
  Coding DNA Sequence Number=SeqID_33180
  Gene Ontology: Mol. function=hydrolase activity
  Homolog annotation: Hit_ID=Q1GWY0; Match level="QueryCoverage=79%, HitCoverage=38%, E-value=4e-36, Identity=51%"; Hit description=Beta -lactamase-like protein precursor
ANWSSTAVAAALELVDPPGCRNSIFDVAQKTLKPYLDAGKVVPFSGTSEILPGLTGTVHPGHTPGSAFYTLESKGEQITFVGDIIHAAAVQFPQPAVTITYDEDENKAASVREHAFADFVKNKDLIAAPHLPFPGIGYVTKGEKGGYAWVPVTYTNRDASSAK

SEQ ID NO: 124866 - protein, 109 aa, Glycine max
  Coding DNA Sequence Number=SeqID_33181
MGAKLAYDTGIWGMAFVDKWAVGKEKGWVMTLLGWMTKFAFFQTHIDPFTGKDQILKALKVRSPPFSIVEYWCHFELPGSPPLGKEACLRFPGAFELHCQIHITAHHYL

SEQ ID NO: 124867 - protein, 302 aa, Glycine max
  Coding DNA Sequence Number=SeqID_33182
  Gene Ontology: Mol. function=transporter activity; Cellular component= integral to membrane; Biological process=transport
  Homolog annotation: Hit_ID=A1FW81; Match level="QueryCoverage=100%, HitCoverage=28%, E-value=1e-166, Identity=99%"; Hit description =Transporter, hydrophobe/amphiphile efflux-1 (HAE1) family
MQGTVAQTPGMAFPISSYQANVPQLDAEVDRVKAKAQGVQLTELFDTLQTYLGSAYVNDFNQFGRTWQVIAQADGPYRETVEDIGKLRTRNDRGEMVPIGSMVTIKQTFGPDPVLRFNGYPAADLAGEADPRLLSSAEAMNKLTEIAGKVLPVGMTTEWTDLSYQQATQGKAAFIVFPVAIMLAFLVLAALYESWSLPLAVILIVPMTLLSALFGVWLTGGDNNVFVQVGLVVLMGLACKNAILIVEFARELEMGGKGIVEAALEACRLRLRPIVMTSIAFIAGTVPLVLSHGAGAEVRSVT

SEQ ID NO: 124868 - protein, 204 aa, Glycine max
  Coding DNA Sequence Number=SeqID_33183
MPPTRHPLDPDKSNRALGFLALITGLCQSFRVLVTPSKVIRPPITRAFIEKYCTPRQAQGDAPQAADASPPPHQADPAGSLGMERYLQHLVCQQAANHRGQVQIHECLYQLSLSQQGQGFIPFACPTPDQFRAEVAWPEDWPEAQAGEAPAEAPSDVEEACMDEEMTDCSVSWEGAEPHDYGIPRFILFYVSSFIIYMLFILMT

SEQ ID NO: 124869 - protein, 71 aa, Glycine max
  Coding DNA Sequence Number=SeqID_33184
MLATHFGYRATAKKLASNYFLTSSLIFKDISGLILRSFRLTGEDPGFNGNLCCTMSESRLGISWYDHAKMS

SEQ ID NO: 124870 - protein, 170 aa, Glycine max
  Coding DNA Sequence Number=SeqID_33185
MVATDVRKECAGLREENAVTTKALEQETKRARKKEHGRDKFRGALWGSNSELKLRREERDRSRAHSMVLKEELAACSSLATTHEHRVVDEYAQVYAEKEARGRVIDSLHQEATMWMDRFSLTLNGSQELPRLLAKAKAMADTYSALEEIHGLLDYCQHMIDLMAHIIRNR

SEQ ID NO: 124871 - protein, 79 aa, Glycine max
  Coding DNA Sequence Number=SeqID_33186
  Homolog annotation: Hit_ID=A0ST23; Match level="QueryCoverage=34%, HitCoverage=55%, E-value=2e-08, Identity=100%"; Hit description =Putative reverse transcriptase
EFDIKLIDTVDLEGGPVGKPVVPAALMNRPTRGERRFAYWALAECILAYYVGTDEGEKKGCTGASAEYVIQDIFRFLAH

SEQ ID NO: 124872 - protein, 103 aa, Glycine max
  Coding DNA Sequence Number=SeqID_33187
MAYVWLHYMYYRWYACEKQKRMSMTLNGGKRYKKQKNCIKLDDVGLSHNRGRENIYMCVSVCQSPAEAEGTKRSGNQAIPKGNKTAIKEPKECVREELWGLYI

SEQ ID NO: 124873 - protein, 67 aa, Glycine max
  Coding DNA Sequence Number=SeqID_33188
MVKEECKEVTVSSKRQPPHFLLCKKTLVSIATPLGLEFIPQVKELLDEGLVRKNLNPCALLVPKNRC

SEQ ID NO: 124874 - protein, 217 aa, Glycine max
  Coding DNA Sequence Number=SeqID_33189
  Pfam annotation: Domain name=zf-CCHC; Domain location=47-64; Score =19.7; E_value=0.0016; Accession=PF00098.14; Description=Zinc knuckle
MALTLIPKKDQGQGILGVRPSKPKDDKGKTIEKQPLKASMQEKTSSMKCFKCIGRGHITSQCPTKKTMIMRGQDIYSSQDEATTSPSSSKSEEAKGEESSEEIYPQEEGQPLMVKEECKEVSVSSKRLAKKERHFEIKTNIKEISLLRQPPHFLLCKKTLVSIATSLRLEFIPQVKELLDEGLVRKRLNPCALLVPKIGIINMKIQKNRIPAARGIH

SEQ ID NO: 124875 - protein, 35 aa, Glycine max
  Coding DNA Sequence Number=SeqID_33190
NSIPPKEVMDKSLKVEEDEWREKDRRSIKFYASNE

SEQ ID NO: 124876 - protein, 238 aa, Glycine max
  Coding DNA Sequence Number=SeqID_33191
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=71%, E-value=1e-23, Identity=68%"; Hit description=LacZ protein
  Subcellular localization annotation: CTP_CleavageSite=82; ConfidenceScore=5.54e-01
MEKRLCRGPLTSLLSIFLASSRKSSRPVRKPFPLAAVRTDPSVASHKPVYTPLAPQYANRLSPRVGRFINAAGTTGFPTGKRAGTKAGTGPPLEVDGIDKLDPQGCRGGARSRSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 124877 - protein, 293 aa, Glycine max
  Coding DNA Sequence Number=SeqID_33192
STAVAAALELVDPPGCRNSMLKIDADNLNAFLETAVGHPGKILKKDLTTLAQVWSVLSYSNLAPTSHTSDLIVERARLIFGLVSHMDMNIGALISGQMTSTAQSNTSRLGFPALITALCRSRGVVSDSLTFERLSPVINLAYIRKNCWNPKALTISIRGVRRVRARPAELPSTFAAPTPASMSVVAPLGSIPSVEQFKEMVVWSRNQPSLHKEDKGPTAQVPQNMEDEFSEATIPEPFTAGEEAGDTQMTQVATATSERSLEATSEPPASAVDLPSPQHATDPSTPVLEIPKD

SEQ ID NO: 124878 - protein, 164 aa, Glycine max
  Coding DNA Sequence Number=SeqID_33193
  Gene Ontology: Mol. function=catalytic activity; Cellular component =kinesin complex; Biological process=nucleoside metabolic process
  Homolog annotation: Hit_ID=Q2PIN8; Match level="QueryCoverage=85%, HitCoverage=39%, E-value=2e-48, Identity=67%"; Hit description =Nucleoside phosphorylase
SSTAVAAALELVDPPGCRNSIPRLSHEEYTVGWVCALPVELAAAQEMLDEVHEDHERDGNDENLYSLGSIAGHNVAIVCLPAGCIGNNPAAVVATQMKATFKGIRFGLMVGIGGGVPSAAADIRLGDVVVSQHDKTFGGVVQYDAAKATTSGFERTGSLNAPPK

SEQ ID NO: 124879 - protein, 81 aa, Glycine max
  Coding DNA Sequence Number=SeqID_33194
MSGHRVRHRGSCSFTSALDFYLALYSNSSILGQDQLQYSRAGCQDIVSDIVDPATSILPATSILHLTFYLALCIVQPDLIP

SEQ ID NO: 124880 - protein, 44 aa, Glycine max
  Coding DNA Sequence Number=SeqID_33195
MELGFRCDALKGSLSNVLLGMTFNDEPCSIRTLATMWSKYLTNT

SEQ ID NO: 124881 - protein, 116 aa, Glycine max
  Coding DNA Sequence Number=SeqID_33196
  Homolog annotation: Hit_ID=Q6WAY6; Match level="QueryCoverage=85%, HitCoverage=17%, E-value=1e-11, Identity=35%"; Hit description =Putative uncharacterized protein
MEEGKEGVLFSCGDYLNIPLIEMRGCINYNPTLGIRQLGYPMRGAPAEESLSPFLVRDFGAQSFKIIQRVHKAWESLLRKDKELRGIRNGIVGGYHEWLKVRTRGLDWLSKLKAIN

SEQ ID NO: 124882 - protein, 145 aa, Glycine max
  Coding DNA Sequence Number=SeqID_33197
MEDDVNLRVSTGSLALIDKRASPHANGLTGYDSESLYREMLTSPNDEVRITGRCLRMLPDSWVMIAKVRGEKVASAQDLGWQSKGEDHFRQGWAFSPWVKVYGESGFWLKACRTAGHDICQGVGLASDSGIKEMSHNISMIHMQQ

SEQ ID NO: 124883 - protein, 90 aa, Glycine max
  Coding DNA Sequence Number=SeqID_33198
MKTLSTTLEGKADQAMPRWIEPKSHVQTGGYKCGYYVMHWVWCIVSGGLKNEWNRWFCDGIPLNKEVMTTLRNKWARYFLQIKNMEVRKI

SEQ ID NO: 124884 - protein, 116 aa, Glycine max
  Coding DNA Sequence Number=SeqID_33199
MTRGNPSDLQPFDPEIDRTFYRLVRHHLIPFEHHEHSVIGDFEHYCFEHSNFEHFENMAQPPPRERTLREMAAPDFTYESLCIQYPDEDVPYVLKTGLILLLPNFHGLEMKTHTNI

SEQ ID NO: 124885 - protein, 78 aa, Glycine max
  Coding DNA Sequence Number=SeqID_33200
MSAEKYQSGYFSDRCRSIEFSIQSLNEICMMSDKEMFDRTSCGHASFLDLDRSSFLADVDCQFFPINIGEKYFFAEMG

SEQ ID NO: 124886 - protein, 112 aa, Glycine max
  Coding DNA Sequence Number=SeqID_33201
  Homolog annotation: Hit_ID=Q1RU49; Match level="QueryCoverage=32%, HitCoverage=29%, E-value=3e-07, Identity=72%"; Hit description =Putative polyprotein, related
  Pfam annotation: Domain name=zf-CCHC; Domain location=49-66; Score =32.7; E_value=1.4e-06; Accession=PF00098.14; Description=Zinc knuckle
MTNDGSKMTSKFAKLDKFEGQDFRRWQKKMHFLLTTLKVVYVSESRQIVRCWKCGKLGHLKSDCRVSKERIQGDVWAALESKYRAEDAQIEESLRAQEIDKVNRIPAARGIH

SEQ ID NO: 124887 - protein, 67 aa, Glycine max
  Coding DNA Sequence Number=SeqID_33202
MNLFGGGVGIPYRLVEAGTLNFGGRASSCPPIASVAGGRPNSSIDKTIGDAAMLGWDNVPGAGRGGG

SEQ ID NO: 124888 - protein, 84 aa, Glycine max
  Coding DNA Sequence Number=SeqID_33203
MGILDSSNPKAPFSLFAFIFLCFRSSPQAYLGVWYELACYIDPVPHFFMFEHEPTKCSVKCLNGLCVWLAFELAASWACKVASG

SEQ ID NO: 124889 - protein, 128 aa, Glycine max
  Coding DNA Sequence Number=SeqID_33204
MASRKRKSSASRPAAQYDTRRFQSLEAWNRYMDNILDRNILPERNVQIYYTEFDEFEVELERANHGKLLRKDLTTLAQTWSVFSYSNLAPTSHTSDLNMDRARVTPLGSDFQPLSPPFAELEELPLTV

SEQ ID NO: 124890 - protein, 116 aa, Glycine max
  Coding DNA Sequence Number=SeqID_33205
MKADMEAMKEQMATMMVAMMSMKKIMEANTVIVAATSAVAKVNPMLPSGLKQMNHPTSNMVGKDLGSTDDPMMCKFKTSTPSHHIDCLPTIHHPMWHTLSMKISITHRIPAARGIH

SEQ ID NO: 124891 - protein, 328 aa, Glycine max
  Coding DNA Sequence Number=SeqID_33206
MVTPMAKFDPEIVLEFYANAWPTEEGVRDMRSWVRGQWIPFDADAIGQLLGYPLVLEEGQECEYGQRRNWSDGFDEEAISQLLCTPGQDFARTAAGRRVRVMRTNMTTLTQIWMTLLLSNILPSDHNSDLPLPKCQLVYAILTRMSVHVAQLIADAIYIFAVQQGPGISYTDHKTLPVVRSPRCTYQGDSGRLSPGLLLRSTVPRDRLKVMLHRPQHAPPPHQAGQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 124892 - protein, 67 aa, Glycine max
  Coding DNA Sequence Number=SeqID_33207
  Gene Ontology: Biological process=transposition, DNA-mediated
  Homolog annotation: Hit_ID=Q1J7G7; Match level="QueryCoverage=44%, HitCoverage=42%, E-value=2e-10, Identity=100%"; Hit description =Transposase
CPGLPGITGTPDYYLRSDLPSQWLLFLSAVPPVQLLTGWCVTAKAPPDISAGKCSGHAARNHHTRRA

SEQ ID NO: 124893 - protein, 119 aa, Glycine max
  Coding DNA Sequence Number=SeqID_33208
PRGVWETLEAMRVPIRGMIRLTATSSTSEEPARTLQRTVEWILPTPTPYRLVEPVQVIEVSSSEEDPKEDPEELPPEPTDDEDPLPDVDSPEDIMSASEANSTEESGPGGTANSGDSSS

SEQ ID NO: 124894 - protein, 245 aa, Glycine max
  Coding DNA Sequence Number=SeqID_33209
  Homolog annotation: Hit_ID=Q2HW90; Match level="QueryCoverage=57%, HitCoverage=25%, E-value=5e-12, Identity=32%"; Hit description =Putative uncharacterized protein
MPLLGEEKSYLFLRVSSLLEQDCNCGRGFGKRVGSHEANSQRRSRPATKILGRQGKGYGEPREVGPVCGYTSFVDFWGCPLSKRGRFGGLSAIDAFHTYHHSKESPMVAILADLFDTFDLRCEKNSARIVCCLPALCVWLVSHLFQQDTRPLCPLQSYRSCAKKGRVDWDQHLAGIGGNTINWFPRWKEGKEGVLFLCGDYPNVPLIGTRGFINYNPALAIRQLRVPHEGSANKKKVSRLFLVRI

SEQ ID NO: 124895 - protein, 77 aa, Glycine max
  Coding DNA Sequence Number=SeqID_33210
  Subcellular localization annotation: CTP_CleavageSite=31; ConfidenceScore=5.27e-01
MWSLGRMLLNSNVIHVRVVMLVRMVRTRLFAAARGKSCPGMHSRCVIASLSGRARTVGRPPISGGGPGTDKRKLLAP

SEQ ID NO: 124896 - protein, 36 aa, Glycine max
  Coding DNA Sequence Number=SeqID_33211
MDWMHKLENDEGQVVGEHHPQKMVQGKFVPNFGEAL

SEQ ID NO: 124897 - protein, 135 aa, Glycine max
  Coding DNA Sequence Number=SeqID_33212
  Homolog annotation: Hit_ID=Q6UUU1; Match level="QueryCoverage=44%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPLAAPRALSCSCLSVYRCHSAVMA

SEQ ID NO: 124898 - protein, 124 aa, Glycine max
  Coding DNA Sequence Number=SeqID_33213
MGKVEKVQEQMKADMEAMKEQMATMMEAMMSMKKIMEANAVAVAATSTVAKVNPMPPSSLNQMNHPTSAMVGKDLGSTGSPHYAQIQNKHAFPPYGLPPNYTPPNVAYTPSENVNNSTPILIES

SEQ ID NO: 124899 - protein, 270 aa, Glycine max
  Coding DNA Sequence Number=SeqID_33214
MGEVEEVQEKMKADMEAMKEQMATMMEAMMSMKKIMEANAVIVAATSAVAKVNPMLPSGLKQMNHPTSNMVGKDLGSTDDPMMCKFKTSTPSRHMACLPNYTPPNVAYIPNEDVNNSTPILIKSQQPQSDHAHVSRPMEETHGMPHHNLADFEPCLGYATEGQAVGGIPLQNTLEGPQCHPQPQPSHSTAVKNPHAMAEMGKRKGSGPLKENMCKKGDDNRDGRHIYRYSTMKRWWAAHPQSFADFGSSPVKGIDVVSKRGKFDHPYYDD

SEQ ID NO: 124900 - protein, 122 aa, Glycine max
  Coding DNA Sequence Number=SeqID_33215
  Subcellular localization annotation: CTP_CleavageSite=32; ConfidenceScore=5.19e-01
MGGANSNFVILNWAFQTVFRSWIASGGNNPARLGKLGGNLLPLFPRKRQKGVVLRVPDPPDLCISAVLGEKNCFREENPSRGAFVTLLRCFRNQIREGFPPFFTVLHPFFVLQRVSFQIRDF

SEQ ID NO: 124901 - protein, 103 aa, Glycine max
  Coding DNA Sequence Number=SeqID_33216
MIRCDCWRYSLKILSGRHRSHLRPHSHRREKERKPQEANINLPYFHGKDNVEANLDWEIRVEQQLKKKSTSKSYVSHSYPKKDQGQGILGVTSSKPKMIRERQ

SEQ ID NO: 124902 - protein, 216 aa, Glycine max
  Coding DNA Sequence Number=SeqID_33217
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=46%, E-value=3e-54, Identity=78%"; Hit description =Photosystem I P700 chlorophyll a apoprotein A1
  Pfam annotation: Domain name=PsaA_PsaB; Domain location=1-210; Score=- 288.9; E_value=0.04; Accession=PF00223.10; Description=Photosystem I psaApsaB protein
GAAAHAAIFMVRDYDPTIRYNDLLDRVLRHRDAIISHLNWVYTAIQLQPVFAQWIQNTHALAPGTTAPVGGKVALLPIPLGTADFLVHHIHAFTIHVTVLILLKGVLFARSSRLIPDKANLGIVNHITGEILRRVPLPLMGGSVISYGHRHPSGRGYWQELIESIVWAHNKLKVAPATQPRALSIVQGRAVGVTHYLLGGIATTWAFFLARIIAVG

SEQ ID NO: 124903 - protein, 89 aa, Glycine max
  Coding DNA Sequence Number=SeqID_33218
MVRTRGLGRAIGRVVGRDRPTDQDATDVPERRRPTASARKLRDVADMSDDVPEQAAEAPEMRADAQGADSGEGSDGDDAAEGFPGGPRD

SEQ ID NO: 124904 - protein, 333 aa, Glycine max
  Coding DNA Sequence Number=SeqID_33219
  Gene Ontology: Mol. function=protein serine/threonine kinase activity; Cellular component=integral to membrane; Biological process=protein amino acid phosphorylation
  Homolog annotation: Hit_ID=A7PN67; Match level="QueryCoverage=27%, HitCoverage=12%, E-value=2e-17, Identity=49%"; Hit description =Chromosome chr1 scaffold_22, whole genome shotgun sequence
MSWLQSKGAFPLSPKQHFLQYLGVQAAGVRNNRWQCWWLALTWSIWKLRNNIVFSNANFDANKLFEEAIFLLWSWLRSIEKDFTVHFNHWSKIADKKVAAAEAWIEALKASEKEILMETKIAQRQLKESKLEQELEVYTKENMLSRRVSSSEELHNSYAYFTLRWHNPVFSLQLHEPQKKHQMLDTMVWKADPSGFYSTKSAYRLLMTFYRPVPRRILQTIEACNAHKKFSIETKWGTMMGSYPFSEEQPIPVTWRSLVYSFGAVLQELLTGRRPVGNFWGRSNDKVVKILDERLCHIPLDEAKQEQSMERPTMREVVEMLAQAKKPNTFQKQ

SEQ ID NO: 124905 - protein, 81 aa, Glycine max
  Coding DNA Sequence Number=SeqID_33220
MVRQQTANHRGQGQGSPPFVCPSPEQFRAEVVWPGDWPTEEGTGPARSPGEAKEAHMNEDMTDLLGHLGEGGATRPRSPHL

SEQ ID NO: 124906 - protein, 160 aa, Glycine max
  Coding DNA Sequence Number=SeqID_33221
PGPPPDIRGRPAVRAHPEREAITHLLCIPGQDFTRAAAKRRVWIMRTNMTTFTWIWMTLLFSNILPGDHNANLPLQMYRNHTYKDTQWTRRSPIGPWGFQLWLRASVVLQGARSPQQGHVIIGIAPARHPVDPEEVQQGLGVNEAPGRRRAKHHSNIGMA

SEQ ID NO: 124907 - protein, 184 aa, Glycine max
  Coding DNA Sequence Number=SeqID_33222
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=A4W7F8; Match level="QueryCoverage=100%, HitCoverage=85%, E-value=5e-92, Identity=90%"; Hit description =Adenylate kinase
  Pfam annotation: Domain name=ADK; Domain location=1-167; Score=271.7; E_value=1.6e-78; Accession=PF00406.13; Description=Adenylate kinase
  Pfam annotation: Domain name=ADK_lid; Domain location=103-138; Score =79.3; E_value=1.3e-20; Accession=PF05191.5; Description=Adenylate kinase, active site lid
  Pfam module annotation: Pfam domain module=ADK::ADK_lid; Domain location=1-167::103-138
MEKYGIPQISTGDMLRAAVKAGSELGKQAKEIMDAGKLVTDELVIALVKERIAQEDCRKGFLLDGFPRTIPQADAMKEAGINVDFVLEFDVPDELIVDRIVGRRVHAPSGRVYHVKFNPPQVEGKDDVTGEELTTRKDDQEETVRKRLVEYHQMTAPLISYYSKEAAAGNTQYRKIDGTRKVAE

SEQ ID NO: 124908 - protein, 238 aa, Glycine max
  Coding DNA Sequence Number=SeqID_33223
  Homolog annotation: Hit_ID=Q2HW90; Match level="QueryCoverage=81%, HitCoverage=39%, E-value=2e-20, Identity=32%"; Hit description =Putative uncharacterized protein
MEPLQMQAFSKIYGKILELTIAEVSIEAIASLTEYYDQPLKCFTFGDFQLVPTIEEFEEILGCPLGGRKPYLSSGCLPSLSRIATVVKDSARGLDRIKQTRNSIAGLPRKYLEDKAKDMASQGDWVPFMDVLALLIFGVVLFPNIDDLVDLAAIDAFLAYYHSKESPVVAVLADLFDTCDRKCEKSSARIICRLPALYVWLVSHLFQQDTRHPCPLQSHHSCTEKRRIDWDHLLAGIG

SEQ ID NO: 124909 - protein, 261 aa, Glycine max
  Coding DNA Sequence Number=SeqID_33224
  Homolog annotation: Hit_ID=A0TT02; Match level="QueryCoverage=88%, HitCoverage=20%, E-value=2e-22, Identity=35%"; Hit description =Putative uncharacterized protein
MADAAADHFVDIAHGERHVVQAPWAVRQLQQEQVMVAAARLGAQEDGAIDIAIGNLEIQQLAIETLGRRQILNEEHHVADVDRLCLRIDRAGLIDAAHVAPLVDWRDRHLDRLLAADDEAQRHAVGIETFQLFSHLPEAGHQRQTRLQARQIGGRGHAPGHAAQGRTTFKRRRQRRALQRVQDDPRPAQGSEFALRFAPMLRGGLQAEVLHEFFAGWQIFDAKFQFFDSDYAHCSASRSRCIRFSGMSQPRPLFATGLIPA

SEQ ID NO: 124910 - protein, 66 aa, Glycine max
  Coding DNA Sequence Number=SeqID_33225
  Gene Ontology: Biological process=transposition, DNA-mediated
  Homolog annotation: Hit_ID=Q1J7G7; Match level="QueryCoverage=45%, HitCoverage=42%, E-value=2e-10, Identity=100%"; Hit description =Transposase
LPGINRDTRNLFILRSDLPSQWLLFLSAVPPVQLLTGWCVTAKAPPDISAGKCSGHAARNHHTRRA

SEQ ID NO: 124911 - protein, 81 aa, Glycine max
  Coding DNA Sequence Number=SeqID_33226
KKNVYVFLDFRVVIIKKGEIVEAMPSKVILMMPKNSRIKRKIQEKFQVSSFQESRIKNNQEQDSRFKIQESREDLINISMK

SEQ ID NO: 124912 - protein, 292 aa, Glycine max
  Coding DNA Sequence Number=SeqID_33227
  Homolog annotation: Hit_ID=Q6WAY6; Match level="QueryCoverage=72%, HitCoverage=40%, E-value=7e-13, Identity=26%"; Hit description =Putative uncharacterized protein
LAAIDAFLAYHHSKESPVVAILADLFDTFDRSAINWFPRWKEGKEGVLFSCGDYPNVPLIGTRGCINYNPALAIRQLGYPMRGAPTEGSLSPFLVKDLGAQGLKIIQRIHKAWKSPLRKDKELRGIRNGVIGGELRSSGGDEEVRALKLELGKARLAKENFKAAATHIRKECTELQEENAATARALEQETKRAHKEEYGREKFRGALWGSNNELKLQREERDRSREELNQSMAHEQKLVEDFAQVYAEKEARGRVIDALHQEATMWMDRFTLTLNGSQDLPRLLAKAKAMAE

SEQ ID NO: 124913 - protein, 79 aa, Glycine max
  Coding DNA Sequence Number=SeqID_33228
MRPCTYIFRFQILKPTTLLSKILERFDGFQTFVGERFDTLELQVDMRFNEMESRMTKVEEDVSYIRSSFDLPPPPPPSS

SEQ ID NO: 124914 - protein, 87 aa, Glycine max
  Coding DNA Sequence Number=SeqID_33229
  Homolog annotation: Hit_ID=A8AG58; Match level="QueryCoverage=91%, HitCoverage=86%, E-value=2e-18, Identity=60%"; Hit description =Putative uncharacterized protein
MGYLVIEAQLRAIITGEKTEVSPPELAKELLAARVKIGELERQLATPIRLPFSSASPVCEIEAGYAAGVSDCRQAIREAGFPIEGDD

SEQ ID NO: 124915 - protein, 258 aa, Glycine max
  Coding DNA Sequence Number=SeqID_33230
  Gene Ontology: Biological process=transposition, DNA-mediated
  Homolog annotation: Hit_ID=Q1J7G7; Match level="QueryCoverage=18%, HitCoverage=80%, E-value=3e-15, Identity=75%"; Hit description =Transposase
LNSYVPINVSFSPKVGPGLPGIYSAQSASGDAAQLTDLVYDGVFEVLQWLLFLSAVPPVQLLTGWCVTAKAPPDISAGKCSGRVPFAIQAAQLLGRAIGAGLFAITPAGERGMCCKAIKLGNARVFPVTTLNSIMNSLPNFIRVNTSYNSTKSTLKVSIEAMVNFELGVIMVIAVSFGKPVVPAALMNRQRAGRGGCTGGGSRICDTGYIPVPRSLTGYARVVRLRERKWFTNGAEEFLEEWPGKILNKEVRRAGGKA

SEQ ID NO: 124916 - protein, 80 aa, Glycine max
  Coding DNA Sequence Number=SeqID_33231
MGHLRFVILFGRNDQHENTEKSDQGVPMNPKRIKVIPEWPTPSSVEEKSPEFQEPRDLRSNPVQWGGSSLSIPSTSRGGP

SEQ ID NO: 124917 - protein, 78 aa, Glycine max
  Coding DNA Sequence Number=SeqID_33232
  Homolog annotation: Hit_ID=A0PAV3; Match level="QueryCoverage=48%, HitCoverage=17%, E-value=5e-07, Identity=76%"; Hit description =Restriction endonuclease
  Pfam annotation: Domain name=Ins_element1; Domain location=43-75; Score=-27.4; E_value=0.067; Accession=PF03811.4; Description =Insertion element protein
MVKVGTSYVPINVSFSPKVGPGLPGINRDTRIYLFCEVIFRHSCPSCSATDGVVRNGKSTAGHQRYQAYRYRRPRGGA

SEQ ID NO: 124918 - protein, 181 aa, Glycine max
  Coding DNA Sequence Number=SeqID_33233
MIMRGQDIYSSQDEATTSPSSSESEEAKGGESSEEIYPQEEGQPLMVKEECKEVSVSSKRLAKKERHFEIKTNIKEISLLRQPPHFLLCKKTLVSIATSLRLEFIPQVKELLDEGLVRKRLNPCALLVPKIGIIRHQIPMIGGIMNVLSGATLFCKITHAPNIFMICVIKLIDTVDLEGGP

SEQ ID NO: 124919 - protein, 23 aa, Glycine max
  Coding DNA Sequence Number=SeqID_33234
MELTDHNRESIKLIDTVDLEGGP

SEQ ID NO: 124920 - protein, 117 aa, Glycine max
  Coding DNA Sequence Number=SeqID_33235
MTLQLANLSITRPYEVIEDVLVRVKHFIFPADFVVMDICEDTDIHTSPLQNKMFAYSLFAKRTPRAKRIFVHALSCESQALSDQPLHLRLIWSAKLAKAELSQLQFDLNSAKLQPNH

SEQ ID NO: 124921 - protein, 106 aa, Glycine max
  Coding DNA Sequence Number=SeqID_33236
MTRGEKFGHSAPLCHSDTTVSDGAQRQKLVILHPLSSRGGGPDDTRRQNLVILHPFAIQTQSVSDGAQRQNWSFCTLCHPEAAGPMTREDFKIWSSALTRSVIHDF

SEQ ID NO: 124922 - protein, 66 aa, Glycine max
  Coding DNA Sequence Number=SeqID_33237
MQRSNVPNIMLGVQRKGCLSYQKTIDSERWIYVGDASYGESFNAELRGTKRVELIIQTQEHYGISA

SEQ ID NO: 124923 - protein, 46 aa, Glycine max
  Coding DNA Sequence Number=SeqID_33238
MSGRQRRRGERRRHPLGNKPWKKELRHQDEPWIRSLERCFTGGGIL

SEQ ID NO: 124924 - protein, 137 aa, Glycine max
  Coding DNA Sequence Number=SeqID_33239
  Homolog annotation: Hit_ID=Q6UUU1; Match level="QueryCoverage=43%, HitCoverage=40%, E-value=1e-18, Identity=78%"; Hit description =Putative uncharacterized protein
MAGPPIANQVSSSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAK

SEQ ID NO: 124925 - protein, 82 aa, Glycine max
  Coding DNA Sequence Number=SeqID_33240
GTGPPLEVDGIDKLDVENVGKTEGNRSKIKILSSGVVFTLEEGISTSYVDKSGAFAPTYPPLERKSDLRSSFLCVNQAILFT

SEQ ID NO: 124926 - protein, 16 aa, Glycine max
  Coding DNA Sequence Number=SeqID_33241
MKEIKLIDTVDLEGGP

SEQ ID NO: 124927 - protein, 57 aa, Glycine max
  Coding DNA Sequence Number=SeqID_33242
MAGILFLLEQQNSLEITECHYFGDATKATTSPSSSESEEQKGKNLMKKYTPKKKDNH

SEQ ID NO: 124928 - protein, 91 aa, Glycine max
  Coding DNA Sequence Number=SeqID_33243
MGISSSSSGDAQEEASLGSAYFQLLAKPICRLSKPSAERTTLEAECEEEYGRRIVEAMLSKIILMMPKTQVKNQESSKFQESKSRSIKIQD

SEQ ID NO: 124929 - protein, 93 aa, Glycine max
  Coding DNA Sequence Number=SeqID_33244
  Homolog annotation: Hit_ID=A7P7E3; Match level="QueryCoverage=97%, HitCoverage=68%, E-value=3e-09, Identity=36%"; Hit description =Chromosome chr9 scaffold_7, whole genome shotgun sequence
STYKTNRYRLSLLDFVGVTPTGMTFFAGFAYVEGECVNNLGCLTDCPSEQQFDECLKKFEMACIPWPMFVDYFKETWIIPHNEKFVSAWTNKG

SEQ ID NO: 124930 - protein, 80 aa, Glycine max
  Coding DNA Sequence Number=SeqID_33245
MQLPQEPLNKRPRGLARKSMAGINFAELYGVAIVNSSCKGKRGTSREHIAWSKRSLSQCLCETETNMLAIIAKYQEELGP

SEQ ID NO: 124931 - protein, 172 aa, Glycine max
  Coding DNA Sequence Number=SeqID_33246
  Homolog annotation: Hit_ID=A5B6Y9; Match level="QueryCoverage=20%, HitCoverage=6%, E-value=1e-10, Identity=85%"; Hit description =Photosystem I P700 chlorophyll A apoprotein
GIRVEKCSSQSSSTRRYSAEVIHAITPRKSSNDLQQMDHVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTH

SEQ ID NO: 124932 - protein, 56 aa, Glycine max
  Coding DNA Sequence Number=SeqID_33247
MANKLIKDIQPKSEVVKLLQKYIVNSFWSIFPKLKKALIWLPSTMKVWKMMFLHFF

SEQ ID NO: 124933 - protein, 208 aa, Glycine max
  Coding DNA Sequence Number=SeqID_33248
AGTGPPLEVDGIDKLDNTETFSSLTSYPELRRSEFLIGGYVGARASLLSTTPPFVAITQELVARGDTLRLSAPRHSVTPSVIDEQRPMWSSRVFREYLHTLARQSAFSDGDFQVSQVIHPNIRRSEFLIGHSCGYAETKICILSAAPIIFVIQTLRQTQLCPMARRDQVWSFCTHDTRRYLMVIRTLLSSRGGGPDDKQRPSLVILHP

SEQ ID NO: 124934 - protein, 110 aa, Glycine max
  Coding DNA Sequence Number=SeqID_33249
  Homolog annotation: Hit_ID=O69421; Match level="QueryCoverage=25%, HitCoverage=29%, E-value=4e-08, Identity=100%"; Hit description=InsA protein
  Pfam annotation: Domain name=Ins_element1; Domain location=3-59; Score=-15.4; E_value=0.004; Accession=PF03811.4; Description =Insertion element protein
  Subcellular localization annotation: CTP_CleavageSite=72; ConfidenceScore=5.82e-01
APVASVSISCPSCSATDGVVRNGKSTAGTSALASVAVTLRVTTTPAALNAPLQGASHSPFRLRNCWEGRSVRASSLLRQLAKGGCAARRLSWVTPGFSQSRRCKTTASEL

SEQ ID NO: 124935 - protein, 100 aa, Glycine max
  Coding DNA Sequence Number=SeqID_33250
STAVAAALELGGSPGLQEFDLGTSFSGTGAEPGIICIGWILNSGRSWFDGALVDDGDDGTEGEPGAEVSFGEVAMEKQSGRVKQRSNSFWLSSERAINVK

SEQ ID NO: 124936 - protein, 274 aa, Glycine max
  Coding DNA Sequence Number=SeqID_33251
  Gene Ontology: Mol. function=nucleotide binding; Cellular component =intrinsic to membrane; Biological process=defense response
  Homolog annotation: Hit_ID=A2Q4E5; Match level="QueryCoverage=99%, HitCoverage=31%, E-value=2e-58, Identity=46%"; Hit description =Disease resistance protein
  Pfam annotation: Domain name=LRR_1; Domain location=141-163; Score =9.1; E_value=6.3; Accession=PF00560.24; Description=Leucine Rich Repeat
  Pfam annotation: Domain name=LRR_1; Domain location=219-241; Score =12.2; E_value=1.7; Accession=PF00560.24; Description=Leucine Rich Repeat
  Pfam annotation: Domain name=LRR_1; Domain location=24-45; Score=7.1; E_value=15; Accession=PF00560.24; Description=Leucine Rich Repeat
  Pfam annotation: Domain name=LRR_1; Domain location=243-265; Score =14.7; E_value=0.34; Accession=PF00560.24; Description=Leucine Rich Repeat
  Pfam annotation: Domain name=LRR_1; Domain location=47-69; Score =10.4; E_value=3.6; Accession=PF00560.24; Description=Leucine Rich Repeat
  Pfam annotation: Domain name=LRR_1; Domain location=71-93; Score =11.6; E_value=2.1; Accession=PF00560.24; Description=Leucine Rich Repeat
  Pfam module annotation: Pfam domain module=LRR_1::LRR_1::LRR_1::LRR _1::LRR_1::LRR_1; Domain location=141-163::219-241::24-45::243 -265::47-69::71-93
MFPNGAEGGNVESLLNTCVSKFKLLRVLDLSYSTCKTLPRSIGKLKHLRYFSIENNRNIKRLPNSICKLQNLQLLSVRGCKKLKALPKALRKLISLRHLKITTKQPVLPYSEITNLITLAHLYIASSHNMESILGGVKFPALKTLYVVDCHSLKSLPLDVTNFPELETLFVVDCVNLDLELWKDDHEEQNPKLKLKYVAFWGLPQLVALPQWLQETANSLQTLFIKNCDNLEMLPEWLSTLTNLKALEISDCPKLISLPDNIHHLTALERLRIV

SEQ ID NO: 124937 - protein, 249 aa, Glycine max
  Coding DNA Sequence Number=SeqID_33252
  Homolog annotation: Hit_ID=Q2HW90; Match level="QueryCoverage=59%, HitCoverage=30%, E-value=5e-11, Identity=32%"; Hit description =Putative uncharacterized protein
MGSSQTPSLKKRFYQVNVKSLGITSLKELGQLMGQLQRQAFRKAYGKIWDLAMVEVSIEAIASLAQRPYLFSGFYPSLARISKIVQISAQELDHRKQVENGVVGIPRKYLEVKARILAGKGEWASFIDILALLTFGGVLFPNVDGLVDLAAIDAFLTYHNHKESSVVAMLADLYDTFDRRCEKSNTRIVCCTLALYVWLVSHLFRQEVRHACPLESHRSCTEKGGANWDQLLASKEGASVNWFPRWKEG

SEQ ID NO: 124938 - protein, 194 aa, Glycine max
  Coding DNA Sequence Number=SeqID_33253
  Homolog annotation: Hit_ID=A0ST23; Match level="QueryCoverage=12%, HitCoverage=51%, E-value=5e-07, Identity=100%"; Hit description =Putative reverse transcriptase
ISVTGIYSAQSASAVPPVQLLTGWCVTAKAPPDISAGKCSGRVPFAIQAAQLLGRAIGAGLFAITPAGERGMCCKAIKLGIRCKNDDPFFVLNSDQAYRYRRPRGGARYQLLFPLVRVNFELGVIMVIAVSFGKPVVPAALMNRPTRGERRFAYWALAECILAYYVGTDEGEKKGCTGASAEYVIQDIFRFLAH

SEQ ID NO: 124939 - protein, 46 aa, Glycine max
  Coding DNA Sequence Number=SeqID_33254
MEPRGPLRRPASSSSANTNQYPALNRCFEVGRARTPVRGTGCFGVF

SEQ ID NO: 124940 - protein, 195 aa, Glycine max
  Coding DNA Sequence Number=SeqID_33255
MVSRGGGERDECLFHLGESHDMETCPAVEELLQRLMDCGQLEVSIGGREEPQICMQSEEKKERDRLHTHIPPDSPKPTPFAYQSNKAVPWKYTPPAFNERVATKVDSLSAKVTNITGLSGVTRSGRVFASPHPAELPSKGKAPMVQEPTDVATPSKEVDPPVVREAEKKEGLQEKTVTLEEAHEFLRLIQQSEFK

SEQ ID NO: 124941 - protein, 111 aa, Glycine max
  Coding DNA Sequence Number=SeqID_33256
MKPPDVQEDHIFLKDFPHSLEGVEKDWLYYLAPRGNPSDLQPFDPEIDRTFHRLVRHHFIPFDHSELSITGESVHYVIGDFEHPDLEHYNFEHSDSEHSDFAHSETWHTST

SEQ ID NO: 124942 - protein, 114 aa, Glycine max
  Coding DNA Sequence Number=SeqID_33257
  Subcellular localization annotation: CTP_CleavageSite=62; ConfidenceScore=5.44e-01
MVRQQPVPTSSPQATCGPWDFFQPCKNPFTSKDSQGMYPSLFSLNLVDVPSTRTDPQEMYPLLFSVKPKEKGDTKEFKRLVPWSFGKERRETQKEFKAVSPWRILLAKGEENER

SEQ ID NO: 124943 - protein, 195 aa, Glycine max
  Coding DNA Sequence Number=SeqID_33258
GTGPPLEVDGIDKLDTDLVFASERIKVGPKRGKFDHPTRTTEKTGANKEGEDEGETHVVAAIPVRPNFPPTQQYLYSANNKLSPYPPPTRKPVEFTPIPVSYADLLPYLLDNSMVAITLAKVHQPPFLREYDSNATCACHGEAPGRSIEHGRALKRKDFQVQAIGQFAQAICALEFGLPRPFNQRLLVLHVGGVA

SEQ ID NO: 124944 - protein, 213 aa, Glycine max
  Coding DNA Sequence Number=SeqID_33259
  Homolog annotation: Hit_ID=A0ST23; Match level="QueryCoverage=11%, HitCoverage=51%, E-value=7e-07, Identity=100%"; Hit description =Putative reverse transcriptase
GFPGINRDTRIYLFCEVISVTAVPPVQLLTGWCVTAKAPPDISAGKCSGHAARRVPFAIQAAQLLGRAIGAGLFAITPAGERGMCCKAIKLGNARVFPEFDRRTPLRRSHGLLRLLLIIDPADQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 124945 - protein, 284 aa, Glycine max
  Coding DNA Sequence Number=SeqID_33260
  Homolog annotation: Hit_ID=Q6UUU1; Match level="QueryCoverage=21%, HitCoverage=40%, E-value=4e-18, Identity=78%"; Hit description =Putative uncharacterized protein
LELLRADQRLISPKVGPGLPGINRDTRIYLFCEVIFRHRYSSAQSASAVPPVQLLTGWCVTAKAPPDISAGKCSGRVPFAIQAAQLLGRAIGAGLFAITPAGERGMCCKAIKLGNARVFPVTTLNASFLRKHYLFQLEIVNITHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 124946 - protein, 58 aa, Glycine max
  Coding DNA Sequence Number=SeqID_33261
MHESLYSTCFTVPLVNDAPDGEIGRHAALRKQWANEHLSVRSPKEYAALFDYLIFLKK

SEQ ID NO: 124947 - protein, 32 aa, Glycine max
  Coding DNA Sequence Number=SeqID_33262
MQRSPRLPQTSSVISFNYIGIHGRGQLLAIHV

SEQ ID NO: 124948 - protein, 222 aa, Glycine max
  Coding DNA Sequence Number=SeqID_33263
ALLIFGVVLFPNMEGLVDLAVIDAFLAFHHGKESPVVAILAMYDTFDRGCEKSGARIVCCALALYVWLVSHLFLQEGRPVYPLQGRKNQDSIFMRRMSKCSLDGTRGCINYNPILAIRQLGYPMRGVPSDESITPFIARGFSDPNARDRELRGSSNGIIGGYHKWLRVRTQGLDWLPNLKTVRDDEVKASEKAAIVSSNSEEVKGIIMGQRHDLEGRAKGLP

SEQ ID NO: 124949 - protein, 422 aa, Glycine max
  Coding DNA Sequence Number=SeqID_33264
  Gene Ontology: Mol. function=helicase activity
  Homolog annotation: Hit_ID=Q9LW42; Match level="QueryCoverage=26%, HitCoverage=7%, E-value=2e-12, Identity=39%"; Hit description =Helicase-like protein
MLDEHDTHAKSFRMVGDRLTHSEVHNVRLKLIANCEKDGRTYNVFTISEVVALIGGDFDMNSRRDIILETQNDQLQRMHELHSSYLEKREELESERQYANRGRISTSKRKFQQLLSPSTLLFFFSTIVASLEAPNSSSFLPQIVEKCEILRVRKAKLGKNGCAVLVTGKLGGVDEDPMLRGTRIRATVVPGDMPRGSGDLGDVRWGAIAQNQAWLIPTQPGHSQSMRTCDVPKQGDRVLVINYQLGVIDYIVSPATVSNVQRLCNSFLGTGNRLHTLIAMAAQLIYDRVVMECLEGVWEILEGNERCRFRGTIRLTATSLVHPKEPARTLQQPVEWILPTPTPYRLVEPVQVIEVSSFEEDLEEDPEELPPEPAMDALDLPEDDEDPLLDVDSPGDIMSASEADSTEENGPGGTANSDDSSS

SEQ ID NO: 124950 - protein, 346 aa, Glycine max
  Coding DNA Sequence Number=SeqID_33265
MAPRKLASKRSRKDKAAEGTSFAPEYDSHRFRSAVHQQRFEAIKGWSFLQERRVQLRDDEYTDFQEEIGRRRWASLVTPMAKFDPDIVLEFYANAWPTEEGVRDMSSWVRGQWIPFDADAIGQLLGYPLVLEEGQECEYGQRRNWSDGFDEEAIAQLLCIPGQDFARTTAGRRVRIMHTNMTTLTQIWMTLLLSNILPTDHNSDLPLPKCQLVYGILTRMSIHVAQLIADAIYIFAGLCQSFGVPVAPTKVIRPPITRAFIEKYCTQRQAQGDAPQAAGAPPPPHQAGPAGSFDMEQYLRHLVRQQAANHRAHVQTHDCLYQMSLSMQSQGFASFSCPTPDQFRAE

SEQ ID NO: 124951 - protein, 83 aa, Glycine max
  Coding DNA Sequence Number=SeqID_33266
EFDPSRIFLQKAVASGGSNLARLGELGGNHLPYFAINRGGSEEERAEALPKRFRNVFREEFRKDFNRSSTFFIRSSSFFDLQR

SEQ ID NO: 124952 - protein, 135 aa, Glycine max
  Coding DNA Sequence Number=SeqID_33267
MRGIVHEPQYPHLQRTIRPRLERTTRPHHQRAARLHLQRTILTLTVRGLHVLALRGLHVLTIRGLHALTSRGLYVLALRGLHALTLGTSYPHRQRTTRPRLERTTRPHHQRAAHPYLQRTTCPRLERATRLHLGY

SEQ ID NO: 124953 - protein, 111 aa, Glycine max
  Coding DNA Sequence Number=SeqID_33268
GSRQNPYAMPMQKTQCGNVHSMTIFTEHKQKGIIPFEEHIVAVGTTSNNRFSKRKALDEGRRETRGMRVPRKEYARSRHQRLFEENVGKTGKDAIYELFSERFGSCIYAQG

SEQ ID NO: 124954 - protein, 95 aa, Glycine max
  Coding DNA Sequence Number=SeqID_33269
MSDSGGSRIETIVIEQWKLSRNSNGHNFSGGSNLARLGELGGKHLPYVAINRGGSEEEKAEALPKRFRNVFREEFRKVSTVLRRSHSSSSFFDLN

SEQ ID NO: 124955 - protein, 231 aa, Glycine max
  Coding DNA Sequence Number=SeqID_33270
GTKAGTGPPLEVDGIDKLDLSKRKGHALRRPYRTRARTRVMGEAEEVQEKMKAEMEAMKEQMATMMEAMMSMKKIMEANAVIVAATSVVAKVNPMLPSGLKQMNHPTSNMVGKDLGSTDDPMMCKFKTSTPSRHMACLPNYTPPNVAYIPNEDVNNSTPILIKSQQPQSDHAHVSRPMEETHGMPHHDLADFEPCLGYATERASSWWYTPAKHFGGPSVSSTTTTLTFHSG

SEQ ID NO: 124956 - protein, 78 aa, Glycine max
  Coding DNA Sequence Number=SeqID_33271
MTKENKEPFLGNLGKIDGDPVLRGKDMGYVGVRELRMEVGNRGWWVYARFVDVENLLCTIAQPPPSTTCDGYPIILQA

SEQ ID NO: 124957 - protein, 114 aa, Glycine max
  Coding DNA Sequence Number=SeqID_33272
MWLPPKPWNEKPRGLVGKNMAGTNSEGLCGVCSRSKRNLSQRLCETETNMLAIVNKYQEELNLATAHEHKVADEYARVYAEKEARGRVIDSLHQEATMWMDRFALTLNGSQELP

SEQ ID NO: 124958 - protein, 280 aa, Glycine max
  Coding DNA Sequence Number=SeqID_33273
MLAIIAKYQEELGLATTHEHRIADEYAQVYAEKEARGRVIDSLHQEATMWMDRFALTLNGSQELPRLLAKAKAMADTYSAPEEIHGLLDYYTGTDESRHVGSERTDGFHDGAMLGMRQLMEKNAATAAAVSSAAEADPTLLVGRGRNTLGHDGNPHLGYNQAAYPYGLPPNYSPPVLQDDAGHIVSPVLEREPPQQPDEVHEDPQDYARRDVEFYPLIPEGPAPSTTTPGVATYPSVGGRRETRGMRVPRKEYARSRHQRLFEENVGKTGKDAIYELLSK

SEQ ID NO: 124959 - protein, 145 aa, Glycine max
  Coding DNA Sequence Number=SeqID_33274
MSLHSSSSVNGEGSTPKDPLYKILDELRSLKLWKEKQERKEKGRHRSHLRPHSHRRENERKPQEANINLSYFHGKDNVEANLDWEIRKRTHYFSMPHQEIHDYEKPKTFTVAKMRLLLHLPLVKVKKQNRKNLVKKSTPKKKDNL

SEQ ID NO: 124960 - protein, 122 aa, Glycine max
  Coding DNA Sequence Number=SeqID_33275
  Homolog annotation: Hit_ID=Q6UUU1; Match level="QueryCoverage=49%, HitCoverage=40%, E-value=2e-15, Identity=71%"; Hit description =Putative uncharacterized protein
MSELTRIHCGALTARFPIRKPVMPSALMNRPTHGERRFAYWALAECILAYYVGVDEGVSEVLHVAGEKRLLLCVSRICDTGYIPLPRSLTRYARSIDCGERQWLTSGAEISCKMPGRYLTGK

SEQ ID NO: 124961 - protein, 79 aa, Glycine max
  Coding DNA Sequence Number=SeqID_33276
MAHHAHGHQDVLTTAIGPPEHLGRVHAAGAAITIKQYFGSAPTTSRTSSSMGLEDLDQMQSQFQSHMQSHGLALPPEPE

SEQ ID NO: 124962 - protein, 121 aa, Glycine max
  Coding DNA Sequence Number=SeqID_33277
  Pfam annotation: Domain name=G-patch; Domain location=4-45; Score =19.3; E_value=0.00089; Accession=PF01585.14; Description=G-patch domain
MAMMVTRMMLGYDYEPEMGLGKNNGGRTSLVSTSGNRGKFGLGYKPMQADIRKNILERKNKGQGLRLGQQAEEAPPYHISRSFISAGLRREGQVNTICEDDSPRRSDLVWPCPPNFRLGNW

SEQ ID NO: 124963 - protein, 155 aa, Glycine max
  Coding DNA Sequence Number=SeqID_33278
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=72%, E-value=3e-24, Identity=66%"; Hit description=LacZ protein
RPIRKPPLPARWPIINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 124964 - protein, 139 aa, Glycine max
  Coding DNA Sequence Number=SeqID_33279
IRSSERIEVDLKRGKFNHPAWTNEKTGANKEGEDEGETHAVTAIPVRPSFPQTQQRYYSVNNKPPPYPPPTLGHSIEHCMTLRRKVQGLIDAGWLKFEENRVIFKCKPLVSLLKRPAPEFGLPRPFNQRLLVLHVGGVA

SEQ ID NO: 124965 - protein, 40 aa, Glycine max
  Coding DNA Sequence Number=SeqID_33280
MTITKDDDKGDDKKLKGIKIHGSSFKNQDQDSRFKNQEKA

SEQ ID NO: 124966 - protein, 77 aa, Glycine max
  Coding DNA Sequence Number=SeqID_33281
MTHYNPYPRKQKRKEGKFPIKEKAKRKERKFPIKEWEKAKRKERKFPIKEWEKAKRKERKFPTKEWEKVKKGRKESS

SEQ ID NO: 124967 - protein, 146 aa, Glycine max
  Coding DNA Sequence Number=SeqID_33282
TLGFPALIPGLCQSFGVPVAPSKGDAPQAADAPPPHQVGPAGSFDTEQYLRHLVRQQAANHRAHVQTHDCLYQMSLSLQSQGFTSFPCPTMDQFRAEVTWPGDWPEARAGEAPAKVPAEAPDEADEAREEEEMTDLLDFLGGSGAT

SEQ ID NO: 124968 - protein, 81 aa, Glycine max
  Coding DNA Sequence Number=SeqID_33283
  Homolog annotation: Hit_ID=A0ST23; Match level="QueryCoverage=33%, HitCoverage=55%, E-value=2e-08, Identity=100%"; Hit description =Putative reverse transcriptase
MYLSLLDALRYLLVIKLIDTVDLEGGPVGKPVVPAALMNRPTRGERRFAYWALAECILAYYVGTDEGVSEVLHVAGEKRLH

SEQ ID NO: 124969 - protein, 232 aa, Glycine max
  Coding DNA Sequence Number=SeqID_33284
  Gene Ontology: Mol. function=nucleoside-triphosphatase activity; Cellular component=alpha DNA polymerase:primase complex; Biological process=DNA replication, synthesis of RNA primer
  Homolog annotation: Hit_ID=Q8KA79; Match level="QueryCoverage=100%, HitCoverage=94%, E-value=2e-98, Identity=75%"; Hit description=DNA replication protein dnaC
  Pfam annotation: Domain name=IstB; Domain location=41-204; Score= -30.2; E_value=1.2e-06; Accession=PF01695.8; Description=IstB-like ATP binding protein
MPADVQPKFKNGAELLAWNQEQGRLRSEAIVRENRAMKMQRIMGRSGIRELHMNCSFDNYRVENDGQRKALSLAREYAAGFENSIASFVFSGRPGTGKNHLAAAIGNDLILRGKSVLIVTVADLMSSMKGTFSGGSDLTEERLLQDLSHVDLLVIDEIGMQSESRYEKVIINQIVDRRSSSKRPTGMLSNLDPAGMNTLLGERVMDRMRLGNSLWVRFDWESYRSRVRGDEY

SEQ ID NO: 124970 - protein, 251 aa, Glycine max
  Coding DNA Sequence Number=SeqID_33285
  Homolog annotation: Hit_ID=Q9AVH2; Match level="QueryCoverage=47%, HitCoverage=46%, E-value=6e-60, Identity=85%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRWILPAARWELRFKASRRANPPHEGHQRHVPLGGRGPLLLVGKRTAGARVASSPDSDLEAFSHNPTHGSFAPLAFQPSAMTNCANQRFPLGKTNLSHDGLNPAHVPYWWVNNPTLGEFCFTMIGRADIEGSKSNVAMNAWLPQASYPCGNFSDTSSFKFRRTKGSIGHAFT

SEQ ID NO: 124971 - protein, 57 aa, Glycine max
  Coding DNA Sequence Number=SeqID_33286
MTGPEKTVSFLDTTSRGSKVPQWDKQNPCEILAPLFSHPRSNVSYMAKMATTGLSLP

SEQ ID NO: 124972 - protein, 61 aa, Glycine max
  Coding DNA Sequence Number=SeqID_33287
MNLFGGTERFEQLKLSLLVDGFSKVSVDKWMDITDMGYVIASRYNVILVSVSQQQSMTFSL

SEQ ID NO: 124973 - protein, 73 aa, Glycine max
  Coding DNA Sequence Number=SeqID_33288
MGRVAILKPIMFWGIARGTQQDCWCTQQFFRIPKIPLNVSVEEPSSAVNVTTVEEPSSVPSHGRTSSGGSHRR

SEQ ID NO: 124974 - protein, 140 aa, Glycine max
  Coding DNA Sequence Number=SeqID_33289
MADFPRGSANVRTNPLTNHGGGAVNVVESDRPRRSKPLKDVATPRRFIFEALQKGGIVTADDRSRSTGSWQWRKRRAAYMHVVHGWEQCCEAQTLATDVSSLSAKVTNITGLSGVTRSGRVFAPPDLPVQPANVKGKGKV

SEQ ID NO: 124975 - protein, 199 aa, Glycine max
  Coding DNA Sequence Number=SeqID_33290
MIMRGQDIYSSQDEATTSPSSSESEEAKWEESSEEIYPQEDGQPLVVKEKCKEVSVSSKRLAKKETHFTIKTNIKETFPLRQPPNFLFCKKTLASIATPLGLGFIPQVKKLLDEGLVRKSLNPCAFLVPKIGIIRHQVPKIGGMMNVLSGATLLCKITRTLHVHGVERRSLEYEEPQDLRSNPFQGGGNDAILPRKGIG

SEQ ID NO: 124976 - protein, 30 aa, Glycine max
  Coding DNA Sequence Number=SeqID_33291
MESFDAHARCPLLPQCKALRYQSLPFVMTL

SEQ ID NO: 124977 - protein, 92 aa, Glycine max
  Coding DNA Sequence Number=SeqID_33292
PHQLDLAPYASGPYNAQWNAPGLLHDKHTLRSSRILGEMEVDEPWLGLSRCKIHFLVGVFGMAFGDNWAVGKEKVCYWLSNDIVGLVGNLAV

SEQ ID NO: 124978 - protein, 116 aa, Glycine max
  Coding DNA Sequence Number=SeqID_33293
  Gene Ontology: Mol. function=sodium channel activity; Cellular component=integral to membrane; Biological process=sodium ion transport
  Homolog annotation: Hit_ID=A9ZLE9; Match level="QueryCoverage=44%, HitCoverage=100%, E-value=4e-15, Identity=75%"; Hit description =Putative uncharacterized protein
MVVTGKKLVVGPWVGSIGPPPVCTGRLVPSAGDALLSLTGRVVPPHGITPQDSDPIVLAFGIGVMINRDSRGHSYFIVRGEILGFMKDEQLRKHLPRMFSLIKNESWGLEDDQIPS

SEQ ID NO: 124979 - protein, 22 aa, Glycine max
  Coding DNA Sequence Number=SeqID_33294
MELSKLHDDDPSNFDDAKSPSD

SEQ ID NO: 124980 - protein, 231 aa, Glycine max
  Coding DNA Sequence Number=SeqID_33295
  Homolog annotation: Hit_ID=A8AFU1; Match level="QueryCoverage=66%, HitCoverage=68%, E-value=4e-07, Identity=25%"; Hit description =Putative uncharacterized protein
MSRIQTPYSHIIDEYNKMISKNIKAIDSLSHSSNIRQIADDTSFTLSTGEIIIVLEGVIAVEMQEHNFILAPGKAKTQAKKLFQVGKGIKGMFFGIVESYGPGIQLHYTAKKNVKVFSCNLEYFEKHFTQPDKFTFLMNMMAITLAFLLDAHDERAIDTRYFVIRSMIYRYLKQKNEGVLHDPSLANFILRRTKMSRSYLFQVLSDLKNGGYITMKNGELVDIVNELPEKY

SEQ ID NO: 124981 - protein, 248 aa, Glycine max
  Coding DNA Sequence Number=SeqID_33296
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=42; ConfidenceScore=5.15e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSISLDKISLGLDIRDHRIEVTLKKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGE

SEQ ID NO: 124982 - protein, 63 aa, Glycine max
  Coding DNA Sequence Number=SeqID_33297
MAQDLGAIAEDLERVINLRMVTEGTDLYDIMTRCLRRARGTTHPLCSDALQQETYSLLTNLIE

SEQ ID NO: 124983 - protein, 52 aa, Glycine max
  Coding DNA Sequence Number=SeqID_33298
MSIGVIRRCSFLILDRLLSGRRRLAFFRSVSVNQGNVRSASSGDASSLNLDR

SEQ ID NO: 124984 - protein, 137 aa, Glycine max
  Coding DNA Sequence Number=SeqID_33299
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=43%, HitCoverage=47%, E-value=5e-25, Identity=91%"; Hit description =Putative uncharacterized protein
MASEDKRTTFITLWGTFYNKVMSFGLKNVGAIYQRAMVAESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 124985 - protein, 160 aa, Glycine max
  Coding DNA Sequence Number=SeqID_33300
  Homolog annotation: Hit_ID=Q6WAY6; Match level="QueryCoverage=38%, HitCoverage=10%, E-value=5e-10, Identity=48%"; Hit description =Putative uncharacterized protein
MVEEFEEILGCPLGGRKPYLFTGFYPSLARISKIIQILARELDHRKQVENGVAGIPRKYLEAKARILAVSHLFRQEVRHASPLESYRSCTEKGGANWDQLLASKEGASVNWFPQWKEGRTEVLISCGGFPNVPLMGTRGCISYNLVLAIRQLGYPMRGHH

SEQ ID NO: 124986 - protein, 91 aa, Glycine max
  Coding DNA Sequence Number=SeqID_33301
MGMEDAMEEKLMLRLMLSRFAQPVWTPLFGRNRLPTKANLRKRHITLPSYRCPLCDSEEEDIGHIMFSCRMTRNLWWEALRWVNRVGPFPH

SEQ ID NO: 124987 - protein, 149 aa, Glycine max
  Coding DNA Sequence Number=SeqID_33302
MRLQFAATSVVAKVNPTSPSSLNQMNHPTLDMVGKDLGSRDGLHDPNKHAFPPQGLPPNYTPPNVAYTLNEDVNNSIPIPIESRQPQTVHAHVSQPMGEIHEIPHHNLADFEPWLGYATEGQAVGGIPLENTSEGPQYHPQLHLLHSTT

SEQ ID NO: 124988 - protein, 206 aa, Glycine max
  Coding DNA Sequence Number=SeqID_33303
  Gene Ontology: Mol. function=hydrolase activity; Cellular component =integral to membrane; Biological process=metabolic process
  Homolog annotation: Hit_ID=Q1H4C8; Match level="QueryCoverage=67%, HitCoverage=82%, E-value=7e-43, Identity=55%"; Hit description =NLP/P60
  Pfam annotation: Domain name=NLPC_P60; Domain location=92-199; Score =164.0; E_value=3.9e-46; Accession=PF00877.10; Description=NlpCP60 family
MARFRPYLIFHNPTPISKPLIVMNKSFIRLAALLVSVLLCQCKSVAAPSDDKRWQNAYSYSQEQVMENQSGVAGSWSEKVEEIMISALSLTGVDYKYGGRSPETGFDCSGFVQYVFKHAAQISLPPSARTISEMGDAVKREDLQPGDLVFFNTLRSAFSHVGIYVGNNQFIHAPRAGAKVRVESMDERYWRTRYNGAKRLEVEASK

SEQ ID NO: 124989 - protein, 62 aa, Glycine max
  Coding DNA Sequence Number=SeqID_33304
  Gene Ontology: Mol. function=selenium binding; Biological process =cell redox homeostasis
  Homolog annotation: Hit_ID=Q1H4D2; Match level="QueryCoverage=85%, HitCoverage=55%, E-value=3e-17, Identity=77%"; Hit description =SelT/selW/selH selenoprotein
  Pfam annotation: Domain name=Seleno_W_rel; Domain location=1-58; Score=27.0; E_value=7.1e-05; Accession=PF05169.3; Description =Selenoprotein W-related family
SVSLVPGTGGILEVRCDGRVIFSRKEMGRFPEAKELKQLIRDLVDPERSLGHSDSAVKGGGE

SEQ ID NO: 124990 - protein, 58 aa, Glycine max
  Coding DNA Sequence Number=SeqID_33305
MVPFIALVQGFEAQSLSFAMTLQQGTYWVRTSNLPLGSSASKFYSGQESKKVKIYDQV

SEQ ID NO: 124991 - protein, 230 aa, Glycine max
  Coding DNA Sequence Number=SeqID_33306
MTQELVARGDTLGLSAPRHSVTPSVIHEQRPIWSSAPFPEMSAFSDGDFSSLTSGGPDDTRRYPYGYPAPFCHPEAAGPDDKQRPSLGHSAPLVSSRGRRAPMIRGDTLRLSAPFCHPEAAGPMTSRDPSLVILHPLYHPEAAGPMIRGDTLRLSAPFCHPEAAGPMTSRDKIWSFCTLVSSRGGGPDDTRRYLTVIRTLLSSRGGGPDDKQRQNLVILHPCIIQRRRAR

SEQ ID NO: 124992 - protein, 66 aa, Glycine max
  Coding DNA Sequence Number=SeqID_33307
MVVLVGETEGPPKCFQRVYHQLIALQWHIRAKARSQLDCDGEFHVSPPRFKRHVHDQFGVVGSQWV

SEQ ID NO: 124993 - protein, 115 aa, Glycine max
  Coding DNA Sequence Number=SeqID_33308
  Homolog annotation: Hit_ID=Q6WAY3; Match level="QueryCoverage=79%, HitCoverage=4%, E-value=2e-07, Identity=36%"; Hit description =Gag/pol polyprotein
MDLSKNTPKRWRDLAAQVVPPMMERETMIVMVDTLSILYYERWWATHPQSFADLVFASERIDVGPKRGKFDHPTRTTEKTGANKEGEDEGETHALTAIPIRPSFPPNPTMSLLSQ

SEQ ID NO: 124994 - protein, 179 aa, Glycine max
  Coding DNA Sequence Number=SeqID_33309
MTLFMDMDDDAISTFCPATTMPISLADRISAHKTPVDPKEVQQGPGVSSSGYGPLSVLQGAHSPSKESHPQRHPVDPEKSNRALGFLALESHPQRHLVDPEKSNRALGFLALVTGLRSPTGCPFPPARSRHPDIGITPVRHPVDPKKSNRVLELPSSNYGPLSVLRSACRPQQGHQAPY

SEQ ID NO: 124995 - protein, 92 aa, Glycine max
  Coding DNA Sequence Number=SeqID_33310
MEEGFSKGSVPIVATYPSAEGRRVTRGMRVPRKEYARSRHQRLFEENVGKTGKDAIYELLSERFGSCIYARGRVFPFDPTYSSICDEEIRPT

SEQ ID NO: 124996 - protein, 77 aa, Glycine max [sequence omitted]

SEQ ID NO: 124997 - protein, 85 aa, Glycine max
  Coding DNA Sequence Number=SeqID_33312
  Subcellular localization annotation: CTP_CleavageSite=76; ConfidenceScore=5.31e-01
MRGNPLGATCFIKILGSSSRVHPIGISNFFGFFPVNAHPTNVFWVDVPSPVVIHERVMSRGVDAFKLAKSQLFGTRMGTEVEFWK

SEQ ID NO: 124998 - protein, 181 aa, Glycine max
  Coding DNA Sequence Number=SeqID_33313
  Gene Ontology: Mol. function=sodium:hydrogen antiporter activity; Cellular component=integral to membrane; Biological process=sodium ion transport
  Homolog annotation: Hit_ID=A3M1G7; Match level="QueryCoverage=100%, HitCoverage=47%, E-value=6e-86, Identity=88%"; Hit description =Putative membrane protein
  Pfam annotation: Domain name=Na_H_antiporter; Domain location=1-175; Score=72.7; E_value=1.2e-18; Accession=PF03553.5; Description=Na+H+ antiporter family
MILGGLVGFAVLSTAGIFKWQDADDVFVQGMRMMALVGFIMISAAGFASVMTHTGDINQLVNGVVDIIGDNRALAAFLMLCIGLFVTIGIGSSFSSVPVLAVIYVPLCVQFGFSPLATIALIGTAAALGDAGSPASDSTLGPTAGLGVDGQHDHIWDTVVPTFIHFNIPLLIFGWIAAMVL

SEQ ID NO: 124999 - protein, 90 aa, Glycine max
  Coding DNA Sequence Number=SeqID_33314
MGAIVPLLDPTCDPLGSGNYNRKLVVPFIFFIEKLDHGLHHCGHYRSFHGLHGSAFILGSAPPLLHPYSSSSTSSVKGRRKACPFFLITN

SEQ ID NO: 125000 - protein, 235 aa, Glycine max
  Coding DNA Sequence Number=SeqID_33315
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=51%, HitCoverage=18%, E-value=1e-44, Identity=75%"; Hit description=Mini -chromosome maintenance protein MCM3
  Pfam annotation: Domain name=MCM; Domain location=80-220; Score= -208.2; E_value=0.00057; Accession=PF00493.14; Description=MCM235 family
MKTRCPDGLFLYPENSAHGQLPRTVDVIAEDDLVDSCKPGDRVAIVGIYKALARKRTVLIANNVSLLNKEDNAPIYSVEDVKNIKEIATRDDAFDLLSDSLAPSIYGHSWIKKAVVLLMLSGVEKNLKNGTHLRGLEFSLDLLSLLNPTKFLGNIVVEHDYAECTGSAIQALVLFKKLYPRHRETEIKNSIANAVHAASKTYTNCAAIRKTIKFLLSTLKEDGRWGESYLSCPKQ

SEQ ID NO: 125001 - protein, 201 aa, Glycine max
  Coding DNA Sequence Number=SeqID_33316
  Homolog annotation: Hit_ID=A6TGL4; Match level="QueryCoverage=100%, HitCoverage=100%, E-value=2e-97, Identity=87%"; Hit description =Putative uncharacterized protein yigP
  Pfam annotation: Domain name=SCP2; Domain location=12-113; Score =81.5; E_value=2.8e-21; Accession=PF02036.8; Description=SCP-2 sterol transfer family
MPFAPLVTAGIETVLNTFLWRDRALKPARQRLLGKVLRVELKELSAPVVLAYSEQQIDVLGAWEGEADCTVITRLSVLPQLRNRQQLTALIRSGDLEVQGDLQVVQNMVALCDLAEFDPAELLAPYTGDIVAEGVGKVLRGGARFLLQGAKSQQRYVAEAITEEWRLAPGPLEMAWFAEESAAVERALAALEKRLETLEGK

SEQ ID NO: 125002 - protein, 664 aa, Glycine max
  Coding DNA Sequence Number=SeqID_33317
  Gene Ontology: Mol. function=cation transmembrane transporter activity; Cellular component=integral to membrane; Biological process=cation transport
  Homolog annotation: Hit_ID=Q01V83; Match level="QueryCoverage=64%, HitCoverage=39%, E-value=1e-93, Identity=42%"; Hit description =Acriflavin resistance protein
QYVHQGDVLFELDARSADEAVSKAEVAVEFAQKGFERKEALYANNDTSLKLYKDAEQQLETAKKDLSNARTQREILRIKAPLSGTISTIHYKIGESISVNTVMADLMDLKRLDVALKVPTTEVAAIHTGQQVEVFADDSSSAKPYTGKVDPTTDTVLVRASFASDDRIRPGQFVSARIQTVRLPDQLAVPQASVLHGDSGDYVMLVSGQIAKQYPVKIGIKDHGWVGLAGATLKPGMQVVTEGLYAALQMPSSIFPQTNFPRVVILLDNGVMPSNEMMATITRPVEESMKDIPGVENVRSKTGRGTAEVNVFFNWHTDMTQAELYVRGKMAMVQKTLPPTANYSVSRLTFSAFPVMGLSLTSDKHDVTQLWETARYTIQPKILRLKNVAKVGIVGGRVPEYHIVVDPLKLQALHFGISQVADLVARSNVIAPAGMLEEDYKLYLTVTDGRIHGTEELENLVIAAPNPASAPGSLGGNPAATGIADHPVRIKDFARVERNKEPAFYEVTADGKNAVLINVYSQPDGSTLDIAQAVKAELISINKSLPPGMKVQFFYDQSELVADSMQSVWEAILVGLVLSMAILYLFLQNWGTTLVASIVIPVTVCFAMLGLKVAGLGFNLMTLGGIAAAIGLVIDDAIVVVEIIHAKMQHGQQRLAAITEGLSE

SEQ ID NO: 125003 - protein, 140 aa, Glycine max
  Coding DNA Sequence Number=SeqID_33318
MAPKKLSAKRSRRDVAAEGTNAAPEFNSHRFRSVEHQQRFEAIKGWSFHRERRIQLKDDENANFQEEIFHRRWTSLVTPMAKFDPDIVLEFYANAWSTEEGVRDMRSWVRGQWIPFDADALSQFLGDPLVLEEGQECEFS

SEQ ID NO: 125004 - protein, 124 aa, Glycine max
  Coding DNA Sequence Number=SeqID_33319
MRVWYCEAPNPYDRWYDEYVEWCNHLFCKITHASNVFMIHIHRDSLGSDQGVPTDPKKIKVIPEWLTPPTPPIELVWNHVPSWEDAQERGVEGRSPEFQEPLDLRSNPFQGGGDDAILTPKGIG

SEQ ID NO: 125005 - protein, 42 aa, Glycine max
  Coding DNA Sequence Number=SeqID_33320
MDDFSEPKDKESFHHNNDQSDDQSNDEGVVIPTLPPLQYHQP

SEQ ID NO: 125006 - protein, 298 aa, Glycine max
  Coding DNA Sequence Number=SeqID_33321
  Homolog annotation: Hit_ID=A7QJ53; Match level="QueryCoverage=55%, HitCoverage=62%, E-value=1e-39, Identity=56%"; Hit description =Chromosome chr2 scaffold_105, whole genome shotgun sequence
MVALSFQGGRASPAQPQHPSLCSGRAAGVIRIRCGIAEPSGEPAPLGQKTRYHDGIFEKAFMTLFARKMEKFSDPPAGKARENKGWWDWGYDYESFVDVSRRVMQRRSRIQQQQVVREVLLSMLPPGAPAQFRKLFPPTKWAAEFNAALTVPFFDWLVGPSEGIQDSRLNTKIKLWESCFWFFRCFFVIKNIQEIMSNTIRIEKFNGKNSFNLWRIKMRALLKEQRVWAVVASASVKKEVTSESKEKATISKTEELAEQEEKAHSLILLSLSDEVLYEVANEETASGLWLKLEKLYMT

SEQ ID NO: 125007 - protein, 149 aa, Glycine max
  Coding DNA Sequence Number=SeqID_33322
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=71%, E-value=1e-24, Identity=69%"; Hit description=LacZ protein
  Subcellular localization annotation: CTP_CleavageSite=50; ConfidenceScore=5.48e-01
MGVFPFLLCNLSAMPGANLLAMGSSSDSTSSRSMREDFSIWGGDVGTSLSASGTSNSCSPGDPLVLERPPPRWSSNSPYSESYYNSLAVVLQRRDWENPGVTQLNRLAAHPPFASWRNSEEARTDRPSQQLRSLNGEWDAPCSGALSAG

SEQ ID NO: 125008 - protein, 86 aa, Glycine max
  Coding DNA Sequence Number=SeqID_33323
MTKMMTKSPKNDFKIESTSSRSSLISREEIKKIQESREVDFKIQEKMNSRFKKRNQEDFTREVFLKVITLPMVFLTRLEEFIKARP

SEQ ID NO: 125009 - protein, 590 aa, Glycine max
  Coding DNA Sequence Number=SeqID_33324
  Gene Ontology: Mol. function=peptidase activity; Cellular component =cytoplasm; Biological process=isoprenoid biosynthetic process
  Homolog annotation: Hit_ID=A1FT16; Match level="QueryCoverage=44%, HitCoverage=89%, E-value=1e-118, Identity=85%"; Hit description =ThiJ/PfpI precursor
  Pfam annotation: Domain name=DJ-1_PfpI; Domain location=431-578; Score=9.9; E_value=0.00051; Accession=PF01965.15; Description=DJ -1PfpI family
  Subcellular localization annotation: CTP_CleavageSite=58; ConfidenceScore=5.33e-01
LSPARQATARDQPHSPKIGSNPTPRSSLADSTNAILNRIPHQQLNHCPRRGRLPPMRRIDHRERPRPPPQLRQHFYQLPALQPLAHDELIALADADALFGQRHHAQHIVGGLDGRTRQPVHVASTVAEDPRGQPPGARHHKRQAQVLLQVVQRLRRTPALQIVRRGHQQQRRILKLPPHQPAVRQLAQADGQVEAFGHQVHVAVGDVQFHLHLRVLLRKARQHGRQPVVAIGGGHAQAHAAGQRTVLGQYVALGVVQQAEGGAHLFQIEPPGVGQAHAAGGPLQQLPAQPRFQAGDRAAQHRGRGGQRHRAGSERAVLDHRQEHLHIAQVVELAAHLALRGTDVLRWGQFIAAGAMNKAANVLVVLSDESHLDLKDGKVLSTGFYLNELMQPVKLLLDAGHEVTFATPQGRAPTVDASSVTAAYFGNDAAQLTLHKELLEKLALTSPTASPVVSLARIEQQGYARFDAVYIPGGHAPMQDLLNSPALGRLLADFHQRNKTTALVCHGPIALLSTLPDAVGSVAKLDAGAMPATPKWIYSGYQMTVISNQEEAQAKPLLGGREMKFYPQTVLQRAGAEFSSDTTPWTGAVV

SEQ ID NO: 125010 - protein, 251 aa, Glycine max
  Coding DNA Sequence Number=SeqID_33325
  Homolog annotation: Hit_ID=Q8PR16; Match level="QueryCoverage=48%, HitCoverage=50%, E-value=1e-18, Identity=44%"; Hit description =Putative uncharacterized protein XAC0151
APAQEPVATQTHSLAPSIQAEVADAVPATARLHEAEATPAPVQLEPDVPAPLAAAEAAAPRVSEHEPPYAPPPVEALAVPPSSATAQQEPEAPPAPLLPTQPEHPDHALYQQVRTGVATLDAKHGRTFDESSERMTASLLVLAKDNDLDRVDHVLLSNATADKPAGHTLPPSWSLCLPIGAIDIAAQSEEQTRSLNGRERIGLPHRLQKKQKVAVEQRKVVGERHALFTRCSAEAYLPDIARIDDVGRSGD

SEQ ID NO: 125011 - protein, 173 aa, Glycine max
  Coding DNA Sequence Number=SeqID_33326
  Homolog annotation: Hit_ID=Q84VI1; Match level="QueryCoverage=88%, HitCoverage=40%, E-value=9e-39, Identity=73%"; Hit description =Envelope-like protein
MDLIKAAGLLKTVTKLGDCYEGLVREFIVNIPSDISNRKSDDYQRVFVRGKCKDVPTSSAPNAEALPSPSEEGSTEEDDQAAEETPAPRAPEPAPGNLIDLEEVESDEEPIANRLAPGIAERLQSRKGKTPLKRSGRIKTMAQKKSTPITPATSRRSRLLSPPRRGKKFPHPI

SEQ ID NO: 125012 - protein, 187 aa, Glycine max
  Coding DNA Sequence Number=SeqID_33327
  Gene Ontology: Mol. function=helicase activity; Biological process =viral genome replication
  Homolog annotation: Hit_ID=A2Q378; Match level="QueryCoverage=86%, HitCoverage=13%, E-value=3e-33, Identity=36%"; Hit description =Putative uncharacterized protein
  Pfam annotation: Domain name=DUF889; Domain location=30-186; Score =20.8; E_value=6.8e-13; Accession=PF05970.5; Description=Eukaryotic protein of unknown function (DUF889)
MCHKFSYEALDKSLKDIMYNDRPFGGKVIVFGGDFRQILPVVPRDIGDGKLGQPNDGHCEIAIPNEFLIMDFEDPIQAIVDATYPDLLQNYNNADFLQKRSILASSKDVVDKINDYVLSLIPGDKKEYCSADSVDKSDELLNLAFGLLTPNFLNTLKTSGIPKSQAKNQDWYSHHTMKFRPDRWFMQ

SEQ ID NO: 125013 - protein, 65 aa, Glycine max
  Coding DNA Sequence Number=SeqID_33328
RAFAKRDTQWLSTRKNPEEDELSGSLSAPLQVIKRTASAYPLSERSALSHNPLMRTKRSRFALSA

SEQ ID NO: 125014 - protein, 158 aa, Glycine max
  Coding DNA Sequence Number=SeqID_33329
MDKSLKVGEVSGSIFIQIMMATKWSAMKMLTGHQIEWTHLVRYRMHKALQANAPLSYPQLVTLFFQHFNVPLDDEPFVKVKRYFAIGAAVVASYGYRKDMDGQWVWTQDLPPTVPYEHTPSPPPQRDSSSSLLHESLSELWDLRVIVEVIILMLWIPV

SEQ ID NO: 125015 - protein, 67 aa, Glycine max
  Coding DNA Sequence Number=SeqID_33330
  Homolog annotation: Hit_ID=Q6WAY3; Match level="QueryCoverage=89%, HitCoverage=2%, E-value=6e-08, Identity=43%"; Hit description =Gag/pol polyprotein
MSPVKQLVNQVEEGEDEDWGLSPELKRMVKQEDREVKPHQEEKKIVNLGVGKERKEVKVGTCMSTNV

SEQ ID NO: 125016 - protein, 178 aa, Glycine max
  Coding DNA Sequence Number=SeqID_33331
  Subcellular localization annotation: CTP_CleavageSite=79; ConfidenceScore=5.79e-01
MVTSPRPSGKSTGTSFMECTAISARFSSIASSSSLTNSPLPPTFASGVSRMTSPLVTIGASSTCKPGCAAIRRCWTYCACHKASGLCLGNAVSFNGLTRLQSQTGARFLRRQILRLESENAGLRLERAKLSGSATFFTVNLPAACRSRTSCHGTCFPARLQSAANITALSSSADAGLP

SEQ ID NO: 125017 - protein, 135 aa, Glycine max
  Coding DNA Sequence Number=SeqID_33332
MKEIKREKHASDSSHDSCKSLSEEHSDYYRGHHSSHTKHHSQRKEKERKPQEANINLSYLHGKDNVEPNLDWEIRVEQQLKRKSTSKSYGSHSYPNKDQALGILGAAPSKPKDDKGKTIEKKPPKASRQEKTSSI

SEQ ID NO: 125018 - protein, 105 aa, Glycine max
  Coding DNA Sequence Number=SeqID_33333
MLPFDFRCVTKTYGLCINIFLVFRHVLEFHKLPNDGCQAPHKDQRKVACHQAKESHEDSTYGGFNPFSVSLTFRNSIRAVRGKIGQISGNCKRCRYRSRKTRESA

SEQ ID NO: 125019 - protein, 238 aa, Glycine max
  Coding DNA Sequence Number=SeqID_33334
  Gene Ontology: Mol. function=phosphoprotein phosphatase activity
  Homolog annotation: Hit_ID=Q5XM22; Match level="QueryCoverage=52%, HitCoverage=84%, E-value=1e-34, Identity=50%"; Hit description =Resistance-like protein HAAS-2
ASLLHVPITGALHKFEPLVTSDPIGLLTELLEVSHEEATFETRQAGRPHVRLGWLQDLYESQCRARRWVVAARTYLLHLVGCTLFANKSSTHVHVMHLEAFRDLAQVGGFSWGAAALVHMYEHLNDASQASTRQLGSYIILLQCWIYEHFPIVHTCVVHDAYDEGSPRVCRWLTGKAHMTGIKGAPYRRRLDALTVTDVCWMPYAEHRGVRGFDLISSYTGQLRWGQIVVYVRPERVL

SEQ ID NO: 125020 - protein, 195 aa, Glycine max
  Coding DNA Sequence Number=SeqID_33335
MFAFSEKQRDFFKSHKYPELRRSEFLIGGYVGARASLLSTTPPFVAMTQELVARGDTLRLSAPHHSVTPSVIHEQRPIWSSAPFPEMSAFPMETFQVSQVIKNYVEAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 125021 - protein, 76 aa, Glycine max
  Coding DNA Sequence Number=SeqID_33336
MMTKVMTKSSKNQEHFKTQEESYRTLQDSRGKLNSRIKNQDSRIKLPRIKIKLQTQDSRIKKELNQDSMKGFFKTE

SEQ ID NO: 125022 - protein, 121 aa, Glycine max
  Coding DNA Sequence Number=SeqID_33337
HPVDPEKSNRALGFPALVTGLCQSYRVPVPPARSRHHDIGIAPTKAPSGPGEVQQGLEFYGVPVTFSKGIRPPTNRAFIKKYCVPRQAQGETQQQPGDGRQRAIDAPPSPLEFTSAHPQKG

SEQ ID NO: 125023 - protein, 128 aa, Glycine max
  Coding DNA Sequence Number=SeqID_33338
IAGARGRVYRPRHGIESSKWAIFGKQNWRCGMNRKLGYGAQLRANLDPTKGVGRLRQQDGGHGSRNPLRTPMSRRARRSLQNPGREPGRSGRRCRSGGSSESIPGNEKALKREGQRVPCERHCTSGVG

SEQ ID NO: 125024 - protein, 41 aa, Glycine max
  Coding DNA Sequence Number=SeqID_33339
MDSKHFYGLFVGVTQGLNVWKKRQDQKEKGGKYSIKMGQKD

SEQ ID NO: 125025 - protein, 84 aa, Glycine max
  Coding DNA Sequence Number=SeqID_33340
  Subcellular localization annotation: CTP_CleavageSite=28; ConfidenceScore=5.22e-01
MRLSRANEPTSSLPVISTWLVQTNRQASCTEKSHFQSSSSAPSNGSMIEREEKRLVYRVCCSSDENNEEEEMEYPEPRSAVGFY

SEQ ID NO: 125026 - protein, 173 aa, Glycine max
  Coding DNA Sequence Number=SeqID_33341
MGSVLIPTVNNQRRGSTKSKSKVISKENFEAPEEDAEVQALKSELGKAKLAKEKFKLAATHVRKECAGLREENTITARALEQETKRARKEEYGRNKFREALWGSNSELKLRREERDQSRAHSMVLKEELIACSRSKRSLSQRLCETETNMLAIIAKYEEELGLATAHEHRIAD

SEQ ID NO: 125027 - protein, 38 aa, Glycine max
  Coding DNA Sequence Number=SeqID_33342
MEVDEPWLGLWLPLNCIGHRNSGGVRHWKCGRQALWLI

SEQ ID NO: 125028 - protein, 172 aa, Glycine max
  Coding DNA Sequence Number=SeqID_33343
  Gene Ontology: Mol. function=monooxygenase activity
  Homolog annotation: Hit_ID=Q6T4Q1; Match level="QueryCoverage=20%, HitCoverage=62%, E-value=3e-10, Identity=83%"; Hit description =Cytochrome P450 monooxygenase
VPPQPNSPPDNVFRPDRPAEADLGSKKRGSAPLPIHGIKAPKGPVPNPSPRPGTRRPALAAEAARAVHRQPTGSGLGPPCPSPQSPIPFPEVYGSILPTSLAYIVPSTRGCSPWRPDAVMSTTGRGRHSVLRIFKGRRGRTGHHATCGALPAAGPYLRLSRFQGGQAVKQKR

SEQ ID NO: 125029 - protein, 82 aa, Glycine max
  Coding DNA Sequence Number=SeqID_33344
MGVQIAPRPIWALQKIPPEGENLSRGASERFRNVFREESRKGFNRSSTFFIRSSSFFDLQRVSTSNQAFRFILCTHRGPHCV

SEQ ID NO: 125030 - protein, 216 aa, Glycine max
  Coding DNA Sequence Number=SeqID_33345
  Gene Ontology: Mol. function=nucleoside-triphosphatase activity; Cellular component=DNA replication factor C complex; Biological process=DNA replication
  Homolog annotation: Hit_ID=Q9CAM7; Match level="QueryCoverage=38%, HitCoverage=24%, E-value=5e-24, Identity=72%"; Hit description =Replication factor, putative; 74998-73295
SLHYSVEHALPPNELSKMPAMDVASKGRNFRTIDPNEYAFSPTAKKPVENMPFEIRSDEPLKSMSLSSSSNAYNVPWVEKYHPIKVADAVVNEDAVSRLQVIARNNNMHNLILSGPPRTIKTTSILALMHKLLGGPNCKEAILELNASDESDVYEEERHALAVWNGDFKFCSISVPDQGEGELAQFCSGNCFWDIKDVCSEECHAEPGEAQDSDTG

SEQ ID NO: 125031 - protein, 173 aa, Glycine max
  Coding DNA Sequence Number=SeqID_33346
MERETIIVMVDTLSILYYEKMVGYTPSSFTDLVFASKKIEVDPKRGKFDHPTRTTEKTGANEEGEDEGETHAVTAIPVRPSFPPTQQYLYSANNKLSPYPPPSYPQRPSLNLPQTITLSKVHQPPFLREYDSNATCACHGEAPGRSIEHGRALKRKVQGLIDAGWLKFEENCV

SEQ ID NO: 125032 - protein, 132 aa, Glycine max
  Coding DNA Sequence Number=SeqID_33347
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=22%, HitCoverage=29%, E-value=6e-11, Identity=100%"; Hit description=LacZ protein
MKHFTDTLISANIGTKAGTGPPLEVDGIDKLDNKSVIAGLGVAAAATATAAAAAVGMGAKPEAHPPFASWRNSEEARTDRPSQQLRSLNGEWDAPCSGALSAAGVVVTRSVTATLASADVRRCFCRYAPPRQ

SEQ ID NO: 125033 - protein, 286 aa, Glycine max
  Coding DNA Sequence Number=SeqID_33348
  Homolog annotation: Hit_ID=Q9AVH2; Match level="QueryCoverage=63%, HitCoverage=75%, E-value=6e-67, Identity=63%"; Hit description =Putative senescence-associated protein
VGGAGLWPRAKFRIGWPPPPPREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANHAHVPYWWVNNPTLGEFCFTMIGRADIEGSKSNVAMNAWLPQASYPCGNFSDTSSFKFRWTKVSIGHAFTVRIRTGNQNQTSFYPFVPHEISVLVELILGHLRYLLTDVPPQPNSPPDNVFRPDRPAEADLGSKKRGSAPLPIHGI

SEQ ID NO: 125034 - protein, 85 aa, Glycine max
  Coding DNA Sequence Number=SeqID_33349
MTILISRELPLFNFERLDILCDEDMTKSKGKDPLEGLGGPMTRARARKAKEALQQVLSILFEYKPKFQGEKSKVVSCIMAQMEED

SEQ ID NO: 125035 - protein, 113 aa, Glycine max
  Coding DNA Sequence Number=SeqID_33350
  Subcellular localization annotation: CTP_CleavageSite=72; ConfidenceScore=5.07e-01
MWRHPTVTHKHSFAIRPDSESARGKQPVRHAETNVVFCTFVIQRRRKSVTCGETQVGRDTQVVMGINTLSLSARLRVGLHAETNVVFCTLCQSGASKPVDTRRLISSSAPLSS

SEQ ID NO: 125036 - protein, 97 aa, Glycine max
  Coding DNA Sequence Number=SeqID_33351
MAAEWRRKRERRCHFKEKMSLEEAHHHRRPWIRAWRKKEMNEGRERKILSRNASRPTSITSCSTKCVVMRHEKLRTCTKCELYDGQWGCKQMLTLPS

SEQ ID NO: 125037 - protein, 217 aa, Glycine max
  Coding DNA Sequence Number=SeqID_33352
  Gene Ontology: Biological process=transposition, DNA-mediated
  Homolog annotation: Hit_ID=Q6UUU1; Match level="QueryCoverage=32%, HitCoverage=46%, E-value=1e-18, Identity=71%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 125038 - protein, 99 aa, Glycine max
  Coding DNA Sequence Number=SeqID_33353
MHIHGEDRKGKGDENNEDFHSDEIKTDADLPREWRVSRYHPLDNIIGDISKGYLAPFVAQYVKSRDAPEIKRKLVTPSVKFCNVTETKKKYCYAIREFP

SEQ ID NO: 125039 - protein, 86 aa, Glycine max
  Coding DNA Sequence Number=SeqID_33354
  Gene Ontology: Mol. function=structural constituent of ribosome; Cellular component=ribonucleoprotein complex; Biological process =translation
  Homolog annotation: Hit_ID=Q67IB9; Match level="QueryCoverage=81%, HitCoverage=53%, E-value=7e-22, Identity=74%"; Hit description=30S ribosomal protein S7
  Pfam annotation: Domain name=Ribosomal_S7; Domain location=1-77; Score=-48.6; E_value=3.3e-05; Accession=PF00177.12; Description =Ribosomal protein S7pS5e
MKRSTKTETNPLSVLRQAIRGVTPDIAVKARRVGGSTHQVPVEIGSTQGKALAIRWFGPHHGFCKIFQDSKKQEKIAGFLEIGCSY

SEQ ID NO: 125040 - protein, 117 aa, Glycine max
  Coding DNA Sequence Number=SeqID_33355
EQRETPLSTTKRKNIKGYKDIKGNVKIKVTFAHSIKGCPSLGTDVWGANTFPVRKYNSRTFHLKVRRSRLFRFFRRFPQINVGGDSARIPFVEHASRESRVALPPKGRLRQYFSMNV

SEQ ID NO: 125041 - protein, 132 aa, Glycine max
  Coding DNA Sequence Number=SeqID_33356
MLLSSNVIYIYVRVVMLVRMIHTRLFAAARVKSCPSMHSSCVIASLSGCARTVGPPPISGGGPGIVWMWSTLKMRTRSPLKVRACNPLRVRTCSPLRVRTCSPLKVRTCSPLKSSDGEGVKPSEVRACSPTK

SEQ ID NO: 125042 - protein, 57 aa, Glycine max
  Coding DNA Sequence Number=SeqID_33357
MTTFRKVDGLSTFNVLGAKLNSLFSNIPFDNQSFGTNKPTGNRLQDVVIDYRLPVHV

SEQ ID NO: 125043 - protein, 88 aa, Glycine max
  Coding DNA Sequence Number=SeqID_33358
AFPGIKQGDTQDFILFLAKVILPVTAVPSCSATDGGGGVTAKSTRPDISAGKCSGPAARNHHTPPRLMRRYRARPIRHSGCATVGKGD

SEQ ID NO: 125044 - protein, 240 aa, Glycine max
  Coding DNA Sequence Number=SeqID_33359
MIRGDTLRLSAPFCHPEAAGPMIRRDTLRLSAPFCHPEAAGPMTSRDKIWSFCTLVSSRGGRPDDTRRYLTVIRTLVSSRGGGPDDTRRYLTVIRTLVSSRGGGPDDTRRYLTVIRTLLSSRGGGPDDKQRQNLVILHPCVIQRRAGPMIRGDTLWLSAPLCHPEAAGPMIRGDTLRLSAPLCHPEAAGPMIRGDTLRLSRTLVSSRGGGPDDTRKYPSGYPYKHSFAICKTERLIACRG

SEQ ID NO: 125045 - protein, 172 aa, Glycine max
  Coding DNA Sequence Number=SeqID_33360
MRTRSPLKVRACSPLQERMCSPLMARTYSPLKVIGTSTQGSTFMRKQEIDSSRGPVIHKIGHEILTVLLKKVIIHATLSYLLQISPGTPSKCDASSIGACRPRIFFINGFLCFLEDEWQQNGERERERRRHFKEKMSLEEAHHHRRPWIRACRKKEMNEGKGREEHEILCSK

SEQ ID NO: 125046 - protein, 81 aa, Glycine max
  Coding DNA Sequence Number=SeqID_33361
RVPFAIQAAQLLGRAIGAGLFAIRQLAKGGCAAKAIKLGKRQVGKPVVPAALMNRPTRGRGGFAYWALAECILAYYVGTDE

SEQ ID NO: 125047 - protein, 86 aa, Glycine max
  Coding DNA Sequence Number=SeqID_33362
  Homolog annotation: Hit_ID=A0ST23; Match level="QueryCoverage=31%, HitCoverage=55%, E-value=2e-08, Identity=100%"; Hit description =Putative reverse transcriptase
METKLKASEAITKTEVKAIKLIDTVDLEGGPVGKPVVPAALMNRPTRGERRFAYWALAECILAYYVGTDEGVSEVLHVAGEKKAAP

SEQ ID NO: 125048 - protein, 162 aa, Glycine max
  Coding DNA Sequence Number=SeqID_33363
MVGYTPSSFTDLVFASKKIEVDPKRGKFDRPTRTTEKIGANEEGEKEGETHAVTAIPIRPSFPPTQQCHYSANNKPPPYPQPSYPQRPSLNQPQSLSTALPMTKTTFSTNKKKTPTKRNFAAKSLHNPSQGSSTPFLREYDSNATCAVTEKPRGVPLSIVGL

SEQ ID NO: 125049 - protein, 179 aa, Glycine max
  Coding DNA Sequence Number=SeqID_33364
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=75%, E-value=5e-24, Identity=65%"; Hit description=LacZ protein
  Subcellular localization annotation: CTP_CleavageSite=73; ConfidenceScore=5.51e-01
MTMITPSSKLTLTKGNKSWYRAPPRAQAGVQWRHLGSLQPTPPGFKRFSCLSLPRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 125050 - protein, 240 aa, Glycine max
  Coding DNA Sequence Number=SeqID_33365
SSEVKSKRGKNLSEEIYPQEEGQPLVVKEKCKEVSVSSKSLAKKETHFTIKTNIKETFPLRQPPHFLFCKKALASIATPLGLEFIPQVKKLLDEGLVRKSLNPCALLVPKIGIIRYQVPKIGGMMNVLSGATLFCKITRTPNIFMVCVHRDPLGRGSHEPKRIKVIPEWPIPPSIRKIWGFHDLQTFTKGVEEKSPEFQEPRDLRSNPFQGGGNDAILPHKGIGQKTTPSRLGQRCKKRP

SEQ ID NO: 125051 - protein, 53 aa, Glycine max
  Coding DNA Sequence Number=SeqID_33366
MSDKESWTSGPRYWTQKIFQENDRSHPAQVVAAQIRTLLYKHEGCTSFLPVRD

SEQ ID NO: 125052 - protein, 79 aa, Glycine max
  Coding DNA Sequence Number=SeqID_33367
PLGSVQLPALISKQLDGPQQPQNKGEGYGKDEVMKDEVIASSKDLSRSIGSYKIHVLGDSCPSYGSPTSLASMGDSLRA

SEQ ID NO: 125053 - protein, 101 aa, Glycine max
  Coding DNA Sequence Number=SeqID_33368
MLVRMIRTRLFAVARVKSCLGMHSRCVIASLSGCARTVGRPPISGGAVYYDEESPLFAVPPGLLSSVESVSDADMTSSGESTSGSGPHHPLESQEHPQQAQ

SEQ ID NO: 125054 - protein, 231 aa, Glycine max
  Coding DNA Sequence Number=SeqID_33369
  Homolog annotation: Hit_ID=Q2HW90; Match level="QueryCoverage=92%, HitCoverage=43%, E-value=1e-21, Identity=31%"; Hit description =Putative uncharacterized protein
MGSSQMPFLKKRFYQVKVKSLGITSLKELGQLMGQLQWQAFRKAYDKIWDLATVEVSTEAIVSLAQYYDQPLRCFTFEDFQLSPMVEEFEEILGCPLTRRKPYLFTGFYPSLARISKIVQILAQELDHRKQVENGVVGIPRKYLEAKARILAGKGEWVPFIDILALLIFRGVLFPNVDGLVDLAVIDAFLAYHNHKESPVVAMLADLYDTFDRRCEKSNTRIVCYTSALYV

SEQ ID NO: 125055 - protein, 95 aa, Glycine max
  Coding DNA Sequence Number=SeqID_33370
MTHQDFQVQAIGQFAQATCAPEFGLPRPFNHRLLVLHVGGGAVKQRGQPFPCVQESPTTTDPRSLNPFSEIRRREEEISLKEMDCKMRIIKFLIE

SEQ ID NO: 125056 - protein, 33 aa, Glycine max
  Coding DNA Sequence Number=SeqID_33371
MGTTKSSTALGENLFLDDGRVEAKAKQPKILKA

SEQ ID NO: 125057 - protein, 125 aa, Glycine max
  Coding DNA Sequence Number=SeqID_33372
  Gene Ontology: Mol. function=structural constituent of ribosome; Cellular component=ribonucleoprotein complex; Biological process =translation
  Homolog annotation: Hit_ID=A4GG85; Match level="QueryCoverage=60%, HitCoverage=55%, E-value=8e-37, Identity=98%"; Hit description=50S ribosomal protein L16
  Pfam annotation: Domain name=Ribosomal_L14; Domain location=65-125; Score=-14.3; E_value=0.00079; Accession=PF00238.10; Description =Ribosomal protein L14pL23e
  Pfam annotation: Domain name=Ribosomal_L16; Domain location=1-91; Score=89.1; E_value=1.4e-23; Accession=PF00252.9; Description =Ribosomal protein L16
  Pfam module annotation: Pfam domain module=Ribosomal_L14::Ribosomal _L16; Domain location=65-125::1-91
YALQALEPAWITSRQIEAGRRAMSRNVRRGGQIWVRIFPDKPVTVRPTETRMGSGKGSPEYWVAVVKPGKILYEMADNSGARELMCIRILGASNRRYAYIGDIVVAVIKQAVPNTNLERSEVIRA

SEQ ID NO: 125058 - protein, 106 aa, Glycine max
  Coding DNA Sequence Number=SeqID_33373
MALSLRTRQLAMVSPFTMACCRGWTRQSNWRVEGADFVAVCNAAGSAIFNGVLLGQRRQHQQRFALPELLKSPLFVDHFTREKEKKREDRCCVFEEERRSVAVLCI

SEQ ID NO: 125059 - protein, 271 aa, Glycine max
  Coding DNA Sequence Number=SeqID_33374
MRGAPMEESMSPFLVSDFGAQNFKAIQRIRKAWETPLRKDQEPRGIRNGIIGGYHEWLKVHIRGLDWLAKLKVVSEESFEAPEEDEEVQALKSELGKAKLAKEKFKLAATHIRKECAGLREENATTAKALEQEAKRAHKEEYGRNKFRGALSKRSLSQRLCETKTYMLAIIAKYQEELGLATAHEHRVAEEYAQVYAEKEARGRVIDSLHQEATMWMDRFALTLNGSQELPRLLAKAKAMADTYSATEEIHVLLGYCQHMIDLMAHIIRNR

SEQ ID NO: 125060 - protein, 163 aa, Glycine max
  Coding DNA Sequence Number=SeqID_33375
  Homolog annotation: Hit_ID=Q2LEC5; Match level="QueryCoverage=22%, HitCoverage=30%, E-value=5e-08, Identity=67%"; Hit description =Integrase-like protein
MIKLRAMLSIIFGMTPICGSCAVTRLLRDAFQTMRLTRSYNSFILPHQVAILAYREQRTRCLTAVSIGPPSSRMRGEYVALVSLVREQAAHLHGDNKCLNYPYFMGPFPVSFGFIYILLAVDYVSKWVEACRSKLHDDESRLIQGVLMITKMMTKSSRVKITS

SEQ ID NO: 125061 - protein, 71 aa, Glycine max
  Coding DNA Sequence Number=SeqID_33376
KAVASGGSNLARLGELGGNHLPYFAINREEVKKKGALPKRFRNVFREEFRKGFNRSSTFFIRSSSFFDLQR

SEQ ID NO: 125062 - protein, 135 aa, Glycine max
  Coding DNA Sequence Number=SeqID_33377
MRVCVCVCVFVCDEDYGNLSTIALSVKDPKMSLDDSSISLGLERIRECSGAISNACILHTDEVVSEKLILSGGKAGSKEKISLDEFTGCPQDEAEANIQGKEHELSYTAHEHRPKEGVSQEEFQDFHISKRKRIN

SEQ ID NO: 125063 - protein, 63 aa, Glycine max
  Coding DNA Sequence Number=SeqID_33378
MRDGKRSSYVIGEWGEFLKWPQREVPCCVGIIGRASCVQSWNLGASLWVGALGCTGAELEAFL

SEQ ID NO: 125064 - protein, 111 aa, Glycine max
  Coding DNA Sequence Number=SeqID_33379
  Subcellular localization annotation: CTP_CleavageSite=50; ConfidenceScore=5.28e-01
IAPTRDTQWNLKKSKQGPGVSSSGLRASVGPIGRPFPPASSCYRGIGIVPARHLVDPKKANRVLELPALNTGLYQFKGVPVAPNRVIRPPTNRAFIKKCCAPRRAQGETPQ

SEQ ID NO: 125065 - protein, 148 aa, Glycine max
  Coding DNA Sequence Number=SeqID_33380
MGEVEEIQEKMKADMEAIKEKMATMMEAMMSVKKIMEANAVAIAATSVVAKVNPTSPSDLKQMNHPTSNMVGKDLGSTDDPMMCKFKTSTPSHHMACLPTIHHPTWRTLSMKISITPLRYSLRTNNLNLIRHISLKPWGRHMKFPTTI

SEQ ID NO: 125066 - protein, 173 aa, Glycine max
  Coding DNA Sequence Number=SeqID_33381
  Homolog annotation: Hit_ID=A5BTM1; Match level="QueryCoverage=63%, HitCoverage=4%, E-value=1e-10, Identity=33%"; Hit description =Putative uncharacterized protein
MTRGNPYDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTRLIHLLPKFHGLAGEDPHKHLKEFHIVCSTMKPPDVQEDHIFLKAFPSFFRGSGKDWLY

SEQ ID NO: 125067 - protein, 76 aa, Glycine max
  Coding DNA Sequence Number=SeqID_33382
MKILKLAKYRLKAQVEKDKGPSGAGQSPRTYQGNPCGVYPDISSFTGSGLIQISVACIKRSAPSQDHIIWYQSFGS

SEQ ID NO: 125068 - protein, 109 aa, Glycine max
  Coding DNA Sequence Number=SeqID_33383
  Homolog annotation: Hit_ID=A0PAV3; Match level="QueryCoverage=34%, HitCoverage=17%, E-value=5e-07, Identity=76%"; Hit description =Restriction endonuclease
MVKVGTSYVPINVSFSPKVGPGLPGINRDTRIYLFCEVIFRHRLLFLSAVPPVQLLTGLCVTAKAPRTSALASVAVPLRVTTTPPALNAPLQGASHSPFRLRNCWEGRS

SEQ ID NO: 125069 - protein, 156 aa, Glycine max
  Coding DNA Sequence Number=SeqID_33384
MELMEVKDKEEVVEAEGKFEREMQELLNEATILQCIWKDDGVEVTFINVYSPCDMDAKRRLWGDLIPHKENKSWSNVGIIGDINSVRRIGEREEVNPRGVKYEKISLEDNNMLIGRFEEEEVREAIWECVNSKSLGLDGGANASFVALTPKVEDPK

SEQ ID NO: 125070 - protein, 64 aa, Glycine max
  Coding DNA Sequence Number=SeqID_33385
  Homolog annotation: Hit_ID=A5C0F5; Match level="QueryCoverage=92%, HitCoverage=9%, E-value=1e-07, Identity=40%"; Hit description =Putative uncharacterized protein
MTVTLNNYKGGCNVEISILDIMKRHEFLWEPYTATVMSVLPPICLVGSVAWCAVVPLICFHVVE

SEQ ID NO: 125071 - protein, 31 aa, Glycine max
  Coding DNA Sequence Number=SeqID_33386
MEAGSLSFNEVASLRSFLEKTSLKSLFEKLP

SEQ ID NO: 125072 - protein, 433 aa, Glycine max
  Coding DNA Sequence Number=SeqID_33387
  Gene Ontology: Mol. function=methyltransferase activity; Cellular component=chloroplast; Biological process=metabolic process
  Homolog annotation: Hit_ID=A7P4P2; Match level="QueryCoverage=24%, HitCoverage=30%, E-value=1e-40, Identity=73%"; Hit description =Chromosome chr4 scaffold_6, whole genome shotgun sequence
  Pfam annotation: Domain name=CMAS; Domain location=121-345; Score= -146.9; E_value=8e-05; Accession=PF02353.11; Description=Cyclopropane- fatty-acyl-phospholipid synthase
  Pfam annotation: Domain name=HSP70; Domain location=1-394; Score= -346.8; E_value=0.017; Accession=PF00012.11; Description=Hsp70 protein
  Pfam annotation: Domain name=Methyltransf_11; Domain location=151 -248; Score=58.5; E_value=2.2e-14; Accession=PF08241.3; Description =Methyltransferase domain
  Pfam annotation: Domain name=Methyltransf_12; Domain location=151 -246; Score=42.2; E_value=1.8e-09; Accession=PF08242.3; Description =Methyltransferase domain
  Pfam annotation: Domain name=Methyltransf_4; Domain location=130-303; Score=-71.3; E_value=0.035; Accession=PF02390.8; Description=Putative methyltransferase
  Pfam module annotation: Pfam domain module=CMAS::HSP70::Methyltransf _11::Methyltransf_12::Methyltransf_4; Domain location=121-345::1 -394::151-248::151-246::130-303
MANNQGHQTTPLDVPFLDIAQLINVAVKDQASKYLTIFMKMKEIAEGYPETTIRNVVVPVPVYFNDPQRQTTKDVSVNSGLNVMRTIHLSTMAAIVYGLDKKAISYVEKNFFIFDPGGGIHGLTSFFALCSRNLDAGVTAGSNLKDGYTVLDLGCGWGSLVLYIAKNYTNCRVIGSSYSTTQKTYIEEKCRDLQLQNLNIIVADIGTFEMEASYDIIFSIEMFEHMKNYKDLLKKISKWMKEDSLLFIDTVAENFHRLTGELSILLDMFPLQDLNLNDDVRELVLLNEIVPDQAHLASIFEKLEIRDALSCKVEIGSLEEEIHNRCEEQPKTYLIALIGLVCFTKCVLYGASTPSQKTVTLRTNIRSCINQALDGFWTQHVFKNGSNVITQRPNPQSRPSEHDNNNEEKGMAEKGHDNDSERNFQIHSLEDRI

SEQ ID NO: 125073 - protein, 120 aa, Glycine max
  Coding DNA Sequence Number=SeqID_33388
MYSKTESDKQFPSLQQHAFVKWWNQFDTSKAEPDQVKLWFKSHSELLKAADLETSLFLNRKSQLAAFLAGSSSKEHLTKNLKEVLQLLQKDEEEVTVQFYVYKKSPQFHCETPFQIARVG

SEQ ID NO: 125074 - protein, 30 aa, Glycine max
  Coding DNA Sequence Number=SeqID_33389
MPIRTRLFAAAQVKSCPVGRSSRIRGWPGN

SEQ ID NO: 125075 - protein, 150 aa, Glycine max
  Coding DNA Sequence Number=SeqID_33390
NLHGDEDDDDDYLVSNSYVEKSLDKDDSIDDISDTDDEVTDMIQPVRIVHPAQGVQGIQNQFWNDALHYNNINWSNPDEEDICGLEMPSSFNVGQELYVGMNFDSKDAVKNAVKQYVMKVHQSFKVVESKLNKHDQGRSIYKIFFDSRED

SEQ ID NO: 125076 - protein, 197 aa, Glycine max
  Coding DNA Sequence Number=SeqID_33391
  Homolog annotation: Hit_ID=Q6L477; Match level="QueryCoverage=62%, HitCoverage=19%, E-value=2e-09, Identity=29%"; Hit description =Putative uncharacterized protein OSJNBa0009L15.8
  Subcellular localization annotation: CTP_CleavageSite=47; ConfidenceScore=5.43e-01
MATPPASPPPPPLDTSASPSTLKRTRKATRLRSLVTIPLGAERHVVNVDPATGKADGPHKKKLRTYLGIVARDKVDVTYDTWKEVPTAQKDLIWEDIQAEFEIPEASDSRTKKKILQIVDERWRQFKSDLTRKWALAADKDGVDDIVCEKYDISKEKCTQFCQTRRDPSWEDVRKKAQASQKQNTAPTYCLVGVMNI

SEQ ID NO: 125077 - protein, 95 aa, Glycine max
  Coding DNA Sequence Number=SeqID_33392
  Gene Ontology: Mol. function=oxidoreductase activity; Biological process=metabolic process
  Homolog annotation: Hit_ID=Q9SLN8; Match level="QueryCoverage=65%, HitCoverage=18%, E-value=2e-17, Identity=67%"; Hit description=Allyl alcohol dehydrogenase
MAQVRNKQVLLKDYVTGFPKESDMNIVENTITLKLPEGSNEVLLKNLYWSCDPFMRNLMNKPEGPPNSLAHTPGSVKVAVTGNVAAVMQIAAVAA

SEQ ID NO: 125078 - protein, 178 aa, Glycine max
  Coding DNA Sequence Number=SeqID_33393
  Gene Ontology: Mol. function=aspartic-type endopeptidase activity; Cellular component=small subunit processome; Biological process=DNA integration
  Homolog annotation: Hit_ID=A5AD47; Match level="QueryCoverage=92%, HitCoverage=20%, E-value=3e-25, Identity=40%"; Hit description =Putative uncharacterized protein
MAVSGPVFSFSGTPTITTTKLNWKNYPPLSASVELWFLGQGHHDHLEKASDSVPNDKRPEWEKLDYQLCAVLWHLFDATMKVTALKQIGHDIIAHVGKTWAAVEELRKFLVADSLEEVNRKLDKFYMVLILRSLHSDFDHVRDQVLARDQVPSMDSLITRLLRVPHSLKDENLADGVE

SEQ ID NO: 125079 - protein, 40 aa, Glycine max
  Coding DNA Sequence Number=SeqID_33394
MTSMLKAPTRSEVLFYGPVQDFGLPIRLGVIHGAHSKLGA

SEQ ID NO: 125080 - protein, 76 aa, Glycine max
  Coding DNA Sequence Number=SeqID_33395
MADSLPDSSNSLSELSASLSGCYSLSAYASLNTMDKVVLFKKANFYKGKELLIKEDEDPPPTIYITFKNTCSTFGG

SEQ ID NO: 125081 - protein, 122 aa, Glycine max
  Coding DNA Sequence Number=SeqID_33396
MVCRQVVVVGVAVKGGGKMDEDQWMYNNIMSEEVDMNEENEEEPVRHPYVGRLTKDEKIIVGDMTKLKDEDVACDIFWSDPDAVKLSNACNLVFLIDSTYKANRRIISNWAWIRNWAELAWT

SEQ ID NO: 125082 - protein, 411 aa, Glycine max
  Coding DNA Sequence Number=SeqID_33397
  Gene Ontology: Mol. function=two-component response regulator activity; Cellular component=nucleus; Biological process=two -component signal transduction system (phosphorelay)
  Homolog annotation: Hit_ID=A7QVK8; Match level="QueryCoverage=43%, HitCoverage=32%, E-value=9e-26, Identity=35%"; Hit description =Chromosome chr16 scaffold_189, whole genome shotgun sequence
  Pfam annotation: Domain name=Myb_DNA-binding; Domain location=129 -179; Score=18.6; E_value=0.023; Accession=PF00249.22; Description =Myb-like DNA-binding domain
MEVHMSDLDGFKLKQIIDEEFAIPVIMISVDKSEETQEKALMSGVMRYIFKPIKAEDFIGIWQFAVVVMKGKMPTMTKVVGDIIEDHKELCCASFSKEDNRDEKNNDGKEHLSMNTVNEDEPTTSKNTKFVWTKDLRYRFEEAINILGPKNVIPTKIVQVMNVEGLKRRNVASHLQDFQIFHKYKHYLRQVERIFVAIIKKANEDNDISFTKKASIHWSLVFNHIRHYLEKTIKHSKRKSLRHLESDEIYISHLKSKLSILLSNLDKYNNNKLNANANDALSSSNLVQCNEPSQNLLCSPSEILRSGQASSSNVVGLLEPSSLGSIVGEVYSRDQTLPTSMEDINNVENIMGGNLFQPRQHHQIYNQGYHQTFATMDNNFASQGTFDGFHFKEIDDPFSMEDILNNFHMQF

SEQ ID NO: 125083 - protein, 71 aa, Glycine max
  Coding DNA Sequence Number=SeqID_33398
MKDHTGTDSHKVKMKSGKLKETYSNRGIYGERCVPTSFSTWFLKAIHVVICSPEHKVQDHHKIQTQTTHGE

SEQ ID NO: 125084 - protein, 201 aa, Glycine max
  Coding DNA Sequence Number=SeqID_33399
MEQDSLHVPVMEKVAYIGEEFDVWEDISADCMNTFILYDLMKALDPILEQVPQMLYLECHPIPEVVENEDDLDDVPVAGHEEDVGGREKGINVDAGADVGAGEQKLELGMEFGTLVEFKSSLREYSIFMGREFKWKKNDKHRARAKRKKAFFRIAARLPWWHCRMVLPENAQELSLADMEKSSEQEKAKGRTFTDERRRSK

SEQ ID NO: 125085 - protein, 122 aa, Glycine max
  Coding DNA Sequence Number=SeqID_33400
  Gene Ontology: Mol. function=metal ion binding; Biological process =histone H3-K9 demethylation
  Homolog annotation: Hit_ID=A2XI91; Match level="QueryCoverage=73%, HitCoverage=10%, E-value=5e-14, Identity=50%"; Hit description =Putative uncharacterized protein
MEHKGGLYDRKEVYQFHQRSGGNEVAIANEGGLSCRSELKEVDKVKLKQDSDMLFVGDGSDGALRDIFWRQDVIHLIHDQTFYLTVEHKRKLKEEYGIEPWTFIQKVGDVEGMMHPCLRRNV

SEQ ID NO: 125086 - protein, 188 aa, Glycine max
  Coding DNA Sequence Number=SeqID_33401
MCTTTRFVFGVESINSLKAEEKDRDYDESSKPLTRYKALAAFIWKHMTPACKMKSNNTRPAVVIHILDRRRRIGEPFSRYTINNILWPVMVDKFGNLSRELFLRVKSDPNILGSTQCMDLTQGGLDFGFGKPLWVGVTRGDKETLPNEVIIMEINEAIQAWLTMEMQHIANLERDIEFLRLALPNPSV

SEQ ID NO: 125087 - protein, 462 aa, Glycine max
  Coding DNA Sequence Number=SeqID_33402
  Gene Ontology: Mol. function=serine carboxypeptidase activity; Cellular component=peroxisome; Biological process=proteolysis
  Homolog annotation: Hit_ID=A7QYZ2; Match level="QueryCoverage=13%, HitCoverage=12%, E-value=5e-18, Identity=66%"; Hit description =Chromosome undetermined scaffold_259, whole genome shotgun sequence
  Pfam annotation: Domain name=Transposase_23; Domain location=192-262; Score=-4.8; E_value=0.004; Accession=PF03017.5; Description=TNP1ENSPM transposase
MAAELGQQTVELSTLVTGVAHDNLSWFFPICCVVLYVRPDKDSVDIVDDTTHRDPSWEDVRKKAQAIQKKNTAPHVLSRGGYEYLEQKLMIEKTKKKLEEAAQSGSIEAAAKEIATKIASQGSFVPHGRQDLLTTAIGRPEHLGCVRATEVGVTGPAGGVDYIKSDSATDVILHPDAILGSCVDPSVTDLDTGDSDKCGLYIKENPSRLVTLGRVYEGSTAVHNIPLLHGQVKVGVEEVEDVDAPVPVPTDEINLVGQTLNTFLAWSTHLGAVGPAKPVDRPDHKVMWDAIVFGVFNQDFPLHIKHEDLSKIAHGGQCLNIFVIQLWILHLIETSMRAGNSNVYGFLEPHALKELDDTPQPKSKAGARWIVVEYFNDVRPLEAKRLKALRIQWAQYYLKGYMVGNGVTDEQIDGNALVPFVHGMRLIPDELFEEVNRECNGNFYDPTSDNCSSELSKVDELK

SEQ ID NO: 125088 - protein, 219 aa, Glycine max
  Coding DNA Sequence Number=SeqID_33403
MEIITIHTDNESSIHTIAPKVLGVKVVLFCNTIAKEIGCLHEGSTYQEGWEKNYESHVTRTLYKENADKAGSKITLSDLHKFVLFHLMENLLFYLPHIIYINMLKNLKGFGGQDEIYYASFINKLLWDQGVYHVFNKMDKESKHTLIVKGSVVAKQNFFSKTNLKAMNVALEQSLKEAPKVDVDTINKKKQKRLDKALPDEDLGVGSSGLRIIKKGGLN

SEQ ID NO: 125089 - protein, 63 aa, Glycine max
  Coding DNA Sequence Number=SeqID_33404
  Homolog annotation: Hit_ID=A5CBT8; Match level="QueryCoverage=92%, HitCoverage=16%, E-value=4e-10, Identity=45%"; Hit description =Putative uncharacterized protein
MATPMSTACYLDKDETGQSIDIKKYRDFMQIPRSHLSAVKRIMRYLLGTINIGLWYPKIPLAI

SEQ ID NO: 125090 - protein, 51 aa, Glycine max
  Coding DNA Sequence Number=SeqID_33405
MVTYKVPLRLLGDPINENKLHDIPHEISCRNTWVDLGGGGSKGDLGLGDMM

SEQ ID NO: 125091 - protein, 100 aa, Glycine max
  Coding DNA Sequence Number=SeqID_33406
MGGLCSKSMKGDKVFAKSDGHSDNHKSNGKNHKSTNMPSDLTSVGDHGVDKKKKEVVAAAGNGSDDFYDGIPWFNDSFPHKSRSVKSRHVVAKVLLAMRI

SEQ ID NO: 125092 - protein, 173 aa, Glycine max
  Coding DNA Sequence Number=SeqID_33407
MKDKRNEKEKLEKQKKKKDGKALSSKAKGKEKEEKDSSKKIVKKENHFASKCDIKRALLLKQSFYLLLSRESYLSTTIPCELEVIPQVKEFLDEGLVRIMRHQIPVRGDMMNVLSGATFFCKITHASNIFMIHIHRDSLAQLIELVRNHVPSWEDAQEKGFSDLILLQHAKHH

SEQ ID NO: 125093 - protein, 115 aa, Glycine max
  Coding DNA Sequence Number=SeqID_33408
  Homolog annotation: Hit_ID=A5BP71; Match level="QueryCoverage=65%, HitCoverage=19%, E-value=1e-11, Identity=46%"; Hit description =Putative uncharacterized protein
  Pfam annotation: Domain name=zf-CCHC; Domain location=88-105; Score =17.9; E_value=0.003; Accession=PF00098.14; Description=Zinc knuckle
MIVIVNAEACGYVSMNYYQYIDVVYTNEHILKAYSAQWWPLGNEAAIPPSDDAWTLIPDPTTIRAKGRPKSTRIRNEMDWVEPSEHRTKCSRCGAEGHNRRRCPMQSERGSCSNP

SEQ ID NO: 125094 - protein, 307 aa, Glycine max
  Coding DNA Sequence Number=SeqID_33409
  Homolog annotation: Hit_ID=A5AJ35; Match level="QueryCoverage=41%, HitCoverage=38%, E-value=2e-15, Identity=35%"; Hit description =Putative uncharacterized protein
  Pfam annotation: Domain name=DUF1723; Domain location=181-230; Score =27.3; E_value=5.6e-05; Accession=PF08330.1; Description=Protein of unknown function (DUF1723)
MEMDTIQVWKGCYLVHPTFLLEHPILVVKWQKFASSSFSHHLLLPLSVTVGVGVCSSSAHPSSFSVLVVVAVGGCWSFVFFSSSSCSLKNLLRERVVKDPATAAEELNEEQPEAPVEEVVTDVEGFSSGSHDTSILRDFENHIAFRVWNGEMAKFGRPAPEIKGLAAVNGLSPLIVYSLDTGDWRLIYAFMEHWHKETNNFHLPIGEVIITLDDFMSLLHLLAVGVFHSFELLHVDDVIDTLVELLKVSTVEARAETIQLRAYLLHPLGCTLFANKSATHVHVVFLDALRDLTQSEGYTWGAAALVH

SEQ ID NO: 125095 - protein, 71 aa, Glycine max
  Coding DNA Sequence Number=SeqID_33410
METISKRFEHLDVCGKVHLNSKLQEIAYHDMNSMCPPPEKDFIENIIDVKADGNCDYLAIVALLGMGEESW

SEQ ID NO: 125096 - protein, 76 aa, Glycine max
  Coding DNA Sequence Number=SeqID_33411
MAAEWRRKRERKRHFKEKMSLEEAHHHRRPWIRAWRKKEMNEGRGREEHEILCSKRALKSEPTNSRSIPRFSTKCA

SEQ ID NO: 125097 - protein, 527 aa, Glycine max
  Coding DNA Sequence Number=SeqID_33412
  Gene Ontology: Mol. function=hydrolase activity, acting on ester bonds; Cellular component=plasma membrane; Biological process=lipid catabolic process
  Homolog annotation: Hit_ID=A2XP62; Match level="QueryCoverage=98%, HitCoverage=98%, E-value=0.0, Identity=60%"; Hit description =Putative uncharacterized protein
  Pfam annotation: Domain name=Phosphoesterase; Domain location=14-383; Score=547.1; E_value=1.9e-161; Accession=PF04185.5; Description =Phosphoesterase family
MASNSSTNNAGYPIKTIVVLVQENRSFDHMLGWMKSLDPKINGITGSESNPISTSNPNSNLVQFSDQSVYVDPDPGHSIQDIYEQIFGEPWSEASTAKKLPPTMQGFAQNAGRQAVPKNATATMMETVMNGFKPDLIPVYKELVKEYAVCDCWFASVPASTQPNRLYVHSATSHGLTSNDTNKLIGGLPQKTIFDSLDENGFSFGIYYQSPPATLFYRNLRKLKYVDNFRPFDLFKKHCKEGKLPNYVVIEQRFFDLLSIPGNDDHPSHDVSEGQKFVKEVYEALRGSPQWNETLFVIVYDEHGGFYDHVPTPVEGVPSPDDIVGPEPFKFQFDRLGVRIPAIIVSPWIEPGTVLHGPSGPSPTSQYEHSSIPATVKKIFNLPEFLTKRDAWAGTFEGLLTRSSPRTDCPVKERVKLPEPVKLREAPAQEKAKLSEFQEELVQMAATLNGDHRKSIYPDKLTENMSVPDAVKYVEDAFNTFLNECEKAKQNGADESEIVDCADGCSSAPPDSKNFFYNVLSCITCNR

SEQ ID NO: 125098 - protein, 27 aa, Glycine max
  Coding DNA Sequence Number=SeqID_33413
MGGLFLLVVIMQLFAHDGSKDYSVIRN

SEQ ID NO: 125099 - protein, 123 aa, Glycine max
  Coding DNA Sequence Number=SeqID_33414
  Homolog annotation: Hit_ID=A5BSR3; Match level="QueryCoverage=58%, HitCoverage=23%, E-value=9e-12, Identity=48%"; Hit description =Putative uncharacterized protein
MVEKTKKELEEAAQSRSTKVVIDPPSPIRQHVMWKMARTKKTGQMTSEAAKEIAEKIDSFEEQAPQGSFVPHGRQDVLTDAIGRLEHPGRVRATGAGVTIKQYFGPAPRTSRTSSSMAPEELE

SEQ ID NO: 125100 - protein, 210 aa, Glycine max
  Coding DNA Sequence Number=SeqID_33415
MVHVDPTIGKVDGPHKKKLRTYLGIVAHDKEFDMPEASDGRTKKKVLQTVGEWWRQFKYDLTRKWTLAVDKDSVDGTVSKKYDISKEKWVQFCQTRRDPSWKDVRKKAQAIQKQNTAPHVLSRGGYEYLEQKLMVEKTKKKLEEAAQSGSTEGIIDPPFPIRRQVKWKMTRTKKTGQMTSEATKEIAEKIILWRSRRHRVHLSPMDVRMS

SEQ ID NO: 125101 - protein, 271 aa, Glycine max
  Coding DNA Sequence Number=SeqID_33416
MAPEELEQLAQQIRDQLEESITEKIQSQGLALPPEPVVGPSAACVSTKESYVDPSGNDPETGDSDKCGLYIKENPSRLVALGRVYEGSTTVGIEEVNDAEAPIPVPTNEVSLVEQTLNTFLAWPTHLIKRLSEHPLHVMWDATVFVVFNERFPLYIKHLDLSKIAHDGQCFSISVIQLWILAHWKMVVILPKENLVVWFSSLHNRLDNYLKGIINNALKGLDDTPQPKSKAATARWIVVKYFNDVRPLEAERLKALCIQWAQYYLKVKNQT

SEQ ID NO: 125102 - protein, 470 aa, Glycine max
  Coding DNA Sequence Number=SeqID_33417
MGPQGSNREPLNSKSSTDHAIIHPTRSGFLSTCLSRSVELIVESEMDKYSNKLAPNVARVRMGEVAAYGNDCFAFVWVGIDPLATQVYVKETQNSVSTGVVDKLIDARKQVYILWASLVEVGVVNAHPLFLVGFLDHHDIGQPCRLLSPLCHGFGFGKNGDFVAYEIGVYVEHVRGAPCEEISIMCQHVLDPSLKVFIKSFPNLGALAFGITFTGFNLVGFDNDYVATLVGELHCEVSVSMRTYYTSNVLDNSPLPKVVARSTTPWSMSVELSLSIRTFLTSQLAMPTIITIGSSCSGSTPMKSTSVNIIDGIDLLELTVEIWFTLLMASKCLFRAVLVLPPPAKLPAMVLMTSLLTLHRLLRIRGTIIPFNVQRFPSYRGLEAAHSGYRRKVECDFLRCVSRHGRVEGMGSEVKMVVVGVAEVAGGFVEVRGGICKRDSNEQINGALSIMAKFMGGNGRLLRSEHVGVS

SEQ ID NO: 125103 - protein, 235 aa, Glycine max
  Coding DNA Sequence Number=SeqID_33418
MEFLISGVEMGEGTYKRDSNELAKPRTSSLVFYAKCGGTRMFIRQVVVTAEVAIGNEAFGPRVIRGPPIRGRSLVGREVRGIGEFDFLVSSPSSLPNSKKGDKVVVGGKKVRNYREGKFYLVTIPRYEWVSIEVEKTNFGEGPTEETRIEKGAEIEIVSKAVEKTKAMTLQLKAMKAEAGKSKQLGLELTKSRGTVKKLQEDLDKHVAYLSSKAKENNALSNRVVDLEQQVKDIG

SEQ ID NO: 125104 - protein, 102 aa, Glycine max
  Coding DNA Sequence Number=SeqID_33419
MIQHEELIRILNDFASVCPKVFLREDRTMNVSQPTLQREGDTRLTGASSMKGKYAESQTTFIRGKRQKNQKKVWSTKSVKRFGSCFYAWGRVFPLLLRIPQL

SEQ ID NO: 125105 - protein, 163 aa, Glycine max
  Coding DNA Sequence Number=SeqID_33420
MYKDNWTQPWPMGSEIYPEVHENPRAFFSISSPILLEPLAHGSSDWFLPREDCIMLSLKYLKGSDRRQDVSIMRARASMLTARVTNISGMSGMMRSGRIFALPELPAKSNDKGKAREDVVEREKVGLMMNNKAPVKKPTEEEESFGKKEISAKEATNFLRIIQ

SEQ ID NO: 125106 - protein, 90 aa, Glycine max
  Coding DNA Sequence Number=SeqID_33421
MENYCPVLRVVKLTGVRIGGYISFDNTDGGTSRLRSRAQPFATSPIGEPVQVTMILPPPPPTSVSEGVRRSGGGDFRASPCVWLLVDEYD

SEQ ID NO: 125107 - protein, 159 aa, Glycine max
  Coding DNA Sequence Number=SeqID_33422
MAIVATCSFAGERRRGSRVPFPKEERCAESPPTFICGKRRENRRKPVKMKILSSGVVFTLEEGISTSHVDKSGALAPTYPPSKRKSDLRSSFLCVNQNGRESSRNYSRKRYGSASAWIFFTEIIFLSNFERIRSAKKASQVASSRSNSLLEEESGRPKW

SEQ ID NO: 125108 - protein, 164 aa, Glycine max
  Coding DNA Sequence Number=SeqID_33423
  Gene Ontology: Mol. function=protein serine/threonine kinase activity; Cellular component=cytoplasm; Biological process=protein amino acid phosphorylation
  Homolog annotation: Hit_ID=Q5XLG3; Match level="QueryCoverage=39%, HitCoverage=20%, E-value=1e-18, Identity=50%"; Hit description =Calcium-dependent protein kinase 1
MHHLSKHPNVIRIHDTYEDTASVEACHWLGVMHRVLKPENFLFDTVEEGAKVKTTDFGLSVFYTPSLVALSLDLVFVEDAEGEGLVVDFGGGGDSDDVFEFSLAEELADVVDGVLGNGVGAEAKDHAGLDILDDLVGGNFLEVVLGEDDEGGGEGCWIKWPRNN

SEQ ID NO: 125109 - protein, 149 aa, Glycine max
  Coding DNA Sequence Number=SeqID_33424
MANGFIHLKKHYMLKMLVMMCGMSYIGDHFFKILSQMNLEKLQVSRCMIMHNLFQKRFVALQIGCLDGSAVSDKVNLELDSEGRGTVADVVMEATADGDMGDLLGADVGCTEGGELARIKIGVDVVHPLMMAVRFVLALALCEELRVTT

SEQ ID NO: 125110 - protein, 134 aa, Glycine max
  Coding DNA Sequence Number=SeqID_33425
  Subcellular localization annotation: CTP_CleavageSite=19; ConfidenceScore=5.57e-01
MTTPLVSPPPPPPSDASMSPSTVKRTRKTTQLRSLATRLPGAERPVVNVDPAIGKVDGPHKKKLRTYLGIVARDKAEFQILEAFDSRTKKRILQIVGERWRQFKSDLTKKWALVADQDGVDDTVCEKYGISKEK

SEQ ID NO: 125111 - protein, 28 aa, Glycine max
  Coding DNA Sequence Number=SeqID_33426
MSSCHVIILLVGLPRRNLADIEESKFND

SEQ ID NO: 125112 - protein, 90 aa, Glycine max
  Coding DNA Sequence Number=SeqID_33427
  Homolog annotation: Hit_ID=A5BSA3; Match level="QueryCoverage=55%, HitCoverage=24%, E-value=1e-09, Identity=46%"; Hit description =Putative uncharacterized protein
MEDIERMRHHRSPYSSQGSDDGYEEGRRHRHIRNRDGMDDVKLASLEFEGHALVWWNQVQVDKERSRRHRVDTWMVMKRITRERFVPPHY

SEQ ID NO: 125113 - protein, 223 aa, Glycine max
  Coding DNA Sequence Number=SeqID_33428
MMLEYKCEMKSHIGVVSGLLMCWLVVHRHRSHLRPHSHRRENERKSQEANINLSYFHGKDNVEAYLDCEIRVEQKLKRKYTLKSYGSHSYPKKDQGLGILGATPSNPKNDKGKGPITSQCPAKKTMIMRSQDIYSSQDEATTSPSSSESEEAKKEESVEAMPSKIILMMPKNQELSKFQRIRSQKALTIKFQDSRTKNNQVSRTIKIKIQDSRFKNQEKTQSR

SEQ ID NO: 125114 - protein, 136 aa, Glycine max
  Coding DNA Sequence Number=SeqID_33429
MTNKQYLQQRKEAGKQTSYKRETTSNEVRMAPDCSGRCARKGRRQRWKHAGKGTVRHLHASENSDANDSWTAAAVAEKFPGKEGKSVGNDIARIKVHRKPEKSQQLMVAGNVVGKGEMDRRKRRNGSSKSETRLLE

SEQ ID NO: 125115 - protein, 97 aa, Glycine max
  Coding DNA Sequence Number=SeqID_33430
  Gene Ontology: Mol. function=cytochrome-c oxidase activity; Cellular component=mitochondrial respiratory chain; Biological process =aerobic respiration
  Homolog annotation: Hit_ID=A7PJE8; Match level="QueryCoverage=46%, HitCoverage=28%, E-value=7e-19, Identity=95%"; Hit description =Cytochrome c oxidase subunit 1
  Pfam annotation: Domain name=Ribosomal_L2_C; Domain location=1-81; Score=-59.8; E_value=0.055; Accession=PF03947.9; Description =Ribosomal Proteins L2, C-terminal domain
MLLTDQNFNTTFSDPAGGGDPILYQHLFRFFGHPEVYIPILPGSGKRPVGGVVINPVDHPHGGGEGRAPIGRKTLQLLGVFLHLEEEVEKGRNIVII

SEQ ID NO: 125116 - protein, 193 aa, Glycine max
  Coding DNA Sequence Number=SeqID_33431
  Gene Ontology: Mol. function=protein dimerization activity
  Homolog annotation: Hit_ID=A7QJV3; Match level="QueryCoverage=41%, HitCoverage=40%, E-value=7e-25, Identity=72%"; Hit description =Chromosome undetermined scaffold_108, whole genome shotgun sequence
  Subcellular localization annotation: CTP_CleavageSite=42; ConfidenceScore=5.02e-01
MVSLAIDTWTSIQNVNYMCVTSHYIDEAFRSSPSRLATFKRRAEEVSVNSEAMLTLDVPTWWNSTYLMLDVVENFEQTFNHFEYVEAAYVLTLLTSEEGCPKEMDWKLARVFELYSRAREQEEEILSLREQIGIACMKELQLLNEKCKLERQFSELRMAVDEKQNEAISSASNDLVQRKGYLEENLKLAHDLK

SEQ ID NO: 125117 - protein, 197 aa, Glycine max
  Coding DNA Sequence Number=SeqID_33432
  Homolog annotation: Hit_ID=A4PSD7; Match level="QueryCoverage=40%, HitCoverage=32%, E-value=3e-07, Identity=30%"; Hit description=RNA -directed DNA polymerase ; Ribonuclease H, putative
MAFYSTKNKMAHETNVSFSHEADMDIAIPSKEILVTDGDPTMDISKKLSATQGAFGFLRPDRISHAISLTLWHMLLPFLPRNPILSGSVKLYMPPIPIARSVFWEYLIQSESTVQGRWLMLGDFNDIILSLEVSEDMETIGGCFTWRKNIHQDGHVRKKLDRCLANPTWQCQMENIPLLSSMEDPPRVSGSCVTNVV

SEQ ID NO: 125118 - protein, 255 aa, Glycine max
  Coding DNA Sequence Number=SeqID_33433
MQIAIGNGAFAADWTRGKQIASHAGDFAERGISPLPLATQPVVVKLLLPLALASYAKGDSPVALAIREKVYEENDSIIFEGSKIVIQIKHGISFNALKKKIGDKMLKPCLKQQDQMSVLELYIEKDVAGDDDDDYLVSNSYVEKSLDKDDSIDDISDTDDEVTDMIQPVRIVHPAQGVQGIQNQFWNDALHYNNINWSNPDEEDICGLEMPSSFNVGQELYVGMNFDSKDAVKNAVKQYVMKVHQSFKVVESKLN

SEQ ID NO: 125119 - protein, 194 aa, Glycine max
  Coding DNA Sequence Number=SeqID_33434
MALNQNGDTATNPVAGKGREVSGESGGIKEWFIVILGSNKEKKLGTKMVVWAVTWFWEKLEKGEGGVRKVRERGKLGSVYGVGNGRSEVHRGFCLPEAWQGPQPEPKTKTGNKATKEEGGREPHNLIHRGFELSKVRGRLGGHRREKGQSGALMPKGKMPMMVASRYGTSTETSLVRHHQGALVPSNLGTRTLI

SEQ ID NO: 125120 - protein, 325 aa, Glycine max
  Coding DNA Sequence Number=SeqID_33435
  Subcellular localization annotation: CTP_CleavageSite=34; ConfidenceScore=5.13e-01
MASFSQMQSQFQSQMQSQGLALPPEYLVSPSGPRVSTKESCFDPLGNDPEMGDSDRCGLYIEVNHAHLVALGRVYEGSTIVHNTSLLSGQVKVGVEEVKDPDVPVPVPTDEPIVSPAKPPQKPNPEVDDPLYLMTLTIPELFLRPYHVTWDATVFGVFNPDFPLYIKHEDLSKIAHGGQCLSISVLRLWIMHMTETSMQAGNSDIYGFLEPQSIQRFGQTQFQTESYIKSWMQGSKHDVYLGAYLNGGHRQMVVIVPKEHLVFWFCSLHNSALKGLDDAPQPKSKAPTRWIVVKYFNNPRPLEPERLKAMWIQWEQYYLRVRVHS

SEQ ID NO: 125121 - protein, 243 aa, Glycine max
  Coding DNA Sequence Number=SeqID_33436
  Homolog annotation: Hit_ID=A5BSR3; Match level="QueryCoverage=75%, HitCoverage=66%, E-value=9e-09, Identity=28%"; Hit description =Putative uncharacterized protein
  Subcellular localization annotation: CTP_CleavageSite=31; ConfidenceScore=5.81e-01
MASPPTSPPPPPPPSPPPPSSDTSASSSAVKRTRKASRLRSLSTRPPGAERLVVHVDPTIGKADSPHRKKLRIYLGIVERDKVDITYKSWKEAEFEIPEASDSRMKRKMCRKRHRQSRNRTLPPTFCLVGTRKKLEEDAQSGSVDDVIDPPSPVRRHMKSKMVRTKKTGEMTTEAAKEITEKIGSFVPRGHQDVLTIAIGRPEHPGRVRATGSGVTIKKYFGSVPWTSHSSSLLPPEELQQLT

SEQ ID NO: 125122 - protein, 177 aa, Glycine max
  Coding DNA Sequence Number=SeqID_33437
MKNKKVVVAGALLSEAYVLSEQHLLSKTSARLASEENLEENLPCKHALNMPLACPTTYLSLLAPSAPDSLSQKSLTCSGTTVFNGDVIQGAVVDAKSPGVWYGLLVEMVEEALVFGKDECTCREDDVLKGEEWGCQKQLVHDPGVGCGTGPLLTGWSSGVSFGRGESQLDRCQHRLG

SEQ ID NO: 125123 - protein, 66 aa, Glycine max
  Coding DNA Sequence Number=SeqID_33438
MEESKEFSDCVALNSLKREKGDTKEFRRLFMSGQENHWKSYDLEKNLKTIGRVTSFDFYSKLVTGN

SEQ ID NO: 125124 - protein, 246 aa, Glycine max
  Coding DNA Sequence Number=SeqID_33439
NGCHDNFNIAPWRKITPCASDGKVEYIGGEFDVWEDISTDYMNTFILCDLVQACKKYSRIGDCFWLIDKDLDFNHGLRSCTTDGDILYLVKDALENENEINVYFHHEVDPIPEEVSLMLDLKCHPILEASNEDDLDDIPIAGHEEDVGGGENGINVDVGGGEERDVGGGEEKDVGGDEEEKVDNPDDEDDNDEDEWFTNFSYMRKEVEVEYEIDGYHLEELKNPISSDDEDEDVRKVYPLYNDQGL

SEQ ID NO: 125125 - protein, 238 aa, Glycine max
  Coding DNA Sequence Number=SeqID_33440
  Gene Ontology: Mol. function=protein serine/threonine kinase activity; Biological process=protein amino acid phosphorylation
  Homolog annotation: Hit_ID=A5AMD3; Match level="QueryCoverage=31%, HitCoverage=22%, E-value=2e-22, Identity=57%"; Hit description =Putative uncharacterized protein
MEAVAEGLWGLAEYHGKRGEIGKAVKCLEAICQSDVSFFPEVYSLLSECYHLVGAILPQNQVLHKGLELTASVGERSIVARLALYVLKKIRLARQTKQCRRSAHQEAWVEKARESTLFQLLYCRLLCLHCYWIREDGDMAALMKKSIGVYFPEECSNIFLTKDEDVRLGDFGLAKTLKADDLASSMLWKIEAPTKIRHILFKLGDAGLNHLAEEEEKEYARLVEGVRPSSVIDHHDPY

SEQ ID NO: 125126 - protein, 101 aa, Glycine max
  Coding DNA Sequence Number=SeqID_33441
  Homolog annotation: Hit_ID=A5C7C5; Match level="QueryCoverage=54%, HitCoverage=8%, E-value=5e-07, Identity=45%"; Hit description =Putative uncharacterized protein
MEKSEKKNFNEKKMKKAYITWDDNDMESSEDSENEEINLCLMAKSYESDEEVSLKKKWYIDSGCSKHMTGDASKFTHISPKKSGHVIMVTTTKVESLELVK

SEQ ID NO: 125127 - protein, 129 aa, Glycine max
  Coding DNA Sequence Number=SeqID_33442
GFILSVLIYIYCLLLKTGPDGCRETRRTGTREEARKPRQDFSIHKIFRKLFPSHIAFLFFFFLSIEASIKAPNFAHHFYSKLQREAIFGVVKRTSMLWDFEFQVEKCEILRVREAKFGESLGRANEKNE

SEQ ID NO: 125128 - protein, 508 aa, Glycine max
  Coding DNA Sequence Number=SeqID_33443
  Homolog annotation: Hit_ID=Q2QVH7; Match level="QueryCoverage=33%, HitCoverage=19%, E-value=1e-07, Identity=25%"; Hit description =Transposon protein, putative, CACTA, En/Spm sub-class
MATEVDCTSIGSATTNCTEKISILHTSWKDVPDTLKELVWDDILAKFDIPEALNAKKKIKKLGSNLAQAAKPLTGRKKMQEIQKYNDCPHVLFSGGYDLLEKKMMDEKMKKRQHDTMMTKNTPDFRDPPSPIQRYEKWASLEEQTRQGSFVPHGREDILNTAIRQLDHGGRVRAAGSGVTITQYFGKAAHGSSCSSASISQVQLAEIIGSLQEQWKNDIQVLKHELKEQIILEMLQRGSPISAPIQPDIHVLGARVSTKGSNAETAVNPSPPNHVAPVKPTMGLYVHRQDSTELVALGKTYDGGSTIHTVAYAHDVIRVSVEKVINSDAEVPFSTSEIKYVRQALDTFIAWPTPLVKLASNELKGTTLTTVTEAVEPVNDVAIDDPLRELIKTLVDIYEKPVELVWDAILNAKDTRGQSQEYIEKWLKESNRDVYLGAYLNQKLDVHIKVAIDNAFKTLKMSSDGKFDHSTPQWIEVKVVIRATPCPQVILMQLGGSPKEQLVSMEAG

SEQ ID NO: 125129 - protein, 126 aa, Glycine max
  Coding DNA Sequence Number=SeqID_33444
RCPWLRQVNVVDHTYACSGCETYTIADVRRRTGQLPLALMFCIFWVALFLLIRVQPMFMSHTYRPCMTSLLLGQYAWGAAGLVHIYDQLNDCWIYEHFSSVAECNADPDYDECHHVRVGGLRQRRL

SEQ ID NO: 125130 - protein, 134 aa, Glycine max
  Coding DNA Sequence Number=SeqID_33445
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q8MBP6; Match level="QueryCoverage=91%, HitCoverage=26%, E-value=5e-38, Identity=72%"; Hit description=ATP synthase subunit beta
  Pfam annotation: Domain name=ATP-synt_ab; Domain location=5-89; Score= -59.3; E_value=0.00065; Accession=PF00006.16; Description=ATP synthase alphabeta family, nucleotide-binding domain
DLKYLPYGSNASAVGITHSSTEMGSLQERITSTKEGSITSIQAVYVPADDLTDPAPATTFAHLDATTVLSRGLAAKGIYPAVDPLDSTSTMLQPANLLVKNKLMRLVQRVTAITVRQIIELVATLSLDELIRRK

SEQ ID NO: 125131 - protein, 77 aa, Glycine max
  Coding DNA Sequence Number=SeqID_33446
MTSRMTCGDTLWLSALMEACLWGFYGGWIFDLQWGPLMVIFHHGDAAEDKGKEVASLRSFLEKTSLRSFFEKTSLRS

SEQ ID NO: 125132 - protein, 281 aa, Glycine max
  Coding DNA Sequence Number=SeqID_33447
  Gene Ontology: Mol. function=exonuclease activity; Cellular component= cytoplasm; Biological process=DNA recombination
  Homolog annotation: Hit_ID=A7FLH3; Match level="QueryCoverage=99%, HitCoverage=92%, E-value=1e-132, Identity=86%"; Hit description =Recombination-associated protein rdgC
  Pfam annotation: Domain name=RdgC; Domain location=1-280; Score =576.6; E_value=2.6e-170; Accession=PF04381.3; Description=Putative exonuclease, RdgC
MEKQLSAFAFTPCGSQDMAKTGWVSPMGSHSDALTHAVNGQIVICARKEEKILPSPVIKQELQAKIERLEAEQHRKLKKTEKDALKDEVLHSLLPRAFSRFNQTFMWIDTVNDLIMVDAASAKRAEDTLALLRKSLGSLPVVPLTMESPIELTLTEWVRSGEMPAGFAIQDEAELKAILEEGGVIRCKKQNLISDEIAVHIEAGKLVTKLAVDWQERIQLMLSDDGSLKRLKFADTLREQNDDIDRDDFAQRFDADFILMTSELAALIKNTIEALGGEAQR

SEQ ID NO: 125133 - protein, 182 aa, Glycine max
  Coding DNA Sequence Number=SeqID_33448
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=68%, HitCoverage=16%, E-value=3e-61, Identity=91%"; Hit description =Photosystem I P700 chlorophyll a apoprotein A2
MALRFPRFSQGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGHLVHVAIPGSRGEYVRWNNLLSILPHPEGLGPFFTGQWNLYAQNPDSNSHIFGTPQGAGTAILTLLGGFHPQTQ

SEQ ID NO: 125134 - protein, 22 aa, Glycine max
  Coding DNA Sequence Number=SeqID_33449
MVPHPTPMSGATSVENNGINLP

SEQ ID NO: 125135 - protein, 49 aa, Glycine max
  Coding DNA Sequence Number=SeqID_33450
MEQVSKWNLLQELGFPHALLDAIQDKEQLDDRTKPEIVILHNQTSIRDA

SEQ ID NO: 125136 - protein, 175 aa, Glycine max
  Coding DNA Sequence Number=SeqID_33451
  Gene Ontology: Mol. function=RNA-directed DNA polymerase activity; Biological process=RNA-dependent DNA replication
  Homolog annotation: Hit_ID=Q5NRP4; Match level="QueryCoverage=56%, HitCoverage=6%, E-value=6e-09, Identity=32%"; Hit description =Putative gag-pol polyprotein, identical
  Pfam annotation: Domain name=zf-CCHC; Domain location=115-132; Score =21.5; E_value=0.00084; Accession=PF00098.14; Description=Zinc knuckle
LSEELRDYYEGRHRSHLRPHSHRRENERKPQEVNIKLPYFHGKDNVEANLDWEIRVEQQLKRKSTSKSYGSHSYPKKDQGQGILGVRPSKPKDDKGKTIEKQPLKASMQEKTSSMKCFKCLGRGHITSQCPTKKTMIMRGQDIYSSQDEATTSPSSNLSPRRKGQPLMVKEECKG

SEQ ID NO: 125137 - protein, 198 aa, Glycine max
  Coding DNA Sequence Number=SeqID_33452
  Homolog annotation: Hit_ID=Q84VI1; Match level="QueryCoverage=100%, HitCoverage=26%, E-value=6e-59, Identity=66%"; Hit description =Envelope-like protein
MDKKIRSIVSSILKDASVPDAEKDVPTSSTPDVAVPEADEDVPTSSTPNVSVPDVEKDVPTSSGPNAEVLSSPSKERSTEEDDQATEETPAPRAPEPAPGDLIDLEEVESDEEPIANKLAPGIAERLQSRKGKTPIKRSGRIKTMAQKKSTPITPTSSRRSKVAIPSKKRKEISSSDSDDDVELDVSTSKKAKKSGRK

SEQ ID NO: 125138 - protein, 55 aa, Glycine max
  Coding DNA Sequence Number=SeqID_33453
MWTTTGEVVAAQLAQASSARPGEQGCFLQKQPPSGGIFWEGPNGAWGAICTPHFY

SEQ ID NO: 125139 - protein, 186 aa, Glycine max
  Coding DNA Sequence Number=SeqID_33454
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MEKRLCRGPLTSLLSIFLASSRKSPPRSWHDRFPDWKAGSERNAINGTKAGTGPPLEVDGIDKLEFRENQVAAFPRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 125140 - protein, 314 aa, Glycine max
  Coding DNA Sequence Number=SeqID_33455
  Homolog annotation: Hit_ID=Q6WAY4; Match level="QueryCoverage=100%, HitCoverage=54%, E-value=2e-38, Identity=33%"; Hit description =Putative uncharacterized protein
MGTNPTGKRFYQVKVKGLDTTRIKELGRLMEPLQMQAFRKTYGKILDLTIAEISIEAIVSLTQYYDQPLRCFTFGDFQLVPTIEEFEEILGCPLGGRKPYLFSGCLPSLSRIATVVKDSARGLDRVKQTRNGIAGLPRKYLEDKARDMANQEEWVPFMDVLALLIFGVVLFPNVDGLVDLAAIDAFLAYHHSKESPVVAVLADLFDTFDRRCEKSSARIICCLPALCVWLVSHLFPLDTRHPCPLQSYRSCTEKGRVDWDQHLAGIGGSAINWFPRWKEGKEGVLFSCGDYPNIPLIGTRGCINYNPALAIRQL

SEQ ID NO: 125141 - protein, 53 aa, Glycine max
  Coding DNA Sequence Number=SeqID_33456
MEEKKIENERDENTYRLKNEERTKNGEERRKIFTDLLSEALRKHFDSIFLHEN

SEQ ID NO: 125142 - protein, 178 aa, Glycine max
  Coding DNA Sequence Number=SeqID_33457
  Subcellular localization annotation: CTP_CleavageSite=27; ConfidenceScore=5.04e-01
MAEPSKKQKGTLSRSQRHFGSQETPIPSSIPFGSLFSSEEQRIRYTNLFSSRSIIDPKFIDMDFFSNDSFECFQAFENSNLIPFMSLKLLVYSELVKAFYSNLEIHEGTLMSEVYGIKMVIDQSLFYDLTQLPSEGVPFEGALIDDWKFDFSVHGCPPVGLYQPSGYDRKASCGFIGF

SEQ ID NO: 125143 - protein, 186 aa, Glycine max
  Coding DNA Sequence Number=SeqID_33458
MGEVEEIQEKMKADMEAIKEKMATMMEAMMSVKKIMEANAVAIAATSVVAKVNPTSPSGLKQMNHPTSNMVGKDLGSTGGPHDVQIQNEHAFPSYGLPLNYTPPNVAYTPNKNTHEIPHHNLADFEPWLGYTTEGQAVGGIPLQNPLEGPQYHPQLHLLHSTAVKNPYDYGRDGKVGSSRGKAQGH

SEQ ID NO: 125144 - protein, 120 aa, Glycine max
  Coding DNA Sequence Number=SeqID_33459
MVHCHIHTLSLSFFAIFKFFFILNLMFQSRDPFLIGAAVIASFGYRKEHDGSWVKMGAQPADDEGNLPVEDNSSILRRLLDKFDVDMRFDAMDSRITKVEEDVSFIHTCFDPPPPPPSSS

SEQ ID NO: 125145 - protein, 77 aa, Glycine max
  Coding DNA Sequence Number=SeqID_33460
MRIALANTCVATDFLDGGWMNDNPIHGAPNKSGEWRIALGNHFAWLQTHWWRMHERQSIHGAPNESGEWRIALGNHF

SEQ ID NO: 125146 - protein, 58 aa, Glycine max
  Coding DNA Sequence Number=SeqID_33461
ESERGVKKRKIGLYGTWFGEELSENRRFGCAAALISPNKPSGNRLQDVVIDYRLPVHV

SEQ ID NO: 125147 - protein, 77 aa, Glycine max
  Coding DNA Sequence Number=SeqID_33462
MAIKGLFICDLEHKFAESFSEQKGLRDRGSLVVKQYEHKGRVVLVWFRTCKGLLQDSGTLKQVAWGLDIGTRVRPNQ

SEQ ID NO: 125148 - protein, 77 aa, Glycine max
  Coding DNA Sequence Number=SeqID_33463
  Subcellular localization annotation: CTP_CleavageSite=2; ConfidenceScore=5.26e-01
MFAHSIKGCRPLGRACWGANTFPHPVFFRFFCRFPQINVGGDSARIPFVEPASRESRVALPPKGRLRQLATPLGTVF

SEQ ID NO: 125149 - protein, 270 aa, Glycine max
  Coding DNA Sequence Number=SeqID_33464
MTGPLNESISCFLIRVDPWVLEPIAFRGLHVLAFRGLHALTIRGLHVLAFRGLRVLAIGGLHILAIRGLHALTFRGLHVLAFRGLHALTFRGLHVLTFQDYTSSPSEDSQVHSPLEDYKSHLQRDYTPSAFRGLHALTFRGCTPSPLETTRPRLRRATRPRLQRTTRPHLSEDYMSSPSEGCTPSPSKDYMSLAFRGLHVLTFRGLTRPHLQRAARPHLQRTAVLVFEGLLALTIHRTTHPHQRAARPHFQRTTRPRLLQDCTSSPSEDC

SEQ ID NO: 125150 - protein, 73 aa, Glycine max
  Coding DNA Sequence Number=SeqID_33465
MAEMGKLDHLEERLRAIEGGKDYAFGNLEELLLVPNIITPPKFKVPDFDKYKGTTCPKNHLKTCCHMQKMRNC

SEQ ID NO: 125151 - protein, 237 aa, Glycine max
  Coding DNA Sequence Number=SeqID_33466
  Subcellular localization annotation: CTP_CleavageSite=32; ConfidenceScore=5.71e-01
MRHLYKYSRNQSCCAAKASSTFSSIPRTSSLRFSLNSSPNHVFLFFTPLSLPPIKIQKNFIKWQSHQRRERDHPPPLPLLPIAVTAHPEHPQHLFLLLCHLQDHQHCFHPMINVYVFQNSGLVDFMSLKLPYYPELVKVFYYNLKIQDGIIMSEVHGTSMVIDQSLFFSLTHLPSQGAPFEGTIVDDWKFDYLSHDARRMVCNDQAEMTGRLLAGSLTFDNRIMHYIIVRILLPRSL

SEQ ID NO: 125152 - protein, 41 aa, Glycine max
  Coding DNA Sequence Number=SeqID_33467
MKIQKKGVEGRSPEFQEPLDLRSNPIQGGGDDAILPPKGIG

SEQ ID NO: 125153 - protein, 92 aa, Glycine max
  Coding DNA Sequence Number=SeqID_33468
MDAHPCQDGIHQLTLRQREVGIMIVGQDVAEQQRHSCLGQGSLVGAHDPHPSPGSGPAEQWPPRQIHRLSSFSDRIHTPGPPPILAGIPGTD

SEQ ID NO: 125154 - protein, 45 aa, Glycine max; identical to SEQ ID NO: 107595
  Coding DNA Sequence Number=SeqID_33469

SEQ ID NO: 125155 - protein, 207 aa, Glycine max
  Coding DNA Sequence Number=SeqID_33470
  Subcellular localization annotation: CTP_CleavageSite=30; ConfidenceScore=5.63e-01
MASPPASPLPLPSPPSDASTSSFAVKRTCKASHQRSLSTRPPGAERPVVHVDPAIGKTDGPHRKKLRTYLGIMARDKMDVTYENWKEVPTTQKDLIWEDQAEFDIPEASDSRTKRKLLQTLGRDGGSLNQTSQGNGPLQPIRTVSRTLSDVRKKEHAIQKQNTAPHVLSRGGYDYLEQKLLAEKMKKKLEEAAQSGSVDGIIDPPSP

SEQ ID NO: 125156 - protein, 98 aa, Glycine max
  Coding DNA Sequence Number=SeqID_33471
LFPEEPWCLPTWMAKSYLHPDFLSVVSLVTIFQRNECGFEAFSPHDHLGLPSGVETKHERHKPIKVLKDERKRGWGHDRPIVALLCAKQAGNVAAGSP

SEQ ID NO: 125157 - protein, 49 aa, Glycine max
  Coding DNA Sequence Number=SeqID_33472
MLSSGFDDTPQSKSKATARWIVVKTKRKYCVRVLRRALDVNYNLRKFQE

SEQ ID NO: 125158 - protein, 69 aa, Glycine max
  Coding DNA Sequence Number=SeqID_33473
  Subcellular localization annotation: CTP_CleavageSite=44; ConfidenceScore=5.35e-01
SRGKQPRSYAKVPKQSLSGKGSDRAMTTRRAQVIHRSDETLKVAFSSVSSGTFCQSGKVFGDNTWRYQK

SEQ ID NO: 125159 - protein, 97 aa, Glycine max
  Coding DNA Sequence Number=SeqID_33474
  Subcellular localization annotation: CTP_CleavageSite=64; ConfidenceScore=5.43e-01
MFAHSIKRLPSLVADVWGANTFPVRKYNSRTFHLKIRRSRLFRFFRCFPQINVGGDSARIPFVEHASRESRVALPLKGRFIEPPSSPLLRLSMGSIP

SEQ ID NO: 125160 - protein, 66 aa, Glycine max
  Coding DNA Sequence Number=SeqID_33475
MDKWQRRSPQTRSPQCGCSHGSAGQFDTKTISGRRRKEKNDRVQDRIQGLHNPNSQSISFVLLDLR

SEQ ID NO: 125161 - protein, 72 aa, Glycine max
  Coding DNA Sequence Number=SeqID_33476
MIGTSKPYTGAMRGIVHEPQVNVGADSKFSPNRFPATRLEVLTQQVPYYKVMMKDNDWHLKALHWGNEGHRA

SEQ ID NO: 125162 - protein, 93 aa, Glycine max
  Coding DNA Sequence Number=SeqID_33477
MGSSAAIIVVESPNTRTGLAPNLKTVRDDEVKASKKVMSLGTRNQEGPKGRTRPKQSFEGLYRAAIVSSSSEEVKGIITGQRHDLEGRAKGLP

SEQ ID NO: 125163 - protein, 76 aa, Glycine max
  Coding DNA Sequence Number=SeqID_33478
MVVSFFLTIFSLKWRLQSSFFLLHSASIHLQEAKDSIDEEDPRPTSSTWSYIIWFHNLIGYPRNVDFVSLDFRHLD

SEQ ID NO: 125164 - protein, 137 aa, Glycine max
  Coding DNA Sequence Number=SeqID_33479
MWDATIFGVFNQNFPLYIKHEDLSEIAHGGQCLSISVIQLWILPDNYLKGIINSALKVLDDTPHRNPRLLLGGLLLRQKGITECGYYVMHWMSTIILGSFRNNWETYFNEVRPLEAERFKALRIQWAQYYLKVRNQT

SEQ ID NO: 125165 - protein, 181 aa, Glycine max
  Coding DNA Sequence Number=SeqID_33480
MTDPGSLLLRPRKEDKSPKQVRVRGHLIKFDEDTLNTFLKTPVIIEEGETLPAYSRFALLRPNPQELAAKLCIPGRGFELNADGQPLKILRKNMTTLAHTWSVFSYSNLIPTSHTSNITLDLAKLIYGIIMKMDMNLGYLVSYQISIIAQHDSSRLGFPALITALCKAREVTSDFQPSDSR

SEQ ID NO: 125166 - protein, 35 aa, Glycine max
  Coding DNA Sequence Number=SeqID_33481
MDCDIFGSDDRRNEDNEAEKSVWSKGEARKQHSLE

SEQ ID NO: 125167 - protein, 206 aa, Glycine max
  Coding DNA Sequence Number=SeqID_33482
  Subcellular localization annotation: CTP_CleavageSite=41; ConfidenceScore=5.32e-01
MAEPSKKRKGSSSTAAAAAHRRHGPSEAPTAPIHPSLSSPRSSTLFSSDDQRLRYLSQFSSRIILDPKYLDVDFFNDETFDCYQVFQNSGLVDFMSLKLPHYPELVKVFYCNLKIQDGIISSEVHGIPMIIDQSLFFSLTHLPSQGAPFEGTIVDDWIFDYSSHDARRMVCNDQAEMTVVRSTGLTWFGTECIRHYGPMHLSLTLN

SEQ ID NO: 125168 - protein, 68 aa, Glycine max
  Coding DNA Sequence Number=SeqID_33483
  Subcellular localization annotation: CTP_CleavageSite=26; ConfidenceScore=5.13e-01
MWTTTGTSNESKSLVRGEVVAAQLAQASRVASSRSNRLLEESSGGPKWAWVLFAPPFLLSTPPSAVFW

SEQ ID NO: 125169 - protein, 96 aa, Glycine max
  Coding DNA Sequence Number=SeqID_33484
MAQEQTWMPCVLLEQVRNQPNTEGGQATDDPCATLFAPSSVLCGSKPLAESLTTVAILLKEGRHPEESISKAGRSIGVIDAMASMDTSAKVNSKIF

SEQ ID NO: 125170 - protein, 83 aa, Glycine max
  Coding DNA Sequence Number=SeqID_33485
MAQPPPRERTLREMAAPDFTYESLCIQYPDEDVPYVLKTGLIHLLPKFHGLAGEEPHKQQQQQQQQQRLIPLGGVGYMDQLPP

SEQ ID NO: 125171 - protein, 145 aa, Glycine max
  Coding DNA Sequence Number=SeqID_33486
MAKFDPDIVLEFYANAWPTEEGMRDMRSWEGYECEFSQRRNQADGFDEEAIAQLLCIPGQDFARTAAGRRVQIMCTSMTTLTQMWMTLLLSNVLPSDHNSDLPLPKCMPPTRHPLDPDKSNRALGFPALITGLCQSFGVPVTPSK

SEQ ID NO: 125172 - protein, 220 aa, Glycine max
  Coding DNA Sequence Number=SeqID_33487
ASSARGGNRADGIDEEAIAQLLCTPGQDFAWTATGRQVRIMCTNKTTLTQTWMTLLLNNVLPSNHNSDLPLPKCQLVYAILTRMSVHVAQAPSRPDKSNRALGFLALITGLCQSFGVPVTPNKVIRPPITRAFIEKYCTPRQAQGDAPQGADAPPPPRQADPAEPLGMERYLQHLVRQQAANHRGQAGEEPAGYPYRMDEPRMDEDMTDLFDFLGGSEAT

SEQ ID NO: 125173 - protein, 57 aa, Glycine max
  Coding DNA Sequence Number=SeqID_33488
MTKSKGKDPLEGLGGPMTRARARKAKEALQQVLSILFEYKPKFQGEKSKVVNDIKLF

SEQ ID NO: 125174 - protein, 101 aa, Glycine max
  Coding DNA Sequence Number=SeqID_33489
GVVLAEVLLADSRFTRPDMGFHPTKLNFVPSDADEAPLDVSICLHAFGIVGCGSFSGVKSCEREDPFHPGLFVGDAGGFQSPTRETTLVVHHNGFLWAHGG

SEQ ID NO: 125175 - protein, 125 aa, Glycine max
  Coding DNA Sequence Number=SeqID_33490
  Homolog annotation: Hit_ID=Q6UUU1; Match level="QueryCoverage=56%, HitCoverage=47%, E-value=4e-20, Identity=74%"; Hit description =Putative uncharacterized protein
MAYERGGDFLEDARKILNREVRGPRQSRFSIGSAPLTSITKSDAQISGGETRQDYKDTRAFPPGGLPRGALLFLPFGFTGCHSAVMGRVLSHSTPDTQFRGRQVRSKLDCMHETPRSVRPLRLIR

SEQ ID NO: 125176 - protein, 96 aa, Glycine max
  Coding DNA Sequence Number=SeqID_33491
  Subcellular localization annotation: CTP_CleavageSite=39; ConfidenceScore=5.09e-01
TDGVVRNGKSTAGTSALARRSVRALFAITPAGERGMCCKAIKLGNARVFPVTTLNSILKKEETVEPAINWWSGKCEAKSNIETCGAPFGFVPFVAP

SEQ ID NO: 125177 - protein, 184 aa, Glycine max
  Coding DNA Sequence Number=SeqID_33492
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MKHFTDTLISANIGTKAGTGPPLEVDGIDKLDNRARSPGARRSGEPRARRRRRGRPARGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 125178 - protein, 131 aa, Glycine max
  Coding DNA Sequence Number=SeqID_33493
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=89%, HitCoverage=96%, E-value=5e-25, Identity=55%"; Hit description =Putative uncharacterized protein
  Subcellular localization annotation: CTP_CleavageSite=25; ConfidenceScore=5.63e-01
MTMITPSSKLTLTKGNKSWYRAPPRGRRVTSGVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVV

SEQ ID NO: 125179 - protein, 170 aa, Glycine max
  Coding DNA Sequence Number=SeqID_33494
MDSGRFQVSVPGNSYPSKTFLEEMYWQFLIFAYALIFRQYIFGWFLGQVVPLYLSKSSTLNLGGVMILGTRNNSSRVVVVGDTEGSPPNLQGYTTNCLALQWVIQGSNGDCGGASMCTVMGRETSCMIRKMEVVRLLMVWEELLTTSLGMYATLGGYSLSIANWGNGVLF

SEQ ID NO: 125180 - protein, 88 aa, Glycine max
  Coding DNA Sequence Number=SeqID_33495
  Gene Ontology: Cellular component=chloroplast
  Homolog annotation: Hit_ID=Q49KT9; Match level="QueryCoverage=45%, HitCoverage=35%, E-value=6e-11, Identity=77%"; Hit description =Putative uncharacterized protein ORF113
MKPESLVIAGQPYGGEFVPGPCTHRPSHYGSCHARSRYLNRKEGDAEGRASDWSEVVTSHMDSLMCSSAPDPEMWIIQGTLAWRTSPV

SEQ ID NO: 125181 - protein, 204 aa, Glycine max
  Coding DNA Sequence Number=SeqID_33496
  Gene Ontology: Cellular component=chloroplast
  Homolog annotation: Hit_ID=A7B5X1; Match level="QueryCoverage=30%, HitCoverage=81%, E-value=1e-17, Identity=70%"; Hit description =Putative uncharacterized protein
MHHLCPRSRRHPSLSRGFAACQALVRFFALHRIKPHAPPLVRAPVNSFEFHSCERTPQAGYLTLSVSAQQSAFAVGVLSDLYAFHRSTGIPSAPTVLQLGSFHRLSRVSLGFDGELKKPPTDALRPIIPDNACILCLTAAAGTELADAYSPDTVIASSPGKESFMTRRPSTFTRHCSVRLSPIAENSPLLPPVGVWAVSQSQCG

SEQ ID NO: 125182 - protein, 187 aa, Glycine max
  Coding DNA Sequence Number=SeqID_33497
MERSMIDAANGGALGVMTLAEARNLIKKMASNSQQFSARNDAIVLRGVHEVATDSSSSTENKMLKGKLDALVNLVTQLAMNQKFAPVARVCGLCSSADHHTDLCPFLQQSGVNEQPETYAANIYNRPPQQQNQQQQNNYDLSSNRYNPSRRNHPNLRWTSPPKQQQPVPPFQNVAGPSKPYVPPPIQ

SEQ ID NO: 125183 - protein, 88 aa, Glycine max
  Coding DNA Sequence Number=SeqID_33498
MVHLLWINLSGGYIHLVVQREQGRVHPLGCSKRTREVMQAPLELVGLGSSSSMDSFASWKIKGSGMEKEEREETPLQGEDESRRSSPP

SEQ ID NO: 125184 - protein, 227 aa, Glycine max
  Coding DNA Sequence Number=SeqID_33499
  Homolog annotation: Hit_ID=Q84VH5; Match level="QueryCoverage=100%, HitCoverage=37%, E-value=1e-70, Identity=60%"; Hit description =Envelope-like protein
  Subcellular localization annotation: CTP_CleavageSite=21; ConfidenceScore=5.25e-01
MATSPKDTSSPGSPSVPSSPSSTKAPSNQEQPEFHIQPIQMIPGQAPVPEKLVPKRQQGVKISENPSIATSPREHFENASVPDADKDVPTSSTPNAEVLSSSSKEKSTEEEDQATEETPAPRAPEPAPGDLIDLEEVESDEEPIVKKLALGIAERLQSRKGKTPITRSGRIKTIAQKKSTPITPTTSRWSKVAIPSKKRKEISSSDSDDDVELDVPDIKRAKKSGKK

SEQ ID NO: 125185 - protein, 83 aa, Glycine max
  Coding DNA Sequence Number=SeqID_33500
PLGPSGIFLQKAVASGGSNPARLGELGGNLLPYFAINRGGRQEGRAEALPKRFRNVFREESRKDFNRSSTFFIRSSSFFDLQR

SEQ ID NO: 125186 - protein, 100 aa, Glycine max
  Coding DNA Sequence Number=SeqID_33501
MKKDEESSRNRARKCFGSASAWIFFSETIFLTNFKRILNTIRAERNYSTLFPLFIGKKREVVAAQLAQASWVASTRRQRLLLEPLEGPSGPGCYLHTFFY

SEQ ID NO: 125187 - protein, 146 aa, Glycine max
  Coding DNA Sequence Number=SeqID_33502
MTMITNSSSVPEVCDEMAPRKLASKRSRKDKAAEGTSSAPEYDSHRFRSAVHQQRFEAIKGWSFLRERRVQLRDEEYTDFQEEIGRRRWAPLVTPMAKFDPEIVLEFYANAWPTEEGVRDMRSWVRGQWIPFDADAIGQLLGYPLV

SEQ ID NO: 125188 - protein, 193 aa, Glycine max
  Coding DNA Sequence Number=SeqID_33503
MSGFTRDSPQISASPHQLDLAPYASEPYNAQWNAPGLLRDKYTLRSSRILGDMEVDEPWLGLWLPLNYQVDMGASGVRHWKCGRQTLWLIWGWPLWITGWWVRRRNGSHSMVLLFLTLSFAQFSQSSSRMIKFASFRTHIDPFTGEDQICKALRVRSLPSFHSRVPIMCLPSRLSSPFLHMFCSCILSGTISE

SEQ ID NO: 125189 - protein, 37 aa, Glycine max
  Coding DNA Sequence Number=SeqID_33504
MDSARSMCGSAKKKCFTLAIDQKQEANPFVFPFNTTR

SEQ ID NO: 125190 - protein, 116 aa, Glycine max
  Coding DNA Sequence Number=SeqID_33505
MANLRFEVPLENRDLPRVDLGFYKPWRSKTHQGWTLGLTSLRRRKTHQGWALGLTSLWRCETHQGRTLGLISLWRNETHQVLTLGLASIWRSETYQGKTLGLTILWRSETPQGRTA

SEQ ID NO: 125191 - protein, 80 aa, Glycine max
  Coding DNA Sequence Number=SeqID_33506
MHPCGHLCIKFNGHVTLGVDNMPFCGRAKDKIGEVVAAQLAQASSARPGEQGSSPEATAFWRNLLEGPSGPGCYLHPHFY

SEQ ID NO: 125192 - protein, 190 aa, Glycine max
  Coding DNA Sequence Number=SeqID_33507
  Pfam annotation: Domain name=Transposase_23; Domain location=37-107; Score=4.6; E_value=0.00037; Accession=PF03017.5; Description =TNP1ENSPM transposase
MQSQGLAPPLDPLVGPSGPRVSTKGSYVDPSGNDPETGDSDRCNLYIEADHARLVAMGRVVEGSTVVHNTPLLPGKVKVSVEEVTDADAPVHVPTDEVSLVGQELHTFLAWPTHLVVVSPAKPPPKPDPEVDDLLYLMTLTISELFLRPYQVRWDATVFRVFNPDFPLYIKHEDLSEIAHGGQCLSISML

SEQ ID NO: 125193 - protein, 408 aa, Glycine max
  Coding DNA Sequence Number=SeqID_33508
  Homolog annotation: Hit_ID=Q84VH5; Match level="QueryCoverage=88%, HitCoverage=61%, E-value=1e-172, Identity=78%"; Hit description =Envelope-like protein
KEESTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVERWKFVYQRRLAVERELGRDALDCKEIMDLIKAAGLLKTVTKLGDCYESLVREFIVNIPSDITNRKSDDYQKVFVRGKSSNCKEITAKQVQHWPKKGKLSAGKLSVKYAILHRIGTANWVPTNHTSTVATESFAVKLPIAFPTVLCGIMLSQHPNILNNIDSVKKRESALSLHYKLFEGTHVPDIVSTSGKAAASGAVTKDALIAELKDTCKVLEATIKATTEKKMELERLIKRLSDSGIDDGEAAEEEEEAAEEEEDAAEDT

SEQ ID NO: 125194 - protein, 61 aa, Glycine max
  Coding DNA Sequence Number=SeqID_33509
QTLVDGGHHAQGTPSCLPKSKAPARWIIVKYFNNPRPLVPERLKALRIQWAQYYLRVRAQS

SEQ ID NO: 125195 - protein, 111 aa, Glycine max
  Coding DNA Sequence Number=SeqID_33510
MPFCGRARQGSQVRFPKEENARNRHQRLFVEKVRKTEGNRAKRIFQVRELYLRLRKVDKSGALAPTYPPSKRKSDLRSSFFKGASSDSFYLEGDHFKALDLKMIHLLGKKT

SEQ ID NO: 125196 - protein, 139 aa, Glycine max
  Coding DNA Sequence Number=SeqID_33511
MASRKRKVPSTPTQARFDRSIFNSQEAGERYTDVIVPRKLLPERNVVIYYTEFDEFKEELERCHWDEELTDFIDGNIDVAIVKEFYANLYDPEDKSPKPDPQELAAKLCILGRGFELNADGQPLNILRKKMTTLAQTWS

SEQ ID NO: 125197 - protein, 86 aa, Glycine max
  Coding DNA Sequence Number=SeqID_33512
  Subcellular localization annotation: CTP_CleavageSite=45; ConfidenceScore=5.07e-01
MVKVGTSYVPINVSFRQKLAQGFPVLQWLLFLSAVPPVQLLTGVAAQLLGRAIGAGLFAITPAGERGMCCKAIKLGNARVFPVTTL

SEQ ID NO: 125198 - protein, 96 aa, Glycine max
  Coding DNA Sequence Number=SeqID_33513
MELTSDGPYDVYPPHGKRPRGGHDIQRMWWSIDIVHECLTFKAFPYMGAAIAFHGEPVIPYCKDLPGHSMPIGDASAHEETGRQSPQCPFVVVESL

SEQ ID NO: 125199 - protein, 139 aa, Glycine max
  Coding DNA Sequence Number=SeqID_33514
MSGFTCDSPQISASPHQLDLAPYASEPHNAQWNAPGLLHDEHTLRSSRILEKMEIDEPWLGLFHCKIHFLVGVLVYAKGGVCHWKCGRNGSHNTGFSFILTLFICPSFLIRPSRMTKFAFFQTHIDPFTGKDQIRKALK

SEQ ID NO: 125200 - protein, 210 aa, Glycine max
  Coding DNA Sequence Number=SeqID_33515
  Homolog annotation: Hit_ID=A0ST23; Match level="QueryCoverage=11%, HitCoverage=51%, E-value=6e-07, Identity=100%"; Hit description =Putative reverse transcriptase
  Pfam annotation: Domain name=Ins_element1; Domain location=9-72; Score=-23.4; E_value=0.026; Accession=PF03811.4; Description =Insertion element protein
  Subcellular localization annotation: CTP_CleavageSite=77; ConfidenceScore=5.33e-01
YDGVLRSPVASVLFSCPSCSATDGVVRNGKKHRRTSALASVAGASHSAIQAAQLLGRAIGAGLFAITPAGERGMCCKAIKLGNASVFPGIVSLWVKVKHKVNFISMRFHLNLKDEDVIDHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 125201 - protein, 90 aa, Glycine max
  Coding DNA Sequence Number=SeqID_33516
MDEFDVQVAWPGAQPSPSGGGGASAAQKPAPEEPTTTVEGEDELTPLEPFYFDADAHIAQEEGTSTDQIHEPSPAPVPNETQPSTLVTEP

SEQ ID NO: 125202 - protein, 129 aa, Glycine max
  Coding DNA Sequence Number=SeqID_33517
  Subcellular localization annotation: CTP_CleavageSite=5; ConfidenceScore=5.01e-01
MPQHNASHNNYMRVKGRPPQSSSPLSKPGNRLHPLVIDYQKPSWLSDLVFKPSNRLHPLELACLGTSQVLTDRLCPGWVGIGQAWFWEIAPHLTSPRSPNPRDISPGTTLWSTIKAGSFTLQHFLISSL

SEQ ID NO: 125203 - protein, 86 aa, Glycine max
  Coding DNA Sequence Number=SeqID_33518
  Subcellular localization annotation: CTP_CleavageSite=68; ConfidenceScore=5.35e-01
MAKIQGLKVGKPILIFTKKSGPNLGPWAQKSILRFMRTLGPSLASSSPILLESFAHGSVSAPPEKGIKSEMLKVVLTPYSFGRSNL

SEQ ID NO: 125204 - protein, 142 aa, Glycine max
  Coding DNA Sequence Number=SeqID_33519
  Homolog annotation: Hit_ID=Q84VH5; Match level="QueryCoverage=72%, HitCoverage=16%, E-value=8e-39, Identity=73%"; Hit description =Envelope-like protein
MIPGQAPAPEKLAPRRQQGVKISENPSLATSPREVDTEMDKKIRSIVSSILKDASVPDADEDVPTSSTPNVSVPDVDEDVPTSSTPNVSVPDADKDVPTSSTPNAEVLSSSSKEDSTEEEDQATEETPAPRAPEPAPVTSLT

SEQ ID NO: 125205 - protein, 92 aa, Glycine max
  Coding DNA Sequence Number=SeqID_33520
MGPKSTLRLIRTLGPSLASLAQSTWSFSIQCPCGVGLHQIVAYTGRGIPPPLLGTSQSLSNGSFMEAKLHDESKIIQRCFDDNNDDTKMMTK

SEQ ID NO: 125206 - protein, 184 aa, Glycine max
  Coding DNA Sequence Number=SeqID_33521
PTVEEFEGILGCPLGGRKSYLISGLYPSMARIAKVVKVSVQELDRVKQNRNGVVGIPRKYLEEKAKALEDQDEWASFIDVLALLVFRVVLFPNVDGLVDLAAIDAFLAYHHSKARKVWSLMFWPMPMIHLTGDVRGAVQGLSTAHPLFMYGWSLTSFVMKVDSSAPYKVIAWVPRKGKQIGSNS

SEQ ID NO: 125207 - protein, 157 aa, Glycine max
  Coding DNA Sequence Number=SeqID_33522
  Gene Ontology: Biological process=transposition, DNA-mediated
  Homolog annotation: Hit_ID=Q1J7G7; Match level="QueryCoverage=19%, HitCoverage=42%, E-value=2e-10, Identity=100%"; Hit description =Transposase
GFPVSQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSISAGVATLLTTEHIRSDERSVYWLTMLGTDEGVSEVLHVAGRKKAAP

SEQ ID NO: 125208 - protein, 60 aa, Glycine max
  Coding DNA Sequence Number=SeqID_33523
MARSVFASCPYSRDLYGRELKSPSGVANCRNLPFGGRATRDSRDACSTKGIRAESPPTFI

SEQ ID NO: 125209 - protein, 156 aa, Glycine max
  Coding DNA Sequence Number=SeqID_33524
LHSLAFERRHVLNFRGLHALAFRGLRVLTFRACSFLLTVPGPPPDIGGRPTVQAQPEREAITQLLCIPGQDFTRTTAKRQGSHPSRHPVDPEKSNRALGFQALVTGRNTTAALGWPVAGNRHTATTSRVHLSSSAKRLERCLRHMADQQATKSKAK

SEQ ID NO: 125210 - protein, 70 aa, Glycine max
  Coding DNA Sequence Number=SeqID_33525
LERIDGDPVLRETRRWATWEYVSSVGGGQQGMETLGTSGGVLLPKTKLDQSRPNPGIVGQLRTCDVPKAG

SEQ ID NO: 125211 - protein, 113 aa, Glycine max
  Coding DNA Sequence Number=SeqID_33526
  Subcellular localization annotation: CTP_CleavageSite=41; ConfidenceScore=5.12e-01
SIPVVPVLSDCSTPRKRPEGPVPIRPPTGTRRPALAAEAARAVHRQPTGSGLGPPCPALRANPFPEYDRAWEALGPPDFQGPPGAHRTPRDVRCSSSRWTLPPAEPFPGWAGC

SEQ ID NO: 125212 - protein, 257 aa, Glycine max
  Coding DNA Sequence Number=SeqID_33527
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=99%, HitCoverage=52%, E-value=1e-99, Identity=93%"; Hit description=DNA -directed RNA polymerase subunit beta'
  Pfam annotation: Domain name=RNA_pol_Rpb1_2; Domain location=73-204; Score=181.3; E_value=2.4e-51; Accession=PF00623.11; Description=RNA polymerase Rpb1, domain 2
MDSSLIEWKELGEEGSPDNENEWEDRKVGRRKNFLVRRIELAKHFLRTNIEPEWMVLCLLPVLPPELRPIIQIDGGPSLSLHRCGLPREIAIELFQTFLIRGLIRKHFASNIGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRRGIYSNRYNPRNCGNSRNLKK

SEQ ID NO: 125213 - protein, 184 aa, Glycine max
  Coding DNA Sequence Number=SeqID_33528
MVLKEELVACSRSKRSLSQCLCETETNMLAIIAKYQEELGLATAHEHGIADEYAQVYAEKEARGRVIDSLHQEATMWMDRFALTLNGSQELPRLLAKAKAMADTYSAPEEIHGLLGYWKNTITKRATRHPYRTRSKSRTMGDQEETQEQMKADMSALKEQMASMMEAMLSMKQLVEKNAATAAA

SEQ ID NO: 125214 - protein, 81 aa, Glycine max
  Coding DNA Sequence Number=SeqID_33529
MGHIQENCYSLHGFPDKVAQVSRSKKAESKFSDEEYLSSIPCFSTACISQSIEGPSPWILESGASDHISETWDGATDWRRT

SEQ ID NO: 125215 - protein, 56 aa, Glycine max
  Coding DNA Sequence Number=SeqID_33530
MKNTKNGFPLLAVTYLVENLSGLKVLAFYLLSLEEIPLSFASGARMRILLIGQGPK

SEQ ID NO: 125216 - protein, 390 aa, Glycine max
  Coding DNA Sequence Number=SeqID_33531
  Homolog annotation: Hit_ID=Q2HW90; Match level="QueryCoverage=73%, HitCoverage=56%, E-value=2e-15, Identity=27%"; Hit description =Putative uncharacterized protein
MDGLVDLAAIDAFLAYHHSKESSVVAILADLFDTFDRRCEKSSARIICCLLALCVWLVSHLFQQDTRHPCPLRSHRSCVEKRRVDWDQHLAGIGGRTINWFPRWKEGNEGVLFSCGDYLNILLIGTRGCINYNPTLAIRKLGYPMRGAPTEERLSHFLVRDFSAQSFKIIQRVHKAWESPLRKDKEVRGIRNGIIGGKARLAKEKFKLVATDVRKECAGLREENAATTKALEQETKRARKEEHDRDKFRGALWGSNSELKLRREERDQSRAHSKVLKKELAACSRSKRNLTQCLCETETNMLAIITKYQEELSLATAHKHRVADEYAQVYAEKEARGRVIDSLHQEATMWMDRFALTLNESQELPRLLAKAKATANTYSAPEEIHGLFDY

SEQ ID NO: 125217 - protein, 94 aa, Glycine max
  Coding DNA Sequence Number=SeqID_33532
MGTRTRYEKIWNKWLNPKGIEEQWRITFEKQHHISACPTFNQYAMYIKYGSKYIMKHDQQNMLSNETKTPTLIPKPIPKLQNSFKDMVISWFFT

SEQ ID NO: 125218 - protein, 101 aa, Glycine max
  Coding DNA Sequence Number=SeqID_33533
CVRVIPLWERRLVDLPGRYHSHLVGDEGWQEVFVRHWDCGECCPRGKVPYRVGTDAKVGITGRASRGWSRSLGVSLWMGVGALACMGAELEESPARAEKLG

SEQ ID NO: 125219 - protein, 97 aa, Glycine max
  Coding DNA Sequence Number=SeqID_33534
  Homolog annotation: Hit_ID=Q84VH5; Match level="QueryCoverage=43%, HitCoverage=6%, E-value=4e-15, Identity=100%"; Hit description =Envelope-like protein
MSDTNCPGDTVPTNTVDTWEMLLGALIAELKDTCKVLEATIKATTEKKMELERLIKRLSDSGIDDGEAAEEEEEAAEEEEDAAEDTESDDDDSDATP

SEQ ID NO: 125220 - protein, 195 aa, Glycine max
  Coding DNA Sequence Number=SeqID_33535
MTTMMERMMSMRRMMEVNVATVVAGGKALGSMGGPHFVQVQSKHSFPPYGLPPNNTPLNTTHTPDENVDHSAPIPIENQHPQSGHAQVSQPMGETHEAPRDHNLVDFEPHVGYATEGVPSAMVERERFDHIKERLRDIEGGGDYAFADMAELCLVLDVVIPLKFKVSDFNKYKGTTCPKNHTEDVQQENGGILEK

SEQ ID NO: 125221 - protein, 121 aa, Glycine max
  Coding DNA Sequence Number=SeqID_33536
MTLSLSNILPSDRNADLPLRKYQLVCVVPTDRAHKTPSGPGEVQQGPGDRARKTPSGPREVQQGLGVSSSDYGPFSVLRSACRPQQGHQAPTNRAFIKKYCVPGSCRAKHHSSLGMAGSGQ

SEQ ID NO: 125222 - protein, 122 aa, Glycine max
  Coding DNA Sequence Number=SeqID_33537
  Homolog annotation: Hit_ID=Q84VH5; Match level="QueryCoverage=50%, HitCoverage=9%, E-value=8e-24, Identity=95%"; Hit description =Envelope-like protein
RISSIPALQTVEGTHVPDIVSTSGKAASGAVSKDALIAELKDTCKVLEATIKANTEKKMELERLIKRLSESGIDDGEAAEEDGEAAEEEEEAAEEEEEAAEEEEDAAEDTDPDDDDDSEATP

SEQ ID NO: 125223 - protein, 156 aa, Glycine max
  Coding DNA Sequence Number=SeqID_33538
MIMRSQDIYSSQDEATTSPSSSESEEAKGEESSEEIYPQEEGKPLMVKEECKETLVSIATSLRLEFIPQVKELLDEGLVRKRLNPCALLVPKIGIIRHQIPKIGGVMNALGGATLFCFITHAPNIFMICVHRDSLGRVPMNPKRIKVIPEWPAPPS

SEQ ID NO: 125224 - protein, 211 aa, Glycine max
  Coding DNA Sequence Number=SeqID_33539
ANNHKVCPRAIKPSGHDSRIETFLRSRSEDADISGKGADDNIGADNHKVCPRATEPLGHDSRIETFSRSRPKDADISGKGADDLIGADNHKVCPCATVPLVHDSDIETFLRSRPEDADISRKGADNHKVCPRATGPLGYDSEIETFSHSQPEDADIFRKGADDHIGLCLSIRLGHVGLLTVNGSFFLGDPTVPSSEGKDGNSHPGSRFMVI

SEQ ID NO: 125225 - protein, 210 aa, Glycine max
  Coding DNA Sequence Number=SeqID_33540
MAASDIAILRDRAHVAGCAIYGGAHNSGYRIPNEEPVHEVNYMGNQPRQNFNAGGYSKFQHGQPYNSQQGQWRNHPGNQFNKDQGGPSTRPQQQGLSLYYRTMKLEETPAQFMQSLEVQVGQLAKQLADRPSSSFTANTEKNPKEECKAIMTRSRMAIQADEGRAKEKVEEFKQLSTVKPTPEPVSDFVELEEVMEDEDDQQERDTNERE

SEQ ID NO: 125226 - protein, 62 aa, Glycine max
  Coding DNA Sequence Number=SeqID_33541
MKSKILHQVCLGVMRHALDLLHQWSPLLFEDHGSGMEKEKDDWRCHFKEKMILEEAHHHRKP

SEQ ID NO: 125227 - protein, 148 aa, Glycine max
  Coding DNA Sequence Number=SeqID_33542
MGIAPQDTQWTRKSPTGPWGFQLWLRASISPTGCPYPPRQGHVIIGIAPARHPVDPKKSNRVLELSSSKYGSLSVQGSACCPQQGHQAPYQSSFHLEVLRPQAGAGRDTTAALGWTVAGNRHTAITTKVHLSSSIKRLERCLRHMADQ

SEQ ID NO: 125228 - protein, 69 aa, Glycine max
  Coding DNA Sequence Number=SeqID_33543
LRNWWGRAIGAGLFAITPAGERGMCCKAIKLGNASVFPVTTFVYWAYYVGTDEGVSEVLSCGRRKKAAP

SEQ ID NO: 125229 - protein, 21 aa, Glycine max
  Coding DNA Sequence Number=SeqID_33544
YENDRLKEKKIEKISKKKIFS

SEQ ID NO: 125230 - protein, 81 aa, Glycine max
  Coding DNA Sequence Number=SeqID_33545
  Subcellular localization annotation: CTP_CleavageSite=72; ConfidenceScore=5.04e-01
HPGPLGPSGIFLQKAVASGGSNPARLGELGGNHLPYFAINRGGTEALPKRFRNVFREGFRKDFNRSSTFFIRSSSFFDLQR

SEQ ID NO: 125231 - protein, 76 aa, Glycine max
  Coding DNA Sequence Number=SeqID_33546
MAKFAILMRAPPSLVTTQKLHGQQGNQHGSTSNLEDLSDEYETCWVKNHDSDTDSSSGPEGSNLSPSHERIFKQDW

SEQ ID NO: 125232 - protein, 201 aa, Glycine max
  Coding DNA Sequence Number=SeqID_33547
  Gene Ontology: Cellular component=membrane; Biological process =lipopolysaccharide biosynthetic process
  Homolog annotation: Hit_ID=A4WG26; Match level="QueryCoverage=95%, HitCoverage=66%, E-value=5e-89, Identity=73%"; Hit description =Lipopolysaccharide biosynthesis protein
MMTQPLAGAKSVVTENELDIRDRPTVNMLGGYYSQQQFLRNLDIKASLATPDQASVMDEAYKEFVMQLASWDTRRDFWSQTDYYKQRRVDNTKADAALLDDLINNIQFMPGDALRNVNDSVKLIAETAPDANNLLRQYVAFASQRAASHLNEELKGAWAARTIQMKAQVKRQEEVANAIFARRIHNIEQALKLRSSTYFPL

SEQ ID NO: 125233 - protein, 129 aa, Glycine max
  Coding DNA Sequence Number=SeqID_33548
PTVKEFEEILGCPLGGRKPYLFSGFYPSTTRVAKVVKISAQELDRVKQNRNGVVGVPRKCVLFPNMEGLVDLAAIDAFLAFHHGKESPVVAILAMHDTFDQRCEKSGARIVCCTPALYVWLVSHLFHQE

SEQ ID NO: 125234 - protein, 169 aa, Glycine max
  Coding DNA Sequence Number=SeqID_33549
HARNEALMEKNMATTAAVSSAAEADPTLLATAHHPPPNTVGRGRNTLGHNSNPHLGYNRAAYPYGLPPNYTPPIMQDDARDVDFYPPIPVEGPAPNTLPHPNLITQPIILSTEGPPPATEERRKLDLLDERLRAVEGFGDYPFANMTDLCLVPDVVIPPKIQSVGLRQV

SEQ ID NO: 125235 - protein, 124 aa, Glycine max
  Coding DNA Sequence Number=SeqID_33550
ALGFPALITGLCQSYGVPITPSKVIRPLITRAFIEKYCTPRQAQGNAHQDAGARPPPRQADSAAKHHGQVQIHECLYRFSLSQQGQPDAQVGEDPTGSPGEADESRMDEDMNDLLGFLRGSGAT

SEQ ID NO: 125236 - protein, 91 aa, Glycine max
  Coding DNA Sequence Number=SeqID_33551
MIQRTNRLRILCPNTLEGISFVVQVEGTSTWGLFTENKRGYISCGSVQVEGTSTWFSKRTREGTSLVDLWLVKDLQVEKNLKNRRYLRDWM

SEQ ID NO: 125237 - protein, 30 aa, Glycine max
  Coding DNA Sequence Number=SeqID_33552
MTQQTFRKGIEERIPKFQEPLALRSNPFQG

SEQ ID NO: 125238 - protein, 87 aa, Glycine max
  Coding DNA Sequence Number=SeqID_33553
MVVILPKENLVVWFCSLHNRSDNYLNRIINSTSALKGLDDTPQPKSKAFARWIVVKYFNEVRPLEAERFKALRIQWAQYYLKVRNQT

SEQ ID NO: 125239 - protein, 348 aa, Glycine max
  Coding DNA Sequence Number=SeqID_33554
  Homolog annotation: Hit_ID=Q84VI1; Match level="QueryCoverage=100%, HitCoverage=52%, E-value=1e-166, Identity=86%"; Hit description =Envelope-like protein
MDKKIRSIVSSILKDASVPEADEDVPTSSNPNVSVPDVKKDVPTSSAPNAEALPSPGEEGSTEEDDQAAEETPAPRAPEPAPGDLIDLEEVESDEEPIANRLAPGIAERLQSRKGKTPIKRSGRIKTMAQKKSTPITPATSRRSKVAIPSKKRKEISSSDSDKDVELDVSTSKKAKTSGKKVPGNVPDAPLDTSLSTPLAILAVERELGRDALDCKEIMDLIKAAGLLKTVSKLGDCYEGLVREFIVNIPSDISNRKSDEYQKVFVRGKCVKFSPAVINKYLGRPTDGVIDIDVSEHQIAKEITAKRVQHWPKKGKLSAGKLSVKYAILHRIGAANWVPTNHTSTVAT

SEQ ID NO: 125240 - protein, 181 aa, Glycine max
  Coding DNA Sequence Number=SeqID_33555
MEAMKEQMATMMEAIRSMKKIMEANAVAVATTRAVAKVNPMPPSALNQMNHPTSARVGKDLESTGGPHYAQIQNKHAFPTYGWPPNYTPPNVTYTPNENINKPKLIMHMPLKPWRRHMKFPTTIQPTPSLASDMPLKGKQLVIYPCKTLWRALSITHNHTPCIPQRLKTLVLWQKWESWII

SEQ ID NO: 125241 - protein, 179 aa, Glycine max
  Coding DNA Sequence Number=SeqID_33556
MAPTRHPMDPDTSNRALGFPALITGLCQSFGVPVAPTKVIQPPITRAFIEKYCTQRQAQGDAPKAAGAPPPPHRAGPAGSFDMEQYLRHLVQQQAANHRAHVQTHDCLYQLSLSMQSQGFASSSCPTPDQFRAGVAWPGDWPEAQAGEAPPEVPDDGEEAHEDEEMADFLDFLGGSGAT

SEQ ID NO: 125242 - protein, 184 aa, Glycine max
  Coding DNA Sequence Number=SeqID_33557
  Gene Ontology: Mol. function=RNA-directed RNA polymerase activity; Cellular component=mitochondrion; Biological process=RNA-dependent DNA replication
  Homolog annotation: Hit_ID=P92567; Match level="QueryCoverage=54%, HitCoverage=50%, E-value=2e-27, Identity=59%"; Hit description =Uncharacterized mitochondrial protein AtMg01410
MAVGRWALTGYPMGPFYHPATIWAAITGKLGCTCEGAGKRRIFAIGNYVRGTNVFEVPFVKRALSQVSFVTGQPLGYYGYWPLFAFTHHVLVWWAAEQVRPGILFDRYAILGDDVLITDPLVAEQYRLGLQRLGVKISTHKSLISSTGAVEFAKQFLVKDMRVNLSPVSMKALCGFHHPHGYYF

SEQ ID NO: 125243 - protein, 144 aa, Glycine max
  Coding DNA Sequence Number=SeqID_33558
ALGFPALITGLCQSFGVPVAPTKAQGDAPQAAGAPPPPHQAGQARAFDMEQYLRHLVRQQAANHRAHVRTHDCLYQMSLSMQSQGFASFSCPTPDQFRAEVAWPGDWPEAQAGEAPPEAPGDGEEAHEDEEMTDLLDFLGGSGD

SEQ ID NO: 125244 - protein, 50 aa, Glycine max
  Coding DNA Sequence Number=SeqID_33559
MDKSFKEEKMRGGRRREGAQNFVPQMRHYLSSCLHRDHDIRCWTLYTSSS

SEQ ID NO: 125245 - protein, 73 aa, Glycine max
  Coding DNA Sequence Number=SeqID_33560
MEKTPSFFNLTSFQNYVGRVPFILCHGNNPDDSHMVILTLGDVKKEDFRRKVSIKEKAKKEKKGNSQSKSGRK

SEQ ID NO: 125246 - protein, 169 aa, Glycine max
  Coding DNA Sequence Number=SeqID_33561
TGLECCYHRKKCHDALLWQLKWNFTSRGCDVWCGEPSSLLQERAAMRLAAEDSSFVVRAKYWHAAIGRLMKSQRLNWKKSDTFIRVWHELAGDSVTAHWLVRTLDENEVARMLFRKGRSKGRRPSSLLDRVNLGALWLAFRPSSLPPLVHPKDLPPLLPEWTAFEQDGT

SEQ ID NO: 125247 - protein, 144 aa, Glycine max
  Coding DNA Sequence Number=SeqID_33562
MTEARQKGVWKVNENENKSTRNKWGPPRVHRNELKSSVWGIYRLKTEEKRRTNDECRRTVENLRVITHRNVTEVPRLGFFSRIQVFLSNFKSPVESPTVATCPFCGRAKARLMGAFSKGGKMRRVTTNVYLWEDIGKTEGNRSK

SEQ ID NO: 125248 - protein, 26 aa, Glycine max
  Coding DNA Sequence Number=SeqID_33563
VRFMVSQDFGYNQGLLKWLDMIHVSV

SEQ ID NO: 125249 - protein, 105 aa, Glycine max
  Coding DNA Sequence Number=SeqID_33564
MAKSLNENLLPYMFPGEDNQMAMRLPLWAGAGRVKLLVFRQKSSDTDRPGSSHFKRNHNMTILDESWDAWGNMTNPGKRSALMGIPSPKAVYAESYYLVDIQNGP

SEQ ID NO: 125250 - protein, 172 aa, Glycine max
  Coding DNA Sequence Number=SeqID_33565
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=98%, E-value=1e-09, Identity=32%"; Hit description =UPI00006A17C9 related cluster
MLVRMIRTRLFAAARVKSCPGMHSSCVIASLSGCARTVGPPPISGVAQEPLKGNYWPLNRKGKSRTLKMRTRSPLKVRACSPLKARRCSPLEVRACSPLLARTCSPFKARTCSHLKARTSSPLKVRTCSPTKVRTCSPLMARACSPLKVRACSPLMVRRVVLSSETCSPLTV

SEQ ID NO: 125251 - protein, 214 aa, Glycine max
  Coding DNA Sequence Number=SeqID_33566
  Homolog annotation: Hit_ID=A5BSR3; Match level="QueryCoverage=28%, HitCoverage=19%, E-value=1e-08, Identity=50%"; Hit description =Putative uncharacterized protein
  Pfam annotation: Domain name=Transposase_23; Domain location=106-176; Score=3.1; E_value=0.00054; Accession=PF03017.5; Description =TNP1ENSPM transposase
MARTKKTGEMTTEAAKEITEKIDSFKEQATQGSFIPHGRQDVLAAAIGRPEHPGRVRAAGAASFSCRCNLKDLQCLLSLWLGPGPSGPRVSTKGSCVDPSGNDPEMGDSDRCGLYIEADLARLVAMGRVYEGSTIVHNTPLLPGQVKVSVEEVTYVDALVPVPTDEVSLVGQALHTFLAWPTHLVKSLSQQVVVSPPKPPPKPDPEVDDPLYLM

SEQ ID NO: 125252 - protein, 159 aa, Glycine max
  Coding DNA Sequence Number=SeqID_33567
  Subcellular localization annotation: CTP_CleavageSite=9; ConfidenceScore=5.09e-01
MKGTMQKPQANLGANEKFSPNRFPAASPHLPNFTTKVACLCIPKIHVNCIDFLHLMSNLFVATCPFAGERGEAHGCAFQRRKDARSRHQRLFVENIGKTEGNRSKTKILSSGVVFTFEEGISTSHVDKCGALAPTYPPSKRKSDLRSSSLSVNQAILFT

SEQ ID NO: 125253 - protein, 153 aa, Glycine max
  Coding DNA Sequence Number=SeqID_33568
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=37%, HitCoverage=46%, E-value=9e-25, Identity=94%"; Hit description =Putative uncharacterized protein
MIGECKGVQDNTRLERRWWGAGSGAGYGAGVGAGYGAGVGAGYGAGVAAGYGVGIESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 125254 - protein, 170 aa, Glycine max
  Coding DNA Sequence Number=SeqID_33569
MIRGDTLRLSAPPLPFRHSRVRWQAETKFGHSAHMIRGDTLRLSAPPLPFRHSRVRWQAETKFGHSAHMIREDTLRLSAPPLPFRHSRVRWQAETKFGHSAPMIRGDTLWLFAPILLLSWLTQLSAPFVPPGNNKVIYMRKFHGRPRLSSTERSELVSYTDFRGPLLDDM

SEQ ID NO: 125255 - protein, 31 aa, Glycine max
  Coding DNA Sequence Number=SeqID_33570
MQIIFDWRKSTKIVLVQGLTATVYNLLSGIL

SEQ ID NO: 125256 - protein, 104 aa, Glycine max
  Coding DNA Sequence Number=SeqID_33571
  Homolog annotation: Hit_ID=Q2A9Z4; Match level="QueryCoverage=97%, HitCoverage=17%, E-value=2e-07, Identity=36%"; Hit description=Zinc knuckle family protein
MTIEESIHVTFDETNITSPRKEFVDDIAYALEDTQNEERNLKRMRDDEDKDDQDDTTQENDNLPKEWKTSRNHPLDNIIGDISKGVTTRHSHKTPPAIIWHLFH

SEQ ID NO: 125257 - protein, 182 aa, Glycine max
  Coding DNA Sequence Number=SeqID_33572
  Homolog annotation: Hit_ID=Q6WAY4; Match level="QueryCoverage=35%, HitCoverage=11%, E-value=6e-07, Identity=44%"; Hit description =Putative uncharacterized protein
MGTDQTGKRFYQVKIKGLDITSIKELGWLMGPLQMQAFRKVYGKILDLTIAKISIEAIASLTQYYDQPLRCFTFGDFQLVPTVENLRRSRMSSWGKETVSFLRISSLLEQDCSCGQGFGERIGSCKAHSKRHSGPTTKVLIRQGEGYGESTGVGLVYGRISIANLWGCPLSKRGWFGGPSHN

SEQ ID NO: 125258 - protein, 61 aa, Glycine max
  Coding DNA Sequence Number=SeqID_33573
GVGEGFCLANLPGDAFSLWGNFFEAKKQMMPRNAKFAGAAWVKPLLKFFHVPGGRFWAVAK

SEQ ID NO: 125259 - protein, 209 aa, Glycine max
  Coding DNA Sequence Number=SeqID_33574
ELCTHKRKFKGNERISMGRKVSALIGKFVPHIPEKCNGRQIVDDYMFDFDNVLHGRKHPFLSDLHTCHSLCIESESEFEFDSMSDFYAENESEFESSSDFLGVVPFDVDFLESECTNHVAKSTYTSDLLYEVQADEPSSFPTMVPPTVQPPPTPELKPLPENHKYAYLEDKEKFPVIISASLVAEQEEKLLLVLKKHKKAIGWTLAGIP

SEQ ID NO: 125260 - protein, 30 aa, Glycine max
  Coding DNA Sequence Number=SeqID_33575
MHMTQMQFTNTGARGIVSFLDTTFGQRGTQ

SEQ ID NO: 125261 - protein, 72 aa, Glycine max
  Coding DNA Sequence Number=SeqID_33576
MVIILPKENLVVWFCFLHNRLDNYLKGIINSALKELDDTPQPKSKAAARWIVVKYFNNVRPLEAERLKVLRI

SEQ ID NO: 125262 - protein, 78 aa, Glycine max
  Coding DNA Sequence Number=SeqID_33577
MSMLQSLHQGQLLIMQSLQIMQSLQDVVQQRPFMSLEEFVQKLEPFAPVPDLPLSQDSPSGTTTLDLNEHATDSAQDH

SEQ ID NO: 125263 - protein, 237 aa, Glycine max
  Coding DNA Sequence Number=SeqID_33578
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=73%, E-value=4e-23, Identity=65%"; Hit description=LacZ protein
  Subcellular localization annotation: CTP_CleavageSite=41; ConfidenceScore=5.00e-01
MEKRLCRGPLTSLLSILWHLPRKSPPVRKPFPARRSRTTERSESVSEEAEYILYHIFLLTHRCSLFSPAHMKHFTDTLISANIVSQVYTPLAPNTQTASPRALADSLMQLARQLVLSNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASVDVRRSFAVTPT

SEQ ID NO: 125264 - protein, 152 aa, Glycine max
  Coding DNA Sequence Number=SeqID_33579
  Homolog annotation: Hit_ID=A5BSR3; Match level="QueryCoverage=67%, HitCoverage=27%, E-value=1e-09, Identity=41%"; Hit description =Putative uncharacterized protein
MKAQAIQKQNTAPHVLSRGGYDYLEQKLVAEKTKKLQEAAQSGSVDGIIDPPSPVRRHMKWKMARTKKTGEMTTEAAKEIAEKIDSFEEQVTQGSFVSHGRQDVLAAAIGTSRAPWTCPCCWSRCHHQAILWIGSHGRPVALPPCLLTNYSS

SEQ ID NO: 125265 - protein, 85 aa, Glycine max
  Coding DNA Sequence Number=SeqID_33580
MAASGYSGFQHGQNYNQQQGQWRTHPGNQFNKDQGEPSNRPQQQGPNLYERTTKLEETLAQFMQVSMSNHKRTESAIKNLEIQVG

SEQ ID NO: 125266 - protein, 72 aa, Glycine max
  Coding DNA Sequence Number=SeqID_33581
  Homolog annotation: Hit_ID=A5AIZ8; Match level="QueryCoverage=72%, HitCoverage=6%, E-value=7e-16, Identity=75%"; Hit description =Putative uncharacterized protein
MLTSPERAQMTTLASAHQSHLGSLNDEGQGYSLHADIQYFDARWEVLVVLPLRDCFAQEINMLCRLDGFVVL

SEQ ID NO: 125267 - protein, 133 aa, Glycine max
  Coding DNA Sequence Number=SeqID_33582
MRGQDIYSSQDEATTSPSSSKSEEAKREESSEEIYPQEEGQPLMVKEECKETLVSIATSLRLEFIPQVKELLDEGLVRKRLNPCALLVPKISIIRHQIPKIGGVMNALGGAILFCKITLALNIFMICVHRDSL

SEQ ID NO: 125268 - protein, 105 aa, Glycine max
  Coding DNA Sequence Number=SeqID_33583
MEREMITMIIDTLPVFYYEKMVGYTPSSFADLVFTSKRIEVGLRIGKFDYPALMNRKPGANEENKKEGETHAMTVVPTWPNFPLAQQYQYSANINPSQYPPPYQP

SEQ ID NO: 125269 - protein, 56 aa, Glycine max
  Coding DNA Sequence Number=SeqID_33584
  Subcellular localization annotation: CTP_CleavageSite=33; ConfidenceScore=5.05e-01
MGVQIATRPTWALQKIPPEAEALPKRFRNIFVRNFAKVSTVLRRSSFVLHRSSIFN

SEQ ID NO: 125270 - protein, 292 aa, Glycine max
  Coding DNA Sequence Number=SeqID_33585
  Homolog annotation: Hit_ID=Q2HW90; Match level="QueryCoverage=85%, HitCoverage=66%, E-value=6e-17, Identity=26%"; Hit description =Putative uncharacterized protein
MEPLQMQAFRETYGKILDLTIAEVSTEAIVSLAQYYDQPLRCFTFGDFQLNCNCGQGFSKRFGPHKTDSKRHSGPTTEVPRRQGEGYGQSRRLAIDAFLAYHHSKESLVVAVLADLFDTFNRRCEKSSAWIICCFPALCVWVGFTPVPARHEASMSAPEPSLEGKKGVLFSCGGYPNIPLIGTRGCINYNPALAIRQLGYPMRGAPTEESMSPFLVRDFGAQNFKAIQRIHKAWETPLRKDQELRGIRNGIIGGYHEWLKVHIRGLDWLAKLKVISEESFEAPEEDEEGGIL

SEQ ID NO: 125271 - protein, 84 aa, Glycine max
  Coding DNA Sequence Number=SeqID_33586
MFGLGKGWKLHGSYMEVIKTSINGWKAGFQKMAEEDALSLDNIECGVCAEYTDADVYGRRNSGSSKEAFEMGERRLHLSWTHSE

SEQ ID NO: 125272 - protein, 126 aa, Glycine max
  Coding DNA Sequence Number=SeqID_33587
MEIRDKQEVAEMGKRQSGKNILILWDALKQIKQQDPDCIWCFMGDFNNIRHHSEREGISPRGAEASIINDFNEWIAFSTGKRRAEPNGYTTRSAYLLMQGEATEENSDQNLMDTQLSKQHYLHSKP

SEQ ID NO: 125273 - protein, 168 aa, Glycine max
  Coding DNA Sequence Number=SeqID_33588
  Homolog annotation: Hit_ID=Q84VI1; Match level="QueryCoverage=54%, HitCoverage=13%, E-value=1e-07, Identity=42%"; Hit description =Envelope-like protein
MGYVRNMFRFNAGWVLPDADWAGRCSDDRKSTSGGMFLPDAGQQSYFQHGSKKQNWKKNLHEEPIAQQVGTWQYFKRLNSRKGKTPIDLGWTNQNYTRRRAHQSTPTTPDGAKLQSRKRKEISSSDSDDDVELDVLTSRRAKKSVWKKVPGKLMLHLLKDNIYIPLLI

SEQ ID NO: 125274 - protein, 60 aa, Glycine max
  Coding DNA Sequence Number=SeqID_33589
  Gene Ontology: Mol. function=polyphosphate kinase activity; Cellular component=polyphosphate kinase complex; Biological process =polyphosphate biosynthetic process
  Homolog annotation: Hit_ID=Q43991; Match level="QueryCoverage=66%, HitCoverage=5%, E-value=3e-12, Identity=87%"; Hit description =Polyphosphate kinase
MAKPKKLLHAPFTLHAQLINYIDDEIANAKAGKPAQIIVKPGGSTSSRAAATAVELQFAL

SEQ ID NO: 125275 - protein, 84 aa, Glycine max
  Coding DNA Sequence Number=SeqID_33590
MENCTKQSLRMAPTRWWRTHERKHNSWDSEKGLRMENCTKHIMAHGSKVMGMENCTKQSLAHGSKLVRGGRMNENAIHGAPKKG

SEQ ID NO: 125276 - protein, 237 aa, Glycine max
  Coding DNA Sequence Number=SeqID_33591
  Homolog annotation: Hit_ID=Q84VH5; Match level="QueryCoverage=83%, HitCoverage=36%, E-value=3e-89, Identity=72%"; Hit description =Envelope-like protein
EFIVNIPSDITNRKSDEYQRVFVRGKCVRFSPAVINKYLGRPTDGVVDITVSEHQIAKEITAKQVQHWPKKGKLSAGKLSVKYAILHRIGAANWVPTNHTSTVATESFAVKLPIAFPTVLCGIMLSQHPNILNYTDSVMKKESPLSLHYKLFEGTHVPDIVSTSGKVAASGAPPSSQHREEDGAGTADQRLSESGIDDGEAAEEEEEAAEEEDAAAEEEEDAAEDTESDDDDSEATP

SEQ ID NO: 125277 - protein, 18 aa, Glycine max
  Coding DNA Sequence Number=SeqID_33592
GAISRPMSGIGVFSSFPE

SEQ ID NO: 125278 - protein, 265 aa, Glycine max
  Coding DNA Sequence Number=SeqID_33593
  Gene Ontology: Mol. function=chloramphenicol O-acetyltransferase activity; Biological process=response to antibiotic
  Homolog annotation: Hit_ID=P62577; Match level="QueryCoverage=81%, HitCoverage=99%, E-value=1e-121, Identity=94%"; Hit description =Chloramphenicol acetyltransferase
  Pfam annotation: Domain name=CAT; Domain location=6-210; Score=470.8; E_value=1.8e-138; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQSDKVLMPLAIQVHHAVCDASMSAECLMNYQQYCDEWQGRGWLLPVVLLHVFPGWTQDDSYRIRRSGRTERGVRAYSPAWSELPTRN

SEQ ID NO: 125279 - protein, 149 aa, Glycine max
  Coding DNA Sequence Number=SeqID_33594
  Homolog annotation: Hit_ID=A5BXY0; Match level="QueryCoverage=26%, HitCoverage=3%, E-value=1e-08, Identity=71%"; Hit description =Putative uncharacterized protein
MEEAEKEILETFRKVEVNIPLLDAIKQIPRYAKFLKELCVATYPSVRGRRVTRGMRVPRKEYARSRHQRLFEENVGITGKETIYELLSERFGSCIYARGRGETLRRWTINDLCFERRETLRHGPLTISGVVDKSGTLLLRILKEEFRPT

SEQ ID NO: 125280 - protein, 232 aa, Glycine max
  Coding DNA Sequence Number=SeqID_33595
  Gene Ontology: Mol. function=chitin binding; Cellular component =extracellular region; Biological process=chitin metabolic process
  Homolog annotation: Hit_ID=UPI00006A17C9; Match level="QueryCoverage =74%, HitCoverage=100%, E-value=2e-24, Identity=33%"; Hit description= UPI00006A17C9 related cluster
  Subcellular localization annotation: CTP_CleavageSite=12; ConfidenceScore=5.04e-01
MLVRMIRTRLFAAARVRSCPGIHSSCVIASLSGCARTVGPPPISGGGPGTVKRKLLVWMSSTLKMRTRSPLKVRACSPLKARMCSPLEVRACSPLLARTCSPLKVRACSPLLARTCSPLKVRACSPLLARTCSPLKVRACSPTKVRTCSPLRVRACSPLKVRTCSPLMARACSPQKVRTCGPLMARACSPLKVRMCGPLKVRACSPTKVRTCGPLKVRTCGPLKVRACSPTK

SEQ ID NO: 125281 - protein, 87 aa, Glycine max
  Coding DNA Sequence Number=SeqID_33596
MDSGRSKLVYQHEGFYLSWNARGVAGGDTEGLPKCFQGVYHQLLALQWHIRAKALSRLDCNGEFHVSPPRFKRHVHDQIEVVGSQRV

SEQ ID NO: 125282 - protein, 218 aa, Glycine max
  Coding DNA Sequence Number=SeqID_33597
AWRSPLRKDKELRGICNGVIGGYHGWLRVHTRGLDWLSKLKVIDEENFEAPEEDEEVQALKLELGKARLAKENAATAKALEQETKRARTEEHGREKFRGALWGSNNELKLRREERDRSRVHGMILKEELAACARSKRSLAQHLEATEQSMLAIIGQYKEELNQSVTHEQKLVGGFCTSVRLDLEWKSRPPATISQSKAMAESGYGPREIHGLSITVNT

SEQ ID NO: 125283 - protein, 138 aa, Glycine max
  Coding DNA Sequence Number=SeqID_33598
MGVKRLKVINQEADDHHHPRYHQTCSPLDGKRDFDSLWIGRVRVTICCLHVSSDLLSLDDEGTDNHEVSPHAIGPSSHDSRIVCTDNHKVSPHAIEPSSHDSKGETFSQSLPEDVDISGKGTDDHIGLCVSTGSLASS

SEQ ID NO: 125284 - protein, 55 aa, Glycine max
  Coding DNA Sequence Number=SeqID_33599
MTLSLAHQWAKRASIAKCSFSALSVIEESGRASISRLHAKREISALSATIFFSQA

SEQ ID NO: 125285 - protein, 219 aa, Glycine max
  Coding DNA Sequence Number=SeqID_33600
MVSTIEEFEEIFGCPLGGRKSYIFSGFLPSLSKIAAVVGDSAKEVDRMKQSRNGVVGLPRKYLEGKARDMASQEKWGPFADILTLLIFGFLLFRNVDGLVDLAAIDAFLAYHHSKESPVVAILADLFDTFDRRCEKNSARIVCCLPALCVWLVRKVSRLYKESTRRGEVPLRKDKELRGIRNGVISGYHGWLRVHTRGLDWLSKLKVIDEENFRSSGGR

SEQ ID NO: 125286 - protein, 127 aa, Glycine max
  Coding DNA Sequence Number=SeqID_33601
MDCGQLEVSIGGREEPQICMQSEEKKEFPPDSVKGANIPQHKEPGPIGASPLPGWSSPRGNKRPWSKSLNRRSHPLPRKKYFPPIPSGIRGAPKRKKVFIGKTVTLEEAHEVPSPLSNKVSLRCRAT

SEQ ID NO: 125287 - protein, 74 aa, Glycine max
  Coding DNA Sequence Number=SeqID_33602
  Subcellular localization annotation: CTP_CleavageSite=42; ConfidenceScore=5.58e-01
MWLSMPPVSWDTVTKSGVVDKSRAFAPTYPQFVMRNSDLRSSCQLGSTGFNKNRRKSLKVYQSHTVRGEKVASA

SEQ ID NO: 125288 - protein, 67 aa, Glycine max
  Coding DNA Sequence Number=SeqID_33603
MFGEGTNRENSKKPYFPVTGGSVLDNGGHMNSARQSIHGAPNRKVEDTRTALGNQFMGLRIRFEGGG

SEQ ID NO: 125289 - protein, 287 aa, Glycine max
  Coding DNA Sequence Number=SeqID_33604
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=2e-47, Identity=33%"; Hit description= UPI00006A17C9 related cluster
  Subcellular localization annotation: CTP_CleavageSite=41; ConfidenceScore=5.59e-01
MACSPLKVRACSPLKVRTCSPLKVRACSPLKGRTCIPLKVRACSPMKVRMCSPLKGRMCSPLKARTCSPMKARACSPLKERTCNPLKVRMCSPLKARACSPLKGRTCSPLKVTTCSPLKARTCSPLKVRTSSPLKVRACSSMKVKMSCPLKVRTCSPLMARTCSPLKGRTCSPLKGRTCSHLRVRACSPTKVRVCSPLKGKTCSPLKVMTCSPLKARMCSPLKAKACSPLKVRACSPLKVRTCSPLKVRACSPMKATACSPLNGRTCSPLKVRTYSPLKARTCSPLK

SEQ ID NO: 125290 - protein, 154 aa, Glycine max
  Coding DNA Sequence Number=SeqID_33605
MSALKEQMASMMDAILGMRQLMENNVATAAAVSSTAEADPTLPATARHPIPNVVGRERSTLGHIKNPHLGYNRVAYPYGLPLNYTAPVMRDDAGHIPFPILEGEPPRQSDEVHEDHREHAQEDIDSYSSVLVEGPTLNTLPQPNLTGEPRNLPA

SEQ ID NO: 125291 - protein, 76 aa, Glycine max
  Coding DNA Sequence Number=SeqID_33606
MTKVNKEPFLGIRFGQNWMKARELGRIDGDSALRGTRIRATWEYVSSVGGGQQGMVGLYVICGCGELVLHHRPTVT

SEQ ID NO: 125292 - protein, 65 aa, Glycine max
  Coding DNA Sequence Number=SeqID_33607
MGAKYLEAVERGSHPNTGWSPDKIRMQNGHNLSLHFVGHDRAWATRHRMTIICLCVPPDTIASGW

SEQ ID NO: 125293 - protein, 146 aa, Glycine max
  Coding DNA Sequence Number=SeqID_33608
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRLPVSFRCMAAFVSSTLTLSS

SEQ ID NO: 125294 - protein, 182 aa, Glycine max
  Coding DNA Sequence Number=SeqID_33609
  Homolog annotation: Hit_ID=A4DID9; Match level="QueryCoverage=30%, HitCoverage=49%, E-value=3e-19, Identity=80%"; Hit description =Putative uncharacterized protein
TTKPGERRRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPDREGRTSGVPVIVPTVNA

SEQ ID NO: 125295 - protein, 52 aa, Glycine max
  Coding DNA Sequence Number=SeqID_33610
PPNLSQKNDDLGLVHRWIVVKFEHHVRNPITRILTVGNFDIMSELREIPLAL

SEQ ID NO: 125296 - protein, 137 aa, Glycine max
  Coding DNA Sequence Number=SeqID_33611
  Gene Ontology: Mol. function=cob(I)yrinic acid a,c-diamide adenosyltransferase activity; Cellular component=mitochondrion; Biological process=cobalamin biosynthetic process
  Homolog annotation: Hit_ID=Q26F95; Match level="QueryCoverage=97%, HitCoverage=70%, E-value=6e-26, Identity=46%"; Hit description =Cobalamin adenosyltransferase
  Pfam annotation: Domain name=Cob_adeno_trans; Domain location=2-137; Score=109.1; E_value=1.4e-29; Accession=PF01923.9; Description =Cobalamin adenosyltransferase
MAGDKGQTALYGGTRVSKASARVESYGNIDELNSFIGIAKSHIEDVEVLKQLKKIQFDLFTVGSEAATPVDKLMLANGKSRLPLIISENEIEELEHWMDDFDTQLEPLQYFILPGGGKSATFLHAARTICRRAERSL

SEQ ID NO: 125297 - protein, 242 aa, Glycine max
  Coding DNA Sequence Number=SeqID_33612
  Gene Ontology: Mol. function=ATPase activity, coupled to transmembrane movement of substances; Cellular component=integral to membrane; Biological process=transport
  Homolog annotation: Hit_ID=A5FH90; Match level="QueryCoverage=93%, HitCoverage=41%, E-value=7e-52, Identity=42%"; Hit description=ABC transporter related precursor
MAKPFNRTVTLFGIYKQLIPFIRPYRLMIYGTLFLTFLGALAAQVNPLVLKYTVDKVTLLTHLPHPMSEGIHVLVVISIILLGKELLNIFINFGQKFYGEKIRINVSSVLAQSAIDKILTYRVAYFNDENHESGKLQIRIDRGIESLTKLVQNFFIDILPLFSNAIIALIIMYMQNAKKLGGVRRQLRNQREQKTSGLLNLINSIMVIKSFVREKFEGKKQYDLQMQLMESQMVHQKNKFYL

SEQ ID NO: 125298 - protein, 65 aa, Glycine max
  Coding DNA Sequence Number=SeqID_33613
MDLKKLAYQNEPFIMAEQAKQVFYVQDPCDERWHMATPPSSPPHPPLESTAPSSLSTSKKTRKET

SEQ ID NO: 125299 - protein, 224 aa, Glycine max
  Coding DNA Sequence Number=SeqID_33614
NSWAPFQTRHDFNAAALAVDAMLNNTQIDALISLIGNASDDGGGGVLTIHNHKELNEIWEDVEYLFLKETVSAVYDQETLSFEVWYRPLWNWVTALVTDPKLGNAFEWDAKRLHKFNGKEWIQFYHEPTTADLMWTIQDNCTVHQPQVQTNITRSRAGDLGKWGQGVMKWERRIEVARTSPKVYLRVRASPKRPSKSEVSEQVRGESKVREDFGVTGRSSDAKG

SEQ ID NO: 125300 - protein, 83 aa, Glycine max
  Coding DNA Sequence Number=SeqID_33615
MGRDGGAKQTTERMRHHWPHTLGGTSRIGVTRWDAIFRYCMNVRQDHSTTGHVAPGGTRVSIFYDVPESNSRPAIYYIKSRSV

SEQ ID NO: 125301 - protein, 73 aa, Glycine max
  Coding DNA Sequence Number=SeqID_33616
  Homolog annotation: Hit_ID=A8PCK1; Match level="QueryCoverage=75%, HitCoverage=10%, E-value=2e-08, Identity=46%"; Hit description =Putative uncharacterized protein
MMVNYVLSEPPHVNLYAKYAAKRYMKVSVYVRQWALNHWSEGDEINLIDDLSMLKIEARELRLKAEEEAEIPV

SEQ ID NO: 125302 - protein, 197 aa, Glycine max
  Coding DNA Sequence Number=SeqID_33617
  Homolog annotation: Hit_ID=A8NN02; Match level="QueryCoverage=99%, HitCoverage=8%, E-value=1e-16, Identity=30%"; Hit description =Putative uncharacterized protein
MWNKFQNTIAEERESYARLEESRKALVVQQRTAQAEIESQRSQLREASSSKKQLQSELSQLQQEVAVAKNEASELRAVIETYQAKEGEYRSKLEAAEIARAKAARAEAHGTCIFYVSLHEADSPFVARRSLTDMEKTHAQAVEERNASEARLQATEKKLRELENKFEEENREATDLSLLHQRLVENCKTNESSTRKI

SEQ ID NO: 125303 - protein, 145 aa, Glycine max
  Coding DNA Sequence Number=SeqID_33618
MTRSRTKQSVDTLQQMVVGILNKAQAEKDEGPSGEGRRPKWRRMKAQVEKDEGQSKDHIRRGQLNTTLTKIVPTQPLSISTKHNLGQGWSKRTLIEPSRGQLKIPLAEVGQKLTLLEVDRKLTLLEVDEKQFGQGRPKTVLAKVG

SEQ ID NO: 125304 - protein, 90 aa, Glycine max
  Coding DNA Sequence Number=SeqID_33619
MGAKSLEVVKRGSHPNNGWFPDEIRDGIFFDCISIHYFVLFSLTKLPNVGYGTFDPLLRLGNLILTDMINGMYNAGKDGDRLDNLFYFLD

SEQ ID NO: 125305 - protein, 56 aa, Glycine max
  Coding DNA Sequence Number=SeqID_33620
MHGSKLEGGGHMNENAIHGAPKKAITTHGSKLEGGGHMNENAIHGAPKKIENGELH

SEQ ID NO: 125306 - protein, 162 aa, Glycine max
  Coding DNA Sequence Number=SeqID_33621
  Homolog annotation: Hit_ID=Q9AVH2; Match level="QueryCoverage=35%, HitCoverage=18%, E-value=6e-17, Identity=75%"; Hit description =Putative senescence-associated protein
MARHKVTRTHTHTHSRRHKGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANHGSSRTRLNYYCDTVISR

SEQ ID NO: 125307 - protein, 152 aa, Glycine max
  Coding DNA Sequence Number=SeqID_33622
RALGFPSLITGLCQSFGVRVAPTKVIQPPITRTFIEKYCTQRQAHGDAPQAAGAPPPPHQAGQAGAFDMEQYLRHLVRQQAANHRAHRQGFVLLFPCPTPDQLVRAEVAWPGDWPEARAGEAPAEAPDEADEAHEDEEMTDFLDFLRGSGAT

SEQ ID NO: 125308 - protein, 174 aa, Glycine max
  Coding DNA Sequence Number=SeqID_33623
MTSEAAKEIAEKIDLLEEQASQEHLGRVRAAGAGVTIKQYFGPAQRTSHTFSFIAPEELEQLTQKIRDQLEESIIEKVTRQLMLSFSQMQSQFQSQMQSQGLALPPEPEVGPSVARVSTKGSYVDLSATDPDMGNSNKCGLYIEENPPCLVALGRVYEGSTFIHNIPLLHDQVK

SEQ ID NO: 125309 - protein, 129 aa, Glycine max
  Coding DNA Sequence Number=SeqID_33624
MRAGNSDIYGFLKPQSIQRSGQSQFESESYIKTWMQSSKCDVYLGAYLNGLNQRLLLGGLLSSVIDKKEVLSVATMSCTGCPFLILGSFRNNWVSVVSPAKQPPKPDSEVDDPLYLMTLTIPELFLRPY

SEQ ID NO: 125310 - protein, 166 aa, Glycine max
  Coding DNA Sequence Number=SeqID_33625
MTRRDKIWSFCTLVSSRGGGPDDTRRYLTVIRILLSSRGGGPDARRDKIWSFCTLVSSRGGGPDDTRRYLTAAGPMTRGDTLRLSAPFCHPEATGPMTRRDKIWSFCTLVSSRGGGPDDTRRYLTVIRTLVSSRGGGPNDARRYLTVIRTLLSSRGSGPDDMQRLT

SEQ ID NO: 125311 - protein, 76 aa, Glycine max
  Coding DNA Sequence Number=SeqID_33626
  Subcellular localization annotation: CTP_CleavageSite=51; ConfidenceScore=5.38e-01
MRGYLMVTRTFGQPGANEPVGARRLTSSSAPFSVLTREGYLMVTRTFRQPGANELVDARGLTPSSAPFVVLPREVK

SEQ ID NO: 125312 - protein, 122 aa, Glycine max
  Coding DNA Sequence Number=SeqID_33627
MGIIEDFYQQRAMRLGVYEQFKQRDPRWKFIQLLDYLKLTLLNEAKELMGLFQSHRLSLKTFFLFSPSYHWRICFFRGGGYVCGLLDHGRFPLGGQLHRVRGSEHPTTAGYATEAGDVGYLS

SEQ ID NO: 125313 - protein, 112 aa, Glycine max
  Coding DNA Sequence Number=SeqID_33628
  Gene Ontology: Mol. function=nucleic acid binding; Cellular component= nucleus; Biological process=mRNA processing
  Homolog annotation: Hit_ID=Q9FT01; Match level="QueryCoverage=100%, HitCoverage=34%, E-value=2e-28, Identity=52%"; Hit description =Putative splicing factor
RFRDKKEVAEPEVDPERDQRTVFAYQLLLNLIYFCHWNCDDLPIELFFLHWNFIDLCCQLLLGQLVMVKPSKAEKNLVQSNASGGAAGVTGPYGAVDRKLYVGNLHFNMTES

SEQ ID NO: 125314 - protein, 189 aa, Glycine max
  Coding DNA Sequence Number=SeqID_33629
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=86%, HitCoverage=32%, E-value=9e-73, Identity=89%"; Hit description=ATP synthase subunit alpha
  Pfam annotation: Domain name=ATP-synt_ab; Domain location=1-85; Score= 1.2; E_value=4.2e-08; Accession=PF00006.16; Description=ATP synthase alphabeta family, nucleotide-binding domain
  Pfam annotation: Domain name=ATP-synt_ab_C; Domain location=97-188; Score=95.3; E_value=1.9e-25; Accession=PF00306.18; Description=ATP synthase alphabeta chain, C terminal domain
  Pfam module annotation: Pfam domain module=ATP-synt_ab::ATP-synt_ab _C; Domain location=1-85::97-188
PPGREAYPGDVFYLHSRLLERAAKLSSQLGEGSMTALPIVETQSGDVSAYIPTNVISITDGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNDIHWGSRSPFEGSYSRTDGTLFTTGT

SEQ ID NO: 125315 - protein, 62 aa, Glycine max
  Coding DNA Sequence Number=SeqID_33630
GIGKEDWCHPLKNLSQEARGQPDAILPRKGPVTRAISKRLQEDWARADKEGLRILINLRVDF

SEQ ID NO: 125316 - protein, 109 aa, Glycine max
  Coding DNA Sequence Number=SeqID_33631
  Gene Ontology: Mol. function=oxidoreductase activity, acting on NADH or NADPH; Cellular component=mitochondrial respiratory chain; Biological process=electron transport
  Homolog annotation: Hit_ID=A7KNI1; Match level="QueryCoverage=94%, HitCoverage=30%, E-value=5e-47, Identity=86%"; Hit description=NADH dehydrogenase subunit 7
  Pfam annotation: Domain name=Complex1_49kDa; Domain location=12-107; Score=-75.3; E_value=1.5e-07; Accession=PF00346.10; Description =Respiratory-chain NADH dehydrogenase,
MACLGLSINSVPVGFEEREKLLEFYERVSGARMHASFIRPGGVAQDLPLGLCRDIDSFTQQFASRIDELEEMSTGNRIWKQRLVDIGTVTAQQAKDWGFSGVMLRGRAT

SEQ ID NO: 125317 - protein, 39 aa, Glycine max
  Coding DNA Sequence Number=SeqID_33632
MEIYMITKDDDKGDDKKLKGQSKNEFKIFKIESRTLQDS

SEQ ID NO: 125318 - protein, 192 aa, Glycine max
  Coding DNA Sequence Number=SeqID_33633
MSALKEQMASMMEAMFGMRQLMEKNVATAAAVSSAAEADPTLLATAHHPPSNIVGRGRDTLGHDGSPHLGYNRAAYPYGLPPNYSPPVLQDDAGHIASPVLEREPPQQPEEVHKDPQDYARRDVEFYPPIPEGPAPSTLPQPNIAAQPIALSMEGPFPATEERRKLDLLEERLRAVEGFGDYPFADMTDLCL

SEQ ID NO: 125319 - protein, 105 aa, Glycine max
  Coding DNA Sequence Number=SeqID_33634
MIRGDTLRLSAPFCHPEAAGPMKSRDQVWSFCTLVSSRGGGPDDTRKYPSGYPYKHSFAISPRPTWALRNIPPEGGCFWRKQPCSPGRAELAWASWAATSSPILL

SEQ ID NO: 125320 - protein, 314 aa, Glycine max
  Coding DNA Sequence Number=SeqID_33635
  Gene Ontology: Mol. function=nucleic acid binding; Cellular component= nucleus
  Homolog annotation: Hit_ID=Q84Y18; Match level="QueryCoverage=40%, HitCoverage=37%, E-value=2e-41, Identity=66%"; Hit description=CAX -interacting protein 4
  Pfam annotation: Domain name=zf-CCHC; Domain location=84-101; Score =21.5; E_value=0.00086; Accession=PF00098.14; Description=Zinc knuckle
MPATAGRVRMPANNRVHSSAALQTHGIWQSAIGYDPYAPNKEDKKDSSQNLPNAEPDAENAYASFQGLLQLAKITNAEVDVSRGACKKCGRVGHLKFQCKNYVKIKDENEKDPEAMQPVGLVGLDKKLKAGKVDRGSNVESSEEEEEEDSESSDSEIDSEIERIIAERSGKKISGKRGSSRKKGDLDDDGSDEDSGKRRKRGRSKRRSAKREVSDSDDSGEERRRRKRRWEPRRKRDNSSDEDDEYRHRHRKSRKEKRRRRSRLSDSDSSEDSIRRHKRKNKRASSSSDTDSRRKGRNVSKSEKRRSRHNANDE

SEQ ID NO: 125321 - protein, 151 aa, Glycine max
  Coding DNA Sequence Number=SeqID_33636
  Homolog annotation: Hit_ID=A5B747; Match level="QueryCoverage=75%, HitCoverage=33%, E-value=5e-09, Identity=29%"; Hit description =Putative uncharacterized protein
MGMEGFNRRGKFKSPVEAGDKVKFWEDRWICHEQSLAKKYPRLYMISSQQNQLIGQLGKHNNSGWEWNFNWRRPLFDSEIELTITFLSEVEGKSIYNQGSDSWEWAADSSDIYSTHSAYSMFWEEASVESTEECFEELWKIKILSKIAVFA

SEQ ID NO: 125322 - protein, 124 aa, Glycine max
  Coding DNA Sequence Number=SeqID_33637
  Gene Ontology: Mol. function=protein disulfide oxidoreductase activity; Cellular component=chloroplast; Biological process=cell redox homeostasis
  Homolog annotation: Hit_ID=A5B2Y3; Match level="QueryCoverage=40%, HitCoverage=36%, E-value=1e-14, Identity=76%"; Hit description =Putative uncharacterized protein
  Pfam annotation: Domain name=Thioredoxin; Domain location=69-123; Score=-29.5; E_value=0.05; Accession=PF00085.11; Description =Thioredoxin
  Subcellular localization annotation: CTP_CleavageSite=66; ConfidenceScore=5.89e-01
MDAMTLSLPLPPVPVCTVPASASTSSSVSLTHSWSATARQRLSSHRTRPIFRNYSSAVPKLTVVTCGAAVTEINETQFKDTVLKANRPVLVEFVATWCGPCRLISPSMESLAKGWLKAHVRALG

SEQ ID NO: 125323 - protein, 87 aa, Glycine max
  Coding DNA Sequence Number=SeqID_33638
MDAFRAKEALRGVMMEPQSTESSALIAQKEKKIDQCQDTPKTNARNFMVSLQIRTKIGPPKVLNKENQHKPTWVSKVLQQAVLPDPL

SEQ ID NO: 125324 - protein, 430 aa, Glycine max
  Coding DNA Sequence Number=SeqID_33639
  Gene Ontology: Mol. function=metal ion binding; Biological process =learning and/or memory
  Homolog annotation: Hit_ID=Q9FSZ7; Match level="QueryCoverage=69%, HitCoverage=93%, E-value=2e-48, Identity=64%"; Hit description =Putative uncharacterized protein
  Pfam annotation: Domain name=PHD; Domain location=367-407; Score= -5.9; E_value=0.064; Accession=PF00628.20; Description=PHD-finger
  Pfam annotation: Domain name=zf-C3HC4; Domain location=368-421; Score= 17.0; E_value=0.001; Accession=PF00097.16; Description=Zinc finger, C3HC4 type (RING finger)
  Pfam module annotation: Pfam domain module=PHD::zf-C3HC4; Domain location=367-407::368-421
MENDTAAAVNNNTTATATAKAGSGGVKSNNHNLEEEHSNLNGEEHMAEQVEAEEEEDREADDGEGEQTGSRQPSRTPFTNLSQVDADLALARTLQEQERAYMMLRMNNEGSDYGSWEGGSYLHDEGDDFDDLHDGTDVDEDEDDDDDEDDDDEEDEDEDAFDVHAHASAGEHDNPTIEFDPDVFSSDEAYARALQEAEEREMAARLLAFAGINDREEEDIEEHGANSQRHLSVAMTSVVGRIEGVAVASAITLVRGGPIAGLAAPRCDNNIDNYALKSSTSLAEQRVVKKNESCKLPLRSLTLGTMARLLPWDAWEDVDPDELSYEELLALGEAVGTESRGLSTDTIACLPSVNYKTGSDQHGSNDSCVICRVDYEDDESLTVLSCKHLYHPECINNWLKINKVVVLVYSSIRSLIHAPVCIWLDNAFVS

SEQ ID NO: 125325 - protein, 35 aa, Glycine max
  Coding DNA Sequence Number=SeqID_33640
MDVRRLQNVSNSFNGCEQRKGKGVQIVRVGEGELF

SEQ ID NO: 125326 - protein, 52 aa, Glycine max
  Coding DNA Sequence Number=SeqID_33641
MVDGVRSTITDIHEDLGYFQQTVETLTHKTDMDAAQSFIEIARICSVFTNQF

SEQ ID NO: 125327 - protein, 231 aa, Glycine max
  Coding DNA Sequence Number=SeqID_33642
  Gene Ontology: Mol. function=4 iron, 4 sulfur cluster binding; Cellular component=molybdopterin synthase complex; Biological process=Mo-molybdopterin cofactor biosynthetic process
  Homolog annotation: Hit_ID=A7QWE6; Match level="QueryCoverage=97%, HitCoverage=98%, E-value=6e-74, Identity=67%"; Hit description =Chromosome undetermined scaffold_203, whole genome shotgun sequence
  Pfam annotation: Domain name=MoaC; Domain location=87-222; Score =280.8; E_value=2.7e-81; Accession=PF01967.12; Description=MoaC family
MMLLRRIIAACPQSKRMFSSSVTHGYESAIQELNKEMESVFGEPPTNGLASSASNSRLNNESQLSSPNTGESSFELTHTGESGEAQMVDVSPKESSKRTAIAVCKVILGKKVFDLVLANQMAKGDVLTVAKIAGITAAKQTSNLIPLCHNISLSHVQVDLRLNHEDFSVTIEGEAASTGKTGVEMEAMTAVSIAGLTVYDMCKAASKDIAITDVRLMHKSGGKSGEYWWTQ

SEQ ID NO: 125328 - protein, 85 aa, Glycine max
  Coding DNA Sequence Number=SeqID_33643
MRFFIVIHLFIWSPEHKFKIITGSKHNNTQGGDQSGSQCFARMLQPYGINIDLKEHSNLVTPKAYTPKSPSRPLPPDSGPTQKIF

SEQ ID NO: 125329 - protein, 418 aa, Glycine max
  Coding DNA Sequence Number=SeqID_33644
  Gene Ontology: Mol. function=protein binding; Cellular component =cytoplasm; Biological process=ubiquitin cycle
  Homolog annotation: Hit_ID=A7QPZ2; Match level="QueryCoverage=96%, HitCoverage=98%, E-value=1e-169, Identity=70%"; Hit description =Chromosome undetermined scaffold_139, whole genome shotgun sequence
  Pfam annotation: Domain name=LRR_1; Domain location=111-135; Score =4.6; E_value=44; Accession=PF00560.24; Description=Leucine Rich Repeat
  Pfam annotation: Domain name=LRR_1; Domain location=137-161; Score =4.6; E_value=43; Accession=PF00560.24; Description=Leucine Rich Repeat
  Pfam annotation: Domain name=LRR_1; Domain location=163-186; Score =4.0; E_value=55; Accession=PF00560.24; Description=Leucine Rich Repeat
  Pfam annotation: Domain name=LRR_1; Domain location=189-216; Score =5.9; E_value=25; Accession=PF00560.24; Description=Leucine Rich Repeat
  Pfam annotation: Domain name=LRR_1; Domain location=242-265; Score =1.3; E_value=1.7e+02; Accession=PF00560.24; Description=Leucine Rich Repeat
  Pfam annotation: Domain name=LRR_1; Domain location=268-291; Score =3.7; E_value=65; Accession=PF00560.24; Description=Leucine Rich Repeat
  Pfam annotation: Domain name=LRR_1; Domain location=295-319; Score =4.5; E_value=44; Accession=PF00560.24; Description=Leucine Rich Repeat
  Pfam annotation: Domain name=LRR_1; Domain location=321-344; Score =6.2; E_value=22; Accession=PF00560.24; Description=Leucine Rich Repeat
  Pfam annotation: Domain name=LRR_1; Domain location=349-373; Score =6.9; E_value=16; Accession=PF00560.24; Description=Leucine Rich Repeat
  Pfam annotation: Domain name=LRR_1; Domain location=375-400; Score =10.2; E_value=3.9; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=111 -135::137-161::163-186::189-216::242-265::268-291::295-319::321 -344::349-373::375-400
MASNSIDGDAVTGSGLCINDVLRDDELRSILGRVESEKDKETFGLVCKRWLRLQSTERKKLAARAGPHMLRKMADRFTRLVELDLAQSVSRSFYPGVTDSDLAVIATAFTCLKILNLHNCKGITDAGMKAIGEHLSLLQSLDVSYCRKLTDKGLSAVAKGCCDLRILHMAGCRFVTDGVLEALSKNCGNLEELGLHGCTSITDNGLINLASGCRRIRFLDINKCSNATDVGVSSVSRACSSSLKTLKLLDCYKIGDETILSLAEFCGNLETLIIGGCRDVSADAIRSLAAACGSSLKNLRMDWCLNISDSSLSCVLSQCRNLEALDIGCCEELTDAAFQLLSNEEPGLSLKILKISNCPKITVAGIGIIVGKCTSLQYLDVRSCPHITKAGLDEAGFHFPECCKINFNGSVNEPVVLL

SEQ ID NO: 125330 - protein, 209 aa, Glycine max
  Coding DNA Sequence Number=SeqID_33645
  Gene Ontology: Mol. function=ribonuclease H activity; Biological process=regulation of epidermal cell division
  Homolog annotation: Hit_ID=A9PJC0; Match level="QueryCoverage=83%, HitCoverage=87%, E-value=9e-51, Identity=52%"; Hit description =Putative uncharacterized protein
  Pfam annotation: Domain name=GRAM; Domain location=74-152; Score =46.8; E_value=7.4e-11; Accession=PF02893.11; Description=GRAM domain
  Subcellular localization annotation: CTP_CleavageSite=68; ConfidenceScore=5.40e-01
MQTSLLQVVGTPVISATYDQLQKSVNRYLPGPATQCQYSTTTSKQMRLGTNISETVKRKLSLGARILRVGGVEKVFKQFFSMGEGERLLKVSQCYLSTTSGPLAGFLFISTDKVAFCSERSMKVFTQKGHMLRIRYKVTIPLKKIKCVNQSANVQKPTQKYIEIVTEDNFDFWFMVIDVTVSILSIRIALTVRLNLKRTSLDCPNDTDI

SEQ ID NO: 125331 - protein, 175 aa, Glycine max
  Coding DNA Sequence Number=SeqID_33646
  Gene Ontology: Mol. function=methyltransferase activity; Cellular component=intracellular; Biological process=metabolic process
  Homolog annotation: Hit_ID=A7QNM2; Match level="QueryCoverage=57%, HitCoverage=24%, E-value=8e-32, Identity=65%"; Hit description =Chromosome undetermined scaffold_133, whole genome shotgun sequence
MQQPEKQINAPAGMPLPERRRRRRSSGICATSGVRVQPQEEQQQVATRGTVLTDSDQFYFNWYAHIDVHEEMIKDRVRTDAYKNAIMRHKDFIRDKVVLDVGCGTGILAIFCAQAGARRVYAVEASNIALQTIRVVEANNLLNIITVLHGRVEVGYSDQYILLFERGTITFNFIL

SEQ ID NO: 125332 - protein, 490 aa, Glycine max
  Coding DNA Sequence Number=SeqID_33647
  Gene Ontology: Mol. function=anion channel activity; Cellular component=membrane of vacuole with cell cycle-independent morphology; Biological process=malate transport
  Homolog annotation: Hit_ID=A7PCB0; Match level="QueryCoverage=91%, HitCoverage=87%, E-value=1e-138, Identity=56%"; Hit description =Chromosome chr2 scaffold_11, whole genome shotgun sequence
  Pfam annotation: Domain name=DUF939; Domain location=35-369; Score= -166.5; E_value=0.031; Accession=PF06081.2; Description=Bacterial protein of unknown function (DUF939)
  Pfam annotation: Domain name=UPF0005; Domain location=23-456; Score =442.7; E_value=5.1e-130; Accession=PF01027.11; Description =Uncharacterised protein family UPF0005
  Pfam module annotation: Pfam domain module=DUF939::UPF0005; Domain location=35-369::23-456
MAETNYFASNRSSMITRHWIWKYMSSVGEKVKRYSGLAWRTAVKPLFKGIGQNAMSAVLTVVVVMEFTVGATLGKGLNRGLGTLLAGSLAFLVEYIADIVGRVFQAVFIGAAVFILGATTTYVRFIPHIKKNYDYGVMIFLLTFNLITVSSYRVDNVWEIAKDRIATIAIGGGLCLVMSLLVFPNWSGEDLHNSTISKLEGLANSIEACVVRYFHDSENQETQDDSTEDLIYKGYKAVLDSRAKDETLALQASWEPRWSRYWHRIPWWQYTKVGTTLRQFSYTVVALHGCLLSEIQTPGSIRALYKDSCIKLAEEVSKALRELANSIRNKRQFSLQLLSDNLNEALQNLHNDLKSQPQLFLGSKKFGGTTHPEEDTRVSFSSVRSDCSSMFEYKSKEHSGEMSMEGHKKVLKPLMSKIAMTSLEFSEALPFAAFTSMLVEMVAKLDHIIDAVEELAKLSRFREFRDGDEIVVTCERPKVANNDLPSHALD

SEQ ID NO: 125333 - protein, 328 aa, Glycine max
  Coding DNA Sequence Number=SeqID_33648
  Homolog annotation: Hit_ID=A7P8E5; Match level="QueryCoverage=74%, HitCoverage=70%, E-value=2e-56, Identity=53%"; Hit description =Chromosome chr3 scaffold_8, whole genome shotgun sequence
  Subcellular localization annotation: CTP_CleavageSite=54; ConfidenceScore=5.34e-01
MAAATLSVRPDRLSPGSVFPRPPVQPPLRKPIAAPEPWRAAAPRIRIRTVAPVQASSRADDSAPFEMSVENALKLLGVSEGASFDDILRAKNAIVANCKDDQDAIAQESMLKVNVNIHYTNSQGGDWSVVKLGYVWINFSIDIIDCVGYKVEAAYDMLLMQSLTQRRAGKVVNSSVRYADVKRVKSPAGGSMPQWLKNSPVSIESPSTSDLGLQAGVYGALMGLTYLNGASAPAAGYAGADVPGLLLAGSFGASLYFMTKKNVKLGKATVITIGGLVAGAVVGSAVENWLQAAVITYNHRTRSWPPVVVSAGENCYTISGHTLSCFCC

SEQ ID NO: 125334 - protein, 894 aa, Glycine max
  Coding DNA Sequence Number=SeqID_33649
  Gene Ontology: Mol. function=protein transporter activity; Cellular component=nuclear pore; Biological process=protein import into nucleus, docking
  Homolog annotation: Hit_ID=A7P8F9; Match level="QueryCoverage=95%, HitCoverage=99%, E-value=0.0, Identity=71%"; Hit description =Chromosome chr3 scaffold_8, whole genome shotgun sequence
  Pfam annotation: Domain name=HEAT; Domain location=131-166; Score =9.6; E_value=0.99; Accession=PF02985.13; Description=HEAT repeat
  Pfam annotation: Domain name=HEAT; Domain location=179-215; Score =5.4; E_value=4.2; Accession=PF02985.13; Description=HEAT repeat
  Pfam annotation: Domain name=HEAT; Domain location=220-256; Score =13.2; E_value=0.29; Accession=PF02985.13; Description=HEAT repeat
  Pfam annotation: Domain name=HEAT; Domain location=261-297; Score =1.6; E_value=15; Accession=PF02985.13; Description=HEAT repeat
  Pfam annotation: Domain name=HEAT; Domain location=388-427; Score =14.5; E_value=0.18; Accession=PF02985.13; Description=HEAT repeat
  Pfam annotation: Domain name=HEAT; Domain location=446-481; Score =12.6; E_value=0.35; Accession=PF02985.13; Description=HEAT repeat
  Pfam annotation: Domain name=HEAT; Domain location=613-650; Score =19.1; E_value=0.017; Accession=PF02985.13; Description=HEAT repeat
  Pfam annotation: Domain name=HEAT; Domain location=92-128; Score=5.5; E_value=4.1; Accession=PF02985.13; Description=HEAT repeat
  Pfam annotation: Domain name=IBN_N; Domain location=40-108; Score =57.5; E_value=4.5e-14; Accession=PF03810.10; Description=Importin -beta N-terminal domain
  Pfam module annotation: Pfam domain module=HEAT::HEAT::HEAT::HEAT::HEA T::HEAT::HEAT::HEAT::IBN_N; Domain location=131-166::179-215::220 -256::261-297::388-427::446-481::613-650::92-128::40-108
MAAAAATTPSWQPQEQGFKEICGLLEQQISHSSSADKAQIWQHLQRYSHLPDFNNYLAFIFSRAEGKSVEVRQAAGLYLKNNLRNTFKSMQPAYQQYVKSELLPCLGATDKHIRSTAGTIISVVVQIGGVVGWPELLQALVNCLDSNDLNHMEGAMDALSKICEDIPQYLDSDVPGLAERPINIFLPRLFRFFQSPHASLRKLSLGSVNQYIMLMPSALYVSMDQYLQGLFILANDAAAEVRKLVCAAFVQLIEVRPSFLEPHLRNVIEYMLQVNKDTDDEVALEACEFWSAYCDAQLPPENLREFLPRLIPVLLSNMAYADDDESVIEAEEDGSQPDRDQDLKPRFHVSRFHGSDEVEDDDDDVVNTWNLRKCSAAALDILSNVFGDEILPTLMPIVEAKLSAGGDDAWKDREAAVLALGAIGEGCINGLYPHLLEGIGHPKGYEQFDNVLMGLLRRILDDNKRVQEAACSAFATLEEEAAEELAPRLEIILKHLMTAFGKYQRRNLRIVYDAIGTLAEAVGGELNQPVYLDILMPPLIEKWQQLSNSDKDLFPLLECFTSIAHALGTGFAQFAEPADPAATTGVQYDKEFIVCSLDLLSGLAEGLGSGIESLVAQCSLRDLLLHCCVDDAPDVRQSAFALLGDLARGGDWVKISLGLPKHVCPVHLHPRLSEFLEAAAKQLEISKVKEAISVANNACWAIGELAVKLQLAVSDEKLFHPKKRKLSGILETGIDGLNKSLIENSAITLGRLAWVCPELVSPHMEHFMQSWCTALSMIRDDVEKEDAFRGLCAMVKANPSGALSSLVYMCKAIASWHEIRSEDLHNEVCQVLHGYKQMLRNGAWDQCMSALEPPVKEKLSKYQWELSLGPSFQTGYQYLNNSFELDDYRKFHKP

SEQ ID NO: 125335 - protein, 72 aa, Glycine max
  Coding DNA Sequence Number=SeqID_33650
MWNKVPFLTKKCYLSTIAITNEERQKRKVKGSEILFLSSFKEIKVHRREVPMEKDTSLPNGERFQDPVVSYN

SEQ ID NO: 125336 - protein, 644 aa, Glycine max
  Coding DNA Sequence Number=SeqID_33651
  Gene Ontology: Mol. function=serine-type endopeptidase activity; Cellular component=integral to membrane; Biological process =proteolysis
  Homolog annotation: Hit_ID=A3BFN0; Match level="QueryCoverage=96%, HitCoverage=89%, E-value=0.0, Identity=53%"; Hit description =Putative uncharacterized protein
  Pfam annotation: Domain name=Peptidase_S9; Domain location=441-631; Score=210.0; E_value=5.7e-60; Accession=PF00326.12; Description =Prolyl oligopeptidase family
  Pfam annotation: Domain name=Peptidase_S9_N; Domain location=1-331; Score=262.8; E_value=7.4e-76; Accession=PF02897.6; Description =Prolyl oligopeptidase, N-terminal beta-propeller domain
  Pfam module annotation: Pfam domain module=Peptidase_S9::Peptidase_S9_ N; Domain location=441-631::1-331
EFEDKLFAEIRGRIKEEDVSAPLRKGPYYYYKRTLEGKEYVQYCRRLISDNQKVPSVHDIMPTGPEAPPEHVILDVNVKAQHHLYYSIGAFKVSPNNKLVAYAEDTKGDEIYTIYVIDVETQATIGEPLVGVTSYLEWAGDNAFVYITMDEILRPDKAWFHVLGTEQSKDTCLYVEKDDMFSLDLQASESKKYLFVASESKNTRFNFYLDVSKPEEGLKVLTPRVDGIDTTVSHRGDHFFIKRRSDQFFNSEVVACAVNNTSSTTVLIPHRERSLESGQAVSFVDPVYSAESSDSEFSSSILRFSYSSLRTPSSVYDYDMKAGISVLKKIDSAPRYASTWGMVTVCICKEAISGFESMTNWSPRASPGAAVKLCLGDLLVMGSNPETASLHMQGVNMRDKARSEKVLGGFDATRYVTERQWAPSSDGTLIPISIVYRKDLVKLDGSDPLLLYGYGSYEWYENGKLLKKKNTFTDFIACAEYLIEKKFCSKEKLCIEGRSAGGLLIGAVLNMRPDLFKAAVAGVPFVDVVTTMLDPTIPLTTSEWEEWGDPRKEEFYFYMKSYSPVDNVKAQNYPHILVTAGLNEPAKFVAKLRDMKTDDNILLFKCELGAGHFSKSGRYDVLSDFSCLLPNVKLSRCAGTMDFR

SEQ ID NO: 125337 - protein, 153 aa, Glycine max
  Coding DNA Sequence Number=SeqID_33652
  Gene Ontology: Mol. function=serine-type endopeptidase activity; Biological process=proteolysis
  Homolog annotation: Hit_ID=Q0WN43; Match level="QueryCoverage=40%, HitCoverage=12%, E-value=6e-18, Identity=67%"; Hit description =Oligopeptidase-like protein
  Subcellular localization annotation: CTP_CleavageSite=66; ConfidenceScore=5.64e-01
MVLPNLRLNFGRIFCIPLAVTVVLSSAVPFPSSAAATAAFSRHRRLVASASPMNPSSQSQSPPPPVAKKVEHAMEMFGDVRIDNYYWLRDDSRTDPEVLSYLRQENAYTDSIMSDRTPPRQQILMAIETISDAPRPSIVFTFFSSWRLMCRVT

SEQ ID NO: 125338 - protein, 106 aa, Glycine max
  Coding DNA Sequence Number=SeqID_33653
MNCFVVCQSRLWVVTIVFYTCILIPLMKLKRALASMFLFSCETKGMAKEMEFPEIPSLPVARYEDLKGHNCDGEKQEICSICLVEYEGEDAVSKLGRENNGTRECL

SEQ ID NO: 125339 - protein, 633 aa, Glycine max
  Coding DNA Sequence Number=SeqID_33654
  Gene Ontology: Mol. function=nucleotide binding; Cellular component =mitochondrion; Biological process=defense response
  Homolog annotation: Hit_ID=Q19PN2; Match level="QueryCoverage=50%, HitCoverage=56%, E-value=2e-43, Identity=35%"; Hit description=NBS -LRR type disease resistance protein
  Pfam annotation: Domain name=LRR_1; Domain location=245-267; Score =12.3; E_value=1.6; Accession=PF00560.24; Description=Leucine Rich Repeat
  Pfam annotation: Domain name=LRR_1; Domain location=269-291; Score =10.8; E_value=3.1; Accession=PF00560.24; Description=Leucine Rich Repeat
  Pfam annotation: Domain name=LRR_1; Domain location=312-335; Score =16.7; E_value=0.089; Accession=PF00560.24; Description=Leucine Rich Repeat
  Pfam annotation: Domain name=LRR_1; Domain location=463-494; Score =0.5; E_value=2.4e+02; Accession=PF00560.24; Description=Leucine Rich Repeat
  Pfam annotation: Domain name=LRR_1; Domain location=527-551; Score =7.2; E_value=14; Accession=PF00560.24; Description=Leucine Rich Repeat
  Pfam annotation: Domain name=NB-ARC; Domain location=3-238; Score =22.6; E_value=1e-11; Accession=PF00931.13; Description=NB-ARC domain
  Pfam module annotation: Pfam domain module=LRR_1::LRR_1::LRR_1::LRR _1::LRR_1::NB-ARC; Domain location=245-267::269-291::312-335::463 -494::527-551::3-238
MKQKSSELPNDLVGENFNRNIEQMWELLGDDQVFIIGIHGMAGVGKTALVTYIENDITRKGSFKHAVVTVSQVFSIFKLQNDIANRIGMTPDEDDERMRAIKLSLVLERKEKTVLILDDVWKNIDLQKVGVPLRVNGIKLILTSRLEHATPAKLPHEVEKIARSIVKECDGLPLGISVMASTMKGGLINDTASLERVLDEGLTIVDKLKSHSLLLESDYLHMHGLVQKMNNIKKIPNGTSPKCPNLSTLIFSGNPLCHIPDCFFSHMSALAVLDLSCNPFFTLLPNAVSNLRLKISGTSIEKVPEGLGKLINLKWLDLSENYNLTLLPGSVLPGLTNKQYLDICYNYGHLAKVNAEDVQGMTMLEHFAGSFHDWDNFNNYVQATLDRGSGPKTYHLHLGIGPGYSLDYSYDYNFLTNDECRIVSFRDCTKLDHVLPTDIARLCIAENKQWRCLCDVLSFRSPSLMYIDIRVCPKLESLFCLTGPCSLCSNLQNLESLNLTSLEGPAETWKENEVKAKNILLGGMFSHIKHLEVSKCHKIEKLLTIGPLLQLKNLVSLDVKSCDLMKEIFTVSITEDVGRVNEITLPKLTRLEFRELPQLKTVWWGIIKCGLSPKLNISDCPQLETPPILQSIS

SEQ ID NO: 125340 - protein, 532 aa, Glycine max
  Coding DNA Sequence Number=SeqID_33655
  Gene Ontology: Mol. function=methionine-tRNA ligase activity; Cellular component=cytoplasm; Biological process=tRNA aminoacylation for protein translation
  Homolog annotation: Hit_ID=O23761; Match level="QueryCoverage=100%, HitCoverage=74%, E-value=0.0, Identity=63%"; Hit description=MEtRS
  Pfam annotation: Domain name=tRNA-synt_1; Domain location=46-471; Score=-393.6; E_value=0.003; Accession=PF00133.13; Description=tRNA synthetases class I (I, L, M and V)
  Pfam annotation: Domain name=tRNA-synt_1g; Domain location=64-501; Score=511.4; E_value=1.1e-150; Accession=PF09334.2; Description=tRNA synthetases class I (M)
  Pfam module annotation: Pfam domain module=tRNA-synt_1::tRNA-synt_1g; Domain location=46-471::64-501
  Subcellular localization annotation: CTP_CleavageSite=51; ConfidenceScore=5.25e-01
MAVRINSSIQNTLCLLNPPLFSLRYRASSLKLKPQLHFRQNPSRGALFCTCATTDITPQSTEHFVLTTPLYYVNAPPHMGSAYTTIAADAIARFQRLLGKSVIFITGTDEHGEKIATAAMAQGSTPPDHCNLISRSYKTLWKDLDISYDKFIRTTDSKHEAIVKEFYSRVLANGDIYRADYDGLYCVNCEEYKDEKELLDNNCCPVHLKPCVSRKEDNYFFALSKYQKALEDTLYRNPNFVQPSFRLNEVQSWIKSGLRDFSISRASVEWGIPVPDDKTQTIYVWFDALLGYISALSDDQEQPDLLKTVSSGWPASLHLIGKAAQIVPTYTGLSYDEMLLFCMDILRFHAVYWPAMLMSAGLSLPKMVFGHGFLTKDKAIHFLGSVDRPWEVYVRRDMNQLKTQTLSRPELLEVVIVSVCCSWCFEGGNSLLGDGMKMGKSLGNILEPNDLVNKFGTDAVRYFFLREVEFGNDGDYSEERFINIVNAHLANTIGNLLNRTLGLLKKNCQSILVVDSTTAAEGNEFKDNVEKL

SEQ ID NO: 125341 - protein, 127 aa, Glycine max
  Coding DNA Sequence Number=SeqID_33656
MNPSLSFSSIFSIFDNLEIDEVTESFSTDSVTLAGHSWELKDLLNNDDNVGSDCPNAEGGPANEAEVKLDTGKGDVFVDIAKAPGGGEGRGEAISDGATKRLRKLLEEGRSQPGYGGKLHQRETEGG

SEQ ID NO: 125342 - protein, 286 aa, Glycine max
  Coding DNA Sequence Number=SeqID_33657
  Homolog annotation: Hit_ID=A7PIY6; Match level="QueryCoverage=91%, HitCoverage=23%, E-value=7e-68, Identity=53%"; Hit description =Chromosome chr13 scaffold_17, whole genome shotgun sequence
MEKWNKRYKPSEETLLQIDHFCSTIIAECDINLNRPWSRSLNHQTGALAISTNTSPLPVSSFTSEAILKSLSYVRSLVAQHIPKRHFQPASFAGPPSALGQSLPTLSSLLSKSFNSQLCPASVTESVEKDSVTSSISKLSKIEKIDEKDKLGFIAHDILQWRWLEKQQSSSMKADSDHAVNSQGMRAYNFLEVGAAALLEGDIGAKMKGQPWKYFGTDDMPYLDQLLQASPVTSFTNSASACPHLRAITASKRTKAGPRQVWHVLLSDNFLLRYFLFSFFVVSSLF

SEQ ID NO: 125343 - protein, 148 aa, Glycine max
  Coding DNA Sequence Number=SeqID_33658
MYVNLIDVSKRIVKQLAGYITLLQTIPLTSAAPFLSIEEVDDRWMHFSEYLALVGQICVAPRLCAPIVAPIMPEPPTAALAYVNMPRHAVEACHAIVERLKRLINLRVVTEGTEAYTVTEECLRITRGVNTQGNVYVRSRRRRRTLDA

SEQ ID NO: 125344 - protein, 458 aa, Glycine max
  Coding DNA Sequence Number=SeqID_33659
  Homolog annotation: Hit_ID=Q5DMV7; Match level="QueryCoverage=93%, HitCoverage=89%, E-value=8e-95, Identity=43%"; Hit description =Pentatricopeptide (PPR) repeat protein-like
  Pfam annotation: Domain name=PPR; Domain location=218-252; Score =19.1; E_value=0.017; Accession=PF01535.11; Description=PPR repeat
  Pfam annotation: Domain name=PPR; Domain location=253-287; Score =23.0; E_value=0.0011; Accession=PF01535.11; Description=PPR repeat
  Pfam annotation: Domain name=Smr; Domain location=355-439; Score= -1.8; E_value=0.035; Accession=PF01713.12; Description=Smr domain
  Pfam module annotation: Pfam domain module=PPR::PPR::Smr; Domain location=218-252::253-287::355-439
  Subcellular localization annotation: CTP_CleavageSite=71; ConfidenceScore=5.15e-01
MMRVWLGNGQQQCPHETLSLSWKLKQPRPQLQARCTLTKQGQRFLTKLTTSSATADNLIRRFLLASPKSVVLSTLSHLLSPSTSYPHLSSLASQLYTGISQAPWFSWNPTTVAELAALLHSLGHHAQSESLISDASSRLQSRQRDLVLFYGKLIDSHSKRNSHTAFDAAFGYLHNLVRTSSSLHVKRRAYQYMVSGLCLMDRPREAEDLVLGLQPSGFEYKSIVYGYGRLGLFNDMNRVVDEMERNGFAVDTVCYNMVLSTYGIHGEHVEMVRWLRRMSNSGVPFSVRTYNSVSNSCPSITRMTRDLSKLALLSISELKEGLEGGEGMVVRELLLLGSCGILEEVMVWDSSEVKLDLHGFHLASAYLIVLLWLEEMGRRLNDSNYGVPAEFTVVCGLGKHSSVRGESPVRVLVQKMMVKMGSPLKVDRKNNGCFIAKGKAVKNWLSQFNNNKSSFTQH

SEQ ID NO: 125345 - protein, 97 aa, Glycine max
  Coding DNA Sequence Number=SeqID_33660
MITKDDDKGDDKKLKGQSNNEFKMFKIESRTLQDSRGKLNSRIKNQDSRDQDSRLKRKFEFKNQESRFKRSRFKTQDSRIMKRLNQDKYEKVFSKTE

SEQ ID NO: 125346 - protein, 134 aa, Glycine max
  Coding DNA Sequence Number=SeqID_33661
MVRTRGLGRVIGRVVGRDRPADQDAADVPERRRPTASARRLRVHQMTTEGRDMAEDVADMTDDFPEQATKAPEMRADAQGADSGEGSDGDDAAEGFPGGPRDPSVLTSFAEHVAHAVWSGQEHPDLKLVSHGRK

SEQ ID NO: 125347 - protein, 360 aa, Glycine max
  Coding DNA Sequence Number=SeqID_33662
  Gene Ontology: Mol. function=DNA binding; Cellular component=nucleus; Biological process=regulation of transcription
  Homolog annotation: Hit_ID=A2Y554; Match level="QueryCoverage=17%, HitCoverage=37%, E-value=6e-18, Identity=64%"; Hit description =Putative uncharacterized protein
  Pfam annotation: Domain name=Myb_DNA-binding; Domain location=128 -174; Score=45.9; E_value=1.4e-10; Accession=PF00249.22; Description =Myb-like DNA-binding domain
MGENNNKFHCCGDDDGFDEPLYLKYPALQDLEWEGTLICLPPDLSSLSNNFTPKVLPLSMSPPSETTVTRVPPMLPPVEDATYVQPNLQDQLSALQNINANQVAPMWPGSQINHSLSRKGSSSKSNECRRWSEEEHRLFLHGLQKYGKGDWINISRIIKTRNPTQVASHAQKYFLRQASSNKGKRRNIHDMVLPDGPVPHRIYQQNGVSFRNLDGPITHHINHQNGIKYLGSSLGYLNPSHTKKANTLSKADLGQCFEYHCNRGHSTEECIILKDKIEDFIKLGHLKDFIHKTQSYRLQNSYRQDKDKGRDRDCSHQSQTESERSRSRFRERKEQSLNPPRCVINTIVGGFAEGRAMTSD

SEQ ID NO: 125348 - protein, 266 aa, Glycine max
  Coding DNA Sequence Number=SeqID_33663
  Homolog annotation: Hit_ID=A7PRR7; Match level="QueryCoverage=87%, HitCoverage=96%, E-value=3e-81, Identity=65%"; Hit description =Chromosome chr14 scaffold_27, whole genome shotgun sequence
  Pfam annotation: Domain name=Rick_17kDa_Anti; Domain location=149 -192; Score=7.6; E_value=0.033; Accession=PF05433.6; Description =Rickettsia 17 kDa surface antigen
MDFESRRLHLLISVVAIVALSFTAEKCRELVGEEGSSQSGKFTILNCFDMGSGTVACAVKEGVKLYFYNIRSSHAERARSQAIESALVDAVAQGMSPTDSAKHAQKEGKKAAKLASRQAKRIIGPIISSGWDFFEAIYYGGTVTEGFLRGTGTLFGTYAGGFLGEQRLGRIGYLVGSHLGSWVGGRIGLMVYDVVNGVHLLLQFVQTAETEVREKSERSESSFFGETPVYDGSEGSSVYESPLDEESYAYKSTERQSYETYEDSEL

SEQ ID NO: 125349 - protein, 985 aa, Glycine max
  Coding DNA Sequence Number=SeqID_33664
  Gene Ontology: Mol. function=nucleoside-triphosphatase activity; Cellular component=mitochondrial matrix; Biological process=ATP -dependent proteolysis
  Homolog annotation: Hit_ID=P93655; Match level="QueryCoverage=94%, HitCoverage=99%, E-value=0.0, Identity=69%"; Hit description=Lon protease homolog 2, mitochondrial precursor
  Pfam annotation: Domain name=AAA; Domain location=463-678; Score =160.7; E_value=3.8e-45; Accession=PF00004.20; Description=ATPase family associated with various cellular activities (AAA)
  Pfam annotation: Domain name=AAA_2; Domain location=461-601; Score= -35.0; E_value=0.0051; Accession=PF07724.5; Description=ATPase family associated with various c
  Pfam annotation: Domain name=AAA_3; Domain location=464-600; Score= -13.7; E_value=0.011; Accession=PF07726.2; Description=ATPase family associated with various
  Pfam annotation: Domain name=AAA_5; Domain location=463-606; Score= -0.6; E_value=0.0032; Accession=PF07728.5; Description=ATPase family associated with various
  Pfam annotation: Domain name=LON; Domain location=132-311; Score =27.9; E_value=3.5e-08; Accession=PF02190.7; Description=ATP -dependent protease La (LON) domain
  Pfam annotation: Domain name=Lon_C; Domain location=765-972; Score =344.4; E_value=2e-100; Accession=PF05362.4; Description=Lon protease (S16) C-terminal proteolytic domain
  Pfam module annotation: Pfam domain module=AAA::AAA_2::AAA_3::AAA _5::LON::Lon_C; Domain location=463-678::461-601::464-600::463 -606::132-311::765-972
  Subcellular localization annotation: CTP_CleavageSite=25; ConfidenceScore=5.22e-01
MKGFKKSGCTNTTQPNLSAPLWVSMAGMNQPSILKIPLPMLKLIASSSRIHRVHPTVLRPAHDSASPLLRVLSSLVGLSWRNTNVGGRYFFCSGSSDSSDRVVDAGVQAADESESKASAIVPTYPRPEDYLTVLALPLIHRPLFPGFYMPVFVKESRERQAPYAGAFLLKDEPEADPSAVSSSDTDKNVYDLKGKELFNRLHEVGTLAQVSEDPLTVKVDHLKDKTYNKDDDIIKATSFEVISTLRDVLKTSSLWRDHVQTYTKHIGDFTYPRLADFGAAISGANKLQCQQVLEELDVYKRLKLTLELVKKEMEISKIQESIAKAIEEKISGEQRRYLLNEQLKAIKKELGLETDDKTALTGKFRERIEPKREKCPPHILQVIDEELAKLQLLEASSSEFSVTRNYLDWLTALPWGEYSDENFDVTRAQKILDEDHYGLTDVKERILEFIAVGKLRGTSQGKIICLSGPPGVGKTSIGRSIARALNRKFFRFSVGGLADVAEIKGHRRTYIGAMPGKMVQCLKNVGTANPLVLIDEIDKLGRGHAGDPASALLELLDPEQNANFLDHYLDVTIDLSKVLFVCTANVVEMIPNPLLDRMEVVAIAGYITDEKMHIARDYLEKTTREACGIKPKQVFIFATCFAVPSPAENGMFKVEVTDAAILALIENYCREAGIALQLVRQGEMIDATVEPIKENIDSDEFGQNTVQNKNSELVEGSDPEKEGETSDKVDKVQTDLSSDESQCLEVAKESEEDKEIKTKTIEKVLVDESNLTDFVGKPVFHAERIYDQTPVGVVMGLAWTAMGGSTLYIETTLVEEGEGKGTLHPTGQLGDVMKESAQIAHTVARAILLEKEPENPFFANSKLHLHVPAGATPKDGPSAGCTMTTSLLSLAMKKPVKKDLAMTGEVTLTGKILPIGGVKEKTIAARRSEVKTIIFPSANRRDFDELAPNVKEGLDVHFVDDYMQIFNLALGDDQSQNIERVINVL

SEQ ID NO: 125350 - protein, 337 aa, Glycine max
  Coding DNA Sequence Number=SeqID_33665
  Gene Ontology: Mol. function=binding; Cellular component=nucleus
  Homolog annotation: Hit_ID=A7PRR3; Match level="QueryCoverage=75%, HitCoverage=36%, E-value=5e-41, Identity=64%"; Hit description =Chromosome chr14 scaffold_27, whole genome shotgun sequence
MAQLLSAFWIQANLPDNLPSNIEAIAHSFILTLPVLRIKNLKDRDSLVIRFFQLPLSLWTMLLDQSNGILSPACQRSVYVLSAGMLSFACKIYQIPDLNDVFASLPMSGVDPSNSAGEDDTISEASVSDLSRFIPKMPLSPSAPHVISIGQLMESALEVAGQVAGTAISTSPLPYNTMASQCESLGTCVRKKLSNWLAFENHYSQTPDDKSFLAIADIRNSASEKVTNGGGHAQLPRDPMKLPPASPFDNFLKAAGAWNCLKWGPVLHAFPTHCFGVNCTGNLLFCENPVYNGTGTATLWWALPVRGGLLLVARVAQVKICHNAYIKGIRIRSTLEV

SEQ ID NO: 125351 - protein, 451 aa, Glycine max
  Coding DNA Sequence Number=SeqID_33666
MQLTNDVHKEQGGTMGSVLGRQCPKMDSLGEAELVKVVANQWGTWSRTLLADKHDIVKHIGAHPSISMNRKNYPINGEVFLRHPSGHPKGMNGTPRVEWALVVSKNNEMLTQEVMPPFSDYGENSTHEGPGRISFDSEKFVKQRSQGIGNRSIVLYKTSVESHNAYETTELCYGQWCKPSEHGTNFLQIGGGTGSGDYVSQAPGIKMVVTGKKVLSRLWVGGEVMKKSHWCWLGRVFELIGIVMKHFECAPNDEPVIAMQYTTISDHHLKGINGVSSDDGGEIETRKHRLDSGVRAGAGTSTSSSAMNKSSKERRFTGNHGVGVDGRGPELSFVEGITGVGKCVERMRQWRSWLATWPPKMSTCHCLTSIGTSTELNLPCKMKQPLNTHFPKCIGGERGGHGVGGDFGEEGVVVRDASFSRMKSILLFMGANAWARETWFCVREVLMEACL

SEQ ID NO: 125352 - protein, 155 aa, Glycine max
  Coding DNA Sequence Number=SeqID_33667
  Subcellular localization annotation: CTP_CleavageSite=56; ConfidenceScore=5.36e-01
MGYFPYHSNSKGLGSMVRAATRRHLLGKVEFPTSRLQPWGQDTYVNRFRRSVTRFYAASGRTVTVPRVRRRRRSRKGSPMKAEFDIGSDAPVKKVDDDVTKVAKIVMKHRDLKEIMEAVKENFEKATIVEDQLLEMLEVRKAHLDRNDNVSKFSF

SEQ ID NO: 125353 - protein, 142 aa, Glycine max
  Coding DNA Sequence Number=SeqID_33668
MNLRRPCSSTLDHHRMPTHFDISVKSEPQTTSAHGHTHIHLHHHVGSKVAFHPNPTTPYMFSHHPCFMTKPFPSDLVSQHCKVSPKTLSFREGFTYEISIRQISSNNHKKKKCRCPLSQLVSNQRKRTHPAFVDQGLKMTIH

SEQ ID NO: 125354 - protein, 641 aa, Glycine max
  Coding DNA Sequence Number=SeqID_33669
  Gene Ontology: Mol. function=metal ion binding; Biological process =histone H3-K9 demethylation
  Homolog annotation: Hit_ID=A7Q7J4; Match level="QueryCoverage=54%, HitCoverage=38%, E-value=1e-68, Identity=38%"; Hit description =Chromosome undetermined scaffold_60, whole genome shotgun sequence
MAPGRKKRQGNTSIIPVDANPTQQKAQSLDIDAECESETKRMKFAEEDGDGAGGSSSVVKKKRGRKSKKEKQDTEKMLESNLSEKKDTQGEYHGENCGVGGSSSVQESAKKKRGRKSKKEKEDMEKKKMAEEKDAQNENHGENGGVGGSSCVVDGVPKKRGRKSKKEKEDMEKKMLEEKDAQNENHGENGGVGGSSSVVEAVVKKRGRKSKKEKEDMERKILEEKDAQNENHGENGGVGGSSSVVDGVPKKRGRKSKKEKEDMEKKMLEGNLLEKKDVQDVNHAENGGVPDMRRGSKRKMLKEDDGEFEMPVDSSGSSIQKQYSLRAPRVNIEEAMPKINKRDPKQWIEEESLMCHQCQRNDKGRVVRYPHLKEDYIAEACPVCRGNCNCKACLRSNQLIKKMKKKEETNENEKIELSMHLLQVLLPYLRLLDEEQMIENETEAKIRGLSVSELNVAQANFDKDERVYCDNCKTSIFDYHRSCTKCSFDLCLICCRELRTGQLVGGADPIMLEFVCQGRDYLHGEENISVKQNEPNAVEQNEPNAVAETVVREWSRSGWHAESNGSIPCPKVNDECNHGFLELRSILGQHFITDLVHKANELAQAYKLQDVVKTPDNFCSCLRLDRNTDIPGTTIYTVLGL

SEQ ID NO: 125355 - protein, 108 aa, Glycine max
  Coding DNA Sequence Number=SeqID_33670
MNVEMQRSISNHKMQNIGDAIPNSCKDLAKQVLTMLELVNNIIKHQTLMLIHPVLRLGFRCIYDNEDSAKSELPCLDGDWCMLGYVLEDETIGDGMRGILSRIIKEGF

SEQ ID NO: 125356 - protein, 133 aa, Glycine max
  Coding DNA Sequence Number=SeqID_33671
MSVPHSRSSATEKKLIVASFGIKNYDKGGASPIDSFTNYNVNMNNPQEQENFSIYANRTVGPPPILLTKALLKAHVQNAEAHFSHIHPDTSIWMPSELSSPRRAGYFTSKFPNGPRWAQGLENVPKMTLLPPF

SEQ ID NO: 125357 - protein, 104 aa, Glycine max
  Coding DNA Sequence Number=SeqID_33672
  Pfam annotation: Domain name=Ins_element1; Domain location=3-93; Score=-21.4; E_value=0.016; Accession=PF03811.4; Description =Insertion element protein
  Subcellular localization annotation: CTP_CleavageSite=73; ConfidenceScore=5.75e-01
APVASVSISCPSCSATDGVVRNGKSPRRTSALASVAGHAARNPPHPPRLMRRYRARPHSPFRLRNCWEGRSVRASSLLRQLAKGGCAARRLSWVTPGFSPVTTL

SEQ ID NO: 125358 - protein, 65 aa, Glycine max
  Coding DNA Sequence Number=SeqID_33673
  Gene Ontology: Mol. function=electron carrier activity; Cellular component=integral to thylakoid membrane; Biological process =electron transport
  Homolog annotation: Hit_ID=P49161; Match level="QueryCoverage=76%, HitCoverage=15%, E-value=2e-18, Identity=96%"; Hit description =Apocytochrome f precursor
  Pfam annotation: Domain name=Apocytochr_F_C; Domain location=2-65; Score=42.6; E_value=3.6e-13; Accession=PF01333.10; Description =Apocytochrome F, C-terminal
MAEGDIIPPETRSFLFQKGDAEIVLQDPLRVQGLLFFFASIILAQIFLVLKKKQFEKVQLSEMNF

SEQ ID NO: 125359 - protein, 154 aa, Glycine max
  Coding DNA Sequence Number=SeqID_33674
  Homolog annotation: Hit_ID=Q6WAY4; Match level="QueryCoverage=87%, HitCoverage=24%, E-value=6e-11, Identity=31%"; Hit description =Putative uncharacterized protein
MGTNQTGKRFYQVKIKGLDITSIKEVGRLMGPLQMQAFRKAYRKILDLTIAEISTEAVISLTQYYNQPLRCFTFGDFQLVPTVEEFEEILGCPLGGRKPYLFSGFLPSLSKIAVVVKDSARGLDRVKQSRNGVVGLPRMYLEGKARDMANQEEW

SEQ ID NO: 125360 - protein, 46 aa, Glycine max
  Coding DNA Sequence Number=SeqID_33675
MPFCGRATRGSRVDKSGALAPTYPPSKRKSDLRSSSLKVNQAILLL

SEQ ID NO: 125361 - protein, 85 aa, Glycine max
  Coding DNA Sequence Number=SeqID_33676
MLLRWNKLNQLKIDGVRFSLDSTRAIFLGILNHVQIVANTNGNDADVAPEFSPLKTVQFRNPSQDTVDPRDGGFGGRLWRWKWEK

SEQ ID NO: 125362 - protein, 178 aa, Glycine max
  Coding DNA Sequence Number=SeqID_33677
  Gene Ontology: Mol. function=cyclopropane-fatty-acyl-phospholipid synthase activity; Cellular component=cytoplasm; Biological process =lipid biosynthetic process
  Homolog annotation: Hit_ID=Q7BB91; Match level="QueryCoverage=100%, HitCoverage=46%, E-value=2e-93, Identity=88%"; Hit description =Cyclopropane fatty acid synthase
  Pfam annotation: Domain name=CMAS; Domain location=1-168; Score =191.6; E_value=2e-54; Accession=PF02353.11; Description=Cyclopropane- fatty-acyl-phospholipid synthase
MARERCQGLDVDIRLQDYRDLNEQFDRIVSVGMFEHVGPKNYDTYFEVVDRNLRPDGLFLLHTIGSKRTDNNVDPWINKYIFPNGCLPSVRQIANASESHFVMEDWHNFGADYDTTLMAWHERFQQAWPEIADNYSERFKRMFSYYLNACAGAFRARDIQLWQVVFSRGIEHGLRVAR

SEQ ID NO: 125363 - protein, 107 aa, Glycine max
  Coding DNA Sequence Number=SeqID_33678
  Subcellular localization annotation: CTP_CleavageSite=18; ConfidenceScore=5.06e-01
MWALSLSLQVAGVATYPSAGGRRGAHGCIFHGRKMRGVATNVYLRKTSEKPERCGLRTLSVKGSGVVFTHGEGCFPRSYVSSIAMRKSDLHSSFRTKRWLSCFDLFP

SEQ ID NO: 125364 - protein, 159 aa, Glycine max
  Coding DNA Sequence Number=SeqID_33679
  Gene Ontology: Mol. function=motor activity; Cellular component=cell projection
  Homolog annotation: Hit_ID=UPI00006A2D9E; Match level="QueryCoverage =99%, HitCoverage=85%, E-value=7e-18, Identity=17%"; Hit description =UPI00006A2D9E related cluster
GLHVLAFRRLHVLAFRGLHIFAFRGLHILSFKGLHVLAYRGLHVLAYIGLHILTFRGLHALTFIGLHALAFRGLHVLAFRGLHVLAFRGQHALAFRGLHILTFRGLHVLAFRGLHVLAFKGLHVLAFRGLHAFTFRGLHALAFIGLHALTFRGLDVLAF

SEQ ID NO: 125365 - protein, 100 aa, Glycine max
  Coding DNA Sequence Number=SeqID_33680
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=71%, E-value=9e-12, Identity=35%"; Hit description =Chloramphenicol acetyltransferase
  Pfam annotation: Domain name=CAT; Domain location=6-98; Score=-109.8; E_value=7.2e-05; Accession=PF00302.9; Description=Chloramphenicol acetyltransferase
MEKKITGYTTVDISQWHRKEHFEAFQSVAQLFTLVTPFSMSKLKRFHRSGVNTTTISGSFYTYIRKMWACYGENLAYFPKGFIENMFFVFSQSLGEFHQF

SEQ ID NO: 125366 - protein, 69 aa, Glycine max
  Coding DNA Sequence Number=SeqID_33681
MGTNQTGKRFYQVKVKSLDTTSIKELGRLMKPLQMQAFRKTYGKETAMTIAEVSIEAIASLTQYYDQPV

SEQ ID NO: 125367 - protein, 152 aa, Glycine max
  Coding DNA Sequence Number=SeqID_33682
SGGANTRPLQVMPLSPVILVTLADNELMSVASSFLSLGGAYLYGAVWLFWHRNRTGLTTEGYRGIWGVTSLVKYTTKGSGLPKLLSSADCIHICCSSLPSSPTSSRPRSIICCNRSSTAKDVSMSCSSPGCIKQESSSCPPWGITPPFCRVS

SEQ ID NO: 125368 - protein, 152 aa, Glycine max
  Coding DNA Sequence Number=SeqID_33683
  Homolog annotation: Hit_ID=Q6WAY4; Match level="QueryCoverage=83%, HitCoverage=23%, E-value=1e-10, Identity=33%"; Hit description =Putative uncharacterized protein
MGPSQTPSLKKRFYQVKVKSLGITSLRELGQLMGHLQRQVFRKTYGKIWDLAMAEVSAEAIASLAQYYDQPLRCFTFGDFQLSPMVEEFEEILGCPLGGRKSYLFSGFYPSLARISKIVQISAQEFDHRKQVENGVVGIPRKCLEAKARILA

SEQ ID NO: 125369 - protein, 84 aa, Glycine max
  Coding DNA Sequence Number=SeqID_33684
MAAEWRRKRERRRHFKEKMSLEEAYDHRRPWIRAWRKKEMNEGRGREEHKILCSKRALKSEPTNSKINSKISPTNCALGCNKGM

SEQ ID NO: 125370 - protein, 255 aa, Glycine max
  Coding DNA Sequence Number=SeqID_33685
MADITNDRNVDANRLVDRGGIDIDMDLLRIRRESVDAAGNTVVETRADADENVAIMHRHVGFVGTVHAQHAEPVLAGRRIGTETHQCRRDREAGQLDQFTQQPGCFRAGIDDAAAGVENRLFRLRHQFDGGMDGIKVTLNLRLVALLLDGGGRRRVGAGGELDVLRDIDNDRTRAAGLRNAESLMDDTSQFVDVLYQPVVLGAGARDANSIAFLERVRADQRGGNLAGQADERNGIHQRILQRGDRIGRAGTGIL

SEQ ID NO: 125371 - protein, 156 aa, Glycine max
  Coding DNA Sequence Number=SeqID_33686
MGRYKALLRSCPCHGYSDYTQISMLIKGKPNEYRRMINTSAGGYYVNGTTTKELAKEAKFMRECITKLEEAVINLSTNKVDWNAITTRSGLATKELLRKDMEVDDGVKEDIQEEGMIVEEIAREPIKIKIQLTREAKQGITCEKSYPHKPTKQDKE

SEQ ID NO: 125372 - protein, 68 aa, Glycine max
  Coding DNA Sequence Number=SeqID_33687
AEREVLRSRGEGLETKKRKEEGRREKEAKSLPNYDRSSFFVLHPEQGQHPLMEACLWGFYRGWIFELQ

SEQ ID NO: 125373 - protein, 70 aa, Glycine max
  Coding DNA Sequence Number=SeqID_33688
MVAELRRKRERRRHFKEKMCLEEAHHHRRPWIRAWRKKEMNEGRVIGMEKEEREETPLQGEDESRRSSPP

SEQ ID NO: 125374 - protein, 185 aa, Glycine max
  Coding DNA Sequence Number=SeqID_33689
DRAHKTPSRPEEVQQGPGVSSSGYGPLSVLQGARSPSEESHPQRHPVDPEKSNRALGFPALVTGLCSPTGCPFPPARSRHHRVPVTSSKGIRPPTNRAFIKKYYIPRQAQGKTPQQPGDGRQRATDAPPSPLEFTSAHPQKGNQVQSQGKQSTRSVTDKSSPVSSDVKEALLGGKLVPFKSLLVI

SEQ ID NO: 125375 - protein, 194 aa, Glycine max
  Coding DNA Sequence Number=SeqID_33690
MVEEQNDKTTLTQNEDFPVKGLPEKRDGCGKKEVSLEEASEFLRIIQQSEFKGLGKDNNGITSLISAKENHGKFGLGYKPTEADIKKGITGRKSGGQGSRLGQEVKGGPPCHISRSFISAGLGHEGQVVAICEDDSPSGSELERPDIYATSIISDDESLEGTNTLDPTIDFEQKQIKRDKEDEDVGLPSGVGER

SEQ ID NO: 125376 - protein, 41 aa, Glycine max
  Coding DNA Sequence Number=SeqID_33691
MHLRDQGTYREDPTEDLAFDTRKSSLQQREDQDERLQKYKW

SEQ ID NO: 125377 - protein, 83 aa, Glycine max
  Coding DNA Sequence Number=SeqID_33692
MSETVKICMAYFKCMKWPRGNLPQRDPGRIKRPKEPVPLPSMTVTALGALNTSSASRPSRDGHFSGSDVASSGTMSIPISRRR

SEQ ID NO: 125378 - protein, 209 aa, Glycine max
  Coding DNA Sequence Number=SeqID_33693
  Gene Ontology: Mol. function=protein kinase C binding; Cellular component=cell projection; Biological process=keratinization
  Homolog annotation: Hit_ID=UPI0000F2ADE5; Match level="QueryCoverage =57%, HitCoverage=14%, E-value=3e-10, Identity=41%"; Hit description =PREDICTED: similar to PDZ-LIM protein cypher3s isoform 1
PSEDYTSSPSEDYTSLPSKGYTSSPSGDYTSSPLEGYTPSPSEDYTSSPLGGYTPSPSEDYASSPSEGYTPSASEEYTSSPSEDYTSSPSEDYTSSTLEDYTSSPSEGYTLSPSRYARRTPGGPKEIQQGLGVPALITGLCQFYRVPVAPTRPLGPAIPGFHQEVLRPQTGAGRNTTAALGWPVASNRHTVTTSRVHLSSSTKRLERCL

SEQ ID NO: 125379 - protein, 109 aa, Glycine max
  Coding DNA Sequence Number=SeqID_33694
METLQKVRKAWEVLQKKDKELRGSNNGPICGYRKWLKAHVQGLDWLPSLRTAKREEVEAPKEDEEENAELRDVNVATTKALEQETKRARREEHGRNKFRGALFGQQQGA

SEQ ID NO: 125380 - protein, 121 aa, Glycine max
  Coding DNA Sequence Number=SeqID_33695
  Pfam annotation: Domain name=G-patch; Domain location=1-42; Score =23.6; E_value=0.00027; Accession=PF01585.14; Description=G-patch domain
MVARVMLKNGFEPGMGLGKDCLGNADVVDIKGNPYKYGLGYEPGMPGRRNVPSRFRADRVWPGRISQCFTSAGMVSEEEVATIEEEFPQDPPSFVQPCHPDSQVGNWRVISQSEVYTADSM

SEQ ID NO: 125381 - protein, 66 aa, Glycine max
  Coding DNA Sequence Number=SeqID_33696
MVWNNAIKGLDEAPQPKSKASARWIVVKYFNDPRPFEPKRLKALRIQWAQYYLRVRAQSLDLGIRH

SEQ ID NO: 125382 - protein, 113 aa, Glycine max
  Coding DNA Sequence Number=SeqID_33697
TKFGHSASMIRGDTLWLFAPFCHPEAAGPMTSRDQVWSFCTLVSSRGGGPDDTRKYPSVFCTFCSSGNNKSFTCGNFMVARDSRQPRGAKLVSYTDFRGPLLDDMRPFFGPCE

SEQ ID NO: 125383 - protein, 48 aa, Glycine max
  Coding DNA Sequence Number=SeqID_33698
MWTTTGEMLAAQLAQAPPPPLPPEATAFWKNLLEGPSGPGCYLHPHFY

SEQ ID NO: 125384 - protein, 230 aa, Glycine max
  Coding DNA Sequence Number=SeqID_33699
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q6I8E6; Match level="QueryCoverage=63%, HitCoverage=44%, E-value=4e-73, Identity=98%"; Hit description =Pseudo-atpA
  Pfam annotation: Domain name=ATP-synt_ab_N; Domain location=84-152; Score=89.6; E_value=1e-23; Accession=PF02874.14; Description=ATP synthase alphabeta family, beta-barrel domain
  Pfam annotation: Domain name=Complex1_49kDa; Domain location=1-87; Score=-135.4; E_value=0.0018; Accession=PF00346.10; Description =Respiratory-chain NADH dehydrogenase,
  Pfam annotation: Domain name=HAS-barrel; Domain location=84-150; Score=44.8; E_value=2.9e-10; Accession=PF09378.1; Description=HAS barrel domain
  Pfam module annotation: Pfam domain module=ATP-synt_ab_N::Complex1 _49kDa::HAS-barrel; Domain location=84-152::1-87::84-150
MTTGSSVYSTSIHHFELYTEGFSVPAPSTYTAVEAPKGEFGVFLVSNGSNRPYRRKIRAPGSAHSQGLDSMSKHHMPADVVTIIVDEIGRVVSVGDGIARVYGLNEIQAGEMVEFASVVKGIALNLENENVGIVVFGSDTAIKEGDLVKRTGSIVDVPAGKAMLGRVVDALGVPIDGRGALSDHERRRDEVKAPGIIERKSVHEPMQTGLKAVDSLVPIGRGQRELIIGD

SEQ ID NO: 125385 - protein, 209 aa, Glycine max
  Coding DNA Sequence Number=SeqID_33700
  Homolog annotation: Hit_ID=A5B076; Match level="QueryCoverage=62%, HitCoverage=7%, E-value=3e-08, Identity=32%"; Hit description =Putative uncharacterized protein
  Pfam annotation: Domain name=G-patch; Domain location=75-119; Score =35.7; E_value=1.7e-07; Accession=PF01585.14; Description=G-patch domain
MVVCAFDGTRREVRGEIDLPIQIGPHTCQVTFQLPILYAIVEAVEESLETAFQSFEVVSIASVDSFSGQPCLSDTAMMVARVMLGNGYDPGMGLGKNNSGRTSLISTKGNRGKFGLGYKPTQVDIRKSVAGRKSESQGSQLGREIERGPSCHISRSFISAGLGHEGQVVVICEDDSPSGSDLVRPCPLGFQLGNWRVEERPDIYATSIM

SEQ ID NO: 125386 - protein, 88 aa, Glycine max
  Coding DNA Sequence Number=SeqID_33701
  Gene Ontology: Mol. function=nucleic acid binding
  Homolog annotation: Hit_ID=Q2A9Z4; Match level="QueryCoverage=100%, HitCoverage=15%, E-value=1e-08, Identity=42%"; Hit description=Zinc knuckle family protein
MTIEESIHVTFDETNITSPRKEFLDDIADSLEDMHNQERNLKRKRNEENNDVQDDIAQENDNLPKEWKTSRNHPLDNIIGDISKGLTT

SEQ ID NO: 125387 - protein, 85 aa, Glycine max
  Coding DNA Sequence Number=SeqID_33702
MNLAIGNRLHPVATYLLAGGRRGAHGCIFQERKMRGAATNVYLRKMSEKPERCGLQNLIIKGLGVVFTHGEDKGVSLTPTYPQLR

SEQ ID NO: 125388 - protein, 87 aa, Glycine max
  Coding DNA Sequence Number=SeqID_33703
MQQGQADIPIARFPDPNYGVKTKTKGQIRVFVLYPNRKPSWKIPLRLKGSSRCGFSMENNDGLWWLWVMEKVLGTLEMTLEERKKKK

SEQ ID NO: 125389 - protein, 270 aa, Glycine max
  Coding DNA Sequence Number=SeqID_33704
  Homolog annotation: Hit_ID=A5C0U2; Match level="QueryCoverage=41%, HitCoverage=31%, E-value=4e-10, Identity=33%"; Hit description =Putative uncharacterized protein
ASLPNSPGYKSNPQETQHKDAHAKVEYVKRLYDQVKVQFAKKNESYAKQANKNRKEEVLEPGDDPGHLRANVFQEGGNDENPKIAKIQGPMTRSKTKQSMDTLQQMVADILSKAQVEKDEALDWRRTKPPSYPCGVYPDLSSFTGSGVIQISIACIKRSAPSQDHITPPRERTLREMAALDFTYESLCIQYPDQDVPYVLKTGLIHLLPKFRGLANEDPHKHLKEFHIVCSTMKPPDVQEDHIFLKAFPHSLEGVVKDWLYYLAPKSISS

SEQ ID NO: 125390 - protein, 70 aa, Glycine max
  Coding DNA Sequence Number=SeqID_33705
MARSVFTPCPYFRDLQGRELKRPLVIFPKVVISILIVSRGIIPFKEHIAAVGTTSNNMLSKRKTLDEGSL

SEQ ID NO: 125391 - protein, 76 aa, Glycine max
  Coding DNA Sequence Number=SeqID_33706
MAKMPLPLAECSGVASAISDLAMQGTVSMDIASGVGEIMQYGYSHWCWRDHATLNSIFKIACSAFLKIVEPFLLQV

SEQ ID NO: 125392 - protein, 304 aa, Glycine max
  Coding DNA Sequence Number=SeqID_33707
  Homolog annotation: Hit_ID=Q6UUU1; Match level="QueryCoverage=19%, HitCoverage=40%, E-value=4e-18, Identity=78%"; Hit description =Putative uncharacterized protein
  Subcellular localization annotation: CTP_CleavageSite=48; ConfidenceScore=5.00e-01
GTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLLLRRPVNFNTTHYRANWSSTAVAAALELVIDDGFGQNGNSATVKKLLNFGYSSEIEVMRIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 125393 - protein, 25 aa, Glycine max
  Coding DNA Sequence Number=SeqID_33708
MLYSMPGGSTSSRAAATAVELQFAL

SEQ ID NO: 125394 - protein, 285 aa, Glycine max
  Coding DNA Sequence Number=SeqID_33709
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIRCRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 125395 - protein, 190 aa, Glycine max
  Coding DNA Sequence Number=SeqID_33710
  Gene Ontology: Mol. function=motor activity; Cellular component=cell projection
  Homolog annotation: Hit_ID=UPI00016621D1; Match level="QueryCoverage =98%, HitCoverage=41%, E-value=8e-18, Identity=34%"; Hit description =UPI00016621D1 related cluster
MHALTFRGLHVLTFKGLHTLTFRGLHVLTNRELHVDTFRGLHVLASRGPHVLAIKRLHALTFRGLHILAIIGLHVLTFRGLHVLAIRGPHAITFSGLHVFAIKGLHALTFRGLHVLAIRGLNVLAFVGLHALTFKGLHVLPFRGLRVLTFRGLHVLTIRGLHVLAICGLHVLPLRGLHVLTFKGLRALTF

SEQ ID NO: 125396 - protein, 145 aa, Glycine max
  Coding DNA Sequence Number=SeqID_33711
MGTNHTGKRFYQVKIKGLDITSIKELGRLMGPLQMQAFRKAYGKILDLTIVEICTEAIVSLTQYYDQPLRCFTFGDFQLGFGKRIGSCKANSKRRSGPTTEVLRRQGKGYGESRGVGPVYGRISISNLWGCPLSKCGRFGGPSRN

SEQ ID NO: 125397 - protein, 201 aa, Glycine max
  Coding DNA Sequence Number=SeqID_33712
  Homolog annotation: Hit_ID=Q2HW90; Match level="QueryCoverage=91%, HitCoverage=51%, E-value=4e-19, Identity=30%"; Hit description =Putative uncharacterized protein
VTSFKELGRLMGPLQRQAFRKVYGKILDLAAAEVFTEAVVSLAQYYDQPLRCFTFGDFQMVPTIEEFEEILGCPLGGRKPYLFSGFLPSLSKIATVKYLEGKARDMPSQGKWGQFADILALLIFGVVLFPNVDGLVDLAAIDAFLAYHHSKESPVVAILADLFDTFDRSAINWFPRWKEGKGGVLFSCGDYPNIPLIGTRG

SEQ ID NO: 125398 - protein, 106 aa, Glycine max
  Coding DNA Sequence Number=SeqID_33713
  Subcellular localization annotation: CTP_CleavageSite=65; ConfidenceScore=5.07e-01
DGPSGTSTLVFRGLHVLANRGLHALTLGTSYPHRQRTTRPRLERTTRPHHQRAARPYLQRTISPRLERATRPHLGGLHVLTIKGLHALTSRGLHVLALRGLHALTF

SEQ ID NO: 125399 - protein, 122 aa, Glycine max
  Coding DNA Sequence Number=SeqID_33714
MEGSIDVALVKEFYANLYVPGDKPPKHVRVRGHLIKFDVDSLKTFLETPIVLEPGETDRGRTRIKENNVGDLVSYPNFIRGLLFDDIQPLIGHFEILGTLCCTICEVPRRAENQKEAGLRDP

SEQ ID NO: 125400 - protein, 153 aa, Glycine max
  Coding DNA Sequence Number=SeqID_33715
VWKECAGLREENAATARALEQETKRARKEEHGHEKFRGALWGRNSELKLRREERDQSRAHSMVLKEELAACSRSKRNLSRRLCETETNMLAIVSKYQEELNQATDHEHKVADEYAQVYAEKEARGRVIDSLHQEATMWMDQFALTLNGSQELP

SEQ ID NO: 125401 - protein, 15 aa, Glycine max
  Coding DNA Sequence Number=SeqID_33716
HRAKELRRVRVAEGI

SEQ ID NO: 125402 - protein, 25 aa, Glycine max
  Coding DNA Sequence Number=SeqID_33717
MAIARWALKQPVYDIVILRLDDVPK

SEQ ID NO: 125403 - protein, 132 aa, Glycine max
  Coding DNA Sequence Number=SeqID_33718
MAEYEACALAVQAAIDSDVKLLQGVRATQPLVIPSGWRRGNGKLEDPQADTLQSPTSKELAGDFRMEISFPSCSPRGRNQMAGCTCYVSWQTRTLLPSGRGTGRKALGITTSSDMSKAKNTRQRLPTTIKGH

SEQ ID NO: 125404 - protein, 67 aa, Glycine max
  Coding DNA Sequence Number=SeqID_33719
VCDALRCSGPHARYTDVFNESIALADRLALTTVPALCTHRPSLLPIEWAGEVVGLAATWSGSLPATL

SEQ ID NO: 125405 - protein, 92 aa, Glycine max
  Coding DNA Sequence Number=SeqID_33720
  Homolog annotation: Hit_ID=A5BTR2; Match level="QueryCoverage=83%, HitCoverage=3%, E-value=1e-12, Identity=50%"; Hit description =Putative uncharacterized protein
  Pfam annotation: Domain name=zf-CCHC; Domain location=51-68; Score =11.4; E_value=0.029; Accession=PF00098.14; Description=Zinc knuckle
MCVQEEEKLVMEMGESALLTTACRKNKTTRSQANKKGNDKIPPQDDIKKVTKCFFSKKKGHTKKNCPKFHKWLEKKGGLILDLQSILQIIYK

SEQ ID NO: 125406 - protein, 148 aa, Glycine max
  Coding DNA Sequence Number=SeqID_33721
MGEVEEVQKQMKADMEAMKEQMATMMEAMMSMKKIMEANAVAVAATSAVAKVNPMPPSGLNQMNHPTSAMVGKDLGSTSGPYYVQIQNKHVFPPYDLPPNYTPPNVAYTPVRMSITLLPYSLKANNLNLIMHMSLDRWGRHMKCPTTI

SEQ ID NO: 125407 - protein, 83 aa, Glycine max
  Coding DNA Sequence Number=SeqID_33722
MASVVVSILKCSSPHTVLDADDTYVPVNLLGESLDFQYMAENLMLKDYTSIFQANIVFSMKTMMILMMYCLGQVSLIQSLFHG

SEQ ID NO: 125408 - protein, 174 aa, Glycine max
  Coding DNA Sequence Number=SeqID_33723
MQGLGWLPSLRTTKGLEVEATEEDEEVRALRENAELRDVNIATTKALEQETKRARREEHGRNKFRGALWGSNSDLKLRREERDQSRVDSLILKDELKVCLRSKRSLSQRLCETETNMLALISKYQEELNLATAHEHKMVDEYARVYAEKEARGKVINSFTSRGNNVGWTDLLLL

SEQ ID NO: 125409 - protein, 108 aa, Glycine max
  Coding DNA Sequence Number=SeqID_33724
  Subcellular localization annotation: CTP_CleavageSite=29; ConfidenceScore=5.79e-01
MGSPPASTSPPPSPPPPPPPTSDASASPSAVKRTRKASRLRLLSTRPPSAERPVVHVDPATGKADGPHRKKLKTYLGIVAHDKVDITYENWKKAEFDIPKASDSKTNR

SEQ ID NO: 125410 - protein, 47 aa, Glycine max
  Coding DNA Sequence Number=SeqID_33725
MDAGKLPGNHITSETSKRVGLRPQKETTPENLAFHGFKQKTQMKHET

SEQ ID NO: 125411 - protein, 219 aa, Glycine max
  Coding DNA Sequence Number=SeqID_33726
  Homolog annotation: Hit_ID=Q84VI1; Match level="QueryCoverage=100%, HitCoverage=32%, E-value=2e-67, Identity=65%"; Hit description =Envelope-like protein
MIPGQAPVPEKLVPKRQQGVKIAENPSPATSPREVDPEMDKKIRSIVSNILKNASVPEADEDVPTSSTPNVSVPDVDKDVPTSSAPNAEALPSPSEEESTEEDDQATEETPAPKAPEPAPGDLIDLEDVESDEEPIANKLAPGIAERLQSRKGKTPLKRSGRIKTMAQKKSTPITPTTSRRSKVAIPSKKRKEISSSDSDDDVELDVSTSKRAKKSGKK

SEQ ID NO: 125412 - protein, 187 aa, Glycine max
  Coding DNA Sequence Number=SeqID_33727
MGDPISRLPFSGRRIVVTQKAYAALNQWNIVSLLKHVCILVEKTPRLFQVSQVIQNYVGHVTCTLVSSRGGGPDDTRRYLTVIRTLLSSRGGGPDDKQRPKTKFGHSAPLYHPEAAGPMIRGDTLRLSAPFCHPEAAGPMTSRDQVWSFCTLVSSRGGGPDDTRRYLTVIRTLLSSRGGGPDDKQRP

SEQ ID NO: 125413 - protein, 323 aa, Glycine max
  Coding DNA Sequence Number=SeqID_33728
  Gene Ontology: Mol. function=4 iron, 4 sulfur cluster binding; Cellular component=integral to membrane; Biological process=protein -chromophore linkage
  Homolog annotation: Hit_ID=Q3ZIZ3; Match level="QueryCoverage=100%, HitCoverage=62%, E-value=1e-111, Identity=61%"; Hit description =Photosystem I P700 chlorophyll a apoprotein A2
  Pfam annotation: Domain name=PsaA_PsaB; Domain location=1-323; Score =181.0; E_value=3e-51; Accession=PF00223.10; Description=Photosystem I psaApsaB protein
WVQDPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSIKDLLEAHTPPGGRLGRGHKGAFAHGAMFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVK

SEQ ID NO: 125414 - protein, 83 aa, Glycine max
  Coding DNA Sequence Number=SeqID_33729
MDGEELPSPVNSDGQDHLGLPSGVKTKHERQKPIKVLKDERKRGWGHDRPIVALLCAKQAGNVAARQPRILCILQLSFTICLF

SEQ ID NO: 125415 - protein, 283 aa, Glycine max
  Coding DNA Sequence Number=SeqID_33730
  Gene Ontology: Biological process=transposition, DNA-mediated
  Homolog annotation: Hit_ID=Q6UUU1; Match level="QueryCoverage=26%, HitCoverage=51%, E-value=1e-21, Identity=70%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDITTSNLVMKNSPEARSNLIDGSPHSRHSSRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGEREMAYERGGDFLEDARKILNRE

SEQ ID NO: 125416 - protein, 70 aa, Glycine max
  Coding DNA Sequence Number=SeqID_33731
RSAASGLIPIDLEINATCRRRNAERIRNFLQDLEAATTPGEEPRSSEESSSFPTQGQSHSGVRGDTIMAE

SEQ ID NO: 125417 - protein, 159 aa, Glycine max
  Coding DNA Sequence Number=SeqID_33732
  Subcellular localization annotation: CTP_CleavageSite=42; ConfidenceScore=5.03e-01
MQRNSPSSSSDTYFLPQPSFFSEKPFIGIFSFGVRGCEHTTAAGNVAQPRDIGYLGQQRADLVGMHQTGIFPVPTVRNYAPLVDKPPGCHYVLQRLRPTRPTRLNGINCSPSMIGKRAVFGGVARGFSHGMRRLRQGYTTLGKEAGRSSREISQPSGWR

SEQ ID NO: 125418 - protein, 112 aa, Glycine max
  Coding DNA Sequence Number=SeqID_33733
MPISPLQKYQLVCVVPTWGSHPQDTQWTRKSPTGPWGFQLWLRASISPIGCPYPPGKGSHLQDTQWTRRSPTGVPVTSSKGIRPPSNRAFIKKYCVSRQAQGETPQQPGDGR

SEQ ID NO: 125419 - protein, 70 aa, Glycine max
  Coding DNA Sequence Number=SeqID_33734
  Homolog annotation: Hit_ID=A5BH93; Match level="QueryCoverage=72%, HitCoverage=4%, E-value=3e-15, Identity=76%"; Hit description =Putative uncharacterized protein
MKVMPSKPTRIGRKWKSKLQPRGDGPFQVLERINDNAYKIDIPGGDSKGLRENAFQERGNDENPKAAQIQ

SEQ ID NO: 125420 - protein, 63 aa, Glycine max
  Coding DNA Sequence Number=SeqID_33735
MEIYMITKDDDKGDDKKFKGQSKNEFKIFKIESRTLQVSKGKLISRIKNQDSRDQDSRLKIES

SEQ ID NO: 125421 - protein, 115 aa, Glycine max
  Coding DNA Sequence Number=SeqID_33736
MTLRQHGLRLKRIHPNKKIEEAKEHHLDEDALIPHGASSIGACRPRIFFINGFLCFLEDEWQRNGEREREGRRHFKEKMSLEEAHHHRRPWIRAWRKKEMNEGRGREEHEILCSK

SEQ ID NO: 125422 - protein, 125 aa, Glycine max
  Coding DNA Sequence Number=SeqID_33737
MVQRKDKELRGSSNGPIGGYHRWLKAYAQGLDWLPSLRTTKEMEGEAPKEDKERRKGPIASRWIDSEGRIEDLPKVKEEFVLVVMRDQNKHVSHHPQVPRRIKFSHRPRAQSGRRIRPSVREKGG

SEQ ID NO: 125423 - protein, 216 aa, Glycine max
  Coding DNA Sequence Number=SeqID_33738
MVEYNGDKGDRSPLHPWELHDVETCLVSKELLQGLIDEGRIEIGRVMREEGEVFMQSSDTNLGKPKPLVIHFTRDVTTQVPRGFQPVVVRTPSPFPYKSDKAMPWRYDIQGSYGRQDASVMCVGASMPTTKITNISSMSGMMSSGHLFAPPELLAKSNDKGKTREDVVERENVGPVMNNKAPVKKPMEEEDSFGKKEIFTEEATKFPRIIQQSEFK

SEQ ID NO: 125424 - protein, 68 aa, Glycine max
  Coding DNA Sequence Number=SeqID_33739
MEKDFLTRLFTPYFIFTSTRGRARSCLLLMQSYPARALGRRLQVDWARDPREGPRVLMNLRVDFKPMG

SEQ ID NO: 125425 - protein, 85 aa, Glycine max
  Coding DNA Sequence Number=SeqID_33740
  Gene Ontology: Biological process=transposition, DNA-mediated
  Homolog annotation: Hit_ID=Q1J7G7; Match level="QueryCoverage=35%, HitCoverage=42%, E-value=2e-10, Identity=100%"; Hit description =Transposase
WNLLRADQRLIFAKSWPQGFPGINKGHQDLFILRSDLPSQWLLFLSAVPPVQLLTGWCVTAKAPPDISAGKCSGHAARNHHTRRA

SEQ ID NO: 125426 - protein, 31 aa, Glycine max
  Coding DNA Sequence Number=SeqID_33741
MGLRDMYMIEGCPALNEVWEWEVIDIPLLGS

SEQ ID NO: 125427 - protein, 44 aa, Glycine max
  Coding DNA Sequence Number=SeqID_33742
MVADLLAVGGVEEKSPEFQESRDLRSNPFQGRGNDAILPRKSIG

SEQ ID NO: 125428 - protein, 257 aa, Glycine max
  Coding DNA Sequence Number=SeqID_33743
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSIGEKITLRQLEAHLFKAADKLRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 125429 - protein, 32 aa, Glycine max
  Coding DNA Sequence Number=SeqID_33744
GMGLYFCGLPSVSPNGMQTVIVLLLSLYLQYT

SEQ ID NO: 125430 - protein, 72 aa, Glycine max
  Coding DNA Sequence Number=SeqID_33745
  Homolog annotation: Hit_ID=A3H5A2; Match level="QueryCoverage=55%, HitCoverage=95%, E-value=2e-14, Identity=90%"; Hit description =Putative uncharacterized protein
MYEFSRREEPWWSPPDRPDPTREVRHANVPWMIHISGSGADEHIKLSMWLRALTVQAQRRNYQGRALPRGIL

SEQ ID NO: 125431 - protein, 117 aa, Glycine max
  Coding DNA Sequence Number=SeqID_33746
MAKFDLDIVLEFYANAWPTEEGVRDIRSWVREEAIAQLLCTPGQDFTRTAAGRRVRIMHTSMTTLTQMWMTLLLSNVLPSDHNSDLPLSKCQLVYAILTRMSVHVAQLIADAIYLFV

SEQ ID NO: 125432 - protein, 69 aa, Glycine max
  Coding DNA Sequence Number=SeqID_33747
MGDQEEIQEQMKDDMSALKEQMTSMMDAMLGMRQLMENNVATAAAVSSAAEADPILPATAHHPLPNVVG

SEQ ID NO: 125433 - protein, 222 aa, Glycine max
  Coding DNA Sequence Number=SeqID_33748
  Homolog annotation: Hit_ID=A6H5B3; Match level="QueryCoverage=19%, HitCoverage=55%, E-value=4e-18, Identity=100%"; Hit description =Putative ribosomal protein S3
PVAESITSLRSDPSSMGHVESRVNQQGPPCKAKYSWVTDSEVVPETTGAVAKASLHRAIVTAYGPEPGGEMPLEPRASWFSPKCVEAQQLTRHLGVKHCFGAGRESETPGGLPRAATLERVRNSSLIERSCAKMNGAKRSAEAVGCKKESVGERSALEGRTRASSAGRSGSENVGLSNANVGENPMPRKPKGPKIRPKGVVDGQQVNIPVLPFVGPEGRRRL

SEQ ID NO: 125434 - protein, 284 aa, Glycine max
  Coding DNA Sequence Number=SeqID_33749
AISQFLGYPLVLEEGQECEYGQRRNRSDGFDEEAIAHLLCIPGQDFARTAARRWVRIMRTNMTTLTQIWMTLLLSNIQPSDHNFDLPLPKCQLVYAILTRMSIHVAQLIVDAIYLFAGMAPTRHPLDPNKSNRALGFPALITGLCQSFGVHVAPSKVIRPPITRAFIEKYCTQRQAQGDALQAADAQPPHQAGPAGSFDMEQYLRHLLRQQAANHRAHVQTHDVLPDEPQLQSHGFTLSVPTSDQFRAEVAWPGDWLRPGQERRQQRHQQRLPTRQMRPTRTRR

SEQ ID NO: 125435 - protein, 209 aa, Glycine max
  Coding DNA Sequence Number=SeqID_33750
  Homolog annotation: Hit_ID=Q6UUU1; Match level="QueryCoverage=28%, HitCoverage=40%, E-value=2e-18, Identity=78%"; Hit description =Putative uncharacterized protein
RVPFAIQAAQLLGRAIGAGLFAITPAGERGMCCKAIKLGNARVFPVTTLNSMGVLSLTDLSNYRVIERAPVCFNYRALDVCGISSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 125436 - protein, 67 aa, Glycine max
  Coding DNA Sequence Number=SeqID_33751
MHIVVVRQGQDHLELPSGVRTKCGRQKPIKVLRADASWGWGHDRPICCPFSARNKQRNVAARQPRIL

SEQ ID NO: 125437 - protein, 245 aa, Glycine max
  Coding DNA Sequence Number=SeqID_33752
  Gene Ontology: Mol. function=receptor activity; Cellular component =outer membrane-bounded periplasmic space; Biological process=amino acid transport
  Homolog annotation: Hit_ID=Q6D596; Match level="QueryCoverage=88%, HitCoverage=51%, E-value=1e-115, Identity=92%"; Hit description =Putative substrate-binding periplasmic transport protein
GARRPAGDPGGAVSDERRWRQRQRFFLLGTDYVYPRTTNKILRAFLHSKGVQDKDIEEVYTPFGYSDYQTIVSNIKKFSAGGKTAVISTINGDSNVPFYKELANQGIKATDIPVIAFSVGEEELRGIDTKPLVGQLAAWNYFESVDNPTNAKFVADYRAYAKAHNLPNASTVVTNDPMEATYVGLHMWAQAVEKAGTTDVDKVRAAMAGQTFKAPDGFTLTMDKTNHHLHKPVMIGEVEENGQFN

SEQ ID NO: 125438 - protein, 18 aa, Glycine max
  Coding DNA Sequence Number=SeqID_33753
SRDVSEIKRKQAYAIREI

SEQ ID NO: 125439 - protein, 166 aa, Glycine max
  Coding DNA Sequence Number=SeqID_33754
  Gene Ontology: Mol. function=chitin binding; Cellular component =extracellular region; Biological process=chitin metabolic process
  Homolog annotation: Hit_ID=UPI00006A17C9; Match level="QueryCoverage =54%, HitCoverage=98%, E-value=8e-10, Identity=34%"; Hit description =UPI00006A17C9 related cluster
MLLSSNVIYIYVRVVMLVRMIRTRLFAAAQVKSCPGTHSSCVIASPLLVVLAQLALLQYQGGSPGTVKRKLLMWSTLKIRTHSPLKVRACNPLKARMCSPLEVRACSPLMERTCSLLKARACRPLKVRTCSPLMARACSPLKVRACSPTKVRTCSPLMARACSPLK

SEQ ID NO: 125440 - protein, 80 aa, Glycine max
  Coding DNA Sequence Number=SeqID_33755
MSQPILRREGDARAHGCVFHGRKMREVVTNVYLRKTSKKPERCGLRTLSVKGLRVVFTHGEGCFSCSYVFLNCDKEIKPT

SEQ ID NO: 125441 - protein, 54 aa, Glycine max
  Coding DNA Sequence Number=SeqID_33756
MAEINQGTDASGARVTTDRSLPLPGAKQAENVAAGQPSILCVRSFFYYCLFLNK

SEQ ID NO: 125442 - protein, 111 aa, Glycine max
  Coding DNA Sequence Number=SeqID_33757
  Gene Ontology: Biological process=transposition, DNA-mediated
  Homolog annotation: Hit_ID=Q1J7G7; Match level="QueryCoverage=32%, HitCoverage=51%, E-value=4e-09, Identity=77%"; Hit description =Transposase
  Subcellular localization annotation: CTP_CleavageSite=73; ConfidenceScore=5.71e-01
VLQWLLFLSAVPPVQLLTGWCVTAKSTPRTSALASVAVPLRVTTTPAALNAPLQGASHSPFRLRNCWEGRSVRASSLLRQLAKGGCAARRLSWVTPGFSQSRRCKTTASEL

SEQ ID NO: 125443 - protein, 106 aa, Glycine max
  Coding DNA Sequence Number=SeqID_33758
STLEDPTSGGAPWCLPTWMAKSYLHPDFRSVVSLVMIFQRNEHGFEAFSPHGQDHLGLPSGVETKHERQKPIKVLKDERKRGWGHDRPIVALLCAKQAGNVAARQP

SEQ ID NO: 125444 - protein, 16 aa, Glycine max
  Coding DNA Sequence Number=SeqID_33759
MASRSTKGRASTDLLI

SEQ ID NO: 125445 - protein, 277 aa, Glycine max
  Coding DNA Sequence Number=SeqID_33760
  Gene Ontology: Mol. function=oxidoreductase activity; Cellular component=cytosol; Biological process=metabolic process
  Homolog annotation: Hit_ID=Q7CRZ2; Match level="QueryCoverage=98%, HitCoverage=74%, E-value=1e-142, Identity=90%"; Hit description =Dehydrogenase
  Pfam annotation: Domain name=GFO_IDH_MocA; Domain location=4-121; Score=77.0; E_value=6.2e-20; Accession=PF01408.13; Description =Oxidoreductase family, NAD-binding Rossmann fold
  Pfam annotation: Domain name=NAD_binding_3; Domain location=10-120; Score=0.6; E_value=0.0068; Accession=PF03447.7; Description =Homoserine dehydrogenase, NAD binding domain
  Pfam annotation: Domain name=Semialdhyde_dh; Domain location=5-109; Score=-25.8; E_value=0.08; Accession=PF01118.15; Description =Semialdehyde dehydrogenase, NAD binding domain
  Pfam module annotation: Pfam domain module=GFO_IDH_MocA::NAD_binding _3::Semialdhyde_dh; Domain location=4-121::10-120::5-109
MNKVGIGIIGCGNISSAYLKAMASFPILDIRGLADMNEQAAKARADEFGLQAKSIDALLADPSVEIIVNLTIPKAHVEVGLRALDAGKHAYSEKPLGINFAEGKRLADAAKAKSLRIGSAPDTFLGGGHQTARRLIDEGVLGQPVGGTATFMCPGHERWHPNPAFYYEVGGGPMLDMGPYYITDLVNLFGPVARVAGFAIAPRNERLITSEPKNGKKIPVHVTTHVSGVLAFENGAVVQVGMSFDVAGHKHVPLELYGTEGTLICPDPNHFGGKCNC

SEQ ID NO: 125446 - protein, 75 aa, Glycine max
  Coding DNA Sequence Number=SeqID_33761
MDGPSGTSTLVFRGLHVLANVGLHALTFRGLHVLAFRGLHVLTIRGLHALTSRGLHVLALRGLHALTLGTSYPHR

SEQ ID NO: 125447 - protein, 111 aa, Glycine max
  Coding DNA Sequence Number=SeqID_33762
MQPVHDDIMQMRKRKGNKEMYTAWQYHTAKANMTFRGIIPFDKHIAAVGTTSNNMLSKRKTLDGGSLLTSKSETQHDHRFTSTPYVPTDPGIGPLFNSLFVKKDIGVVCIK

SEQ ID NO: 125448 - protein, 36 aa, Glycine max
  Coding DNA Sequence Number=SeqID_33763
MYIVVVLKDECKWGWGHDRPIVALLCAKQAKNVAAR

SEQ ID NO: 125449 - protein, 93 aa, Glycine max
  Coding DNA Sequence Number=SeqID_33764
WHEHRGIRETLFDLLEGLLAVTVVATYPSAGGRRVTRGMRVPRKEYARSRHQRLFEENVGKTGKDAIYELFSERVFPFAPTYSSICDEEIRPT

SEQ ID NO: 125450 - protein, 51 aa, Glycine max
  Coding DNA Sequence Number=SeqID_33765
TSKLHYVIWVPWLKEGKFKENLKVLKFNKCEFLTEIHDVSDLPNLEELSFD

SEQ ID NO: 125451 - protein, 89 aa, Glycine max
  Coding DNA Sequence Number=SeqID_33766
  Subcellular localization annotation: CTP_CleavageSite=39; ConfidenceScore=5.33e-01
MKREMLDSTGNDGSTTPNHKLFTTVLYYTVTTRPRLPCSSSSRVKGVAKFVGEVFLDLYDLSEGATRYEWLLKEEAQSKQRKASFFPRH

SEQ ID NO: 125452 - protein, 93 aa, Glycine max
  Coding DNA Sequence Number=SeqID_33767
GGSWYLDSGCSNHMAKDETIFKSIDELSKSKFDWEMEVWLNQKAKALSWWRQIKDVSLVSNTDFLSHKRSMESERSIGADTYGRLWTNEDAIT

SEQ ID NO: 125453 - protein, 121 aa, Glycine max
  Coding DNA Sequence Number=SeqID_33768
MEAMKEQMATMMEAMMSIKKIMEVNTAAVATVSAVSRVDPTPPSGLNLINRPTSDTGGPHFVQTHEISHHNLADFEPRLGYATEGQVFGDIPLQNTLEGPQYHPQPHPLHSTAGKNPPPMA

SEQ ID NO: 125454 - protein, 25 aa, Glycine max
  Coding DNA Sequence Number=SeqID_33769
MGVKYLEVVKQRLHANTKRSPDEIR

SEQ ID NO: 125455 - protein, 187 aa, Glycine max
  Coding DNA Sequence Number=SeqID_33770
  Homolog annotation: Hit_ID=Q84VH5; Match level="QueryCoverage=100%, HitCoverage=28%, E-value=1e-71, Identity=74%"; Hit description =Envelope-like protein
  Subcellular localization annotation: CTP_CleavageSite=17; ConfidenceScore=5.15e-01
MATSPKETSAPGSPSVPSSTKAPSNQERPEFNIQPIQMIPGSAPVPEKLVPERQQGVKISENPSLATSPREVDTEMDKKIRSIVSNILKNASVPDADEDVPTSSTPDVAVPDAEKDVPTSSTPSKEESTEEDDQATEETPAPRAPEPAPSDLIDLEEVESDEEPIANKLAPGIAERLQSRKGKTPIK

SEQ ID NO: 125456 - protein, 67 aa, Glycine max
  Coding DNA Sequence Number=SeqID_33771
MEVWKPIGSSQHTSNERPFCYKNLKAMKLLRWLAPCFLTQILQGMAPILLSNFLYSNSQIRKQRDKQ

SEQ ID NO: 125457 - protein, 28 aa, Glycine max
  Coding DNA Sequence Number=SeqID_33772
MRKLIKVKWWQDRNIEMAINEATGLQMR

SEQ ID NO: 125458 - protein, 84 aa, Glycine max
  Coding DNA Sequence Number=SeqID_33773
MWSMHLTDTCKALLCPLPSAGISSLRSEIVIGSDIIDEPSKSFYRDILGHMGIGQTLLTTPDEARVHEYSTARPCRVLLSYSIT

SEQ ID NO: 125459 - protein, 129 aa, Glycine max
  Coding DNA Sequence Number=SeqID_33774
MLQVDSRGSPEGDEERETPIRDCQEKIKNRYIHSDKIVVEGKAFIDLGASINLMPFSMCRRLGEIEIMPTRMCGSKASKLILMMLKTQVKNQDSSKFQESKSHSIKNQDSSEDSREDSRYARTSRKASR

SEQ ID NO: 125460 - protein, 70 aa, Glycine max
  Coding DNA Sequence Number=SeqID_33775
MALVTVHFEHFEYSVAGDSEHSDFEHSTTNFHTENMAQPPPREKTLREMVAPDFTYESLCIQYPDEDVPY

SEQ ID NO: 125461 - protein, 201 aa, Glycine max
  Coding DNA Sequence Number=SeqID_33776
  Homolog annotation: Hit_ID=A5C4I3; Match level="QueryCoverage=23%, HitCoverage=19%, E-value=3e-14, Identity=81%"; Hit description =Putative uncharacterized protein
MAARALGVPRHLRAPGVGLWAPHSARLETRTKESDMCASQRASKPVRRKEADWWDPPGERLIEPSSSWFPPKFPSDSWSRGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGSSKYSNENFEGRRGERFHVNGTCTW

SEQ ID NO: 125462 - protein, 236 aa, Glycine max
  Coding DNA Sequence Number=SeqID_33777
MEDYISWELGYSISARSLGDDIVLITGLSADKAQQLINSETNGGNTLFYSLERWRPGYRVSNRIVWLQVWGFPIEAWEVDHMKQVVSTIGDVIEVDEDTEDRRRLDRARLLVRTPLPPAIIKETIVRCGEEDHRVWLVEEVGDGGDMRRTRLSMSGEWTDEVTSEEEGVAEEDDDGDTAFSYSPELSVTNNNFFLNHQSKVLPSGPCGQTRDRGDAGKSFPSGHNIGTRVRRASKV

SEQ ID NO: 125463 - protein, 81 aa, Glycine max
  Coding DNA Sequence Number=SeqID_33778
MATKDDDKGDDKKLKGQSKDEFKMFKKESRTRMSSRCSRRNQEQFKIKTQEEKLKNISRFKKTDEFKNQDQDSRFKNQEKT

SEQ ID NO: 125464 - protein, 46 aa, Glycine max
  Coding DNA Sequence Number=SeqID_33779
MTKARQKGIPGKEGEEGEACHPARLGELGCFLQKAPPSRELPGRPK

SEQ ID NO: 125465 - protein, 252 aa, Glycine max
  Coding DNA Sequence Number=SeqID_33780
  Homolog annotation: Hit_ID=Q2HW90; Match level="QueryCoverage=74%, HitCoverage=44%, E-value=2e-13, Identity=26%"; Hit description =Putative uncharacterized protein
MGSSQTPSLKKRFYQVKVKSLGITSLKELGQLMGQLQRQAFYKTYGKIWDLAMVEVSTEASLAQYYDQLLRCFTFGDFQLSPMVEEFEEILGCPLGGRRPYLFSGFYPSLARISKIVQISAQELDHRRQVENGVVGILRKYLEAKARIFAAIDTFLAYHNHKESLVVAMLADLYDTFDRRCEKRSKRILYCTPALYVWLVSHLFRQEVRHACPLESHRSCTEKGRANWDQLLANREGASVNWFPRWKEGRTG

SEQ ID NO: 125466 - protein, 80 aa, Glycine max
  Coding DNA Sequence Number=SeqID_33781
CFKGYLDVSAFEGSLSEPILLSETREGTNDSLGKLAACWAHTSVTDPLLGFPNMLSELHVSLSGCHSLSAYASLSETSTA

SEQ ID NO: 125467 - protein, 202 aa, Glycine max
  Coding DNA Sequence Number=SeqID_33782
MEAMKEQMATMMEAMMSVKKIMEANAVAIAATSVVAKVNPTSPSGINQMNHPTSDMVGKDLGSTGGPHDVQIQNEHVFPSYGLPLNYMPPNVAYTPTDFEPCLGYATEGQAVGGIPLQNPLEGPQYHPQLHLLHPTTSKKPYAMAEMGKLDHLEERLRAIEGGEDYAFANLEELFLVPNIITLQVQVPDFDKYKGLLAPRTI

SEQ ID NO: 125468 - protein, 61 aa, Glycine max
  Coding DNA Sequence Number=SeqID_33783
MKFYMKLQMKKLQVAYGSSWKSCILTKSICNKLFLKRLYLVHHEKDIGLNFLEEAIHTTEL

SEQ ID NO: 125469 - protein, 161 aa, Glycine max
  Coding DNA Sequence Number=SeqID_33784
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q37953; Match level="QueryCoverage=40%, HitCoverage=64%, E-value=6e-25, Identity=83%"; Hit description=LacZ protein
MEKRLWPRPSHFPVKYLPGIFQEISAPVRKPFPLAAVERPSVASHWHDRFPDWKAGSERNAINSGRHRGGAPIRPIVRSYYNSLAVVLQRRDWENPGVTQLNRLAAHPPFASWRNSEEARTDRPSQQLRSLNGEWDAPCSGALSAAGVVVTRSVTRYTCQR

SEQ ID NO: 125470 - protein, 68 aa, Glycine max
  Coding DNA Sequence Number=SeqID_33785
MADEHQQRVTLEDYSNNSVPQFFTSIARPEVQAHNINYPHSLIHLIQGNLFQGLPNKDPYAHLATLTL

SEQ ID NO: 125471 - protein, 158 aa, Glycine max
  Coding DNA Sequence Number=SeqID_33786
MIYAIKNVRIPKYLDLEWFSQQGFKFPNLLEAQGLSKLVQMKKTFYLELVKVFYSCAHADLEGNLFSIVNRVDMVIDAVVWKEVVSLDMGGVCKFDENLDGYSMMQTYRGMLLDLARNLRNHLGVGGLTVEDRMLVYLITYILTSRLSNHAQETNDGL

SEQ ID NO: 125472 - protein, 230 aa, Glycine max
  Coding DNA Sequence Number=SeqID_33787
  Homolog annotation: Hit_ID=Q84VH5; Match level="QueryCoverage=75%, HitCoverage=29%, E-value=3e-75, Identity=75%"; Hit description =Envelope-like protein
MVDIDVSEHQIAKEITAKRVQHWPKKGKLSAGKLSVKYAILHRIGAANWVPTNHTSTVATESFAVKLPIAFPTVLCGIMLSQHPNILNNIDSVMKRESPLSLHYKLFEGTHVPDIVSTSGKAAASGAVSKDALIAELKDTCKVLEATIKATTEKKMELERLIKRLSDSGIDDGEAAEAEEEAAEEEEEAAEKKKMQQRIQNQMMMILRPPMTIRPLFCLLLLLAIGSMSL

SEQ ID NO: 125473 - protein, 119 aa, Glycine max
  Coding DNA Sequence Number=SeqID_33788
MCKKEHESFKECAQRWRDLAAQEKMMGYMPSSFVDLVFAGEKIQVGLRRGKFDCPALMNRKPEANGENKEGGTHVVTVIFYMAKFPTSSTISILSQYHPLLITHHPINQEHPIIHKGHP

SEQ ID NO: 125474 - protein, 142 aa, Glycine max
  Coding DNA Sequence Number=SeqID_33789
  Homolog annotation: Hit_ID=A5AZY3; Match level="QueryCoverage=92%, HitCoverage=18%, E-value=6e-13, Identity=35%"; Hit description =Putative uncharacterized protein
MKNWETILELQTRFTHIVNYLLGQGKTCEDEELNIKILNCLTRTSEPKLKVIKESKNLATMAMEAFFAKLLAYEHEQIHQSYIEETEKKRKGIALKFNSLKEEYRDSSSSEEDAENFNLMARKFGKFLRNPRIENSPNHPED

SEQ ID NO: 125475 - protein, 45 aa, Glycine max
  Coding DNA Sequence Number=SeqID_33790
MEEELQDVRGANLKYCFMVTLAPAARTRLGCSGRPMAAELIKHWA

SEQ ID NO: 125476 - protein, 147 aa, Glycine max
  Coding DNA Sequence Number=SeqID_33791
MSKSCGFGMTGPLDESISCFLIRVDPWVLVPITFRGLHVLALRGLHVLAIRGLHVLAIRGLHALTCRGLPVLALRRLHALTLGTSYPHQGLHALTIRGLLALAFKGLHVLALGTSYPHRSEDPTSSFHHRRLLRPPVRRRVKHHSSL

SEQ ID NO: 125477 - protein, 250 aa, Glycine max
  Coding DNA Sequence Number=SeqID_33792
MQQPGAIEQPEAYAANIYNRPPQPQQQNQPQQSNYDLSNNKYNPGWRNHPNLRCSSTQQQQQQPAPSFQNAAGPSRPYIPPPIQQQQQPQKQPTVEAPPQPSLEELVRQMTMQNMQFQQETRASIQSLTNQMGQLATQLNQQQSQNSDKLPSQAVQNPKNVSAISLRSGKQCQGPQPVAPSSSANEPAKLHSILEKGDDKNLPNNFCAEASHPSSSIPSRAVSNKKMKEAEKEILETFRKVEVLCSQLMW

SEQ ID NO: 125478 - protein, 140 aa, Glycine max
  Coding DNA Sequence Number=SeqID_33793
  Gene Ontology: Mol. function=nucleoside-triphosphatase activity; Cellular component=chloroplast
  Homolog annotation: Hit_ID=Q2PMM5; Match level="QueryCoverage=85%, HitCoverage=6%, E-value=5e-50, Identity=74%"; Hit description =Protein ycf2
MANSSDSIVSSTMESDKYPTSELNSFWLKNLFLVALEQLGDSLEEIRSFAFGGNMLWGGGPTYGVKSIRSKKKYLNLIDLISIIPNPINRIAFSRNTRHLSHPKSWVLNSNSIDDKEENSWFSFLPYDRKRIDQFYESDS

SEQ ID NO: 125479 - protein, 108 aa, Glycine max
  Coding DNA Sequence Number=SeqID_33794
MVGYTPSSFADLVFASEMIEVGLKRGKSDHHALIHAKKTGASEEGENEGETHVVTAIPIQPSFPLTQQCHYSANNKPSPYPPPSYPQRPSLNQPQSLSTTLPMTNTHL

SEQ ID NO: 125480 - protein, 170 aa, Glycine max
  Coding DNA Sequence Number=SeqID_33795
  Homolog annotation: Hit_ID=A5C4I3; Match level="QueryCoverage=40%, HitCoverage=28%, E-value=1e-14, Identity=61%"; Hit description =Putative uncharacterized protein
MAARALGVPRHLRAPGVGLWAPHSARLETRTKESDMCASQRASKPVRRKEADWWDPPGSSESIPCRDPKDGELCLSGAKPEETLVEARSDTDVQIVRLTWVGRCGCSVEPRHGIESSKWAIFGKQNWRCGMNRKLGYGAQLRANLDPTKGVGRLRQQDGGHGSRNPLRSV

SEQ ID NO: 125481 - protein, 136 aa, Glycine max
  Coding DNA Sequence Number=SeqID_33796
  Pfam annotation: Domain name=Ins_element1; Domain location=33-96; Score=-26.7; E_value=0.055; Accession=PF03811.4; Description =Insertion element protein
IYSAQSASGDAAQLTDLVYDGVFEVLQWLLFLISCPSCSATDGVVRNGKSTARTSALASVAAAQLLGRAIGAGLFAITPAGERGMCCKAIKLGNARVFPGGLRIGALAECILAYYVGTDEGVSEVLSCGRRKKAAP

SEQ ID NO: 125482 - protein, 94 aa, Glycine max
  Coding DNA Sequence Number=SeqID_33797
TSFGYRKDQNGQWLKKDALPPQDERTPSPPPQRDDSALMTEVLSELWGLHSYVGERFDSLDTHFAGMDLRLTQLEEDVGYIRQSFDLPPPPPPS

SEQ ID NO: 125483 - protein, 90 aa, Glycine max
  Coding DNA Sequence Number=SeqID_33798
MCNRLHHNGNRLPVIGFEKLPRVTTFKVTGFEKIAKSHNFFKVTGTNVPCDEDMTKSKGKDPLEGLGGPMTRARARKAKESLQQVLSILF

SEQ ID NO: 125484 - protein, 121 aa, Glycine max
  Coding DNA Sequence Number=SeqID_33799
MVAITLAKVHQPPFLREYDSNTTCACHGEAPGRSIEHCRALKCSVATYPSAGGRRETRGMRVPRKEYARSRHQRLFEENVGKTGKDAIYELFSERFGSCIYARGRSTKGVSLCSYVFLNLG

SEQ ID NO: 125485 - protein, 270 aa, Glycine max
  Coding DNA Sequence Number=SeqID_33800
  Homolog annotation: Hit_ID=A5B5V0; Match level="QueryCoverage=84%, HitCoverage=50%, E-value=5e-11, Identity=25%"; Hit description =Putative uncharacterized protein
MEFFSNENFECFQAFENSNLIPFMSLKLPVYSELVKAFYSNLEIHEGTLMSEVYGIKMVIDQSLFYDLTKLPSEGVPFEGALIDDWKFDFSVHDARRLVCTNQSDMIGRLLAGSLAFESHILHYLIVRILLPRSSNLAQVSEEDLIVMWAFHKGLQIDWAHLVRYRMHKALRLNALLPYPHLITLFLQHFNIPLDSEPYVPIKRSFLIGASVIASFGYIKEHDGSWILERVDGLQTFVGERFDTLELQVDMRFIEMESRLTKVEEEVSYI

SEQ ID NO: 125486 - protein, 31 aa, Glycine max
  Coding DNA Sequence Number=SeqID_33801
MALGKSINGTGKQQRLERKLRNMEAMEQMRS

SEQ ID NO: 125487 - protein, 62 aa, Glycine max
  Coding DNA Sequence Number=SeqID_33802
MPISPSKIIGWSVPSRHRGRARKTPYGPKEVQQGLGVASSDYEPLSVLRSACRPQHDHQAPY

SEQ ID NO: 125488 - protein, 335 aa, Glycine max
  Coding DNA Sequence Number=SeqID_33803
  Gene Ontology: Mol. function=C4-dicarboxylate transmembrane transporter activity; Cellular component=integral to membrane; Biological process=C4-dicarboxylate transport
  Homolog annotation: Hit_ID=A4W5N3; Match level="QueryCoverage=88%, HitCoverage=68%, E-value=1e-122, Identity=73%"; Hit description =Anaerobic c4-dicarboxylate antiporter, Dcu family
  Pfam annotation: Domain name=DcuA_DcuB; Domain location=5-335; Score =615.1; E_value=6.4e-182; Accession=PF03605.5; Description=Anaerobic c4-dicarboxylate membrane t
MVVVELLIVLLAIWLGARLGGIGIGFAGGLGVLVLTLVCGMKPGAIPFDVIEIIMAVIAAIAAMQVAGGMDYLVGLAERLLRRHPRYVTFLAPLVTYAMTLLAGTGHTAFSTLPVIAEVAKEQGVRPSRPLSIAVVASQIAITASPLSAAVVFFASILEPRGVSYLALLGVALPATMLAIFCAAVITNFLGKELKEDDVYQARLAKGEVTLRGEQVYHIKPGARRAVLLFLIGIGAVVLYATAISDSVGLISNPVLPRNEAIVVFMLTVATLICLTCKVETGEILSASTFKSGMSACICVMGVAWLGDTFVKAHLSDIQTLAGDMLQSYPWMLAL

SEQ ID NO: 125489 - protein, 79 aa, Glycine max
  Coding DNA Sequence Number=SeqID_33804
MSDNLARASSAREYQIELQQVGINTATSPMLNEIAFIFQSFRAKKFERGSLPCHSEGRSSQKFDALASLDSHSGTAGID

SEQ ID NO: 125490 - protein, 163 aa, Glycine max
  Coding DNA Sequence Number=SeqID_33805
MTDLVSAEDDINFCVSTGLSAAVDEGRRRRRLSPRAIRLFFLQTAKKNVYTDNHSGISARQHDSNVSMTDLVSAEDDVNLQVSTGLSAAIDEGRRRRRLSPRAIRLFVLQTTKKNVYTDNHSGISDRQRDSNVSMTDLVSAEDDVNLRVQTGLSAAIDEGRRR

SEQ ID NO: 125491 - protein, 240 aa, Glycine max
  Coding DNA Sequence Number=SeqID_33806
GAPVEESMSPFLVRDFGAQNFKAIQRIHKAWETPLRKDHELRGIRNDIIGGYHEWLKVHIRGLDWLAKLKVVSEDSFEAPEEDEEVQALKNELGKAKLAKEKFKLAATHIRKECAGLREENATTAKALEQETKRARKEEYGRNKFRGALWGSNSELKLRREERDQSRAHSMVLKEELVACSRLEKGDRLFTPRGTMWMDRFALTLNESQELPRLLAKAKAMADTYSAPKKFMGFSAIVSI

SEQ ID NO: 125492 - protein, 49 aa, Glycine max
  Coding DNA Sequence Number=SeqID_33807
MGESSTVLDLKPHEGGEVAFGGIGKGKISDIGKIGIPSLASINNVLYVE

SEQ ID NO: 125493 - protein, 140 aa, Glycine max
  Coding DNA Sequence Number=SeqID_33808
GTSFVVQVEGTSTWLVVTENKRGNISCGSVLVEGTSTRLFKENKGGLKRNLKDRQFAWGLDVGTGCCRTRCLMLKGVEAMTSKIILMMPKNQSGVKKLPESSFKESGFKILSSFKNQDSRIIKIKIQDSRFKNQEKTRSR

SEQ ID NO: 125494 - protein, 198 aa, Glycine max
  Coding DNA Sequence Number=SeqID_33809
  Homolog annotation: Hit_ID=UPI00006A2D9E; Match level="QueryCoverage =81%, HitCoverage=86%, E-value=9e-08, Identity=16%"; Hit description =UPI00006A2D9E related cluster
GLPVLTFRGLHVLAFRGLHVLAFRGLHILTFRGLHILAIRGLHALTFCGLHVLVFKWSCTFTFRGLHVLAFRGPHALAFRGLHVLTFRGLHTFSFGYTPSSSEDYTSSLERTTRPRLRRAAHSLAFRGLHVLAFRGLHICTLREFKGANYANTTKEGGYHATTMHTGARFHSCRCKETSADHAHQHGHSYTDMDDVAT

SEQ ID NO: 125495 - protein, 123 aa, Glycine max
  Coding DNA Sequence Number=SeqID_33810
MAILSMKKSAQRVQDFQELPAYNEIPELLWLSIRDAPSSLSIPSTSRGGPEKKRLHRCVSRICDTGIYSASSLTDSLRSVVRLRRAEMAYERGGDFLGDGRKILNREVRGAAAKPFFHRLRLP

SEQ ID NO: 125496 - protein, 247 aa, Glycine max
  Coding DNA Sequence Number=SeqID_33811
  Homolog annotation: Hit_ID=A5ASR8; Match level="QueryCoverage=74%, HitCoverage=39%, E-value=3e-09, Identity=25%"; Hit description =Putative uncharacterized protein
  Subcellular localization annotation: CTP_CleavageSite=41; ConfidenceScore=5.73e-01
MVESSKKRKGSSASASASRAHRSGATSIHSTNSTLIVLFPQCFLSTNSRNAFQNLGLLPFMSLQLPIYPELVKAFYCNLEIQDITLISEVFGIKMVIDQSLFHDLTKLPSDGVPFEGTLDDDWKFDFSAHDARQLVCTNNADMTERLLAGSLAFESRILHYLIVRILLPRSSNLAQVSEEDLIIMWACHAGRQLDWAHLVRYRMHKALRLNAPLPYPQLVTLFLRHFGIPLDSESISNQEIFLMGLL

SEQ ID NO: 125497 - protein, 239 aa, Glycine max
  Coding DNA Sequence Number=SeqID_33812
MTTLTQIWMTLLLSNILPSDHNSDLPLPKCQLVYAILTRMSVHVAQLIADAIYIFAGMAPTRHPLDPDKSNMALGFPTLITGLCQSFGVPVAPTKVIRPPITRAFIEKYCTQRQAQGDAPQAAGTPPPPHQAGQAGSFDMEQPMISVPDEPQHAEPGLRFFFMPYSRPVQDRGCMAQRLARGPSRRGAPRSSRRWRRGPRGRGDADLLDFLEGVEIRDWEIPDSCFLSYFFVIFIYVIV

SEQ ID NO: 125498 - protein, 119 aa, Glycine max
  Coding DNA Sequence Number=SeqID_33813
MRIPFLQAKVQKGPRLCFNGVFYRGNPILISGVKQIWVTRCRSRAELPHYSIRHTHDNDDLKTTCKISHGYNQVGPQASRLWHCDTTVGNLHGQTQRFPIMFFHQFNEFIHPYLGSFRK

SEQ ID NO: 125499 - protein, 117 aa, Glycine max
  Coding DNA Sequence Number=SeqID_33814
MVMGDFISRLSFPENTLVSSRDGGPDDTRRYLTVIRTLLSSRGGGPDDKQDQVWSFCTLVSSRGGGPDDTRRYLTVIRTLLSSRGGGPDDTRKYPSGYPYKHSFAICKTERLIACRD

SEQ ID NO: 125500 - protein, 221 aa, Glycine max
  Coding DNA Sequence Number=SeqID_33815
  Homolog annotation: Hit_ID=A0ST23; Match level="QueryCoverage=12%, HitCoverage=55%, E-value=4e-08, Identity=100%"; Hit description =Putative reverse transcriptase
LELLRADQRLISPKVGPGLPGINRDTRIYLFCEVIFRHSCPPVQLLTGWCVTAKAPPDISAGKCSGRVPFAIQAAQLLGRAIGAGLFAITPAGERGMCCKAIKLGNARVFPVTTLNSIFLGGAIGNVGVYGTSLFSLLRHIVFWFFVTGPVHVIKLIDTVDLEGGPVGKPVVPAALMNRPTRGERRFAYWALAECILAYYVGTDEGVSESASCGRRKKAAP

SEQ ID NO: 125501 - protein, 105 aa, Glycine max
  Coding DNA Sequence Number=SeqID_33816
MVFVLDGAHVHTSYVVYVHGGFLVRRTTCTRGCVTQFGNSLVAQADHHGRGELRCTTGWPRHDMNGSGMEKEEREETPLQGEDESRRSSPPKEAMDKSMEEEGDE

SEQ ID NO: 125502 - protein, 113 aa, Glycine max
  Coding DNA Sequence Number=SeqID_33817
GLSFEHFCIREREESNQFSDCVVLNSLTREKGDRKEFGRLVPCSFGKGRRETQKEFKRLVLGEFFLAKGEGNEKMNSTSFQGLENQKNFGKLLAKGRRRRSSKRFKACKGLYE

SEQ ID NO: 125503 - protein, 67 aa, Glycine max
  Coding DNA Sequence Number=SeqID_33818
MSAFEKMCFADIFAQRTKLYKWAIGGTYSMVTSHYSLGFLGEILHHTLTQVGYCKRVQKGLGCPDRS

SEQ ID NO: 125504 - protein, 77 aa, Glycine max
  Coding DNA Sequence Number=SeqID_33819
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=29%, E-value=6e-11, Identity=100%"; Hit description=LacZ protein
MAHVLGEAHPPFASWRNSEEARTDRPSQQLRSLNGEWDAPCSGALSAAGVVVTRSVTATLASADVRRCFCRYAPPRQ

SEQ ID NO: 125505 - protein, 141 aa, Glycine max
  Coding DNA Sequence Number=SeqID_33820
  Homolog annotation: Hit_ID=Q6WAY4; Match level="QueryCoverage=31%, HitCoverage=8%, E-value=8e-07, Identity=53%"; Hit description =Putative uncharacterized protein
IGGRTINWFSRWKEGKEGVLFSCGDYPNIPLIGTRGCINYYPALAIRQLGKDKGLRGIHNGIIGGYHEWLKVRTRGLDWLSKLKIINEENFKAPEEDEELREENAATARALEQETKRACKEEHGQDTPRGALWDSNNELKL

SEQ ID NO: 125506 - protein, 223 aa, Glycine max
  Coding DNA Sequence Number=SeqID_33821
  Homolog annotation: Hit_ID=Q2AA09; Match level="QueryCoverage=62%, HitCoverage=50%, E-value=4e-07, Identity=31%"; Hit description =Retrotransposon gag protein
MIDAASGGALGDMTPAEARNLIEKMASNSQQFSARNDAIVIRGVHEVATNSAASSETKKLEGKLDALVNLVTQLTLNQKSVPVARQPGAIEQPEAYAANIYNRPPQPQQQNQPQQNNYDLSSNRYNPGWRNHPNLRWSSPQQQQQQLAPSFQNAGWPKQTIHSSTNPTTATTQKQPTVEAPPQPSLEELVRQMTMAKHAVSTRDSRDACSTKGIRAESPPTFI

SEQ ID NO: 125507 - protein, 88 aa, Glycine max
  Coding DNA Sequence Number=SeqID_33822
MTHDQELFRELDKAHVSKVRICNGDLIIVEEKEVVAIESCATIEEQCTILLDHYAMNALNNVDSAMKRTLSMYSKEMDQWLSSSKALK

SEQ ID NO: 125508 - protein, 85 aa, Glycine max
  Coding DNA Sequence Number=SeqID_33823
MFLRTGDRGLIFAFVERWHKETNSFHLSVESQTGSYAWGATALVHMYENLNDALKRSARQLAGYITLLQWLDLRTFSYCCFFYCC

SEQ ID NO: 125509 - protein, 166 aa, Glycine max
  Coding DNA Sequence Number=SeqID_33824
MTSRDQVWSFCTHDTRRYLMVIRTLLSSRGGGPDDKQRPKTKFGHSAPLYHPEAAGPMIRGDTLRLFAPFCHPEAAGPMTSRDQVWSFCTLVSSRGGGPDDTRKYPSEADIVFCTFCSSGNNNSFTCGNFMVARDSRQPRGAKLVSYANFRGPLLDDMRPFFGPCE

SEQ ID NO: 125510 - protein, 177 aa, Glycine max
  Coding DNA Sequence Number=SeqID_33825
MAEPSKKRKGSSSRSQQHFETQETQIPSSISSSSLFSFEEQWIRNTNLFFSRSIIDPKFIDMDFFSNESLECIQAFENSNLIPFMSLKLLVYSDLVKAFYSNLEIQEGTLISEVYGIKMVIQSLFYDLTQLSSEGVPFEGTLIDDWKYEFSVHDVRRLVCTNQADMTGRLIAGSLAF

SEQ ID NO: 125511 - protein, 211 aa, Glycine max
  Coding DNA Sequence Number=SeqID_33826
  Homolog annotation: Hit_ID=UPI00006A2939; Match level="QueryCoverage =81%, HitCoverage=89%, E-value=3e-07, Identity=27%"; Hit description =UPI00006A2939 related cluster
HVLANVGLHALTFRGLHVLANRGLHALTFRGLHILAFRGLHVLTLRGLHVLALRGLHVLALRGLHVLALRGLHVLTIRGLHALTSRGLHVLALRGLPALALGLHALTFRGLHILAFRGLHVLTLRGLNVLALRGLHVLTIRGLHALTSRGLHVLALRGLHVLTIRGLHALTSRGLHVLALRGLLALALGTSYPHLQRTTCPHLRRATRPHL

SEQ ID NO: 125512 - protein, 124 aa, Glycine max
  Coding DNA Sequence Number=SeqID_33827
MKREKHASYSSHNSCKSLSEELRDYYEGRHRSHLRPHSHRREKERKPQEANIKLSYFHGKDNVEANLDWEIRKSNPVATYPAAEGQRVTHGGVFHERNTRGFATNVYSRKTSEKLEKTWSTNFK

SEQ ID NO: 125513 - protein, 140 aa, Glycine max
  Coding DNA Sequence Number=SeqID_33828
  Subcellular localization annotation: CTP_CleavageSite=31; ConfidenceScore=5.11e-01
MVEPSKKRKGSSSRSQRHSKAQDTPIPSSISSSSLFSSEEQHIRYRNLFSSHSIIDPKFIDMDFFSDESFECIQAFQNSNLIPFMSLKLPVYSELVKAFYSNLEIQESTLISEVYGIKMVIDQSLFYDLTQLSSDGVPFE

SEQ ID NO: 125514 - protein, 228 aa, Glycine max
  Coding DNA Sequence Number=SeqID_33829
MTGPLDESISCFLIRVDLWVLVLITFRGLHALTFKGLHVLTFRGLHVLAFRGLYTLSFSGLDALAFKGGCAHKTPNGPEKSNKALGFPVLVMGLCRSYRVPVSPQQGIVPARHPVDPKKANKDLELPALITGLCQFYGVPVAPSKKYCAPRQAQGATPQQLRDGRQRAIDALPPPPKNLSSSTKKLVRCLRPMADQQATKYKAKDKKSTRSVTDKSSSVQLKTLKKRY

SEQ ID NO: 125515 - protein, 79 aa, Glycine max
  Coding DNA Sequence Number=SeqID_33830
MYPLLFSVTTTQVDVPSTCTTKDVPSNVLRQRKGKNQKILRLCHFEFFDKGERRHKRIQAVSPSFFWKGEERHKNNSRP

SEQ ID NO: 125516 - protein, 74 aa, Glycine max
  Coding DNA Sequence Number=SeqID_33831
  Pfam annotation: Domain name=G-patch; Domain location=1-42; Score =27.1; E_value=6.5e-05; Accession=PF01585.14; Description=G-patch domain
MVARVMLKHGYEPGMGLGKDSLGNADVVDIRGNPYKYGLGYESGMPGRRNALSRLRADKAWPGHVSQCFTSAGI

SEQ ID NO: 125517 - protein, 112 aa, Glycine max
  Coding DNA Sequence Number=SeqID_33832
MRAQPEEEAIAQLLCIPGQDFAQTAAGRRVWIMCTNTWMMFLLSNILPNDHNFDLPLPKCQLDFAPKTPSGPREVQQGPGVSRSDYGPLSVLRSGRLVGSSGLGIIKMRGLN

SEQ ID NO: 125518 - protein, 122 aa, Glycine max
  Coding DNA Sequence Number=SeqID_33833
  Homolog annotation: Hit_ID=A5BQ91; Match level="QueryCoverage=75%, HitCoverage=13%, E-value=4e-08, Identity=40%"; Hit description =Putative uncharacterized protein
IPKARYGWSDKSFSSLLQVVHDMLLEENTLPKSYYQKFRNALGVKYHGTKSRMMRSVLDEDMTKSKGKDPLEGLGGPMTMARARKAKEALQQVLSILFEYKPKFQGEKSKVVSCIMAQMEED

SEQ ID NO: 125519 - protein, 81 aa, Glycine max
  Coding DNA Sequence Number=SeqID_33834
IEEDADIPLILGRPFMSTASCKVDMGWKILQMGIEDQKINFDLFHEDKDPPCQNVCLKVHVMEEKRPEKKVLEVGTLLDPG

SEQ ID NO: 125520 - protein, 96 aa, Glycine max
  Coding DNA Sequence Number=SeqID_33835
  Homolog annotation: Hit_ID=Q6WAY4; Match level="QueryCoverage=67%, HitCoverage=11%, E-value=3e-08, Identity=47%"; Hit description =Putative uncharacterized protein
MGTNQTGKRFYQVKVKSLDTTSIKELGRLMEPLQMQAFRKTYGKILELTIAEVSIEAIASLTQYYDQPLRCFTFGDFQLVPTIEESHTFPPGVSPL

SEQ ID NO: 125521 - protein, 92 aa, Glycine max
  Coding DNA Sequence Number=SeqID_33836
MQEKALGTKFHALLSLSLHSSSLTFKLLSKASYGGELLLDSSSTLSGISIHLSPFHSAAIRPQEAKESIDEEDPRPTSSTWSYIMWYQSIFI

SEQ ID NO: 125522 - protein, 140 aa, Glycine max
  Coding DNA Sequence Number=SeqID_33837
MASNSQQFSARNDAIVIRGVHEVATNSAASSETKKLEGKLDALVNLVTQLALNQKSVPVARVCGLCSSTDHHTDLCPSMQQPGAIEQPEAYAANIYNRPPQPQQQNQPQQNNYDLSSNRYNPGWRNHPNLRWSSPQQQQQ

SEQ ID NO: 125523 - protein, 123 aa, Glycine max
  Coding DNA Sequence Number=SeqID_33838
MMITKDEDKGDEKKLNDQSKYNSSKSIRIQDSRRKFRVKNQDSRFKISRIKIKIQESREGLIKIRYILCGTSRGYIYLGLTENKRGYISCGSVLVEGTSTRFKENKGGYIPCGSLLVKGFLQG

SEQ ID NO: 125524 - protein, 15 aa, Glycine max
  Coding DNA Sequence Number=SeqID_33839
MASCSWRQSNWRLTY

SEQ ID NO: 125525 - protein, 98 aa, Glycine max
  Coding DNA Sequence Number=SeqID_33840
  Homolog annotation: Hit_ID=A5B1P9; Match level="QueryCoverage=94%, HitCoverage=6%, E-value=1e-14, Identity=44%"; Hit description =Putative uncharacterized protein
MEESLGKFDAKVDEAIFLGYSLESKVVYRVFNRRTLCVEESVHVVCDETNSLIQENALEDEDTGFQDKDIALEDETKVKDLEQNKEITTTPPKDLPKE

SEQ ID NO: 125526 - protein, 119 aa, Glycine max
  Coding DNA Sequence Number=SeqID_33841
MGEVEEVQEKMKADMEAMKEKMATMMEAMIKHEEDNGSQCGCNCRYQHSYTPSENVNNSTPILIESRQPQTDHAHVSQPMGETHEMPHHNLADFEPCLGYATEGQAISGVPLQNPLEGP

SEQ ID NO: 125527 - protein, 86 aa, Glycine max
  Coding DNA Sequence Number=SeqID_33842
  Subcellular localization annotation: CTP_CleavageSite=52; ConfidenceScore=5.27e-01
MASESSADSTKTSTSSDSSSATSKIQYPIHTKPLILQFTAVFRNDMDMIEVSSFYYQQWALEYPEFMNFRYDGITYQIRLRQHQAK

SEQ ID NO: 125528 - protein, 90 aa, Glycine max
  Coding DNA Sequence Number=SeqID_33843
MGEGYFISETVATYPSAGGQRLARGMRVPRKEYARSRHQRLFEENVGKTGKDAIYELLSERFGSCIYARGRVFPFAPTYSSICDEEIRPT

SEQ ID NO: 125529 - protein, 206 aa, Glycine max
  Coding DNA Sequence Number=SeqID_33844
  Homolog annotation: Hit_ID=A7PUB3; Match level="QueryCoverage=36%, HitCoverage=39%, E-value=2e-12, Identity=50%"; Hit description =Chromosome chr7 scaffold_31, whole genome shotgun sequence
MTVKTSDTCSSRRRSQLVCKRMPGADKPVRARQRMRKEKIPHQAPFAIQAAQLLGSAIGAGLFAITPAGERGMCCKAIKLGNARVFPVTTLSTLEDPPSSSSVTSSTSSNRTIVFGVNPSDSKKDPSFFDENGAVNDMEGYLNHLSLEYDSVWDTKPSWSGTELEFVIMVIAVSFGKPVVPAALMNRPTRGERRFAYWALFRFLAH

SEQ ID NO: 125530 - protein, 156 aa, Glycine max
  Coding DNA Sequence Number=SeqID_33845
  Homolog annotation: Hit_ID=A5AK77; Match level="QueryCoverage=63%, HitCoverage=12%, E-value=1e-12, Identity=39%"; Hit description =Putative uncharacterized protein
MTRGNPGDLQPFDPEIDRTFHRLVRHGVHPDHSVHFEHYEYSIASDSAYFDFEHSAVNFHTERTLREMAAPNFTYESLCIQYPDEGVPYVLKTGLIHLLPKFHGLAGEDPHKHLKEFHIVCSTMKPSDVLEDHTFLKAFPHSLEGVAKDWLYYLAP

SEQ ID NO: 125531 - protein, 189 aa, Glycine max
  Coding DNA Sequence Number=SeqID_33846
MTSLAQTWSVLPYSNLIPTSHTSDITLDRAKLIYGIIMKMDMNLGYLISHQISIIAQHDSSRLGFPALIVALCKARGVAPDSKSLESLSPAINLAYIKNNCWNLDDPTVAFRGPRKARGKRSEASPTSVAPDTSAPSSSTLPDPLAPSTSTPHLPQFPVQLPASSAPASDLLFTPEMLHSMMQSLHRGQ

SEQ ID NO: 125532 - protein, 97 aa, Glycine max
  Coding DNA Sequence Number=SeqID_33847
  Subcellular localization annotation: CTP_CleavageSite=46; ConfidenceScore=5.70e-01
MASSSSSVLCQSSHSKSSQNTLELRPFSLYKSLNMQKLREMPKLPSSFLISGLNRWPSHPSSRFFLVLSRKSGVLSGWLAKPIDWLDQDQHFTNLPN

SEQ ID NO: 125533 - protein, 182 aa, Glycine max
  Coding DNA Sequence Number=SeqID_33848
  Homolog annotation: Hit_ID=Q6WAY6; Match level="QueryCoverage=47%, HitCoverage=15%, E-value=2e-13, Identity=44%"; Hit description =Putative uncharacterized protein
MFGSKGENLGKSRRMGPVHGHPGAPDLRSGPLSKSSKEGASVNWFPRWKEGRTGILISCRGFPYVPLMGTRGCINYNPVLAIRQLGYPMRGEPLEEGLTPFIARGFNSTSARVLHRVHKAWEMVQKKDEELRGSSNGPIGGYHRWLRAYAQGLHWLPNLRTTKEVEGEALEDTKRYGPQNRA

SEQ ID NO: 125534 - protein, 55 aa, Glycine max
  Coding DNA Sequence Number=SeqID_33849
LVFWLDDPARVGDPEEVEDDFLVDNSGRASLDPFPVPRPPRKEAPDALGGITVFL

SEQ ID NO: 125535 - protein, 193 aa, Glycine max
  Coding DNA Sequence Number=SeqID_33850
  Gene Ontology: Mol. function=phosphoprotein phosphatase activity; Biological process=intracellular signaling cascade
  Homolog annotation: Hit_ID=A7R8Y3; Match level="QueryCoverage=98%, HitCoverage=62%, E-value=2e-26, Identity=33%"; Hit description =Chromosome undetermined scaffold_3090, whole genome shotgun sequence
MCSATDYKIKSIGGMCILIQLWAWERCTTLAPKRTPSIIENKPLGHRWLRRGNQHIGNDDLIVFRRKLDIMKRHEFLWEPYTATVMSMLPPICLVGKWHQPDRVLRQFGMQQPIPESPSQPWNVHGLTLKGKMDENWFQLLAPFISQWNNRAEFRVDVYARQEGLLSFNSDYMVWYRRKTKMFIDPNNATRLH

SEQ ID NO: 125536 - protein, 96 aa, Glycine max
  Coding DNA Sequence Number=SeqID_33851
  Homolog annotation: Hit_ID=Q51617; Match level="QueryCoverage=36%, HitCoverage=50%, E-value=4e-11, Identity=91%"; Hit description =Putative uncharacterized protein
MTVKTSDTCSSRRRSQLVCKRMPGADKPVRARQRMRKEKIPHQAPFAIQAAQLSGRAIGAGLFAITPAGERGMSCKAIKFGNVRAIPVTTLLNDGQ

SEQ ID NO: 125537 - protein, 194 aa, Glycine max
  Coding DNA Sequence Number=SeqID_33852
  Homolog annotation: Hit_ID=UPI0000ECBAF8; Match level="QueryCoverage =21%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTNMNITKHAIFISPSSHGMQAWHWPSFYNVVTGKTLALPNLIALQHIPLSPAGVIAKRPAPIALPNSCAA

SEQ ID NO: 125538 - protein, 78 aa, Glycine max
  Coding DNA Sequence Number=SeqID_33853
MGIIRHQIPKISDMMNVLSVATLFCKITHAPNIFMIHVLRDSFGVEGRSREYEEPWDLRSNPFQAGGNDAILPRKGIG

SEQ ID NO: 125539 - protein, 87 aa, Glycine max
  Coding DNA Sequence Number=SeqID_33854
MPSWFPTRKLASGGAAGHLRDKHNVTLCGFQTLRSDDESLEGTNTWDPTIDFKQETDQTEDEEDKDVGLPPELEKVVAHEDQEIGPH

SEQ ID NO: 125540 - protein, 51 aa, Glycine max
  Coding DNA Sequence Number=SeqID_33855
MLAIISKYQEELSLATTHEHRLPDEYAQVYAAKEARGRKPLGSLYGRSNLD

SEQ ID NO: 125541 - protein, 140 aa, Glycine max
  Coding DNA Sequence Number=SeqID_33856
  Subcellular localization annotation: CTP_CleavageSite=47; ConfidenceScore=5.52e-01
MPTLPSSPPPPPSTGAALHSPPTLKRTRKASCLRSLATRPVGAERPLVHMDPATDKADGPHNKKLRTYLGIVAHDKAEFDIPEESDVRTKKKILKTVGKRWRQFMSDLTSKWALAKRCAKKGTGYPEAKHCPSRVVSWGL

SEQ ID NO: 125542 - protein, 189 aa, Glycine max
  Coding DNA Sequence Number=SeqID_33857
  Gene Ontology: Cellular component=plasma membrane
  Homolog annotation: Hit_ID=A8XZZ5; Match level="QueryCoverage=95%, HitCoverage=57%, E-value=3e-19, Identity=22%"; Hit description =Putative uncharacterized protein
MRGIVHEPQYPHLRRTTRPHLQRASRPRLHRATCPHLQRTSRPRLHRATCPHLQRASRPRLHRATCPHLQRATRPRHQRAARPNLQRVAHPRLQRVTSPHLQRTSCPRLHRTTRPHLRRTKRPRLERATRPRHQRAACPNLQRVAHPRLQRVTSPHLQRTSRPRLHRATCPHLQRATHPRLRRATCLHL

SEQ ID NO: 125543 - protein, 171 aa, Glycine max
  Coding DNA Sequence Number=SeqID_33858
  Subcellular localization annotation: CTP_CleavageSite=28; ConfidenceScore=5.24e-01
MLILSSVGTLAFTFCKPPTRKNHKLGTNMSHNSSSVNGEGTSHKDPLSRILDELRSLKLCKEKQERKENGKERVEINQDEREQISEEERRKILKELRKENMSLIVKQPPKPKDDKGKTIEKQPLKASMKEKTNSIKRGQDIYSSQDEATTSPSSSESKEAKGEESSEEIYP

SEQ ID NO: 125544 - protein, 94 aa, Glycine max
  Coding DNA Sequence Number=SeqID_33859
MALKRWPQMMHPLHVMVPGLWDLHLPCEEKVGPQARSYRCGRKLSWPRPCLPSPSDRNCQIIKIPTILPNVGQVNDRAQALKSEAVKDNPSGST

SEQ ID NO: 125545 - protein, 231 aa, Glycine max
  Coding DNA Sequence Number=SeqID_33860
  Homolog annotation: Hit_ID=Q6WAY6; Match level="QueryCoverage=84%, HitCoverage=31%, E-value=3e-21, Identity=33%"; Hit description =Putative uncharacterized protein
MASQEKWGPVVLFPNVDGLVDLATIDAFLAYHHSKESPVVAILADLFDTFDRRCEKNSARIVCCLPALCVWLISHLFQQDTRHLCPLQSYRSCAEKGRVDWDQHLAGIGGSAINWFPRWKEGKEGVLFSCGDYPNVPLIGTRGCINYNPALTIRQLGYPMRGAPTEGSLSPFLVKDLGAQGLKVIQRIHKAWRSPSRKDKELRGIRNGIIGGYHGWLRIHMRGLDWLSKLK

SEQ ID NO: 125546 - protein, 134 aa, Glycine max
  Coding DNA Sequence Number=SeqID_33861
  Gene Ontology: Cellular component=mitochondrion
  Homolog annotation: Hit_ID=O47882; Match level="QueryCoverage=48%, HitCoverage=19%, E-value=3e-17, Identity=67%"; Hit description =Putative uncharacterized protein orf1
MTLIEGVNNPAAPLSQAFAQDRPFMDMDIEIPDSNKSIIIGVSLGLAVAILFTFGINPCCGEVILSKDIRYVHDYLKAENLIPSITPFQLSIILQKIENSSYKVGPLEYLTCLDEDMNKLLKDILPDYPDIHIH

SEQ ID NO: 125547 - protein, 98 aa, Glycine max
  Coding DNA Sequence Number=SeqID_33862
MVEGANLDEFGDEVAGDVKGDERLEAADGVAADEDGGDGVAVVVVGKGEGGDLVVVQFDDGCSEIRRWMRASVDSSTSMEREQEEVVVVVVVVVVGVE

SEQ ID NO: 125548 - protein, 336 aa, Glycine max
  Coding DNA Sequence Number=SeqID_33863
MHILLVSVFDTCEERFYALKDVVYDNGTKTAKEFTDLNKWSYFEVFGIVKDLKCDIEVRLWWTNDGPKSIAGYRAINVEGAIGSQTTQGGGSDKGTTEVKVFENDGLVRSESDDSDEANDVYLDDSEDERDLEIIEKLSNSLQVDPTFTKDMDQFDYESEELTNFDGSSVEEERDKNDKFPKFLKEELEINFKFQLRMEFSMLAEFKDAIRSCPFKALVSQVDDTTTFKMKTFYRKHTCGRVFNNKTTNSKWMAKKVAKKAKKMVEDEIEGDATKQYSLLWRYNQNPNFQHYPTAFVVVETETKDSWRWFLTCMLEDIGIEKKGLANVCQEMFDNV

SEQ ID NO: 125549 - protein, 120 aa, Glycine max
  Coding DNA Sequence Number=SeqID_33864
MAPKRSEVVVIPGINFEEEAKNVFPLGSFIPRRRVNFQTLEEEGFPIKGLFDRVVWTNILKNFSLMHYGPYALLWGTARQNRASIRGTIRGKEVVISSSTIGVVSGCAKEESLMKTGRRK

SEQ ID NO: 125550 - protein, 455 aa, Glycine max
  Coding DNA Sequence Number=SeqID_33865
  Gene Ontology: Mol. function=ATP binding; Cellular component =cytoplasm; Biological process=septin ring assembly
  Homolog annotation: Hit_ID=Q8GUW6; Match level="QueryCoverage=84%, HitCoverage=90%, E-value=1e-118, Identity=77%"; Hit description =Nucleotide binding protein
  Pfam annotation: Domain name=ArsA_ATPase; Domain location=129-372; Score=-157.4; E_value=0.0059; Accession=PF02374.6; Description=Anion- transporting ATPase
  Pfam annotation: Domain name=CbiA; Domain location=131-347; Score =37.0; E_value=2.1e-08; Accession=PF01656.14; Description=Cobyrinic acid a,c-diamide synthase
  Pfam module annotation: Pfam domain module=ArsA_ATPase::CbiA; Domain location=129-372::131-347
MENADIPENANEHCPGPQSESAGKSDACEGCPNQQICATAPKGPDPVNNPYDLYKHAVMPQLMILEFGTVSQEVSKSFPPQSRCLQHCIEEHSATALHPSVAQYVPLFLECLNSTDLVAIAERMATVKHKILVLSGKGGVGKSTFSAQLAFALAARDFQVGLLDVDICGPSIPKMLGLEGQEIHQSNLGWSPVYVESNLGVMSVGFMLPNPDEAVIWRGPRKNGLIKQFLKDVYWGELDFLIVDAPPGTSDEHISLVQCLDATGIDGAIIVTTPQQISLIDVRKEVNFCKKVGVKVLGVVENMSGLCLPITDFKFMKLTDNGEQKDVTQWVWEYMREKAPEMLNLLACTEVFDSSGGGAVKMCNDMGVTFLGKVPLDPQLCKAAEEGIPPVPIAGSSIPPTPKTASSCMGQSGGIVAADPRGSASWSGEICEGKEKKTGSAIETGGIGASYSSVP

SEQ ID NO: 125551 - protein, 96 aa, Glycine max
  Coding DNA Sequence Number=SeqID_33866
  Homolog annotation: Hit_ID=A5AUB4; Match level="QueryCoverage=98%, HitCoverage=9%, E-value=4e-11, Identity=36%"; Hit description =Putative uncharacterized protein
KYSAFHYPCSHIIAVHGYVSMNYFQYVDVVYTNEHILKAYSVQWRPLGNEAAIPPSDEPWTLIPYPSTIRAKGEPKSTRIRNEMDWLEASEHRQKM

SEQ ID NO: 125552 - protein, 102 aa, Glycine max
  Coding DNA Sequence Number=SeqID_33867
MEKSPETTEEEALTKKLQELLSESDNEETENFNCQEEKVEEMMQDLYKEKTFSTCHICSTSSMMQRMGAFELKINLRWRGLRLLVPVMAEKEGSSKTYIVWV

SEQ ID NO: 125553 - protein, 150 aa, Glycine max
  Coding DNA Sequence Number=SeqID_33868
  Gene Ontology: Mol. function=oxidoreductase activity, acting on NADH or NADPH; Cellular component=mitochondrial respiratory chain; Biological process=mitochondrial electron transport, NADH to ubiquinone
  Homolog annotation: Hit_ID=A7P4I4; Match level="QueryCoverage=99%, HitCoverage=74%, E-value=5e-46, Identity=65%"; Hit description =Chromosome chr4 scaffold_6, whole genome shotgun sequence
  Pfam annotation: Domain name=Oxidored_q6; Domain location=85-150; Score=15.1; E_value=3.7e-06; Accession=PF01058.13; Description=NADH ubiquinone oxidoreductase, 20 Kd sub
  Subcellular localization annotation: CTP_CleavageSite=39; ConfidenceScore=5.35e-01
MALVTRTRPTWCLPRRLLFASLRSNSTGATAPPSYCAPPSMIANSSPVGHSKPVEFVISKVDSLLNWAHSRSIWPMMFGLAYCDMEMMHTGATYYDLDRFRIIFRPSPHQSNCMIVAGTLTNKMAHVYDQMPEQRWVISMGSCANGGGYC

SEQ ID NO: 125554 - protein, 207 aa, Glycine max
  Coding DNA Sequence Number=SeqID_33869
  Gene Ontology: Mol. function=oxidoreductase activity, acting on NADH or NADPH; Cellular component=mitochondrial respiratory chain; Biological process=mitochondrial electron transport, NADH to ubiquinone
  Homolog annotation: Hit_ID=A7P4I4; Match level="QueryCoverage=100%, HitCoverage=100%, E-value=5e-94, Identity=80%"; Hit description =Chromosome chr4 scaffold_6, whole genome shotgun sequence
  Pfam annotation: Domain name=Oxidored_q6; Domain location=85-192; Score=220.7; E_value=3.4e-63; Accession=PF01058.13; Description=NADH ubiquinone oxidoreductase, 20 Kd sub
  Subcellular localization annotation: CTP_CleavageSite=69; ConfidenceScore=5.46e-01
MALVTRIGLTWRLPQRLVSASLHSNSTGTTAPTSYCALPQPTANSSPVGLSKPAEFVISKVDSLLNWARTGSIWPMTFGLACCAVEMMHTGGARYDLDRFGIIFRPSPRQSDCMIVAGTLTNKMAPALRKVYDQMPEPRWVISMGSCANGGGYYHYSYAVVRGCDRIVPVDIYVPGCPPTAEALLYGLLQLQKKINRRKDFLWWWTR

SEQ ID NO: 125555 - protein, 122 aa, Glycine max
  Coding DNA Sequence Number=SeqID_33870
  Gene Ontology: Mol. function=nutrient reservoir activity
  Homolog annotation: Hit_ID=A7P4I3; Match level="QueryCoverage=75%, HitCoverage=14%, E-value=2e-23, Identity=61%"; Hit description =Chromosome chr4 scaffold_6, whole genome shotgun sequence
MVERTLFYLPGAKRNCLDGRVCFCWSNSVISRTSTNRHRNPAMSGGYSQQGYQARPPTSWGPPAAPMQQSGYGYVQPGAYSGPPQYNMPQQQYAGYPPQSSGGYSATNWDQSTAPQQQSPMQ

SEQ ID NO: 125556 - protein, 312 aa, Glycine max
  Coding DNA Sequence Number=SeqID_33871
  Homolog annotation: Hit_ID=A5AY35; Match level="QueryCoverage=59%, HitCoverage=41%, E-value=2e-35, Identity=42%"; Hit description =Putative uncharacterized protein
  Subcellular localization annotation: CTP_CleavageSite=43; ConfidenceScore=5.58e-01
MGTQKSSIAFIMCIIFPPVFPAPSTKPRVYLFLPSNPSLPVTVTVTVTGHSSSIDSPKMNLNHYHHHVPPYEHMLKESINRFFAEHRRGATDFADFTSIFSRMIHATPEPPIPLLWFYAALEFRATRDPSRRARDLFHLLVSCSGARGSTKQIAALAPLLFVLHRLALLQQGELLKTELNGLVEGVVSYCSICCGSEICRDDDVAVLEFGDLIKVWMVDDHDHDGGVLGFFPFVSGEFKKGIEKGCEVGVLAGIVMWEALLLKLCLAFEKGIGRAEQEKKLMASAVQTITGFRSFGFLVLRHVLGLMSLGPS

SEQ ID NO: 125557 - protein, 252 aa, Glycine max
  Coding DNA Sequence Number=SeqID_33872
  Gene Ontology: Mol. function=catalytic activity
  Homolog annotation: Hit_ID=A7P4H7; Match level="QueryCoverage=99%, HitCoverage=93%, E-value=2e-46, Identity=39%"; Hit description =Chromosome chr4 scaffold_6, whole genome shotgun sequence
  Pfam annotation: Domain name=PP2C; Domain location=30-233; Score= -58.3; E_value=0.015; Accession=PF00481.12; Description=Protein phosphatase 2C
MGICISVAEGVNDDNVTIFQARKVPNESQRLCSVYSQQGSKGLNQDAASVHEGYGMEDGTFFGVYDEHGGNGHKVSKIVSSRLSSLILDQKNVLEKIDAIENGIGCKKWKEAILSAFKVMDKEVKLQKNLDCSSSGTTAGEGLVIANLGDSRAVLGTICDEKTHGHSIDHRFEAGITSKVLKLLATEATVMSYMVWDVLSNNEVASIVWGVDSEEAVVEAATAAWNEKYPSYMADDCTVVCLILHKKSQLGA

SEQ ID NO: 125558 - protein, 313 aa, Glycine max
  Coding DNA Sequence Number=SeqID_33873
  Homolog annotation: Hit_ID=A5BVL2; Match level="QueryCoverage=86%, HitCoverage=50%, E-value=5e-54, Identity=49%"; Hit description =Putative uncharacterized protein
  Pfam annotation: Domain name=DUF1639; Domain location=238-287; Score =96.5; E_value=8.5e-26; Accession=PF07797.5; Description=Protein of unknown function (DUF1639)
MDKESHQGNSVRERDKVGGDSSSGGAGSLLLRGSSDGMRQAATTSDLGLQWGNRKRLRCMKVQVKHDPSSSNNPVQRTTTTTTTVRVDRRVVRNDKDSSSNLSISRSLPTTATLTNNNNNNHISLHNNNNINQSNGYLNLRQRPPSPQQPPPRILRNSETSSAMRGGQSNGSVRGIASPDRGAHDKRGTQNNHLNDNNNKSVVSSDTAHDSKKGGGGSPSGSGDAAPPVWPPKFVIALTNKEKEEDFLLLKGSKLPQRPKKRAKFIQRTLNLVSPGTWLCDLTLERYEVREKKISKKRPRGLKAMGNMDSDSE

SEQ ID NO: 125559 - protein, 275 aa, Glycine max
  Coding DNA Sequence Number=SeqID_33874
  Gene Ontology: Mol. function=ubiquitin thiolesterase activity; Cellular component=intracellular; Biological process=ubiquitin -dependent protein catabolic process
  Homolog annotation: Hit_ID=A7P4H1; Match level="QueryCoverage=84%, HitCoverage=72%, E-value=5e-42, Identity=35%"; Hit description =Chromosome chr4 scaffold_6, whole genome shotgun sequence
  Pfam annotation: Domain name=DUF239; Domain location=130-274; Score =70.9; E_value=4.2e-18; Accession=PF03080.6; Description=Arabidopsis proteins of unknown function
MGSTIFILMVVSVYGFVDHGSSLSRHKILEVERKLNHLRRHSLKTIQSEDGDVIDCIDINKQPAFDHPALKGHKIQMAPTYNSAKKDKTVGTRTRNNAKSGKMMKQRTEGAIQCNNRSLISPDGVVGFRYLRAKGDIKVCNPSVDKDDEYSTSQVSLLTGPYKDFECVEAGWAVNPSVYGDRQTRLFVYWTADASNKTGCFDLTCPGFVQISNCPGCSNLSHINSWWASKYIIIIYIYKDPYTNNWWVQYGEKTNIGYWPPEKQYVTMRNVWSGG

SEQ ID NO: 125560 - protein, 134 aa, Glycine max
  Coding DNA Sequence Number=SeqID_33875
MIESFQQQQEMGVIELCVEVDVVGASASNVTNSLLSYEDSDNDDYIISNSYVEDSLDEEKDIDDISDTDKEGGSETAFWESASNYSNINWSHPGEEDICGFNMGSTFNIGQELFVGMEFESKNAVKKMHCNNML

SEQ ID NO: 125561 - protein, 68 aa, Glycine max
  Coding DNA Sequence Number=SeqID_33876
MSFPHFPHLQQTPPYSRNFLLHMYLIWQVHHPPHPVLMWYVDHVKMMCCGCKSNMSPNILGTGMQIKN

SEQ ID NO: 125562 - protein, 299 aa, Glycine max
  Coding DNA Sequence Number=SeqID_33877
MDFNTLVSHTLTFLIGYLFTNGQALHLFIFPLALSARGYSNDAIATGNEDKFKRDEHDTLEYVNGEYCIWEGGGLVCPEINKDVLDMCNLGIAYPNKDDHVYFEHVVDDMPKILSDDELVDVVIDQVAEEVKEQNGIDSKIEAVNEEGIGQVSSIEELIQMCDNLNQVSIDAQEHEVVANGDLKKVTKIDDGIVSENVNAPQFVDVDDNDNEERSFDGEDNDFDYVMMDNLAHEHMKVDYGVHIDERKIFKTLKEARLMVEDSIKQHYAKLWDYAIELTRTNKGIIVVIDIVSISREPP

SEQ ID NO: 125563 - protein, 242 aa, Glycine max
  Coding DNA Sequence Number=SeqID_33878
  Gene Ontology: Mol. function=3'-5' exonuclease activity; Cellular component=intracellular; Biological process=nucleobase, nucleoside, nucleotide and nucleic acid metabolic process
  Homolog annotation: Hit_ID=A5B4I6; Match level="QueryCoverage=51%, HitCoverage=35%, E-value=4e-41, Identity=70%"; Hit description =Putative uncharacterized protein
  Pfam annotation: Domain name=3_5_exonuc; Domain location=38-234; Score=-34.3; E_value=0.029; Accession=PF01612.11; Description=3'-5' exonuclease
MASSSPSPPSYLTHLPLHPSHQGESEKRVEDDESRVPIHIVTAATQLPVEFLEPSPQSKLVIGFDCEGVDLCRKGTLCVMQLAFPDAVYLVDAIEGGEELIIACKPALESNYITKVIHDCKRDSIILSVWHQVEQRSGYPAISPDWPVSSFSANPQPEFATVQLSQCVRAPLNADLSTHHSSFTIQLWLRYPVCQDSWAGWRFSSLGYQHDQVLMMEKWALHPFSAVAIVGETLRCLKNVLR

SEQ ID NO: 125564 - protein, 576 aa, Glycine max
  Coding DNA Sequence Number=SeqID_33879
  Gene Ontology: Mol. function=hydrolase activity, hydrolyzing O -glycosyl compounds; Cellular component=extracellular region; Biological process=carbohydrate metabolic process
  Homolog annotation: Hit_ID=Q5ZQK6; Match level="QueryCoverage=93%, HitCoverage=92%, E-value=0.0, Identity=60%"; Hit description=Fructan 1-exohydrolase
  Pfam annotation: Domain name=Glyco_hydro_32C; Domain location=406 -522; Score=137.8; E_value=3e-38; Accession=PF08244.3; Description =Glycosyl hydrolases family 32 C termi
  Pfam annotation: Domain name=Glyco_hydro_32N; Domain location=45-365; Score=583.6; E_value=2e-172; Accession=PF00251.11; Description =Glycosyl hydrolases family 32 N termi
  Pfam module annotation: Pfam domain module=Glyco_hydro_32C::Glyco _hydro_32N; Domain location=406-522::45-365
MKIIPELLLFVIVPFLLNSGNGIETSTHSINNRTPEKQPYRTSYHFQPRQNWMNDPNGPMYYKGVYHLFYQHNPEAATFGDRIVWGHSVSYDLINWIHLNNAIEPSGPYDNNSCWSGSATIIPGKEQPVILYTGIDDKKHQVQNLAMPRNLSDPFLREWIKHPQNPVMSPPSGVEVNNFRDPSTAWQGKDGKWRVVIGAQNGDEGKTILYQSEDFVNWKVDPNPFYASDNTGVCECPDFFPVNISGSKNGVDTSVQNPSVRHVLKISYLRKQHDYYFLGKYVSDQENFIPDVRFTGTSSDLRYDYGKFYASKSFFDYAKNRRILWGWVNESDSTQDDIEKGWAGLQSIPRQVWLDKSGKRLVQWPIEEVEKLRDKHISIMGEKLVYGSNLEVSGITASQADVEVLFELPELQSAEFLDPDGVDPQLLCSQEDASRSGIIGPFGLLALASKDLKEHTAIFFKIYRAPNRYVGLMCNDQRRSSFRHDLDKTAYGTIFDIDPNLKNISLRSLIDHSIIESFGDEGRVCITSRVYPSLAIDKDAHLYAFNNGSQSVVVSKLNAWSMKQAEIGREGNISYT

SEQ ID NO: 125565 - protein, 174 aa, Glycine max
  Coding DNA Sequence Number=SeqID_33880
  Pfam annotation: Domain name=GRP; Domain location=1-79; Score=-11.5; E_value=0.0011; Accession=PF07172.2; Description=Glycine rich protein family
MVMMMVLVAMTLEILVVVVMALTEEATPMVPMVSAVIMVVVMTSNGGNRGASSSGGGDNDDGGGSDNNVASGGGDRGGGSSNMVAKMMAVTIVVAVLVLAVNGGDDEGSINCGDNDNVNDGNNDTNSDIDDSYDGGSGGDKKKCDGQIWEMPLETKPNFTKSFFLVLKINVKVF

SEQ ID NO: 125566 - protein, 359 aa, Glycine max
  Coding DNA Sequence Number=SeqID_33881
  Gene Ontology: Mol. function=binding
  Homolog annotation: Hit_ID=A7QWW8; Match level="QueryCoverage=44%, HitCoverage=12%, E-value=4e-45, Identity=62%"; Hit description =Chromosome chr13 scaffold_210, whole genome shotgun sequence
MDDDTWLSSQGTKLSWKCLPLNLISLPFIVAEKAKVVHSSCVLQSYWQMVMMSLQTISYWSCEDERQRWIRKKLVKIVHSLFDVPLDYFVLMLKKDICWENNEDVGEDDDVEEEGDESSMMVMMIALNVLQAPSSFGTPKVSIASGFPFTPLWPLLFPGGSGLHLDIGSLEKLIASLGPFVTRNTFDPEELLETSVEKSVLPGILQGDKLDSLLYDFVDNGKKICWNEYFHSKVLEAAKRLHLKEDLVLDRSENLFKLAAPMECKGIVVGDDRVIPYDANYTVPGSRFCILRPELITAHCRAQAAEILKSKEKNPQEADNLVTDSQNAAEADHLVNDSQNAADADQLVNDSQLLVYHCF

SEQ ID NO: 125567 - protein, 230 aa, Glycine max
  Coding DNA Sequence Number=SeqID_33882
  Gene Ontology: Mol. function=glycerophosphodiester phosphodiesterase activity; Cellular component=anchored to membrane; Biological process=glycerol metabolic process
  Homolog annotation: Hit_ID=Q2WGN6; Match level="QueryCoverage=58%, HitCoverage=18%, E-value=6e-42, Identity=61%"; Hit description =Putative glycerophosphoryl diester phosphodiesterase family protein
MELKPGDSAAKKELSQLLQAQSALETTHSLYDLGNFSKSLEYIDKVVLVFSSACNKAKLLIVKVLIVDKEYESAIVESGFLLKEDENNLEAFIRVKSNFNYGPTSFIFKILEQIKIEPTTNQTYGELLKNLTQIKTFASGILVPKGYIWPVDSDLYLQPHTPLVSNAHREGLQVFVSDVVNDVPFSYDSSYDPLDERLSFIDGGDFSVDGVLFDFPTTASTVISKFVSFV

SEQ ID NO: 125568 - protein, 88 aa, Glycine max
  Coding DNA Sequence Number=SeqID_33883
MENFIMNSDLSSQAQLAHFQLLQEVVAELSALLPTTIFLGENPWKVGMPGETENTWIVSPMTMCNVVVKVDYFSRVRRVLGRGTFSKR

SEQ ID NO: 125569 - protein, 327 aa, Glycine max
  Coding DNA Sequence Number=SeqID_33884
  Gene Ontology: Cellular component=membrane
  Homolog annotation: Hit_ID=A7NUD9; Match level="QueryCoverage=100%, HitCoverage=39%, E-value=4e-91, Identity=53%"; Hit description =Chromosome chr18 scaffold_1, whole genome shotgun sequence
MVLPVNYNGMGGMRKNIPFESLEVFTIENVKEGSKWLWVHCLALYIITLSACALLYFEYKSITNLRLLHIIGSPPNPSHFTILVRSIPWSSEESYCETVKKFFSYYHASTYLSHQMIYKSGKVQKLKGQEKKKWVWQKKEHVKMRGHTRKDEICYVDDAEHICKVIRDASLEKTCKPSFTKCCCYGAPTFSFKKISTETGSTHGRTCNNDLHLDTGKKYYYHDLLCQECPAAFVFFKSRYAALTAAQVLQTSNPMLWVTDVAPEPHDVYWSNICIPYRQLWIRKIATLVASVAFMLVFLIPVTFVQGLTQLDKLQKMFPFLTGILKE

SEQ ID NO: 125570 - protein, 140 aa, Glycine max
  Coding DNA Sequence Number=SeqID_33885
  Gene Ontology: Cellular component=membrane
  Homolog annotation: Hit_ID=A7NUD9; Match level="QueryCoverage=46%, HitCoverage=9%, E-value=2e-15, Identity=60%"; Hit description =Chromosome chr18 scaffold_1, whole genome shotgun sequence
MGFFVVSVGKLEKGIEKFVKLDAKRLCILVHSALIESSITCSWIGLLSKNVVANVMGMVWISNVFLLGKQPSNVNVYFGRRLASQHSRRIDLCLERFVPSPSWILKAWETSEDEILAIGGLDAVVFVRILVFRLFNPSKI

SEQ ID NO: 125571 - protein, 127 aa, Glycine max
  Coding DNA Sequence Number=SeqID_33886
PSSLRRKQLLRECHILSNIEAKEIKVKGKAAIDVVGNPLGEVWSPPNQSQKNDDLEPVHRWIVVKFEYHVRNTILSILTVGNFDIMEKKESHEDSISGGFNLFSVSLTFENFIGAVGEITERISGNR

SEQ ID NO: 125572 - protein, 135 aa, Glycine max
  Coding DNA Sequence Number=SeqID_33887
MGIVVKSFQKDSRPVNFGINRGITMLPSINLTIAMPAVITTNTIANPTDNAEVYLSESDTVEDFDARVNRTSMEMEDSVNMAHKIIMTKPGISPSCLTAAGRAMMPAPTMVVERLNTAPENDEPHWMAASEMRFW

SEQ ID NO: 125573 - protein, 74 aa, Glycine max
  Coding DNA Sequence Number=SeqID_33888
  Subcellular localization annotation: CTP_CleavageSite=60; ConfidenceScore=5.39e-01
MGEIYPSIISIFKFNQQTPPPPTVVAMTSMKVMLVAMIMVVVTIITTTIVLVMTTIIMVVAVETMSLVVETLSR

SEQ ID NO: 125574 - protein, 693 aa, Glycine max
  Coding DNA Sequence Number=SeqID_33889
  Gene Ontology: Mol. function=nucleoside-triphosphatase activity; Cellular component=membrane; Biological process=protein catabolic process
  Homolog annotation: Hit_ID=Q6KC90; Match level="QueryCoverage=90%, HitCoverage=74%, E-value=1e-110, Identity=73%"; Hit description=FtsH- like protease
  Pfam annotation: Domain name=AAA; Domain location=132-311; Score =251.6; E_value=1.6e-72; Accession=PF00004.20; Description=ATPase family associated with various cellular activities (AAA)
  Pfam annotation: Domain name=AAA_2; Domain location=129-258; Score= -40.5; E_value=0.013; Accession=PF07724.5; Description=ATPase family associated with various c
  Pfam annotation: Domain name=AAA_5; Domain location=132-263; Score =15.7; E_value=0.00018; Accession=PF07728.5; Description=ATPase family associated with various
  Pfam annotation: Domain name=Peptidase_M41; Domain location=425-626; Score=385.3; E_value=9.9e-113; Accession=PF01434.9; Description =Peptidase family M41
  Pfam module annotation: Pfam domain module=AAA::AAA_2::AAA _5::Peptidase_M41; Domain location=132-311::129-258::132-263::425-626
MSNSVTEEKTVGGLSALRSLGKSTKDNTIGTASNPIHMVAREGGNIKDQLWRTFRFIVVSFFMISGVGALIEDKGISKGLGINEEVQPSMESSTKFSDVKGVDEAKEELEEIVHYLRDPKRFTRLGGKLPKGVLLVGPPGTGKTMLARAIAGEAGVPFFSSSGSEFEEMYVGVGARRVRDLFSAARKRAPAIIFIDEIDAIGGKRNAKDQMYMKMTLNQLLVELDGFKQNEGIIVIGATNFPQSLDNALVRPGRFDRHVVVPNPDVKGRQQILESHMSKNTTKHNCPITPPSSLHNFKGEVVHTSAKISIVLMQNVPFKPHQITEITAISCCLKAQKLLARLNWMAYDAFFRVICFFLWAMIGYPLDTFVYELTPIYFEVYVLKADDVDLMIIARVTPGFSGADLANLINIAAIKAAMDGAKAVSMADLEHARDKIRMGSERKSAVISEESRKLTAFHEGGHALVAIHTDGALPVHKATIVPRGMALGMVTQLPDKDETSISRKQMLARLDVLMGGRVAEELIFGENKVTSGASSDLKKATSLAREMVTEYGMGNEVGLVTHDYEDDGRSMSSETRLLIEKEVKQFLERAYNNAKTILTTHNKELHALANALLEHETLSGTQIKALLAQVRSQMQQQQPQTLEAQNSSQSNTVPPSSSNPASAAASAAAAAATTAAATATAAAAKAKSAPVGS

SEQ ID NO: 125575 - protein, 98 aa, Glycine max
  Coding DNA Sequence Number=SeqID_33890
  Homolog annotation: Hit_ID=A7P2W0; Match level="QueryCoverage=28%, HitCoverage=6%, E-value=7e-07, Identity=89%"; Hit description =Chromosome chr1 scaffold_5, whole genome shotgun sequence
MARIVSTGISGASYYTGTFNTVNRSPDGSHSGCHVIEQLPEESRTCDGELMVKFLLDGEVTIDTMTDDVEFTEHDSDRIEFLKLSNRIEYTIRTWYLL

SEQ ID NO: 125576 - protein, 579 aa, Glycine max
  Coding DNA Sequence Number=SeqID_33891
  Gene Ontology: Mol. function=transcription regulator activity; Cellular component=nucleus; Biological process=regulation of transcription
  Homolog annotation: Hit_ID=A3FM28; Match level="QueryCoverage=72%, HitCoverage=98%, E-value=1e-100, Identity=50%"; Hit description =Basic helix-loop-helix protein
  Pfam annotation: Domain name=HLH; Domain location=260-310; Score =36.4; E_value=1e-07; Accession=PF00010.17; Description=Helix-loop -helix DNA-binding domain
  Subcellular localization annotation: CTP_CleavageSite=70; ConfidenceScore=5.12e-01
MGFQHGNESILTCPTSGLSGANVNVSEMAISSVSIAKPSDVVNPFIASSAWDPLVSLSQVQSFGGSSMVSHSEFANSNSSYPLVLDNQGISNTSHLVQYMSDSNLGGMVPKVHSYASGGFSEMVGAGSFCQHRSADMANTGYPIHYNPIKEAPINGEQSQVEDSIPEEEAPGSAPSGNRRKRGLDHNSTFSPNKGDAVNDSPGKASNGPKEHEKRPKGEQNNGADVRGKQSVKQAKDNNSQSGEAPKENFIHVRARRGQATNSHSLAERVRREKISERMRLLQELVPGCNKITGKAVMLDEIINYVQSLQQQVEFLSMKLATVNPELNFDVDRILSKDILQSRIGHGIGAYGPGINSSHTFPNGSFHGTLAGMPSTSSQFPPLPQNVLDHEFQSFYGIGYDSNTALDNLEPNVFELSKHELPIISEMSKVPELSKRELPKVSELLKPELPKVPKLPEISELPKPELTKVPELPKVPESFKLELTKIPELTKVSELSKVPELPKPTFPKVPKPELPMVLELPKLELSKIPKIPKVPEFLKVPRTFSTTNLQFELFLTLSCPQIKIGCIPVPRSCCLIDVI

SEQ ID NO: 125577 - protein, 76 aa, Glycine max
  Coding DNA Sequence Number=SeqID_33892
MVSQGPIRSNYNINDWLWPKCKTNDLLAPVMLKVLLVVKDIDVAGTIMVALGWCANNGVVLVVVRQWQGDAEVSHA

SEQ ID NO: 125578 - protein, 180 aa, Glycine max
  Coding DNA Sequence Number=SeqID_33893
  Homolog annotation: Hit_ID=B0LUS5; Match level="QueryCoverage=32%, HitCoverage=18%, E-value=7e-10, Identity=55%"; Hit description =Transcription factor
MENIDTNYKVVTDVTIFKFEKVISLLGRTRIGHVRFKRAPSAPPPPLAESKVYHATPLQQILPPTLHTHAVVTNHSLVPIEDLDHDVVDVVLEAKEEVKVAKVDVIVDGDDREAKAGDGEVDVGSGGGLAHIALARGEKGRIEAEEECEVRSVGGAREKVERGHWEGEKGRGRRRSLVVK

SEQ ID NO: 125579 - protein, 138 aa, Glycine max
  Coding DNA Sequence Number=SeqID_33894
MDQRGHGMYYTPPTFSQYPSQMYQYPFEDHDTDMSASEHSFGGVTETHPHFSWPTMTPSQQHDVPMATPNAPLGPQWDVPRAIPDMGDILGVDLRHEFSADAEQEGPRQRARRNPDRQARRWDRPCGTSSRHHEHHND

SEQ ID NO: 125580 - protein, 632 aa, Glycine max
  Coding DNA Sequence Number=SeqID_33895
  Gene Ontology: Mol. function=nucleoside-triphosphatase activity; Cellular component=membrane; Biological process=protein catabolic process
  Homolog annotation: Hit_ID=Q6KC90; Match level="QueryCoverage=89%, HitCoverage=74%, E-value=0.0, Identity=70%"; Hit description=FtsH -like protease
  Pfam annotation: Domain name=AAA; Domain location=132-357; Score =281.9; E_value=1.2e-81; Accession=PF00004.20; Description=ATPase family associated with various cellular activities (AAA)
  Pfam annotation: Domain name=AAA_2; Domain location=129-258; Score= -42.1; E_value=0.018; Accession=PF07724.5; Description=ATPase family associated with various c
  Pfam annotation: Domain name=AAA_5; Domain location=132-263; Score =16.5; E_value=0.00016; Accession=PF07728.5; Description=ATPase family associated with various
  Pfam annotation: Domain name=Peptidase_M41; Domain location=364-565; Score=389.9; E_value=4e-114; Accession=PF01434.9; Description =Peptidase family M41
  Pfam module annotation: Pfam domain module=AAA::AAA_2::AAA _5::Peptidase_M41; Domain location=132-357::129-258::132-263::364-565
MSNSVTEEKTVGGLSALRNLGKSTKDNTIGTASNPIHMVAREGGNIKDQLWRTFRFIVVSFFMISGVGALIEDKGISKGLGINEEVQPSMESSTKFSDVKGVDEAKEELEEIVHYLRDPKRFTRLGGKLPKGVLLVGPPGTGKTMLARAIAGEAGVPFFSCSGSEFEEMYVGVGARRVRDLFSAARKRAPAIIFIDEIDAIGGKRNAKDQMYMKMTLNQLLVELDGFKQNEGIIVIGATNFPQSLDNALVRPGRFDRHVVVPNPDVKGRQQILESHMSKVPFKPHQITEITAISCCLKAQKLLARVTYFLCWIFVSHQIQVLKADDVDLMIIARGTPGFSGADLANLINIAAIKAAMDGAKAVSMADLEHAKDKIQMGSERKSAVISEESRKLTAFHEGGHALVAIHTDGALPVHKATIVPRGMALGMVTQLPDKDETSISRKQMLATLDVCMGGRVAEELIFGENEVTSGASSDLRKATSLAREMVTEYGMGNEVGLVTHDYEDDGRSMSSETRLLIEKEVKQFLERAYNNAKTILTTHNKELHALANALLEHETLSGTQIKALLAQVRSQMQQQQPQTLEAQNSSQSNTVPPSSSNPASAAAAAAAAAATTAAATATAAAAKAKSAPVGS

SEQ ID NO: 125581 - protein, 263 aa, Glycine max
  Coding DNA Sequence Number=SeqID_33896
  Homolog annotation: Hit_ID=Q1RU80; Match level="QueryCoverage=38%, HitCoverage=88%, E-value=5e-13, Identity=38%"; Hit description =Putative uncharacterized protein
  Pfam annotation: Domain name=DUF1723; Domain location=30-79; Score =45.2; E_value=2.3e-10; Accession=PF08330.1; Description=Protein of unknown function (DUF1723)
MTKFGRSAPEIEGLVAASGLSPLIACSLDTGDRGLMSAFMERWHKETSSLHLPDREVTITLDNVTLLLHLPIAGTFYRFKQLPINDAIDMLVELLEVSVAEARAETIQCHGSYDAAALVHMYDNLNDAPKSTTRQLAGYITLLQCWIYEHFSSVGSALVFEDYDERRPRACRWTSGKALLIISLFSGHLRWGPLTVIHQPKTVSGDPPRVPSVQQYDTFVEPDVHQQWMAATTSDEADVDDGFVAIAVKLERLLNLRILSEGT

SEQ ID NO: 125582 - protein, 155 aa, Glycine max
  Coding DNA Sequence Number=SeqID_33897
  Homolog annotation: Hit_ID=A5BEV8; Match level="QueryCoverage=74%, HitCoverage=21%, E-value=2e-09, Identity=27%"; Hit description =Putative uncharacterized protein
MDKEQSMYDNIMSKEVDMNVENEEDGGVKLFASHDEVLHWARLVNHDIGFVVMIMRSDTNTGVRGRASFLLIACERSGEYRPKKNDLSLVGHPYAGRLTKDDKIVVVDMTKSMVKSRNILLTLKKHDANSYTTIKQIYNVRHAYHSSIRGSDTEI

SEQ ID NO: 125583 - protein, 231 aa, Glycine max
  Coding DNA Sequence Number=SeqID_33898
  Gene Ontology: Mol. function=hydrolase activity, hydrolyzing O -glycosyl compounds; Cellular component=extracellular region; Biological process=carbohydrate metabolic process
  Homolog annotation: Hit_ID=Q93X59; Match level="QueryCoverage=87%, HitCoverage=39%, E-value=8e-44, Identity=39%"; Hit description =Fructan 1-exohydrolase IIb precursor
  Pfam annotation: Domain name=Glyco_hydro_32N; Domain location=1-167; Score=-55.5; E_value=9.5e-10; Accession=PF00251.11; Description =Glycosyl hydrolases family 32 N termi
MPKNLSDPCLRDITIAWQGVDGKWGVNIGAKNGDDGKALLYHIYISGSKSGVDTSVQNSSVKHVLEMSYQNKQLEYNFLGEYFPDQEKFTPDADDLEGTNLNLLLDHGMFYASKSFFNYAKNRRILWGWSKECESTQDDYEKGWAGLQSIPRQVWLHKSGKWLMQWPIEEVEKLRDKQVSIMREKLVGESTIEVSGIPASQDSIENIIDVKADGNCGYRAIVVLLSMDEES

SEQ ID NO: 125584 - protein, 58 aa, Glycine max
  Coding DNA Sequence Number=SeqID_33899
GTSFVAQVEDSIYLGLTENKRGYISCGSVLVEGTSTRIFTRLKEISRIAGRLGTGGRH

SEQ ID NO: 125585 - protein, 167 aa, Glycine max
  Coding DNA Sequence Number=SeqID_33900
ESGPCLSPSVADHPLGPATDHRLGKLLPHQLANQTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSIIIRSRHTNRKTYIGFRDNQARTDNFHHVKVTLYR

SEQ ID NO: 125586 - protein, 66 aa, Glycine max
  Coding DNA Sequence Number=SeqID_33901
MEKSEKKNFSEKKMKKAYITWDDNDMESFEDSENEEINLCLMAKSYESDEEMHLLICIKSQSNLES

SEQ ID NO: 125587 - protein, 116 aa, Glycine max
  Coding DNA Sequence Number=SeqID_33902
  Gene Ontology: Mol. function=phosphoenolpyruvate carboxylase activity; Biological process=carbon utilization by fixation of carbon dioxide
  Homolog annotation: Hit_ID=A7P310; Match level="QueryCoverage=97%, HitCoverage=7%, E-value=1e-13, Identity=42%"; Hit description =Phosphoenolpyruvate carboxylase
MAIDLYIREVDGLRFELSMNQCSDKLSELAHEIQKVCLFSFVFVDIFQMLMGIAVIFVLYHVTSGYCLSRSNDEEDHHEHWNGSMSRSQSKHPNQQASPLPTKLPAGAHIPSCAWP

SEQ ID NO: 125588 - protein, 84 aa, Glycine max
  Coding DNA Sequence Number=SeqID_33903
MWVQAIGLFAQATFALEFGLPRPFNQNLLVLHLWAMRGTMHEPQANLGADPKFSPVDGFKQKKGDKSWDFNGLIKRQTTPLSAL

SEQ ID NO: 125589 - protein, 130 aa, Glycine max
  Coding DNA Sequence Number=SeqID_33904
MKDKRDEEEKLEKQKKEENSKALETSLSTSIPLELEVIPQVKELLDEGLVRKSLNPCALLVPKIGIMRHQIPMIGGMMNVLTGVTLFCKITHASNIFMIHIHRDLLGSDQGVPTDPKRIKFIPECPLHQV

SEQ ID NO: 125590 - protein, 212 aa, Glycine max
  Coding DNA Sequence Number=SeqID_33905
  Gene Ontology: Mol. function=DNA-directed DNA polymerase activity; Cellular component=mitochondrion; Biological process=DNA replication
  Homolog annotation: Hit_ID=Q39432; Match level="QueryCoverage=77%, HitCoverage=20%, E-value=1e-39, Identity=52%"; Hit description=DNA polymerase
MVSYLANPGKGPSYWDPPKNSAVQLAAAITAGSRIYMYKYISREDCLYTDTDSIVLGNPLPEEDVSSSVLGKFKLEDKILEGFFLAPKCYSYTTEESYGNKKVYKYKGPGRNVITPEWYKEQYADPSRSLIKKVTYQFRPDWKELSVKKKESTTTLRTLSNSKRIPFFNEKGKVLDKENSYFRKREFGSFSEITEAGTGKRYNSPAESRRRK

SEQ ID NO: 125591 - protein, 27 aa, Glycine max
  Coding DNA Sequence Number=SeqID_33906
MTFLISLVGKGQGLNWYLDRRCSQHID

SEQ ID NO: 125592 - protein, 39 aa, Glycine max
  Coding DNA Sequence Number=SeqID_33907
ADNYLKGIIYSALKGFDDAPQPKSKAPARWIVVKIKRKY

SEQ ID NO: 125593 - protein, 59 aa, Glycine max
  Coding DNA Sequence Number=SeqID_33908
  Subcellular localization annotation: CTP_CleavageSite=47; ConfidenceScore=5.50e-01
MVFGASAASVILPKIKSKYFRNASVSDSVEILHRSSPFFIRSSFVLRSSTVSFFRFNVL

SEQ ID NO: 125594 - protein, 49 aa, Glycine max
  Coding DNA Sequence Number=SeqID_33909
MTKDASKFTHISPKNSGHVTYGGNNKVIGLPKLDLKKIDYVMHVKKENK

SEQ ID NO: 125595 - protein, 139 aa, Glycine max
  Coding DNA Sequence Number=SeqID_33910
RRCKDYYSKLVAHSQFKITLSPQNPQEFKIPETGPGHLESEPPPHLSDGKTGKSERATASPDKESERSAASLFGDLGGAAASLDGESKMIIKGGDGGTTSSSGEEDGFTTGDYGSTGAGSTRAGVGSGEATSLGLTSGS

SEQ ID NO: 125596 - protein, 138 aa, Glycine max
  Coding DNA Sequence Number=SeqID_33911
MVVTARPERVVRQFGYIQSIPLPPVSADYMEWFFRISHPFMIPTQAGDQQRDAPAVDPEDYIQPPSPQVPVAFDPPPHVDDYEGYETIAQRLERVLNLRIVTAGTELYDIMQDCLTIARGGPSADGTVRARQRHRTDH

SEQ ID NO: 125597 - protein, 32 aa, Glycine max
  Coding DNA Sequence Number=SeqID_33912
MVFFPKKPNVRSGCPPSPWPWLTSGEVLDSRS

SEQ ID NO: 125598 - protein, 295 aa, Glycine max
  Coding DNA Sequence Number=SeqID_33913
MSPFLMRDFGAQNSKTIQRIHKAWETPLRKDQELRGIRNGIIGGYHEWLKVHIRGLDWLAKLKVVSEESFEAPEEDEEVQALKSELGKAKLAKEKFKLAATHIRKECAGYREENAITARALEQETKRLARKSMAGINFAELYGVAIVNSSCEGKRGDQSRAHSMVLKKELIACSRSERSLSQRLCETETNMLAIIAKYQEELGLATAHEHRIADEYAQVYAEKEARGRVIDSLHQEATMWMDRFALTLNGSQELPRLLAKAKAMADAYSAPEEIHGLLGYCQHMIDLMAHIIRNR

SEQ ID NO: 125599 - protein, 112 aa, Glycine max
  Coding DNA Sequence Number=SeqID_33914
MYQYPFEAHQSDTFASEHSLGGVAETYLNFSWPTMTPSQQHDALTETPNAPLGTQWNVLICVTNFLLRLTSMKRGAIVTEEILIDKHEDGIVHAAHPHVIIDIKTIDFLFSI

SEQ ID NO: 125600 - protein, 251 aa, Glycine max
  Coding DNA Sequence Number=SeqID_33915
  Homolog annotation: Hit_ID=UPI00016621D1; Match level="QueryCoverage =55%, HitCoverage=40%, E-value=5e-13, Identity=37%"; Hit description =UPI00016621D1 related cluster
IPSSALTDRGLCVLPFRGLHALAFRGLHIHTFRGLHVLAIRGLHALTFRGLHVLTFRGLHVLTFRRLHVLIFKGLHVLAIRGLHALTFRGLHVLTFKGLHVFTFRGLHVLIFRGLHVLTIRGPHILTFRGLHALTFRGRHVLAIRGLHKTARPHLQRTARAHLQRTARPRLQRTCTPSPSEGYTPSPLEDCTPPPSEDCTSSPLEAARPRLQRTTRPHLQRTARPHLQRTARPHLQRATCPHLQRTIHPPL

SEQ ID NO: 125601 - protein, 82 aa, Glycine max
  Coding DNA Sequence Number=SeqID_33916
MMQSYPQGYRIEDSMKIGPEMQEKALGFVEAKLHGESKVINYLMQSYPARALGRRLQVDRARDPREGSRVLMSLRVDFEPMS

SEQ ID NO: 125602 - protein, 160 aa, Glycine max
  Coding DNA Sequence Number=SeqID_33917
MWAFLIGRQIDWAHLVRYRMLKALRANAPLPYPQLITLFLRHFQIPLDDEPFVQVKRSFAIGVGAVTSFGYRKDRNGQWLKKDALPPQDERTPSPPPQRDDSALMNEVLTELRGLRSYVGERFDSLDTRFAGMDIRLTQLEEDVGYICQSFDLPPPPPPS

SEQ ID NO: 125603 - protein, 129 aa, Glycine max
  Coding DNA Sequence Number=SeqID_33918
MEAMKEQMATMMEAMMSMKKIMEANAVIVAATSAVAKVNPMLPSGLKQMNHPTSNMTHEIPHHNLADFEPWLGYTTEGQAVGGIPLQNPLEGPQYHPQLHLLHSTAVKNPHDYGRNGKVGSSRGKAQGH

SEQ ID NO: 125604 - protein, 195 aa, Glycine max
  Coding DNA Sequence Number=SeqID_33919
  Homolog annotation: Hit_ID=B0HC01; Match level="QueryCoverage=16%, HitCoverage=70%, E-value=6e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTPDGGVGSTLATALVAVTAAALTSIIFFMLIMASIIVAICSFMASMLAFIRTHYSGSSTHSVRVTGGSSRVDLQACKLGTGRRFTTS

SEQ ID NO: 125605 - protein, 57 aa, Glycine max
  Coding DNA Sequence Number=SeqID_33920
MVVSFFLDSSFSLKWRLQSSFSFLHSTAINLQEAKDSIDEEDPRLTSSTRSYIMWFS

SEQ ID NO: 125606 - protein, 34 aa, Glycine max
  Coding DNA Sequence Number=SeqID_33921
MVVTERLLNFVYKKIDTRECVVKSANVLLAMCSQ

SEQ ID NO: 125607 - protein, 45 aa, Glycine max
  Coding DNA Sequence Number=SeqID_33922
ELEGGLVPSLEEFESRSKGPTTLSYPNFVREPLLDDVRPFFGPRE

SEQ ID NO: 125608 - protein, 182 aa, Glycine max
  Coding DNA Sequence Number=SeqID_33923
MAPTRHPLDPDKSNRALGFPALITRLCQSFGVPVTPSKVIRPPITRAFIEKYCTQRQVQGDAPQAADAPLPHQAGPAESFDTEQYLRHLVRQQVANHRAHVQTHDCLYQMSLSLQSQGFTSFPCPTPDQFRAEVAWPGDWPEAQAGEAPVGAPAEAPDEADEACEDEEMTDLLDFLGGSGAT

SEQ ID NO: 125609 - protein, 64 aa, Glycine max
  Coding DNA Sequence Number=SeqID_33924
MASMDTSAKKGSRQNPYAMHMQKTQYGNVHSMTIFTEHKQKGYMILMHGSCEKWHATCLLRAPI

SEQ ID NO: 125610 - protein, 97 aa, Glycine max
  Coding DNA Sequence Number=SeqID_33925
  Gene Ontology: Mol. function=aminoacyl-tRNA ligase activity; Cellular component=cytoplasm; Biological process=tRNA aminoacylation for protein translation
  Homolog annotation: Hit_ID=UPI00005F9797; Match level="QueryCoverage =82%, HitCoverage=9%, E-value=1e-40, Identity=96%"; Hit description =COG0495: Leucyl-tRNA synthetase
MTDVTWQDAGSAGPPAAMQEQYRPEDIESNVQLHWQEKQTFKVTEDDSKEKYYCLSMLPYPSGRLHMGHVRNYTIGDVISRYQRMLGKNVLQPIGWD

SEQ ID NO: 125611 - protein, 251 aa, Glycine max
  Coding DNA Sequence Number=SeqID_33926
MRGAPTEESLSPFLVRDLGAQSLKVIQRIHKAWRSPLRKDKELRGIRNGVIGGYHGWLRIHTRGLDWLSKLKVIDEENFEAPEEDEEVRALKLELGKARLAKEKFKSAATHIRKECTELQEENADTARALEQETKRARKEEYGREKFRGALWGSNSELKLRKEERDPSRVHGMILKEELAACARSKRSLAQHLEATEQSMLAIIGQYKEELNQSVAHEQKLVEDFAQVYAKKEARGRVLDALHQEATMWMD

SEQ ID NO: 125612 - protein, 141 aa, Glycine max
  Coding DNA Sequence Number=SeqID_33927
MSKSCGFGMTSPLDESISCFLIRVDPWVLVPITLRGLHVLTIRGLHALTSRGLHVLALRGLHALTLGLHVLTLKGLHVLTIRGLHALTSRGLHVLALRGLHAWVYTLTVERTTRPRLERTTLPSRSQGYTPSPWVLVTLTV

SEQ ID NO: 125613 - protein, 154 aa, Glycine max
  Coding DNA Sequence Number=SeqID_33928
  Homolog annotation: Hit_ID=Q51617; Match level="QueryCoverage=24%, HitCoverage=55%, E-value=5e-13, Identity=94%"; Hit description =Putative uncharacterized protein
MTVKTSDTCSSRRRSQLVCKRMPGADKPVRARQRVLAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSHEVDKIVDGRESSE

SEQ ID NO: 125614 - protein, 137 aa, Glycine max
  Coding DNA Sequence Number=SeqID_33929
MAPRKLASKRSRKDKAAEGTSSAPEYDSHHFRSAEHQQRFEAIKGWSFLQERRVQLRDDEYTDFQEEIVHRRWASLVTPMAKFNPDIVLEFYANAWPTKEVDPFRCGCPQPVPGIPVSVGGGPRVRVWPEVEPGRWF

SEQ ID NO: 125615 - protein, 54 aa, Glycine max
  Coding DNA Sequence Number=SeqID_33930
SSQKTAIDTSKPYTGAMRGTMDEPQANLGADQKISPGRSKTRKGGLGKIRVGKK

SEQ ID NO: 125616 - protein, 56 aa, Glycine max
  Coding DNA Sequence Number=SeqID_33931
MPKVQKKGFVAQSMKFRDMSGIKRKWVQIATRPTWAFQKIPPEGGCLWRKEPSSPG

SEQ ID NO: 125617 - protein, 328 aa, Glycine max
  Coding DNA Sequence Number=SeqID_33932
  Gene Ontology: Mol. function=peptidase activity; Biological process =proteolysis
  Homolog annotation: Hit_ID=A3RVV4; Match level="QueryCoverage=46%, HitCoverage=53%, E-value=4e-42, Identity=55%"; Hit description=L -alanyl-D-glutamate peptidase
  Subcellular localization annotation: CTP_CleavageSite=73; ConfidenceScore=5.75e-01
PPPPAIAPCHTPPNSPAPSAPRNSSSNTSSGVLERCRTGRCLTSASGTRPSSEARMRDDCGSSTADERPASKLGMAGGGRDFFSSSAMRGSVSAGAWDTVATSTAPIFSARDRRLRAAGVPVFQGRDRAGRARVRTGIRRRVARGAGQAGGVVGGSAQVVRAGVGKAGNTFSAYRWQIAAGLAVVLLPSLFAFVMRHNHTFIYEDRMAGPDPRIQALLTGERLVPPPPLPPEVFTTREVELVRPNLGGASRDWNLLDADYRQRLLAAYRVMREKHGYEMELIDGYRNPERQEELASKGSHVTNVGAYQSYLHYGLAADNAFLRDGNVV

SEQ ID NO: 125618 - protein, 80 aa, Glycine max
  Coding DNA Sequence Number=SeqID_33933
  Subcellular localization annotation: CTP_CleavageSite=43; ConfidenceScore=5.41e-01
MCPPPSSLEPSVVIALCNSPFITPFRSPMNCVFVHLSSTFEFEAMRSDCLVQFSILNPFSEPRELRFRSGVLHLRVWSYA

SEQ ID NO: 125619 - protein, 55 aa, Glycine max
  Coding DNA Sequence Number=SeqID_33934
EMPPRKLFAKRSRRDAAAEGTSAAPEFDSHRFRSAEHQQHFEAIKGWSFHQERRI

SEQ ID NO: 125620 - protein, 134 aa, Glycine max
  Coding DNA Sequence Number=SeqID_33935
GSAINWFPRWKEGKEGVLFSCGDYPNVPLIGTRGAQGLKVIQRIHKAWRNPLKKDKELRGIRNGVIGGYHGWLRIHARGLDWLSKLKVIDEENFEAPEEDEEEKFKSAATHIRKECAELQEENAATAKALEQET

SEQ ID NO: 125621 - protein, 89 aa, Glycine max
  Coding DNA Sequence Number=SeqID_33936
MSEEVDMNEQNEDEASVNEEHVDCSDAFNTSLSMVKPRNILLTLKEHNANSYTTIKQIYNASAYHSSIRGSDIEMQQLMKLLERDQYIH

SEQ ID NO: 125622 - protein, 47 aa, Glycine max
  Coding DNA Sequence Number=SeqID_33937
MGAGFMANLGVAFVDDWVFLADRVVGNEKGRYWLSIDIVELVENLAI

SEQ ID NO: 125623 - protein, 99 aa, Glycine max
  Coding DNA Sequence Number=SeqID_33938
MLLSSNIIYICERVVMLVRTIRTRLFAAARVKSCPSMYSSCVIASLSGCARTVGRPPISGGGPGTNKRKLLAPREISSSLLLISEKGLRDRGSLVVEDS

SEQ ID NO: 125624 - protein, 21 aa, Glycine max
  Coding DNA Sequence Number=SeqID_33939
MALSAPSRLSSTRDIYERSLV

SEQ ID NO: 125625 - protein, 58 aa, Glycine max
  Coding DNA Sequence Number=SeqID_33940
MMKMFKKQGNENPDPVNDLVHAHSGPVLVQMMDPEKEAGSKVNGSGGVGSAASGMSFC

SEQ ID NO: 125626 - protein, 108 aa, Glycine max
  Coding DNA Sequence Number=SeqID_33941
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
KRKSAQYANRLSPRVGRFINAAGTTGFPTGKRAVSATQLIYDHDYEFELGTQYPAGMQAWHWPSFYNVVTGKTLALPNLIALQHIPLSPAGVIAKRPAPIALPNSCAA

SEQ ID NO: 125627 - protein, 129 aa, Glycine max
  Coding DNA Sequence Number=SeqID_33942
  Subcellular localization annotation: CTP_CleavageSite=35; ConfidenceScore=5.02e-01
MDMNIGGLISGQMIMMAQSNPSRLGFPALITAFCRSRGVGSDALTSYENLRPAIDLAYIIKSCWNANDQTVKFPEAWKTKLRAADAPSSFAPITDIPASSTSAPLLALADLFAQSSQTSDAKLQSLFEG

SEQ ID NO: 125628 - protein, 165 aa, Glycine max
  Coding DNA Sequence Number=SeqID_33943
MSVLELYIEKDVAGGSMFHSANSLTSCENNLSNNEAQPPTNVSNLHSDDDDDDYLVSNSYVEESLDEDDSVDDISDTDDEVADIIQPVRIVHSAEGVQGIENPFWNDALHYNNINWSHPDEEDICGLEMPSSFNVGQELYVDMNFDNKKCTETICYEGASNFQSC

SEQ ID NO: 125629 - protein, 156 aa, Glycine max
  Coding DNA Sequence Number=SeqID_33944
NVWSAWASNILEGRSRLLLLLLRAGPSEIRVIPPSRVVSVAGEAAQLLQVAAWKGKGLYGEYSLEVIPARDGPWSKGVATCPFAGERRRGSRVRFPKEERCAESPPTFIYGKRRENRRKPVKMKILSSGVVFTLEEGRKSGALAPTYPPSKRKSDL

SEQ ID NO: 125630 - protein, 121 aa, Glycine max
  Coding DNA Sequence Number=SeqID_33945
MGTNQTCKRFYQVKVKSLDTTSIKELGRFMEPLQMQAFRKIYGKILELTIAEISIEAIASLTQYYDQPLRCFTFGDFQLVPTIEEFEEILGCPLGGRKPCLSSGCLPSLSRIATVVQDSAR

SEQ ID NO: 125631 - protein, 86 aa, Glycine max
  Coding DNA Sequence Number=SeqID_33946
  Subcellular localization annotation: CTP_CleavageSite=11; ConfidenceScore=5.08e-01
VRTFFQFSYVRSTLSRATIPKYVLNFFLWGPSSLPVVGSMWTTGLLAPGGLVDKDHRREALHVRFMADGEADASEGGGGGGGGGEA

SEQ ID NO: 125632 - protein, 94 aa, Glycine max
  Coding DNA Sequence Number=SeqID_33947
MPIESQQPQFDHAHVSQPMGETHEVPRHTVADFEPHLKYATEGQYRPQPQPLHFALERLPPAMVEREKFDHIEERLRAIEGGRDYAFADMEDCA

SEQ ID NO: 125633 - protein, 165 aa, Glycine max
  Coding DNA Sequence Number=SeqID_33948
MGDQEETQEQMKADMSALKEQMASMIEAMLGMRQIMEKNVATATTVSSAAEADPTLLATAHHPPPNTPDEVHEDHREYAQGDVDFYPPIPVVGPAPNTLPQHNLTTQPIFLSTEEPPPATEEKRKLDLLEERLRAVDGFGDYPFADMTNLCLVTDVVIPPKIHCT

SEQ ID NO: 125634 - protein, 126 aa, Glycine max
  Coding DNA Sequence Number=SeqID_33949
  Gene Ontology: Mol. function=cytochrome-c oxidase activity; Cellular component=mitochondrial respiratory chain; Biological process =aerobic respiration
  Homolog annotation: Hit_ID=P60620; Match level="QueryCoverage=70%, HitCoverage=16%, E-value=1e-37, Identity=86%"; Hit description =Cytochrome c oxidase subunit 1
  Subcellular localization annotation: CTP_CleavageSite=49; ConfidenceScore=5.18e-01
MPRRIPDYPDAYAGWNALSSFGSYISVVGIRRFFVVVTITSSSGNNITRANIPWAVEQNSTTLEWLVQSPPAFHTFGELPAIKETKSYLGKQAQFRMATYQQRIARYYKARVKFGNWIELSRSCSY

SEQ ID NO: 125635 - protein, 43 aa, Glycine max
  Coding DNA Sequence Number=SeqID_33950
MLQPYGINIGLKEHSNPVAPKAYTLKSPSRPLPPDSDKWPQIS

SEQ ID NO: 125636 - protein, 177 aa, Glycine max
  Coding DNA Sequence Number=SeqID_33951
  Homolog annotation: Hit_ID=UPI00006A2939; Match level="QueryCoverage =79%, HitCoverage=90%, E-value=3e-10, Identity=30%"; Hit description =UPI00006A2939 related cluster
MVKGLHVLANRGLHALTLRGLRVLTFRGLHVLTFRGLHALAIRGHALTFRGLHALAIRGLHVLTFRGLHVLTFVGLHALTFRGPHVLTFRGLHALAIRGLRVLTFRGLHALAIRGLHVLTFVGLHALTLRGLHVLANRGLHALTLKRTTRPRQQRAARPHLQRTIHPCLARAARPYL

SEQ ID NO: 125637 - protein, 174 aa, Glycine max
  Coding DNA Sequence Number=SeqID_33952
MDSNSQQFSARNVVIVLRGVHEVATDSSSSTENKKLEGKLDALVNLIFVLLSSNLESMSNLKLMLQTFIIDLHSSKTNNSKILMTFQATDTIQNVAGPSKPYVPPPMQQQQQQQQQQSQQRQQATEAPPQPSLEELVRQMTIQNMQFQQETRASIQSLTNQMGLMATQMNQAQS

SEQ ID NO: 125638 - protein, 287 aa, Glycine max
  Coding DNA Sequence Number=SeqID_33953
  Homolog annotation: Hit_ID=A3RVV6; Match level="QueryCoverage=96%, HitCoverage=25%, E-value=6e-40, Identity=39%"; Hit description=VgrG protein
  Pfam annotation: Domain name=DUF586; Domain location=215-287; Score =39.4; E_value=1.3e-08; Accession=PF04524.3; Description=Protein of unknown function, DUF586
MLARQRRRVPDSITVLGWHDSGKRAVTAQALVNPASGQDDAAGLDWYEVAGHGGFADEAQARRQANLATEALRARAETFVGLGVVRTFRSGTRFTLRDLSPLGPAGEGGFEPEFALDRVEHVGINNLPPETRASLAQRLGGLDAHLVLDGDALAAPGAEPHEAVSLRVDPAVLAKAREVGYANRFEAVRCDRPWRPPLPSARGARLAGAPSVHGVHTAVVTDAEGGTQPKEQDEILRNKRGDVRIRFHWQGSGADGEARSRWVRVAQRQSGAGMGISFVPRIGQEVL

SEQ ID NO: 125639 - protein, 102 aa, Glycine max
  Coding DNA Sequence Number=SeqID_33954
  Homolog annotation: Hit_ID=A5AXT5; Match level="QueryCoverage=77%, HitCoverage=8%, E-value=4e-08, Identity=32%"; Hit description =Putative uncharacterized protein
MAEAHSISARMVANCKLSKHGADLFHDPTLYRSVYMANPLDSHWAVVKRILRYLKGTIFHGLFLQPASVSKPMALDAFWLIGHQILMTDVPHQEQLSFLAQT

SEQ ID NO: 125640 - protein, 66 aa, Glycine max
  Coding DNA Sequence Number=SeqID_33955
MTKLGLCLSSALDDKRVRITGADNRKVSPRATSSWVMATKGGVVDKSEALAPTYPPMRNSDLRSSG

SEQ ID NO: 125641 - protein, 69 aa, Glycine max
  Coding DNA Sequence Number=SeqID_33956
LPSPLRGLHVLALRGLQRPHHQRAARPHHQRTTRPCLERVHALTLGTSYPHFQCEDSVHTLKNLRVLYP

SEQ ID NO: 125642 - protein, 61 aa, Glycine max
  Coding DNA Sequence Number=SeqID_33957
MELVNRIGGFTVLCDVSCINESANARGEAVCVLGALPVPRSLTRCARSFGCGERYQLTQRR

SEQ ID NO: 125643 - protein, 77 aa, Glycine max
  Coding DNA Sequence Number=SeqID_33958
MPNNYLKGIINSALKGLDDTPQPKSKAGARQKGSTECDYYVMHWMSTIILGSFRNNWETYFNDVRQLEAERLKALRI

SEQ ID NO: 125644 - protein, 74 aa, Glycine max
  Coding DNA Sequence Number=SeqID_33959
MEKNEEITIEEKVKQKINGASMRSFNGDFPPWRCSRRQRRRGERRCQPLGNKPWKKELHHQDEPWIRSLERMLQ

SEQ ID NO: 125645 - protein, 79 aa, Glycine max
  Coding DNA Sequence Number=SeqID_33960
  Gene Ontology: Mol. function=aspartic-type endopeptidase activity; Biological process=RNA-dependent DNA replication
  Homolog annotation: Hit_ID=Q6WAY3; Match level="QueryCoverage=59%, HitCoverage=2%, E-value=7e-09, Identity=53%"; Hit description =Gag/pol polyprotein
MAPDRMQLSNMCKNEHKSFKEYTQRWRDLATQVAPPMTEKEMITMIVDVGFPLQLLFGLLFLYTNMFKGNLPKLLNLDP

SEQ ID NO: 125646 - protein, 177 aa, Glycine max
  Coding DNA Sequence Number=SeqID_33961
MASKNRKAPFTPIQARFDRSRFTSLEAWERYTDIVVPRKLLPERNVVVYYIEFDEFKEELERRHWDEKLADFSDSSIDIAIVKEFYENLYDPDDKSPKQVRVRGHLVKFDEDTFITFFKTPIVLEEGENLCTYSRFALLRPDPQELATKLCIPGRGFELIADGQPLKILRKNMTTLA

SEQ ID NO: 125647 - protein, 105 aa, Glycine max
  Coding DNA Sequence Number=SeqID_33962
MKTARTKIDVYAGTFSMEFGDIVVHFNILDAMKHPSEDHSIFLAEIIDQIVDDYMFDFDSVLHGVVPLDVDFLESECTNHVAGSTYIFDLLYEVQARESSSSHTL

SEQ ID NO: 125648 - protein, 104 aa, Glycine max
  Coding DNA Sequence Number=SeqID_33963
MLNTCKSEPLFSGSWAEGKEAPSVKVACLAQEVGTVENKVANGCVMRGNLPNSSGQILKKAKKRCLMSLRSISHTGTETRPGLPRGAAVGNLGQWAKARSSNIA

SEQ ID NO: 125649 - protein, 70 aa, Glycine max
  Coding DNA Sequence Number=SeqID_33964
IPGSARSAPAEKALSPYSNKLGCWIRDPRSRLDQHPAERGQPLEATSEKWLDEPFRSPRTGPIHLLIVEA

SEQ ID NO: 125650 - protein, 92 aa, Glycine max
  Coding DNA Sequence Number=SeqID_33965
MSVLELYVEKEVAGGSMFHAANSVTSCGHNESHHESELPRNISNLHDDDDYLASNSYVEESFDEDDSVDGISDTDDEVTDIIEPVSIVHPTE

SEQ ID NO: 125651 - protein, 209 aa, Glycine max
  Coding DNA Sequence Number=SeqID_33966
  Subcellular localization annotation: CTP_CleavageSite=60; ConfidenceScore=5.68e-01
MFSFSVEKPSGPFGPANLFRSPMNCVFVHVSSTFDFGAMRSDCLVQFSILTLFRSPMNCVFVHVSSTFEFGAMRSDCLVQFSILTLFRSPMNCVFVHVSSTFEFGAMRSDCLVQFSILTLFRSPMNCVFVHVSSTFEFGAMRSDCLVQFSILNLFQSPMNCVFVHVSSTFEFGAMRSDCLVTFSILTLSGAHELRFCSCVLHLRVWSHA

SEQ ID NO: 125652 - protein, 133 aa, Glycine max
  Coding DNA Sequence Number=SeqID_33967
MASGKRKSTASKPQAQYDTRRFHSLDTWNRYTDNILGRNILPKRNAQIYHTEFDEFKVELERRNLHECLTNLQDGCIDVVVVKEFYANLYTTEELRTNPQEIDARLCIPHKGFVLNAEGQPWKLLRKDLMTLA

SEQ ID NO: 125653 - protein, 87 aa, Glycine max
  Coding DNA Sequence Number=SeqID_33968
MSGLTRDSPQIPGSPHQLDLAPYASRHYNAQWNTPGLLHDKHTLCLSRILGEMEVDEPWLGLWLPLNYQVDMGVVFVIGSAVDRLYG

SEQ ID NO: 125654 - protein, 99 aa, Glycine max
  Coding DNA Sequence Number=SeqID_33969
CGVATENNGGLWWLMVALGEVESAWDIRNGFGRKKEEEMVFLLSYTKAKAENAQVRNGLGHRNVAHTPDIFSTIPTAAHVASSRSFIKRLPQEASSWLL

SEQ ID NO: 125655 - protein, 282 aa, Glycine max
  Coding DNA Sequence Number=SeqID_33970
  Gene Ontology: Mol. function=peptidyl-prolyl cis-trans isomerase activity; Biological process=protein transport
  Homolog annotation: Hit_ID=Q7WK84; Match level="QueryCoverage=100%, HitCoverage=64%, E-value=1e-144, Identity=93%"; Hit description =Trigger factor
  Pfam annotation: Domain name=FKBP_C; Domain location=1-86; Score =88.1; E_value=2.8e-23; Accession=PF00254.19; Description=FKBP-type peptidyl-prolyl cis-trans is
  Pfam annotation: Domain name=Trigger_C; Domain location=87-259; Score= 155.2; E_value=1.7e-43; Accession=PF05698.5; Description=Bacterial trigger factor protein (TF) C-terminus
  Pfam module annotation: Pfam domain module=FKBP_C::Trigger_C; Domain location=1-86::87-259
REGRASQDGDRVTLDFAGTIDGVPFDGGKAEDFPFVLGQGRMLPEFEEAARGLKAGESKVFPLKFPDDYQGKEVAGKTAEFTITVKEVAEGVLPELNAEFAKSLGQAEGDIEKLKADIRSNIEREVKVRSQGRTKASVMDALVEAGKFDVPKALVDNDVQSRIAAAREELKQRGVPNAESVPIPAEAFSTESERRVRLGLLVSELVKQAQLQAKPEQVRARIEEFAENYEQPAQVVSYYLADRQRRAEIEAIVLEDNVVAHVLEKAKVTDEKVPFDQLMGMA

SEQ ID NO: 125656 - protein, 125 aa, Glycine max
  Coding DNA Sequence Number=SeqID_33971
MALARDFCKETTHGAFWFVHSFYFWNMYSFPKKARVLEIPRGAHVKFLVPQNALSMHEWPRGSLPQRGPGRTRRPKELVPLRSTTVTALGALYTSSASKPSRDGRFSGSDASSSGTTSILIFRRK

SEQ ID NO: 125657 - protein, 111 aa, Glycine max
  Coding DNA Sequence Number=SeqID_33972
  Homolog annotation: Hit_ID=Q53KJ4; Match level="QueryCoverage=43%, HitCoverage=6%, E-value=6e-07, Identity=56%"; Hit description =Transposable element protein, putative
AERRRKLLQDRAVASILEEETHFSDLLSPDSPSSRESNTQLPEVITVAEEHNQRITLEDYSRKLFQGLPNEEPYAHLAMFIEICNTVKIASVPDEAIRLSLFSFSLAGEAK

SEQ ID NO: 125658 - protein, 79 aa, Glycine max
  Coding DNA Sequence Number=SeqID_33973
STECLSPPARSSGLLLTGAFIKKCAPRQAQGETPQQSGDGRQRAIDAPPPPPEPLSSSKKVGAWPTTRGRPTGDQVQSQ

SEQ ID NO: 125659 - protein, 52 aa, Glycine max
  Coding DNA Sequence Number=SeqID_33974
IRPSKVGMIPLSGIVPVAGEHKLQAVQLLQIVAQKGKGDGSLLVELLWRLDL

SEQ ID NO: 125660 - protein, 105 aa, Glycine max
  Coding DNA Sequence Number=SeqID_33975
MTETSMQAGNTDVYGFLEPQSIQRSGQSQFESESYIKNWMQNSKWDVYLYGAYWQMVVILPKENVVIWFCSLHNKPDNYLKGIINSVLKELDDTQQILCRLRGSL

SEQ ID NO: 125661 - protein, 149 aa, Glycine max
  Coding DNA Sequence Number=SeqID_33976
MFPFDSRHVAELNGLPNDGCQVPRSGQVKGKAINSWGSRYDGGGCMNSARQSIHGAPDSMAINSSGSGLDGGGCMNSARQSIHGAPDLMVEDARTAQGNQFMGIRTQWWRMHEQRLAINSWGSRLDGGGCMNSARQSIHGAPDLMVENA

SEQ ID NO: 125662 - protein, 58 aa, Glycine max
  Coding DNA Sequence Number=SeqID_33977
  Subcellular localization annotation: CTP_CleavageSite=25; ConfidenceScore=5.22e-01
MVFGASAASVKFPKTLEKSKSKYFRNASVSDYVEILHRSSSFFTVLHPFFVRSSFFNG

SEQ ID NO: 125663 - protein, 35 aa, Glycine max
  Coding DNA Sequence Number=SeqID_33978
MRLLARQMALRRVCASRRFEWGRRHLRRMRESGRI

SEQ ID NO: 125664 - protein, 101 aa, Glycine max
  Coding DNA Sequence Number=SeqID_33979
  Subcellular localization annotation: CTP_CleavageSite=29; ConfidenceScore=5.39e-01
MPSLGTDVWGADTFPVRKYNSRTFHLKVRRSRLFRFFRRFPQINVGGDSARIPFVEHASRESRVALPPKGRFGKMMIWKLHAKLVMHAPMWTLKCQTFMVM

SEQ ID NO: 125665 - protein, 130 aa, Glycine max
  Coding DNA Sequence Number=SeqID_33980
GPYNQQGQWRSHPGNQFNKDYGGPSNRPIQQGPNIFQRTTKLEETLTHFMQQITDKSSNSFVANTKRNPKEECKVVMTRSKRFVEAEDEESGMHKKKAAEKKGVEGKRKDVRGESNQEKEKQRMVKKKRI

SEQ ID NO: 125666 - protein, 52 aa, Glycine max
  Coding DNA Sequence Number=SeqID_33981
DCHHQKGGDCGSNAFQDYFHDAKESRVNQVSRIKIQEQSRSRFKNQEKTQSR

SEQ ID NO: 125667 - protein, 134 aa, Glycine max
  Coding DNA Sequence Number=SeqID_33982
MEAIKEQMATMMKAMMSMKKIMEANAVIVAAISAVAKVNPMLPSSLKEMNHPTSNMVGKDLGSTDDPMMCKFKTSTPSHHMACLSTIRHPKWRTLPIRMSITPLLYPLKASNPKLIMHMSLKPWKRPMKFPITI

SEQ ID NO: 125668 - protein, 100 aa, Glycine max
  Coding DNA Sequence Number=SeqID_33983
HFPFPQKPRAVSVKLRSGFVNRWIFMKFGYVVRNSISHVFSVGICEIIFMEGENKSHGDSISGGFNPFSVSLTFRNSIEAARGKKLEESQRTARDAAIAG

SEQ ID NO: 125669 - protein, 179 aa, Glycine max
  Coding DNA Sequence Number=SeqID_33984
  Gene Ontology: Mol. function=aspartic-type endopeptidase activity; Biological process=RNA-dependent DNA replication
  Homolog annotation: Hit_ID=A5CAG9; Match level="QueryCoverage=94%, HitCoverage=8%, E-value=7e-10, Identity=28%"; Hit description =Putative uncharacterized protein
MVEGFSQGSVPIILGRPFMKTARTMIDVYACTLSMEFGDITVHFNILDAMKHPSEDLSIFHAKIIDHIVDEYMTDLHSNLHACHSSCIESEFVLDHMSEFDAESKFEIDIDYMFGDVLPLEIDFLVSDRTNHVAGSTYTSDFLYEVETEKPSLSTTIQSSTAELKPLPSNLQYAYLDDS

SEQ ID NO: 125670 - protein, 172 aa, Glycine max
  Coding DNA Sequence Number=SeqID_33985
  Homolog annotation: Hit_ID=UPI00016621D1; Match level="QueryCoverage =66%, HitCoverage=40%, E-value=3e-11, Identity=37%"; Hit description =UPI00016621D1 related cluster
GLHAYAFRGLHALTFRGLHVLAFRGLHVLAFKGLHVLTFRGLHVLAFRGLHVLTFRGLDAYAFRGLHTLTFRGLHVLTIRGLHALTFRGLHVLAFRGLDILTFRGLHVLPFRGLRALTFSGLHSHTLREFKFPGHPLILEERPTVLAQPEREAIAQLLCIPGQDFTRATAKR

SEQ ID NO: 125671 - protein, 195 aa, Glycine max
  Coding DNA Sequence Number=SeqID_33986
  Gene Ontology: Cellular component=mitochondrion
  Homolog annotation: Hit_ID=Q6R9A5; Match level="QueryCoverage=29%, HitCoverage=51%, E-value=3e-27, Identity=96%"; Hit description =Putative uncharacterized protein orf111-b
FWPYLAGDDDVELAAEKDSAFSDILEEGGDDVKSAWPLWAGPHTCYNGNYNGKQGCKAERIRKDCLSSDCSLQLGNMKLESLVIADQHAAVNMYPGPVHTARHTLGIGFARSIGPMITHDFCVPLVAVGEPVAGWNPSRWKSPLPPTGLACWNAGFGSKGHRGRVKKIVPFSLPVEHFVPSCSSIGNQARQTGHY

SEQ ID NO: 125672 - protein, 24 aa, Glycine max
  Coding DNA Sequence Number=SeqID_33987
KINSVIDDTKLMHSSTAAAAGGAD

SEQ ID NO: 125673 - protein, 111 aa, Glycine max
  Coding DNA Sequence Number=SeqID_33988
  Gene Ontology: Mol. function=sodium channel activity; Cellular component=integral to membrane; Biological process=sodium ion transport
  Homolog annotation: Hit_ID=A9ZLE9; Match level="QueryCoverage=46%, HitCoverage=100%, E-value=4e-15, Identity=75%"; Hit description =Putative uncharacterized protein
KKLVVGPWVGSIGPPPVCTGRLVPSAGDALLYLTGRVVPPQGITPQDSDPIVLAFEIGVMINRDSRGHSYFIVRGEILGFMKDEQLRKHLPRMFSLIKNESWGLEDDQIPS

SEQ ID NO: 125674 - protein, 69 aa, Glycine max
  Coding DNA Sequence Number=SeqID_33989
  Homolog annotation: Hit_ID=A6FJQ2; Match level="QueryCoverage=55%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLAAYLPQRMRIVLDIRAQQMCISI

SEQ ID NO: 125675 - protein, 246 aa, Glycine max
  Coding DNA Sequence Number=SeqID_33990
  Gene Ontology: Mol. function=sorbitol-6-phosphate 2-dehydrogenase activity; Cellular component=cellular_component; Biological process =metabolic process
  Homolog annotation: Hit_ID=A8GHS8; Match level="QueryCoverage=99%, HitCoverage=94%, E-value=1e-114, Identity=87%"; Hit description =Short-chain dehydrogenase/reductase SDR
  Pfam annotation: Domain name=KR; Domain location=4-176; Score=-96.1; E_value=0.091; Accession=PF08659.1; Description=KR domain
  Pfam annotation: Domain name=adh_short; Domain location=3-173; Score =90.9; E_value=4e-24; Accession=PF00106.16; Description=short chain dehydrogenase
  Pfam module annotation: Pfam domain module=KR::adh_short; Domain location=4-176::3-173
MSEVAVVIGGGQTLGAFLSHGLAQAGYRVAVADLNADNANQVAQQINEAFGAGSACGFQADATDEQSVIALAAAVDRAFGQANLLVYSAGIAKAAPITDFPLGDFDRSLQVNLVGYFLCAREFSRLMIRDGIAGRIIQINSKSGKVGSKHNSGYSAAKFGGVGLTQSLALDLAEYGITVHSLMLGNLLKSPMFQSLLPQYAQKLGIAPDQVEQYYIDKVPLKRGCDYQDVLNTLLFYASDKASYCI

SEQ ID NO: 125676 - protein, 91 aa, Glycine max
  Coding DNA Sequence Number=SeqID_33991
  Subcellular localization annotation: CTP_CleavageSite=38; ConfidenceScore=5.52e-01
MPITPCKSISWSVSSRHGDRTHKTPSGPGKVQQGPGVSSSGYGPLSVLQGARTPPPASKGIRPPTDRAFIKKYCVPRQAQGETPQQHWDGR

SEQ ID NO: 125677 - protein, 213 aa, Glycine max
  Coding DNA Sequence Number=SeqID_33992
  Gene Ontology: Mol. function=transporter activity; Cellular component= integral to membrane; Biological process=transport
  Homolog annotation: Hit_ID=A3HY83; Match level="QueryCoverage=99%, HitCoverage=20%, E-value=7e-38, Identity=41%"; Hit description =Multidrug resistance protein, putative
MIIKQEGESIIRFRDLGYAELGAENERTAILNSLKGNSATIGVFVEPQRGANAVAIADEFYKRLQELRKEIPKEYELTIGKDFTEPIRASISEVEETLFIAFGLVILILFIFLRDWRSTIIPVVAIPVSIISAFFIMYFAGYSINILTLLALVLAIGLVVDDAIVVLENIYAKVEEGMSPLEAAFKGSSEIYFAVISTTITLAAVFLPILFLP

SEQ ID NO: 125678 - protein, 73 aa, Glycine max
  Coding DNA Sequence Number=SeqID_33993
  Subcellular localization annotation: CTP_CleavageSite=43; ConfidenceScore=5.46e-01
MFVRKKWPRGSLPQRGPGRIKRPKEPVPLPSMTATALGALNTSSASRPSRGGHFSGSDASSSGTMSIPISRRR

SEQ ID NO: 125679 - protein, 210 aa, Glycine max
  Coding DNA Sequence Number=SeqID_33994
  Gene Ontology: Mol. function=nucleic acid binding; Biological process= DNA integration
  Homolog annotation: Hit_ID=A5AMN2; Match level="QueryCoverage=87%, HitCoverage=19%, E-value=1e-14, Identity=27%"; Hit description =Putative uncharacterized protein
MMFYLTMRKVAYVLNTDIPVVLEDAEKEVKDKMTMELALWNENDYLCKNFILNGLADDLYDYYSLYKSAKLVWLALEKKYDTEEAGTKKYQRVSYQRDFKNLLRHKTKEFSLESLITRLRIEEAARRQDQKDEVLVVSHNNTKRKNTGAVLKPIGKNFKNQNRNVSNTSNRNKNPQGSNMLDNIHLPRIIPVSHSSATIMANRDIWHVNA

SEQ ID NO: 125680 - protein, 249 aa, Glycine max
  Coding DNA Sequence Number=SeqID_33995
AACMISCDGGECDECLFHLGESHDMETCPAVEELLQRLMDWGQLEVSKGDKEEPQICMQSAERKIPPTPKALVIRFTRNVTGSRSKYPPTAPKPTPFSYQSNKVVPWKYTHPALGERAVTKVDSLSAKETNTTTLSAVTRSEAEKKEGLQGKAVTLEEAHEFLRLIQQSEFKVVEQLNKTLVRILMQSYPARALGRRLQVDWARDPREGPRVLMSLREVSLAIRELLKEVFSKKLLKEVFSRKLLKEAT

SEQ ID NO: 125681 - protein, 17 aa, Glycine max
  Coding DNA Sequence Number=SeqID_33996
MDTRLRVIGDPMNRVQR

SEQ ID NO: 125682 - protein, 188 aa, Glycine max
  Coding DNA Sequence Number=SeqID_33997
  Gene Ontology: Mol. function=aminoacyl-tRNA hydrolase activity; Cellular component=cytoplasm; Biological process=translation
  Homolog annotation: Hit_ID=A8GD97; Match level="QueryCoverage=100%, HitCoverage=95%, E-value=1e-93, Identity=89%"; Hit description =Peptidyl-tRNA hydrolase
  Pfam annotation: Domain name=Pept_tRNA_hydro; Domain location=1-182; Score=325.9; E_value=7.5e-95; Accession=PF01195.10; Description =Peptidyl-tRNA hydrolase
GLANPGAEYAQTRHNAGAWYVDLLAQRHNQQLKEESKFFGYTARLNLAGNDVRLLVPTTFMNLSGKAVLAMANFYRIEPNEILVAHDELDLPPGVAKIKLGGGNGGHNGLKDIQNKFGNNPNFYRLRIGIGHPGDKNKVVGFVLGKPPASEQKMIDEAIDESLRCTEMLMKDGLEKTVQRLHSFKAQA

SEQ ID NO: 125683 - protein, 50 aa, Glycine max
  Coding DNA Sequence Number=SeqID_33998
SSSSFLSKAILGGEAPSSLAYSLVDASIEAPQASFHQVVIRAQELQVGAP

SEQ ID NO: 125684 - protein, 121 aa, Glycine max
  Coding DNA Sequence Number=SeqID_33999
MEKEMITMIVDTLPMFYYEKMLGYTPSSFADLVFAGGERIEVGLKRGKFDHPTLMNKKHGANGENKKEGGTHVVTAIPTWPNFPPAQQCQYSAKNTQSSTKATPKSATKPACRTSDTKHHP

SEQ ID NO: 125685 - protein, 97 aa, Glycine max
  Coding DNA Sequence Number=SeqID_34000
MYKLILPPFSQAGQEERRQHFHSFLKLFQVFLSPSSIKLRDVAELWKRIEELSVALSMISSLSTSGPLSPRSPLSARCQPGGQLRASSGLVCMHLAA

SEQ ID NO: 125686 - protein, 75 aa, Glycine max
  Coding DNA Sequence Number=SeqID_34001
MPMLDQFHPCIHDSIENIVNVKADELAKWSDEYINLLGGIDRFEELKRSLLVDGLSMVTMNKWMNITDMGYVIAS

SEQ ID NO: 125687 - protein, 142 aa, Glycine max
  Coding DNA Sequence Number=SeqID_34002
MEKSDKMNFKEKKEKKGYITWEDNVINYSSDSEKKIISLGIMMKDYENGEEQSRYIDSNFSKHMACIKQTKATFLPKKSEYVIYGDNKQRPLDQQPQQVISNDTNSWKLEVVIGSSKVKNGSWKLEVEVTGSWKLEMKVIGS

SEQ ID NO: 125688 - protein, 126 aa, Glycine max
  Coding DNA Sequence Number=SeqID_34003
MTRCTGQSVLRMTLYQCNRKSHVGYIHPLMHEGKLLGESKVIQRCFDDNNDDDKGDDKKIKDQSKNNSSESRTIQEFKIRIKKNSRTQEESQETRINIQGSRSQESRSRFKTQDSRIKRRLNQDKY

SEQ ID NO: 125689 - protein, 133 aa, Glycine max
  Coding DNA Sequence Number=SeqID_34004
MERSMIDAASSGALGDMTPAEARNLIEKMASNSQQFSARNDAIIIRGVHEVVTDSSSSTKNKKLEGKLDALVNLDQKSAPVARVCGWRNHPNLRWTSPPQQQQPVPPFENVVGPSKPYVPPPMQQQQQQSQQR

SEQ ID NO: 125690 - protein, 65 aa, Glycine max
  Coding DNA Sequence Number=SeqID_34005
MAGQRRVGADEDKERESAVCKNRLLLTRSPPPLHLLPSDLQKLSRYQRVKEVIPAIYLAFRCPLD

SEQ ID NO: 125691 - protein, 110 aa, Glycine max
  Coding DNA Sequence Number=SeqID_34006
MVVLRLVSTERNKFDSIEMMFRWQERSLAKRCFVRMKLASYLYFPFISNKRQVKKGNCHTQISSRDHSLLGCDPRLTTSRYLAPIVRQFVKFRDMSEVKRKHCSTIREIP

SEQ ID NO: 125692 - protein, 248 aa, Glycine max
  Coding DNA Sequence Number=SeqID_34007
  Homolog annotation: Hit_ID=A4PP05; Match level="QueryCoverage=66%, HitCoverage=46%, E-value=6e-17, Identity=34%"; Hit description=IMP dehydrogenase/GMP reductase, putative
  Pfam annotation: Domain name=DUF1723; Domain location=1-46; Score =40.3; E_value=7e-09; Accession=PF08330.1; Description=Protein of unknown function (DUF1723)
GVISAFVERWHKETSSFHLPVGELTITLDDVASLLHLSIIGTFHSFEPLHVDEAVLMLVELLEVSGPTLDCYNSCVSPTLVSGSYAWGAAALVHMYDHLNDACKSGGRQLAGYITLLQCWIYDHFPSVHESVTDPEYDETSPRAYGGLLRRLIRRDSQHQRTGHGELRWGPIVVTHRPERVVRQFGYVQTIPPLPTGASLSFEDIDNRWMHYSDHLAAGGQICLVPGQCAPDYTNCFFRISHPFITPT

SEQ ID NO: 125693 - protein, 58 aa, Glycine max
  Coding DNA Sequence Number=SeqID_34008
MAFAQTYLIRKIRRLYLAVSLPKEGSPVSKALDIDVRGIIDLSFQTNKVGKVRTLVPQ

SEQ ID NO: 125694 - protein, 65 aa, Glycine max
  Coding DNA Sequence Number=SeqID_34009
MAVVGTTGSYGGHDGEFSKTGDEVLNQYGNTSIYSTKFTTVYKQHRLCILLFLRRCLPKAPSSIS

SEQ ID NO: 125695 - protein, 120 aa, Glycine max
  Coding DNA Sequence Number=SeqID_34010
MTDLVSAEDDVNLCVSTGLSAAIDERRRRRCQSSHAIRHFVLQTAKKNVYTDNHSGISARQRDSKTAKKNVYTDNHSGISARQRDSKVSMIDPVSADVDVNIRVSTGLSAAIDEGRRRRR

SEQ ID NO: 125696 - protein, 85 aa, Glycine max
  Coding DNA Sequence Number=SeqID_34011
  Homolog annotation: Hit_ID=A6FJQ2; Match level="QueryCoverage=44%, HitCoverage=84%, E-value=2e-11, Identity=92%"; Hit description=50S ribosomal protein L5
MTVNTSDTCSSRRRSQLVCKRMPGADKPMRKEKIPHQAPFAIQAAQLLGRAIGAGLFAITPAGERGMCCKAIKLGNARVFPVTTL

SEQ ID NO: 125697 - protein, 159 aa, Glycine max
  Coding DNA Sequence Number=SeqID_34012
MAPTRHPLDPDKSNRALGFPALITGLCQSFDVPITPSKVIRPPITRAFIEKYCTQRQVPEQYLRHLVRQQAANHRAHVQTPDCLYQMSLSLQSQGFTSFPCPTLDQFRAEVAWPGDWPEAQAGEAPAGAPAEAPDEADEAREDEEMTDLLDFLGGSSAT

SEQ ID NO: 125698 - protein, 132 aa, Glycine max
  Coding DNA Sequence Number=SeqID_34013
VIACTICGEAHKIAQCFQQGPYNQQGQWRTHPSNQFNKDQSEPSNKPIQQGPNIFQRTTKLEETLTQFMQNPKEECKAVMTRSKRFVEAEDEDSVVHMKKTANKKGTDDKKNEETGNNHALWRSFAADATLL

SEQ ID NO: 125699 - protein, 387 aa, Glycine max
  Coding DNA Sequence Number=SeqID_34014
  Homolog annotation: Hit_ID=UPI00016621D1; Match level="QueryCoverage =65%, HitCoverage=40%, E-value=1e-09, Identity=27%"; Hit description =UPI00016621D1 related cluster
  Subcellular localization annotation: CTP_CleavageSite=31; ConfidenceScore=5.01e-01
IHALIFRGLHVLTFRGLHALTLKRPHVLAIRGHTSSPSEACTPSLQRTTRPRLQRNDDVLTLRGLHALIFRGLHLLPYRRLHASPSEEWTLIRGLYVHDFRGLHVHTFRGLHVLPFRGLHVHTFRGLHVLPFRGLHVLPFRGLDVQTLRGLHALTLRGLHVLAIRGPHVLAIRGFHTLAFRGLHVLRFRGLHVLAFKGLDRTDVLTFRRLHALTFRGLYVLSLRGPHVLAIRGLHALTFRGLYVLPFRGLHALAFRRLLALIFRGEHVVSFRGLHVLAIRGLHALTIRGLHILAIRGLHILTIRGLHVLAFRGLHVLAFRGLQVFAFRGLHVLTIRMLHALAFRGLYVLAFRWLYAFTFRGLDILPLRGLCVLIFRGPHVLAIRGLL

SEQ ID NO: 125700 - protein, 110 aa, Glycine max
  Coding DNA Sequence Number=SeqID_34015
  Subcellular localization annotation: CTP_CleavageSite=58; ConfidenceScore=5.33e-01
MVHDISVKAKLEVTGTSTALNVFGSRRSNDVTRSIFCPNFCKMVTFMLQLDSMNLYVKARAWFNPITQGMAILIADTSTTFHRDERLGNTHAMHGKCNYEIEMPKETSLS

SEQ ID NO: 125701 - protein, 102 aa, Glycine max
  Coding DNA Sequence Number=SeqID_34016
MDSGRFQVSVPVPLYLSKSSTLNLGGVMILGSRNNFLGVVGGDTEGLPKCFQGVYHQLLALQWHIRAKARSRLDCDGEFHMSPPRFKRHVHDQLGVAGSQWV

SEQ ID NO: 125702 - protein, 174 aa, Glycine max
  Coding DNA Sequence Number=SeqID_34017
  Subcellular localization annotation: CTP_CleavageSite=83; ConfidenceScore=5.10e-01
MSIRSTSLEPKSQLTINLALKRKQSKRRKFPIKEVTLWLPTPFVNQGANEPVDTRRLTLSPTPFIVLTREVRVTLWLPAPFINQGANEPVDAKRPTSSSAPFVIQGQRVRWFLLSSSGNIQAQRRAGFFSARQRRSGTMVKEVSWLSNFVDAFWWKQPSSLGRAGRQPPPSFPL

SEQ ID NO: 125703 - protein, 117 aa, Glycine max
  Coding DNA Sequence Number=SeqID_34018
MNFKEKKEKKGYITWEDNVINYSSDSEKKIISLGVMMKDYENGEEQSRYIDSNFSKHMACIKLEVESYKWKLEVGSSYWKLKVINESWKLEVEVTGSWKLEMKVTGSWKLEMKVTGS

SEQ ID NO: 125704 - protein, 145 aa, Glycine max
  Coding DNA Sequence Number=SeqID_34019
MVELLRTNSTNISQKKYGKTENSKQYPPLQRHAFVKWWSQFDTSKAAPDQVKNWFQSNPEFLKPADPETSLFLNQKSQLAAFLASSKSKESLAQNLKEVLQLLQQEVEEEPSKKEAESSETNDDQEDDSFYQNEDDCFGISLDDD

SEQ ID NO: 125705 - protein, 322 aa, Glycine max
  Coding DNA Sequence Number=SeqID_34020
  Homolog annotation: Hit_ID=Q6WAY6; Match level="QueryCoverage=68%, HitCoverage=40%, E-value=9e-11, Identity=25%"; Hit description =Putative uncharacterized protein
AINWFPRWKEGKEGVLFSCGDYPNVPLIGTRGCINYNPALAIRQLGYPMRGAPTKESLSPFLVRDVGAQSLKVIQRVHKAGRSPLRKDKELRGIRNGVIGGYHGWLRVHTRGLDWLSKLKVIDEENFEAPEEDEEVRALKLELGKARLAKEKFKSAATHIRKESTELQEENAATARALEQETKRVRKEEHGREKFRGALWGSNNELKLRREKETGHGSKRSLAQHLEATEQSMLAIIGKYKEELNQSVTHEQKLAEDFAQVYAEKEARGRVIDVLHQEATMWMDRFALTLNGSQDLPRLLAKAKAMAEKPLGSLVTPLYNLG

SEQ ID NO: 125706 - protein, 59 aa, Glycine max
  Coding DNA Sequence Number=SeqID_34021
  Subcellular localization annotation: CTP_CleavageSite=19; ConfidenceScore=5.33e-01
MASYGVVSPLSLPSPFLCHSSSKKQRNPLMKKILGLQAPMELTSPQMQGLIAKRLRLTA

SEQ ID NO: 125707 - protein, 82 aa, Glycine max
  Coding DNA Sequence Number=SeqID_34022
MERQYFCRPTEEQTVMLKIHHGGMFIYQPFTLYINGQIEEEEWGWDVDTMSYIDFKKKINFLGYKSFMCLWYKDPRKALSRG

SEQ ID NO: 125708 - protein, 40 aa, Glycine max
  Coding DNA Sequence Number=SeqID_34023
MTHCNRLQVLVIDYRPNKPSGCLFMCNRLHWMVIDYQSLS

SEQ ID NO: 125709 - protein, 134 aa, Glycine max
  Coding DNA Sequence Number=SeqID_34024
  Homolog annotation: Hit_ID=UPI0000ECBAF8; Match level="QueryCoverage =30%, HitCoverage=48%, E-value=1e-16, Identity=100%"; Hit description= UPI0000ECBAF8 related cluster
NRKSAQYANRLSPRVGRFSNAAGTTGFPTGKRAVSATQLIYDHDYEFELGTLHSALLAHSGTSSQVYQYLCGSKVYTLLFSGMQAWHWPSFYNVVTGKTLALPNLIALQHIPLSPAGVIAKRPAPIALPNSCAA

SEQ ID NO: 125710 - protein, 98 aa, Glycine max
  Coding DNA Sequence Number=SeqID_34025
MKLAKYSLKAQVEKDEGPSGEGQSPQVEKGNPCGVYPDLSSFIGSGVYPDLSSFTGSGVYPDLSSFMGSGVIQIFVACIKRSAPTQVHISECFVENLK

SEQ ID NO: 125711 - protein, 335 aa, Glycine max
  Coding DNA Sequence Number=SeqID_34026
  Gene Ontology: Mol. function=aldehyde dehydrogenase (NAD) activity; Cellular component=cytoplasm; Biological process=metabolic process
  Homolog annotation: Hit_ID=Q6F9F7; Match level="QueryCoverage=98%, HitCoverage=67%, E-value=1e-115, Identity=63%"; Hit description =Putative aldehyde dehydrogenase
  Pfam annotation: Domain name=Aldedh; Domain location=12-335; Score =312.7; E_value=6.7e-91; Accession=PF00171.13; Description=Aldehyde dehydrogenase family
MESFDLYIDGVFERGAARFSSLNPATAQPWAEIAEAREEEVDRAVAAAKRAFYDPAWRGLTASARGKLLMKLADLVEQNADELARLETLDSGKIIRETRSQIAYVAEYYRYYAGLADKLEGRTLAIDKADTETWTRREAVGVVAAIIPWNSQLFLSAVKIGPALAAGCTIVVKAAESAPTPLLAFARLIADAGFPAGVCNVITGFAGTCGTRLTTHPDVDHIAFTGGPETARHIVRNSAENLSKTTLELGGKSPFIVFEDADLDSAANAQVAAIFAASGQSCVAGSRLLVAESVKEQLLEKLVERVKRIVIGSPDDAATQFGPLCTERQRAHRAV

SEQ ID NO: 125712 - protein, 173 aa, Glycine max
  Coding DNA Sequence Number=SeqID_34027
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPDRCALSGNYRLEFNP

SEQ ID NO: 125713 - protein, 106 aa, Glycine max
  Coding DNA Sequence Number=SeqID_34028
  Homolog annotation: Hit_ID=A6FJQ2; Match level="QueryCoverage=35%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPSHDVVNDGQCQACMHAGRL

SEQ ID NO: 125714 - protein, 248 aa, Glycine max
  Coding DNA Sequence Number=SeqID_34029
MAPRKLASKRSRKDKAAEGTSSAPEYDSHRFRSAEHQQRFEAIKGWSFLRERRVQIRDDEYTNFQEEIVCRRWASLVTPMAKFDPDIVLEFYANAWPTEEGVRDMRSWVRGQWIPFDADAISQLLGYPLVLEEGQECEYGQRRNRSDGFDEEAIAQLLCIPGQDFARTAAGRWVRIMRTNMTTLTQIWMTLLLSNILPSDHNSDLPLPKCQLVYAILTRMSIHVAQLIADAIYTFEALAPTRHPLDPD

SEQ ID NO: 125715 - protein, 173 aa, Glycine max
  Coding DNA Sequence Number=SeqID_34030
GLHVLALRGLHVLAIRGLHVLAIRGLHALTSRGLHVLALRGLHALTLGTSYPHRQRAARPHLQRTTRPRLERTTRPHHQRAARPYLQRTTCPRLERATRPHLGGLHVLAFKGSCTFNFRGLHVLAVKGSCALHLCRACPHLQRIARPCHHRTTLPRLRKATRPELQRATRPRL

SEQ ID NO: 125716 - protein, 206 aa, Glycine max
  Coding DNA Sequence Number=SeqID_34031
MHGGPLHLPVERHPGDGGHQRGDDRIARCQAARQQIGQQHDQHQGQRIPGGGKGLHAEVGQYARQEGGSDFHGDAVHDALEPACGSHQDDQPRADDEGANGLAHGKAPGKPCRGKDGCAWRGPGDHDRHAQYQRGQQRAQAHAQSQRPDPGRDLLGRGMEGLGGLKDQGHRAGEAHEHGHEAGCEGRGTQVTEKAHRAILSPQPPT

SEQ ID NO: 125717 - protein, 272 aa, Glycine max
  Coding DNA Sequence Number=SeqID_34032
HKAWESPLRKDKELRGIRNGIIGGYHEWLKVRTRGLDWLSKLKIIDEESFEAPEEGEEARALKTELGKARLDKEKFKLVATDVRKECAGYEKKMQLPQEPLNKKPRGLARKSMAVTNFVELYGAATVSSSFEGKRDTNHVAHSMVLKEELATCSRSKRSLSQRLCETETNMLAIVSKYQEELNLATAHEHKVADDYARVYAEKEARGRGDRLVTSRGNNVDGPICSYFEWESRTSPIASQGQSDGGHLLRPRGDPRSYQLLSAYDRFNGPYN

SEQ ID NO: 125718 - protein, 57 aa, Glycine max
  Coding DNA Sequence Number=SeqID_34033
MWMDRFALTLNGSQELPRLLAKAKAMANTYSALEEIHRLLSYCQHMIDLMAHEKRHN

SEQ ID NO: 125719 - protein, 58 aa, Glycine max
  Coding DNA Sequence Number=SeqID_34034
MRPHFLVLMGDYLLQLWGKSHIFVLFILRLIRSLLEIDGRVPGITTFEGLVVGSGVLN

SEQ ID NO: 125720 - protein, 36 aa, Glycine max
  Coding DNA Sequence Number=SeqID_34035
MEGGQEVLKVHDAKRQSWQLSEIHCGNVSAKRVHLS

SEQ ID NO: 125721 - protein, 100 aa, Glycine max
  Coding DNA Sequence Number=SeqID_34036
  Subcellular localization annotation: CTP_CleavageSite=86; ConfidenceScore=5.30e-01
ASEPVDAKRLTSSFAPFAIQGQRVRWQAKIPYGHPFLLSSSGNIQAQRRARFFSAGQGRSSPMAKGSVVDVPKKAMPSGGSNPACLAELSGNHLPLFSYK

SEQ ID NO: 125722 - protein, 70 aa, Glycine max
  Coding DNA Sequence Number=SeqID_34037
MWAIIDQYKEKLSLAVAHEQRLEEEYAKVRLYFEWESRASSTASQGQANGGCVLGSRGGSRAPQLLPTHD

SEQ ID NO: 125723 - protein, 218 aa, Glycine max
  Coding DNA Sequence Number=SeqID_34038
  Homolog annotation: Hit_ID=Q84VI1; Match level="QueryCoverage=89%, HitCoverage=33%, E-value=7e-68, Identity=65%"; Hit description =Envelope-like protein
MDKKIRSIVSSILKDASVPDAEKDVPTSSNTNVSVPDVKKDVPTSSGPNAEVLSSPSKERSTEEDDQATKETPAPRAPEPAPGDLIDLEEVESDEEPIANRLAPGVAERLQSRKGKTPIKRSGRIKTMAQKKSTPITPATSRRSKVAIPSKKRKEISSSDSDEDVELDVSTSKRARNLEERLAVERELGRTALDCKGDHGPHQGCWTTEDSHQVGRLL

SEQ ID NO: 125724 - protein, 87 aa, Glycine max
  Coding DNA Sequence Number=SeqID_34039
MKSGGRQRYPSGYPYKNFPLILTREVRRQAEIPKWWRYPSGYLYKRFILILTREVRWQAKIPEWLSVQRRLLLILTREVRRQAEIPE

SEQ ID NO: 125725 - protein, 64 aa, Glycine max
  Coding DNA Sequence Number=SeqID_34040
MEKKMKKQQWKRSGRQRRRGERRRHPLGNKPWKKELHHQDEPWIRSLEGCFNGGKEREKGGARN

SEQ ID NO: 125726 - protein, 203 aa, Glycine max
  Coding DNA Sequence Number=SeqID_34041
  Homolog annotation: Hit_ID=Q2AA09; Match level="QueryCoverage=69%, HitCoverage=49%, E-value=9e-08, Identity=31%"; Hit description =Retrotransposon gag protein
MIDAASGGALGDMTPAEARNLIEKMASNSQQFSARNDAIVIRGVREVATNSVASSETKKLEGKLDALVNLVTQLALNQKFVPVARVYGLCSSADHHTDLSPSMQQPGAIEQPEAYAANIYNRPPQPHNRYNPGWRNHPNLRWSSPQQQQQQPAPSFQNVAGPSRPYIPPLIQQQQQPQKQPTVEAPPQPSLEELVRQMTMQNM

SEQ ID NO: 125727 - protein, 129 aa, Glycine max
  Coding DNA Sequence Number=SeqID_34042
  Subcellular localization annotation: CTP_CleavageSite=42; ConfidenceScore=5.88e-01
MGSPPASTPPPPPPPPSSPSPPRPTHISDASASTSAVKRTHKASRLRSLSTRPPGVERPVVHVDPTTGKADGPHRKKLRTYLGIVAHDKVDITYENWKEVPTTQKDLIWEDIQDEKEVTTGRGGEMEAV

SEQ ID NO: 125728 - protein, 231 aa, Glycine max
  Coding DNA Sequence Number=SeqID_34043
IDEENFEAPEEDEEVRALKLELGKARLAKEKFKSAATHIRKECTELQEENATTARALEQETKRARKEEHGREKFRGALWGSNNELKLRREERDRSRVHGMILKEELVACARSKRSLAQHLEATEQSMLAIIGQYKEELNQSMAHEQKLIEDFAQVYAKKEARGRVIDALHQEATMWIDRFALTLNGSQDLPRLLAKAKAMAEVCTAPEEIHGLINYCQHMIDLMAHIIRNR

SEQ ID NO: 125729 - protein, 228 aa, Glycine max
  Coding DNA Sequence Number=SeqID_34044
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A6BNA0; Match level="QueryCoverage=100%, HitCoverage=30%, E-value=1e-114, Identity=89%"; Hit description=NADP- dependent malic enzyme
  Pfam annotation: Domain name=PTA_PTB; Domain location=29-228; Score =41.0; E_value=1.1e-13; Accession=PF01515.10; Description=Phosphate acetylbutaryl transferase
MDSGVATRPIEDFDAYVEKLAEFVYKTNLFMKPIFSQARKEVKRVVLAEGEEERVLHATQELVSQGLAFPILVGRPSVIEMRLKKLGLQLTPGKDFEVVNNESDPRFNEYWGEYYQIMKRRGVSQEQARRAVIGNPTLIAAIMLHRGEADAMICGTIGSYHEHYDVVKNVFGFREGAHVAGAMNALLLPSGNTFIADTYVNDDPTPEQLAEITLMAAETVRRFGIEPK

SEQ ID NO: 125730 - protein, 76 aa, Glycine max
  Coding DNA Sequence Number=SeqID_34045
  Gene Ontology: Mol. function=nucleic acid binding
  Homolog annotation: Hit_ID=A5B7I7; Match level="QueryCoverage=75%, HitCoverage=6%, E-value=5e-12, Identity=57%"; Hit description =Putative uncharacterized protein
MDLLFDMLLLSMFEHYNKDFTIVASTYDNLNSVPVLNGANFKDWKENMQIVLGCMDLDLASRIEKPFSPTDSSTSE

SEQ ID NO: 125731 - protein, 97 aa, Glycine max
  Coding DNA Sequence Number=SeqID_34046
MYPLLFSVRNPSRCTLFLYHNGCTLQCVKTKISGGRRERQKEFKRLVLGEFFLAKGEGNEKMIVHVSRLENQKPFRKLLVQEIRSSTKIKLIRIVRD

SEQ ID NO: 125732 - protein, 263 aa, Glycine max
  Coding DNA Sequence Number=SeqID_34047
  Gene Ontology: Mol. function=sequence-specific DNA binding; Cellular component=intracellular; Biological process=regulation of transcription, DNA-dependent
  Homolog annotation: Hit_ID=A4W6G8; Match level="QueryCoverage=59%, HitCoverage=55%, E-value=9e-69, Identity=87%"; Hit description =Transcriptional regulator, AraC family
  Pfam annotation: Domain name=HTH_AraC; Domain location=123-167; Score= 49.9; E_value=8.9e-12; Accession=PF00165.14; Description=Bacterial regulatory helix-turn-helix proteins, araC family
  Pfam annotation: Domain name=HTH_AraC; Domain location=70-117; Score =46.8; E_value=7.6e-11; Accession=PF00165.14; Description=Bacterial regulatory helix-turn-helix proteins, araC family
  Pfam module annotation: Pfam domain module=HTH_AraC::HTH_AraC; Domain location=123-167::70-117
PFLRTPVITARDEAHLAQFRELFAQIIEAGQAGGRYAELLAINLLEQLLLRRMEAINASLNPPLDNRVRDACQYISDHLADSQFDIASVAQHVCLSPSRLSHLFRQQLGVSVLSWREDQRISQAKLLLSTTRMPIATVGRNVGFEDQLYFSRVFKKCTGASPSEFRAALIADSFSDRNSYAGIAGTLYYPVRYVFAHRRGAGGLSGIAGARGVNPARHRDDGRAWRADWQRRGWPGSSAVCWATGSLSGWAGALRSRCTAGRS

SEQ ID NO: 125733 - protein, 125 aa, Glycine max
  Coding DNA Sequence Number=SeqID_34048
MAAQLIHDRVEMECLEGVWETLEGNARGTRTHASANCGVDITYTYSISTSRARQVIEVSSSEEDPEEDPEELPPEPAVDALDFPEGDEDPLPDVDSPEDVMSASEADSTEESGAGGIATSGDSSS

SEQ ID NO: 125734 - protein, 77 aa, Glycine max
  Coding DNA Sequence Number=SeqID_34049
MGVKYLEVVKQRLQAIKQWSPDEIRKLDFKVQTLFSRFSLSKFRSHLSLSLHSSSPTFKLLPMAFYGGKLVLDSSST

SEQ ID NO: 125735 - protein, 92 aa, Glycine max
  Coding DNA Sequence Number=SeqID_34050
MPISPCGSISWDHIHKTPREVQQGLGVSSSGYGPLLVLQGARSPQQGIAPARHLVDPEKSNRVLGFLALITDLFQFYGVPVAPSKVIRPPTN

SEQ ID NO: 125736 - protein, 245 aa, Glycine max
  Coding DNA Sequence Number=SeqID_34051
MGTRGCISYNLVLATRQLGYPMRGAPLEEELAPVISRGFNKTNMETLQKVCKAWEVVQKKDKELRGSNNGPIGGALPSLRTAKREEVEAAEEDEEVQALRTELEQAQTVKERFKSVALRIRKEKVELRDVNVATTKALEQETKRARREEHGRNKFRGALWGSNNELKLRREERDQSRVDSLILKDELKACSRSKRSLSQRLCETETNMLAIISKYQEELSLATAHEHRVADEYAQVYRKRRLEEG

SEQ ID NO: 125737 - protein, 243 aa, Glycine max
  Coding DNA Sequence Number=SeqID_34052
  Homolog annotation: Hit_ID=Q83ZQ1; Match level="QueryCoverage=69%, HitCoverage=32%, E-value=2e-11, Identity=34%"; Hit description =Putative uncharacterized protein rhc1
VASLQLVLPEQLFDTPGQVWVAQLRAGEVDRQRAEGFVVLLPGLYLAAGLLQYPVAKLQNGAVFFRQVDEMFRRHFTKGRVAPADQCFGTHQALGPEAELGLEAQAHFVALDGAAQLVLQGNAFTGLGSEVEGIGFDTVAAFGLGTVHRRVGVANQCGNVGAVLWIKADADAGAGEELMLAGLERRVEAGQQLVGDGAGVAGFVQARQQDDEFVTAQAGHGVDVAYLLLQALGDALEQQVADR

SEQ ID NO: 125738 - protein, 44 aa, Glycine max
  Coding DNA Sequence Number=SeqID_34053
MQLSACSMSDKRAETNFVPFIIQEQRAEWFRWQGVHWPNGVSLE

SEQ ID NO: 125739 - protein, 113 aa, Glycine max
  Coding DNA Sequence Number=SeqID_34054
MAPANVEDTGADIPADTGAQAAQDEHEGFPGGPSNPSVLTQYADHVACSVWTGEECPEFKLSSHGRKVHSLGRPVPAIEGLVVGTGLSPLIACSIDTGDRGLLSSFVKRWHRE

SEQ ID NO: 125740 - protein, 173 aa, Glycine max
  Coding DNA Sequence Number=SeqID_34055
AKDRRAFRDWDGWIIELGADQRSRIRVKSTFPLISGEARAEPHLAVGRSSLLGRVQTGLKGGGMKDSDLTGDSSLARANQSMGICKSRTFHKNLSDPLAVTPCPIRSSSFTPLKSYFFIDREKEWAQAHARVFDPKGIDNETRICVHYLWSGVTILNLLFPISPLPFFLFLAG

SEQ ID NO: 125741 - protein, 132 aa, Glycine max
  Coding DNA Sequence Number=SeqID_34056
MAAQLIHDRVEMECLEGVWETLEGNERCRFRGTIRLTATSLRTVEWILPAPTPYRLVEPVQVIEVSYSEEDPEEDPEELPPEPAMDALDFPEDDEDPLPDVDSPEDVMSASEADSTEESGPGGTANSGDSSS

SEQ ID NO: 125742 - protein, 108 aa, Glycine max
  Coding DNA Sequence Number=SeqID_34057
  Subcellular localization annotation: CTP_CleavageSite=45; ConfidenceScore=5.63e-01
MNLLASALHVSSTFESGTPRSYCVALFANSPFSTLFGDPMNLLPSAVHASSTNESGVPRSYCVALFANSPFSTLFGDPMNLLPSAVHASSTNESGVPRSYYVALFANS

SEQ ID NO: 125743 - protein, 78 aa, Glycine max
  Coding DNA Sequence Number=SeqID_34058
MIVKKDFMVGQKVLLYNSRLGLMSVEIKSDSTNKSFKVNGHRLKPFLTNPSLVDVVVEETSLLHPTFPTSFFAFITLV

SEQ ID NO: 125744 - protein, 104 aa, Glycine max
  Coding DNA Sequence Number=SeqID_34059
MHSLKYARVIRPYEMLLNQAHAFTKRKEHALRCPYRTRARARVMGEVEEVQEQMKADMEAMKEKMATMVEAMMSMKKIMEANTVAVAATSAVAKVNPMPPSDLN

SEQ ID NO: 125745 - protein, 41 aa, Glycine max
  Coding DNA Sequence Number=SeqID_34060
MAFVDNWAVGKEKHDDQICLFRPTLILSSVKTISSKLEGAT

SEQ ID NO: 125746 - protein, 619 aa, Glycine max
  Coding DNA Sequence Number=SeqID_34061
  Gene Ontology: Mol. function=alcohol dehydrogenase (acceptor) activity; Cellular component=outer membrane-bounded periplasmic space; Biological process=electron transport
  Homolog annotation: Hit_ID=UPI0000E88014; Match level="QueryCoverage =99%, HitCoverage=97%, E-value=0.0, Identity=82%"; Hit description =methanol dehydrogenase large subunit-like protein
  Pfam annotation: Domain name=PQQ; Domain location=140-177; Score =41.9; E_value=2.2e-09; Accession=PF01011.12; Description=PQQ enzyme repeat
  Pfam annotation: Domain name=PQQ; Domain location=190-228; Score =14.9; E_value=0.15; Accession=PF01011.12; Description=PQQ enzyme repeat
  Pfam annotation: Domain name=PQQ; Domain location=320-358; Score =13.2; E_value=0.25; Accession=PF01011.12; Description=PQQ enzyme repeat
  Pfam annotation: Domain name=PQQ; Domain location=483-522; Score=7.4; E_value=1.6; Accession=PF01011.12; Description=PQQ enzyme repeat
  Pfam annotation: Domain name=PQQ; Domain location=526-563; Score =32.7; E_value=1.4e-06; Accession=PF01011.12; Description=PQQ enzyme repeat
  Pfam annotation: Domain name=PQQ; Domain location=87-126; Score=20.2; E_value=0.0078; Accession=PF01011.12; Description=PQQ enzyme repeat
  Pfam module annotation: Pfam domain module=PQQ::PQQ::PQQ::PQQ::PQQ::PQ Q; Domain location=140-177::190-228::320-358::483-522::526-563::87-126
MINTKTALGIAASVALALPVMAFAAADQEAAMKDANNWVHPRGQHNNQGYSSLAQINKGNIKNLKMAWTFATGVNRGQEGSPIVMGNMMYIVTAFPNNVYALDLNDSQKIVWSYFPKQDPSVQAVLCCDNVTRGLGFGDGKIFLQQNDGLLVALDAKDGKKIWEVKNTDPKVGATNTNAPHVIKDKVLTGCSGAEFGVRCFIAAYNLKDGSLAWKAYSTGPDSETLHDANTNKDNPLYNALSVYQDVNGGNKEGGSFKRLSADQIKGGEKELGTRTWLKPQAIKDGWQHGGGSVWGWWPYDARTNLVYYGAGNPSVWNPDVRPGDNKWSMTVTARDLDTGVAKWAMQMTPHDEWDYDGVNEVILFDKGGKTYAWHHDRNGFAYTWNAVTGTLIAAEKVHPFVNWASDVDLKTGVPNKDGRYSTHQDYNAKGICPAALGTKDQQPAAYSPKTGLMYSPLNHVCMTYEPVESKYVAGQPWVGATLTMFAGPDGVMGGFGAYDPMTNKKVWYNKEKFSAWSGALTTASDLVFYGTLDRWFKAVDAKTGKELWKFQVGSGAIGNAFTYGNKGKQYVGILSGIGGWAGVAMNLGMTTDTDALGAAGGYKELTKYNAAPGGGALN

SEQ ID NO: 125747 - protein, 80 aa, Glycine max
  Coding DNA Sequence Number=SeqID_34062
MTCRESKENIDAQSVWFRDTPEIKRKHRCTNSEVRNTPPTWALQKIPPEGGCFWRKQPCSPGRAELAWASWAATTSPILL

SEQ ID NO: 125748 - protein, 71 aa, Glycine max
  Coding DNA Sequence Number=SeqID_34063
MELQRLNQNEETDKRKRRIALKVSFSMQEEEEEEEFDDEEDFSLFVKKFHKFVKNRSMERSHNFNNGKRSQ

SEQ ID NO: 125749 - protein, 52 aa, Glycine max
  Coding DNA Sequence Number=SeqID_34064
MHEGMHMTQMQFRNAGARGIASFLDTTSRGSKVPQQGIKTEPTCDAYAKGAT

SEQ ID NO: 125750 - protein, 245 aa, Glycine max
  Coding DNA Sequence Number=SeqID_34065
  Gene Ontology: Mol. function=protein binding; Cellular component =integral to membrane; Biological process=protein amino acid phosphorylation
  Homolog annotation: Hit_ID=Q1SWI6; Match level="QueryCoverage=82%, HitCoverage=88%, E-value=4e-42, Identity=46%"; Hit description =Leucine-rich repeat, plant specific
  Pfam annotation: Domain name=LRRNT_2; Domain location=27-67; Score =53.1; E_value=9.3e-13; Accession=PF08263.3; Description=Leucine rich repeat N-terminal domain
  Pfam annotation: Domain name=LRR_1; Domain location=101-126; Score =10.5; E_value=3.5; Accession=PF00560.24; Description=Leucine Rich Repeat
  Pfam annotation: Domain name=LRR_1; Domain location=128-150; Score =10.6; E_value=3.3; Accession=PF00560.24; Description=Leucine Rich Repeat
  Pfam annotation: Domain name=LRR_1; Domain location=152-173; Score =5.1; E_value=35; Accession=PF00560.24; Description=Leucine Rich Repeat
  Pfam annotation: Domain name=LRR_1; Domain location=175-198; Score =14.1; E_value=0.54; Accession=PF00560.24; Description=Leucine Rich Repeat
  Pfam annotation: Domain name=LRR_1; Domain location=200-222; Score =11.5; E_value=2.3; Accession=PF00560.24; Description=Leucine Rich Repeat
  Pfam module annotation: Pfam domain module=LRRNT_2::LRR_1::LRR_1::LRR_ 1::LRR_1::LRR_1; Domain location=27-67::101-126::128-150::152 -173::175-198::200-222
MNSSSIYILVFVQLWLLSLPCRESVCIPSERETLLKFKNNLNDPSNRLWSWNPNNTNCCHWYGVLCHNVTSHLLQLHLNSAFYEKSQFGGEISPCLADLKHLNYLDLSGNGFLGEGMSIPSFLGTMTSLTHLNLSLTGFRGKIPPQIGNLSNLVYLDLRYVAYGTVPSQIGNLSKLRYLDLSDNYFEGMAIPSFLCAMTSLTHLDLSYAGFMGKIPSQIGNLSNLVYLGLGGSYDLLAENVEWVS

SEQ ID NO: 125751 - protein, 71 aa, Glycine max
  Coding DNA Sequence Number=SeqID_34066
DSLTTVLKVTRLCSWKSWDRLLKNKDNVEKHIKIVIFISKTSWVQRRWKNTLKLRFLSQKLHGFRFVNTKA

SEQ ID NO: 125752 - protein, 187 aa, Glycine max
  Coding DNA Sequence Number=SeqID_34067
MAKVHTRGLDWLSKLKIINEENFEAPKEDEEVQALKLELGKARLAKEKFKLVATDVRKVSAELREENAATARALEQETKRARKEKHGRDKFHGALWGSNKELKLQREERDQSRVHSMILKEKLAACSRSKRSLAQHLEDTEQSMLAIIGQYKEELNQSLAHEQKLVEDFAQAYAEKEARGRVIDALH

SEQ ID NO: 125753 - protein, 189 aa, Glycine max
  Coding DNA Sequence Number=SeqID_34068
  Subcellular localization annotation: CTP_CleavageSite=37; ConfidenceScore=5.62e-01
MPKVKHFRNPQKSAPQPQCSSPSDSTQAPEVPTGNVPLSHLSTSEVPTMNPEISFPPSDSTQAPEVPTGNVPFSHVSTSEVPQEDETTRRHVGRESTHCWTVEAIDSEETIKKIKVKVRVVNSLPRELRIIVNFDDQGQAIGEAQALLARFLGTLAADCKLFPMDYDRWSGPSGVPKAYFDDCFETILK

SEQ ID NO: 125754 - protein, 149 aa, Glycine max
  Coding DNA Sequence Number=SeqID_34069
MAPKKLSTKRSRRAAVAEVSSAAPEFDSHRFRSVEHWQHFEAIKGWSLHRERRVQLREDEYTDFQEEIARRHWTSLVTPMAKLDPEEGVRDMRSWVRGQWIPFDADALSQFLGDPLVLEEGQQCEFSQRRNKADEFDEEAIAQLLCTPG

SEQ ID NO: 125755 - protein, 54 aa, Glycine max
  Coding DNA Sequence Number=SeqID_34070
SNAFQGYFDDAKESRVKPIPKIQESRFKNIQESRFKNNQDQDSRIKKRFNQDKY

SEQ ID NO: 125756 - protein, 73 aa, Glycine max
  Coding DNA Sequence Number=SeqID_34071
KAVASGGSNPARLGELGGNHLPYFAINRGGKQEGKAEALPKRFRNVFREESRKAFNRSSTFFIRSSSFFDLQR

SEQ ID NO: 125757 - protein, 105 aa, Glycine max
  Coding DNA Sequence Number=SeqID_34072
MIRGDTLRLSAPFCHPEAAGPMTSRDQVWSFCTLVSSRGGGPDDTRRYLTVIRTLLSPFYPEAAGPMTSRDQVWSFCTLVSSRGGGPDDTRKYPSGYPYKHSFAI

SEQ ID NO: 125758 - protein, 97 aa, Glycine max
  Coding DNA Sequence Number=SeqID_34073
MPLFDSRHVAKLDGLPNDGLQVPRSDHAKVASHQTDGPRMKLGYDTRHKRCLPLPKLGRMSLRILLWLPHMGLPGLSESKVGLKGSYRTGGYPSLGK

SEQ ID NO: 125759 - protein, 452 aa, Glycine max
  Coding DNA Sequence Number=SeqID_34074
  Homolog annotation: Hit_ID=Q6WAY6; Match level="QueryCoverage=51%, HitCoverage=39%, E-value=2e-12, Identity=27%"; Hit description =Putative uncharacterized protein
MVEASVNWFPRWKEGRVGVLSSCEGFSNIPLMGTRGCINYNLVLAIRQLGYPMRGALSEESIMPFIARGFSDPKARIFQGVRKAWSVVKRKDKELRGSSNGIIGSYHKWLKARTQELVWLPKLKASSEEEAETPEESKEVQALKAELERAQAIKEKFKMIAIKVWKEYDELRDINVATAEALERETKRARKEEPVKSRRHDIGGQVEGLPKAIIDQYKEKLSLAATHEQRLQDEYAKRSNDVDGWFAFTLNGSQELPRLLAKAKAINTITEHALRHPYRTRSKTRVMGDIEEVQEQMKADMEAMKDQVASMMEAMLSMKRMKERNTAAIVASSTATEANPTHPSAINQANQPAPDMVGQGGEVLGSTSGPHMGYNRNAYAYGLPPNYTPPTMHMPNENINHVVPVTFEVEGREKLDLIEERLRVVEGFGDYPFADMTELCLVPDVVIPPKFK

SEQ ID NO: 125760 - protein, 207 aa, Glycine max
  Coding DNA Sequence Number=SeqID_34075
DMTKSKGKDPIEGLGGPMTRARSRKAKEALQQVLSILFEYKPKFQGEKSKGTQPPPMKKSSKSAMSPSSSAPPSSPWATGKGWGHGNASAVYTNRSCHSTASGPYGLLPVDQPNVVCMHASGAPSFACELRWTLEMVTNVEAVVVRLRPVAVAGLAPAANWKRPVINAENPSALLDFSRSTGPTDNLGSVRSKLWSLGRMLPSRNVI

SEQ ID NO: 125761 - protein, 42 aa, Glycine max
  Coding DNA Sequence Number=SeqID_34076
MRVVYVVSLDFWTFDAAMITTSGKYVTDSLDDGESDDVESEK

SEQ ID NO: 125762 - protein, 102 aa, Glycine max
  Coding DNA Sequence Number=SeqID_34077
  Subcellular localization annotation: CTP_CleavageSite=45; ConfidenceScore=5.45e-01
MNLLPSAVHVSSTIESGAPRIHCLAMFANSPFSTFIRRPMNSLPSAIHVSSTIESGAPRIDCLALFANSPFSNLIRRPMNSLPSAVHFSSVIKHGASEKKKE

SEQ ID NO: 125763 - protein, 354 aa, Glycine max
  Coding DNA Sequence Number=SeqID_34078
  Gene Ontology: Mol. function=catalytic activity; Biological process =cell adhesion
  Homolog annotation: Hit_ID=A1FUF0; Match level="QueryCoverage=96%, HitCoverage=32%, E-value=1e-168, Identity=85%"; Hit description =Coagulation factor 5/8 type-like precursor
MWPHVQGAYTYMEQLRASERTEENRARNPAFYGMMPASISHEGYSAKPMHSYWDNFWALRGYKDAALLATQLGKVEAMQIAESRDQFRDDLQASLLSAMQQHSIDYLPGSAELGDFDATSTTIALAPGGEQGRLPQQALEATFERYWNEFVARRDGKREWKDYTPYEWRNVAAFVRLGWRDRAWQATEFFFKDRAPQAWNQWAEVVSRTPRKPFFVGDLPHAWVASDFVRSALDMFAYNRDMDDALVLAAGVPSAWLQGEGVAVQGLRTPQGQLNYRLQRSDKQLVLEVQPGLVPPVGGVVLPWPYAGDPGGGDGQRRSRRVGSTRNCTCTSCRARIEIEVPRRGAAAAGAQGT

SEQ ID NO: 125764 - protein, 113 aa, Glycine max
  Coding DNA Sequence Number=SeqID_34079
  Subcellular localization annotation: CTP_CleavageSite=11; ConfidenceScore=5.04e-01
MSFHHLSCNITSQHYTSHTFSHHSRTQGSKHSITQSITIDQYTSVMQQYTKTQSYMQCGTMLIKNLVGCSGVHDKTDHTLHMLQGTFKPSVFTPKAYIPKNPSESFPLDSGPT

SEQ ID NO: 125765 - protein, 69 aa, Glycine max
  Coding DNA Sequence Number=SeqID_34080
HQTKGNHFLTTVLGVTCNSLSGARSPYETVVATTESPREAMTKKDAKIMADRVPGNGHFDDGDGGHQCR

SEQ ID NO: 125766 - protein, 149 aa, Glycine max
  Coding DNA Sequence Number=SeqID_34081
MDKIRNGQDKGKHITTNVRAALDENWGSIDFLNKSSTAKTKEFQRPPTAWEVIEKTKKLKSGEWVNDKSREFVDKYQHRRDEILQHLTNEGTSTQDSPNTATSVNDNEIYLNVVGGPNYKGKMYGLDTLSKKFSCSKSVSSTSIAHVED

SEQ ID NO: 125767 - protein, 165 aa, Glycine max
  Coding DNA Sequence Number=SeqID_34082
SEWRLLFLAEIAYSGWSFASLTLLRKVEEKPQLLVVFDVVVVAGALEEEHMACLDQQHSGKEGQAVNVVEDLSISDLDDSSNLDSIYCLKYHHYFVVVGFATKGVYYKCLKHKLQIFDSWQVMQAPLELVGLGSSSSMDSFASWKMNGSGMEKGRERGDATSRRR

SEQ ID NO: 125768 - protein, 65 aa, Glycine max
  Coding DNA Sequence Number=SeqID_34083
MTLFCTQLPIESKIKRGVGYRQSRTTLNGNLKGRDTKNGFPLPAVTYPAENLSGLKNFYPLSSID

SEQ ID NO: 125769 - protein, 368 aa, Glycine max
  Coding DNA Sequence Number=SeqID_34084
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=52%, E-value=0.0, Identity=92%"; Hit description =Photosystem I P700 chlorophyll a apoprotein A2
  Pfam annotation: Domain name=PsaA_PsaB; Domain location=1-361; Score =470.7; E_value=1.9e-138; Accession=PF00223.10; Description =Photosystem I psaApsaB protein
MYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPEKQILIEPYICPMDTICSCPAFNAGRSIWLPGWLNAVNENSNSLFLTIGPGDFLVHHAIALGLHTTTLILVKGALDARGSKLMPDKKDFGYSFPCDGPGRGGTCDISAWDAFYLAVFWMLNTIGWVTFYWHWKHITLWQGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARLVGLAHFSVGYIFTYATFLIASTSGKFG

SEQ ID NO: 125770 - protein, 70 aa, Glycine max
  Coding DNA Sequence Number=SeqID_34085
MEQVSIGHQNWGEFYRLFAAKFLPWLVGFVVDLGMAFMDKWVVGMVVTAWVSPTFSSSSFAPVFSFVQAG

SEQ ID NO: 125771 - protein, 48 aa, Glycine max
  Coding DNA Sequence Number=SeqID_34086
MEVEEPWLGLWLPLNYQVDMGARWCLATNMRQADFEADLGMTFVDDWV

SEQ ID NO: 125772 - protein, 419 aa, Glycine max
  Coding DNA Sequence Number=SeqID_34087
  Homolog annotation: Hit_ID=Q6WAY6; Match level="QueryCoverage=87%, HitCoverage=64%, E-value=1e-38, Identity=31%"; Hit description =Putative uncharacterized protein
MGSSQTPSLKKRFYQVKVKSLGTTSLKELRQLMGQLQRQAFRKVYGKIWDLAMVEVSTEAIASLAQYYDQPLRCFTFGDFQLSPMVEEFEEILGCPLGGRRPYLFSGFYPSLARISKIVQISAHELDHRKQVENRVVGIPRKYLEAKARILASKGEWAPFIDILALLIFGGVLFPNVDGLVDLATIDAFLAYHNHKESPVVAICEKSSTRIVCCTPALYVSLVSHLFHQYKDCLQYEDRSCTEKGGTNCDQLLANKEGASINWFPRWKEGRTRVLILCGGFPNVPLMGTRGCINYNLVLAIRQLGYPMRGAPLEEEIAPVISRGFNKTNVETLQKVRKAWEVVQKKDKELKGSNNGPIGGYRKWLKAHMQGLDWLPSLRIAKREEVEAPEEDEEVQALRTELEQAQTAKDMFKFAALKI

SEQ ID NO: 125773 - protein, 177 aa, Glycine max
  Coding DNA Sequence Number=SeqID_34088
  Homolog annotation: Hit_ID=Q84VH5; Match level="QueryCoverage=94%, HitCoverage=28%, E-value=1e-80, Identity=80%"; Hit description =Envelope-like protein
MDLIKAAGLLKTVTKLGDCYESLVREFIVNIPSDITNRKSDEYQKVFVRGKCVRFSPAVINKYLGRPTEGVVDIAVSEHQIAKEITAKQVQHWPKKGKLSAEKLSVKYAILHRIGTANWVPTNHTSTVATESFAVKLPIAFPTVLCGIMWSQHSNILNNIDSVKKRESAPVSALQTV

SEQ ID NO: 125774 - protein, 172 aa, Glycine max
  Coding DNA Sequence Number=SeqID_34089
ALSSKAKGKEKEETDSSKKIVKKENHFATKSDIKRALLLKQSFYLLLSRETSLSTAIPLELEVIPQVKELLDEGLVRKSLNACALLVPNIGVEERIHEFQEPLDLRSNPFQGGGNDAILPPRALDRRLQEDWAKDAREGPRVLMRLRVDFGPKVRYTRNIGFFSPCLLGHLD

SEQ ID NO: 125775 - protein, 66 aa, Glycine max
  Coding DNA Sequence Number=SeqID_34090
  Subcellular localization annotation: CTP_CleavageSite=27; ConfidenceScore=5.10e-01
MLLSSNVIHICVRVVMLVRTIRTRLFAAARVKSCPDMHSSCATASLSGCASTVDRSSRIRGWPRNL

SEQ ID NO: 125776 - protein, 151 aa, Glycine max
  Coding DNA Sequence Number=SeqID_34091
  Gene Ontology: Mol. function=phosphoinositide phospholipase C activity; Biological process=intracellular signaling cascade
  Homolog annotation: Hit_ID=A7PHV0; Match level="QueryCoverage=80%, HitCoverage=38%, E-value=2e-16, Identity=41%"; Hit description =Chromosome chr13 scaffold_17, whole genome shotgun sequence
MYMIGGALIPDKSGNRFHLMYLNLLHDLNNTKKYSSGCLANLYRELCRASSEVGKSMGGCVILLLSWAWYRMPFIAPRVPRPETTFPLAKRWSGGRLEYRATPHGDLVEYRSRIDHMESHELQFGLQQDIHVDPMNLDLLHQIDMRGYHYT

SEQ ID NO: 125777 - protein, 66 aa, Glycine max
  Coding DNA Sequence Number=SeqID_34092
  Subcellular localization annotation: CTP_CleavageSite=11; ConfidenceScore=5.04e-01
MWSSTPFPEMSASPGANETVDTRRLTSSSAPSVILTHEVRRRYPSGYPYKYFFTIRQTQSPVACRD

SEQ ID NO: 125778 - protein, 49 aa, Glycine max
  Coding DNA Sequence Number=SeqID_34093
MVVVMTMAAANNEHTRIDEDEQQFDEDQSRIEEMKMREFERRNELSVNE

SEQ ID NO: 125779 - protein, 236 aa, Glycine max
  Coding DNA Sequence Number=SeqID_34094
  Gene Ontology: Mol. function=oxidoreductase activity; Biological process=electron transport
  Homolog annotation: Hit_ID=A5BXF6; Match level="QueryCoverage=82%, HitCoverage=81%, E-value=2e-75, Identity=69%"; Hit description =Putative uncharacterized protein
MENAELGTVTSHIKRQCNSPPTLIVIGAGISGIAAARCLHDASFKVIVLESRDRIGGRIYTDYSFGCPVDMGASWLHGACNENPLAPLIRALGLTLYHTGGDNSVIFDHDLESCMLFNIDGHQVPQHIMMEVGDTYKRILAETVKVRDEHPDDMPILQAISIVLNRHPELRQQGLAHEVLQWYICRMEAWFASDADIIPLKTWDQASAIILVEGHKILFPLSFYTCPFFCSFILES

SEQ ID NO: 125780 - protein, 491 aa, Glycine max
  Coding DNA Sequence Number=SeqID_34095
  Gene Ontology: Mol. function=transferase activity; Cellular component= chloroplast; Biological process=biosynthetic process
  Homolog annotation: Hit_ID=A4F1Y6; Match level="QueryCoverage=98%, HitCoverage=96%, E-value=1e-160, Identity=63%"; Hit description =Phytoene synthase
  Pfam annotation: Domain name=SQS_PSY; Domain location=150-479; Score =349.2; E_value=6.9e-102; Accession=PF00494.10; Description =Squalenephytoene synthase
MSGTLLWVVSSPGLEVSHSSGLLDSIRSVKFLDSSKAMSRDFGSIRAKLGKEKGWRLCSLSTDMKYTCVGRSGLESASNFPLIANVLVNPAAGEVAVSSEQKVYDVVMKQASLVKRKLGAAGELDAKPDIALPGNLSLLNEAYDRCGEICAEYAKTFYLGTLLMTPERRRAIWAIYALAGLQKQSTVKLFQSSVRHFQMSKSLMSILITEVGQIRCGVGERMNLLMVLMLHKLRQLLRNRWESRLEELFQGRPFDMLDAALSDTVAKFPVDIQPFKDMIEGMRLDLKKPRYKNFDELYLYCYYVAGTVGIMSVPIMGISPNSQATTESVYNAALALGIANQLTNILRDVGEDASRGRVYLPQDELAQAGLSDEDIFAGKVTDKWRNFMKSQIKRARMFFDEAEKGVTELNEASRWPGDPYVHKNTHIPRKIMVWASLLLYRQILDEIEANDYNNFTRRAYVSKAKKLLSLPAAYARSMVPPSKKLSSVMKT

SEQ ID NO: 125781 - protein, 263 aa, Glycine max
  Coding DNA Sequence Number=SeqID_34096
  Gene Ontology: Cellular component=extracellular region; Biological process=cellulose and pectin-containing cell wall organization and biogenesis
  Homolog annotation: Hit_ID=A7PTQ3; Match level="QueryCoverage=90%, HitCoverage=89%, E-value=1e-120, Identity=84%"; Hit description =Chromosome undetermined scaffold_30, whole genome shotgun sequence
  Pfam annotation: Domain name=DPBB_1; Domain location=73-159; Score =125.6; E_value=1.5e-34; Accession=PF03330.9; Description=Rare lipoprotein A (RlpA)-like double-psi be
  Pfam annotation: Domain name=Pollen_allerg_1; Domain location=170 -247; Score=143.0; E_value=8.2e-40; Accession=PF01357.12; Description= Pollen allergen
  Pfam module annotation: Pfam domain module=DPBB_1::Pollen_allerg_1; Domain location=73-159::170-247
  Subcellular localization annotation: CTP_CleavageSite=42; ConfidenceScore=5.02e-01
MLALTVSIILIITLSSSPLVTSHYSSPSLEASPTFSEWRSARATYYAPADPRDVVGGACGYGDLVKGGYGMATVGLSEALFERGQICGACFELRCVEDMRWCIPGTSIIVTATNFCAPNYGFTSDGGGHCNPPNKHFVLPIEAFEKIAIWKAGNMPVQYRRIKCRKEGGMRFTVTGSGIFISVLISNVAGHGDVVEVKVKGSRTGWLSMGRNWGQNWHVNALLQNQPLSFEVKASDGKTVTSYNVAPKDWTFGQTFEGKQFET

SEQ ID NO: 125782 - protein, 226 aa, Glycine max
  Coding DNA Sequence Number=SeqID_34097
  Gene Ontology: Mol. function=protein binding; Cellular component =integral to membrane; Biological process=phagocytosis, engulfment
  Homolog annotation: Hit_ID=A9NW90; Match level="QueryCoverage=92%, HitCoverage=35%, E-value=4e-95, Identity=79%"; Hit description =Putative uncharacterized protein
  Pfam annotation: Domain name=EMP70; Domain location=1-185; Score= -91.2; E_value=5.5e-12; Accession=PF02990.7; Description=Endomembrane protein 70
MNLFSGPLFFTFCFLNTVALAYNATAALPFGTIVVIFLIWTLVTSPLLVLGGIAGKNSQSGFQAPCRTNKYPREIPKLPWYRTTLAQMAMAGFLPFSAIYIELYYIFASVWGHQIYTIYSILFIVFIILLIVTAFVTVALTYFQLATEDHEWWWRSFLCGGSTGLFIYGYCLYYYYARSDMSGFMQTSFFFGYMACVCYGFFLMLGTVGFPCCFDLCPSHISFYQM

SEQ ID NO: 125783 - protein, 265 aa, Glycine max
  Coding DNA Sequence Number=SeqID_34098
  Gene Ontology: Mol. function=ribulose-phosphate 3-epimerase activity; Cellular component=cytoplasm; Biological process=carbohydrate metabolic process
  Homolog annotation: Hit_ID=A5C6P1; Match level="QueryCoverage=71%, HitCoverage=100%, E-value=2e-92, Identity=87%"; Hit description =Putative uncharacterized protein
  Pfam annotation: Domain name=DUF775; Domain location=1-186; Score =5.3; E_value=8.6e-07; Accession=PF05603.3; Description=Protein of unknown function (DUF775)
MFGVVFPNRSFPMDISTFAQIDTFHWVLDMNTFVGEAYDQVRELCIFLLNGFTLPPEKALAVYIQSPGSPFVFCGAVTVARPSAVLTLAWPEPGAGGPLQLTADAQPLSAKIGVSVEDLASLPSLDMAAEKRIEGLAMKVGENLFNFMQSFCGVDGSKLVVPMDILERWFKKFQERARRDPEYLKGFALGSSLFRIWKCDPCLDYELSNNVVMLRVMSIMEKQSLYICKSKAPYNIPPPYLRIAKSLWAMGVGCSLQHASVLGGL

SEQ ID NO: 125784 - protein, 464 aa, Glycine max
  Coding DNA Sequence Number=SeqID_34099
  Gene Ontology: Mol. function=DNA binding; Cellular component=nucleus; Biological process=regulation of transcription
  Homolog annotation: Hit_ID=A7PZ25; Match level="QueryCoverage=99%, HitCoverage=99%, E-value=1e-90, Identity=45%"; Hit description =Chromosome chr4 scaffold_39, whole genome shotgun sequence
  Pfam annotation: Domain name=Myb_DNA-binding; Domain location=274 -325; Score=41.8; E_value=2.5e-09; Accession=PF00249.22; Description =Myb-like DNA-binding domain
MTLEGIFIEPTSTTTAPDLSLHISPPTISSLNSNYEPHESNFPSRTTTVSQQAHTELSLGRNFTSETPIPTPHNPYYQSQNHFHHLHHHHHNNNNTSTSVNTTSVVTSTTSTTPLNHINYGVSLLDVSSSDTLRPIKGIPVYHNRSFPFVATMDHARDNLNNNNNNNKDHYHHHKMCLYNHHNMPSYPSLSSSTATPSPSPYFVDPMSLLNNGSTMAACRAATATRFNGFSGDAFKSHHPLHQYGVGPSEASSGFMRSRFLQKLPNKRSMRAPRMRWTSTLHARFVHAVELLGGHERATPKSVLELMDVKDLTLAHVKSHLQMYRTVKTTDKPAASSGHSDGSGEDDLSPMVSTADRGGLRQFPNHRGRPEWAAQQDMDYSSTTTTLWSNSSSCGESRLRPSSNDIDGLRSPILHSQTISGGHQIQECDSIQLKSNMPGSNLECKIPSLEFTLGRPDWDGKEQA

SEQ ID NO: 125785 - protein, 23 aa, Glycine max
  Coding DNA Sequence Number=SeqID_34100
MVVANIFAKIWDECGWKMDQIQK

SEQ ID NO: 125786 - protein, 592 aa, Glycine max
  Coding DNA Sequence Number=SeqID_34101
  Gene Ontology: Mol. function=metal ion binding
  Homolog annotation: Hit_ID=A5AHW0; Match level="QueryCoverage=95%, HitCoverage=80%, E-value=0.0, Identity=57%"; Hit description =Putative uncharacterized protein
  Pfam annotation: Domain name=PHD; Domain location=506-554; Score =39.9; E_value=9.3e-09; Accession=PF00628.20; Description=PHD-finger
MDNGWHKPLDEDSIDNQKHLLHGVIHCNGYGHLLCVNGIEGGSKILSGREIIDLWDRICTNLRARKIAVEDVSCKRSMDLRLLHGVAYGHSWFGRWGYRFCRGSSGVREREYNEAMTMLGSLGLDMIVKDLSETKYKTEIQQIIRCYRDMSETHIISLRDLLRFMLTVKSSRAPVPKITDTYSAASDSTSSALTSRNSTKHTLPNRSNSMKEKSVRYKKFSSAVTNMDSRWPTRRLEFAAQVIVDALKENKTVKLGSGGMTRQDVRDAARLHIGDTGLLDYVLKSLNNVIIGNYVVRRMVNPSTRILEYTIHDLGKGSKAPEENKPEVMAHADQQVVESSWMLGNDVYSDALFLYKNVLLGYPDSEAVDTAVQTILDSRYFVKEWPVRDEMKEQVLTFICRLQPNFVDKKHELKGLACGEVVVVPLHATVGDLKRAAEAALRDTYCIAERLIVTDIKELMDVSDEEVLFGLIQSGVELCVRGIAIDLLTPLKYQGESESADNWKVRCECGAQDDDGERMVACDICEVWQHTRCYGIDDSETVPPLFVCTGCCDSVLVPSSRTESAAFGVDSVDSFLISEDPTTLLLDYEYGY

SEQ ID NO: 125787 - protein, 508 aa, Glycine max
  Coding DNA Sequence Number=SeqID_34102
  Gene Ontology: Mol. function=catalytic activity; Cellular component =mitochondrial outer membrane; Biological process=metabolic process
  Homolog annotation: Hit_ID=A7QFY1; Match level="QueryCoverage=80%, HitCoverage=98%, E-value=0.0, Identity=83%"; Hit description =Chromosome chr9 scaffold_90, whole genome shotgun sequence
  Pfam annotation: Domain name=ThiF; Domain location=93-228; Score =173.4; E_value=5.9e-49; Accession=PF00899.12; Description=ThiF family
  Subcellular localization annotation: CTP_CleavageSite=28; ConfidenceScore=5.01e-01
MERGKYLALVGGGALLGSVSTFFLLRLLQSQKRGVSQCSKNVTADFNGVEGCTIAGKKNDRVINEDLLKDEIVSEQLTRNVQFFGFESQQKVTASYVVVIGLGGVGSHAASMLLRSGIGKLLLVDFDQVSVSSLNRHAVATRADVGISKAQCLKEHFLSIFPECQIDAKVMLYDSSTEEEILSGHPDFVLDCIDNIDTKVALLAACVRRGLKVLSATGAGARADPTRIRIADLRESTNDPLSRAVRHRLRKDYGIEGGIPVVFSLEKPKAKLLPFKGPSGEEENPSDYQWCWLHILTSWSSCQIVPGFRVRIIPVLGTIPAIFGQFMASYVVTELAGVHVQTEPVVNFNMDHYHILHQRLIEHEESLYGTYMEVQVDVEEVMYIVKELWHGRSAREQHVKDVGRGMWRSVNELMLVRWDRTKPASISNLILLKFKEVDEHESRTLDDIKKNEPEFYSRVIAVLKRAELDFGKAAYNIPPPYLHIAKKHRLKQDKIKKVTVEEEEKGLN

SEQ ID NO: 125788 - protein, 116 aa, Glycine max
  Coding DNA Sequence Number=SeqID_34103
MAKSKDDSIASLTTGFNECTRCGKRLGCEKKILGGVGRDGGSVTRRDRGVVGRGWGVGGGGGGGGAGAWCRGATSRAQRQGAARRARVRGATLLLPRAPRRTCCVLHGSVCLGDAL

SEQ ID NO: 125789 - protein, 134 aa, Glycine max
  Coding DNA Sequence Number=SeqID_34104
MKRVASSKSSLELFIKAGPNLNMRVQNLSKHIVSSKVRICTAEESAILQDDFANNINCHRHDHQGEQHRCYYYQSHSVGAMVVVVGINRVQRVEVGGGGRLWRWGRSELRHGDRKVKNERTVEETSKMQLEEHG

SEQ ID NO: 125790 - protein, 944 aa, Glycine max
  Coding DNA Sequence Number=SeqID_34105
  Gene Ontology: Mol. function=damaged DNA binding; Cellular component =nucleus; Biological process=nucleotide-excision repair
  Homolog annotation: Hit_ID=A2Q387; Match level="QueryCoverage=70%, HitCoverage=87%, E-value=0.0, Identity=76%"; Hit description=DNA repair protein Rad4
  Pfam annotation: Domain name=Rad4; Domain location=434-854; Score =226.9; E_value=4.7e-65; Accession=PF03835.6; Description=DNA repair protein Rad4
MPRRGGGSQRKKQPLASTSENQTGAQQNSEGGNRFQSPSDNGTLTEISREAVGNLIRRANKVGISRKKKTPEFEPEQNGTQVLAPMLKQKTSEIGHCGRNSMENASAEEKCGNSGLHCFDNKEELDDSDWEDGTVARDDHPVTIELNMTAHSTVQKQIRRASAEDKDLAELVHKIHLLCLLARGRLIDNACDDPLIQASLLSLLPAQLLQLSNVTKLTSNALYPLISWFHDNFHVKNCTNRETSPHFGLASALESHEGSSEEVLSFSFNKVSIHRCSTSMIAALSVALLRALNLTARFVSILDVAPLKPVQVASGSSNGIFKTSTPMISKRKLDFKSPQESISCNEIENVCESSLVHSRKSKKCHATNHTDQSSDPPVVDVRNDSVANSKASETRDSNSELCLTDKSHKSKRKGDIEFEMQLEMALSATTVECKDSKTEASANPDSSSFSCPSKRVKRVIGEDSSTSPQVISTAIGSMKVGSPLYWAEVYCSEENLTGKWVHVDALNLIIDGEDKVESMVAACKTSLRYVVAFAGQGAKDVTRRYCMKWYKIASHRVNSTWWDSVLKPLRDLESGATGGVAHLGTNQIISTESNMNDSVVPTRSSIEDIELETRALTEPLPTNQQAYKSHPLYAIEKWLTKYQVLHPKGPVLGFCSGHPVYPRTCVQTVKTKERWLREGLQVKPNEHPVKDLQRSMKPQKVQDSEADDYGCTDSIEQIKLYGKWQLEPLNLPHAVNGIVPKNERGQVDVWSEKCLPPGTVHLRFPKAFSVAKRLEIDYAPAMVGFEFKNGRSYPVFDGIVVCAEFKDVLLEAYAEEEERRQAEEKKRDETQALSRWYQLLSSIVTRQRLNNRYINNSLSSDKLTGVLCINNDESSATVCDNNDKSPNQRDQQVDKCDTNVDVSLSTSVKDHEHVFLKEYESFDEGTSLLTKRCQCGFSVQVEEL

SEQ ID NO: 125791 - protein, 701 aa, Glycine max
  Coding DNA Sequence Number=SeqID_34106
  Gene Ontology: Mol. function=nucleic acid binding; Cellular component= nucleus
  Homolog annotation: Hit_ID=A7PE58; Match level="QueryCoverage=47%, HitCoverage=68%, E-value=3e-44, Identity=35%"; Hit description =Chromosome chr11 scaffold_13, whole genome shotgun sequence
  Pfam annotation: Domain name=zf-CCCH; Domain location=333-358; Score =20.5; E_value=0.0027; Accession=PF00642.15; Description=Zinc finger C-x8-C-x5-C-x3-H type (and similar)
  Pfam annotation: Domain name=zf-CCCH; Domain location=362-387; Score =18.5; E_value=0.005; Accession=PF00642.15; Description=Zinc finger C- x8-C-x5-C-x3-H type (and similar)
  Pfam annotation: Domain name=zf-CCCH; Domain location=388-413; Score =10.3; E_value=0.059; Accession=PF00642.15; Description=Zinc finger C- x8-C-x5-C-x3-H type (and similar)
  Pfam module annotation: Pfam domain module=zf-CCCH::zf-CCCH::zf-CCCH; Domain location=333-358::362-387::388-413
MDFPPYCRSQLRSNTYRALVHLLSHISAYNASILEASTQPVNIPDNGSGRMDQENQEKEPKCSEVVDSDFLDPKDPICQKDIPEVQETIEGVEDKDMDFTSNKMVLDDIEHMMGIEDLSTLANGFDKEQKLMNEFEQVMKGTEDLICDSELIPLNLELDKTRSDGGEVELMDYQSEVEEGEISGDLGIDGNLFDVASADALILRQMEVDEVQKPENVTGNMIYPSKIENQEKEKGYDSKSSLVNAFQDYNNNGQVEPRTSGKKGIVCGVEVAISKETIECQKEDKTKLDNASKKNKRGGNKGKKKKADRKKRAEKNKQLGVKRLQLQHVQKPKVVSHCRHYLNGRCHEGDKCQFSHDVVPLTKSKPCTHFARHSCMKGDDCPFDHQLSKYPCTNFVSKGSCYRGDACLFSHQVSTKEDIPTASNMCRPELSPLLSGNANSSTPLNNNHGSTPVQQNHLTNSAGIHFCTSVEHKVTNTVQKQPTPPKGISFINLAKLSPSLSSLKQSTVTTKGSPVQIGTREDQSSFHKTQNKVDIPKKLPAVTPKGINFLSFGKGSVCSFKSVNRENGIKLPQLFNFGLPEQEKSSLNKDDYNKASDTTKQNAPQTDIFLTEILGKNQSVAEEMKLKLPEKTSVDFFMRDHSHSKSVQEGKKSSDNSQSSKGQKALLSTLAFAAEHESSIKMKYPTGGLPMSSEDSERMFC

SEQ ID NO: 125792 - protein, 81 aa, Glycine max
  Coding DNA Sequence Number=SeqID_34107
MEKHRISKQESKQRKQRGGRVKSVQSLTFISCNNRHCKKQQEKKMQSHRLRNLERSLNNERERKEECEMGLEENENENQKE

SEQ ID NO: 125793 - protein, 558 aa, Glycine max
  Coding DNA Sequence Number=SeqID_34108
  Gene Ontology: Mol. function=binding; Cellular component=endoplasmic reticulum
  Homolog annotation: Hit_ID=A7PRE4; Match level="QueryCoverage=95%, HitCoverage=95%, E-value=1e-119, Identity=44%"; Hit description =Chromosome chr14 scaffold_26, whole genome shotgun sequence
MDETSALIEAILREQEEEEEEAHRRRRNLTTQNTTIKSNNQWQTVSYHKRNRNNNKSSSKQPLAADPSPDVFSSVQRHSEHSRRRLLESQIASEAEAAAAAAPSRSKRHSDDEDDGDAEHEASAVQEVKKAKQKKPKKPKVTVAEAASRISADDLDAFLAEITASYESQQDIMLMRFADYFGRAFSSVSAAQFPWLKTFKESTVAKIVDIPLLHISEDIYKISTDWISHRSYEALGSFVLWSLDSILSDLASHQGVKKAVQQSSSKSQENKKYQGQDKLPVIVWVITQASQGDLVMGLYLWVYLLLPMLSVKSGCNPQSRDLILQLVERIITFPKAHSILLSGAVRKGERVVPPWALDSLLRVTFPLHSARVKATERFEAVYPTLREVALAGSPGSKAIKHLAQQILSFAIKAAGKANLDLSKEASDIFIWCLTQNPECYKQWDLLYMDNLEASIVVLRILSGEWKEYFIKHPTLDPLRETLKSFSQKALAKADDAARHALLKDADKYCKALLGRLSQDHGCMKSVTILSVVFADDRVILWLARCLCPAWTTSADSEE

SEQ ID NO: 125794 - protein, 1289 aa, Glycine max
  Coding DNA Sequence Number=SeqID_34109
  Gene Ontology: Mol. function=nucleotide binding; Cellular component =cytoplasm; Biological process=defense response
  Homolog annotation: Hit_ID=A5BH36; Match level="QueryCoverage=97%, HitCoverage=84%, E-value=1e-91, Identity=25%"; Hit description =Putative uncharacterized protein
  Pfam annotation: Domain name=ABC_tran; Domain location=168-301; Score= -41.7; E_value=0.002; Accession=PF00005.18; Description=ABC transporter
  Pfam annotation: Domain name=LRR_1; Domain location=1000-1021; Score =1.0; E_value=2e+02; Accession=PF00560.24; Description=Leucine Rich Repeat
  Pfam annotation: Domain name=LRR_1; Domain location=1205-1225; Score =3.3; E_value=74; Accession=PF00560.24; Description=Leucine Rich Repeat
  Pfam annotation: Domain name=LRR_1; Domain location=1246-1268; Score =2.1; E_value=1.2e+02; Accession=PF00560.24; Description=Leucine Rich Repeat
  Pfam annotation: Domain name=LRR_1; Domain location=584-604; Score =3.4; E_value=72; Accession=PF00560.24; Description=Leucine Rich Repeat
  Pfam annotation: Domain name=LRR_1; Domain location=606-627; Score =10.0; E_value=4.4; Accession=PF00560.24; Description=Leucine Rich Repeat
  Pfam annotation: Domain name=LRR_1; Domain location=629-652; Score =5.2; E_value=34; Accession=PF00560.24; Description=Leucine Rich Repeat
  Pfam annotation: Domain name=LRR_1; Domain location=762-783; Score =0.4; E_value=2.6e+02; Accession=PF00560.24; Description=Leucine Rich Repeat
  Pfam annotation: Domain name=LRR_1; Domain location=818-839; Score =4.5; E_value=45; Accession=PF00560.24; Description=Leucine Rich Repeat
  Pfam annotation: Domain name=LRR_1; Domain location=843-867; Score =6.3; E_value=21; Accession=PF00560.24; Description=Leucine Rich Repeat
  Pfam annotation: Domain name=LRR_1; Domain location=908-927; Score =4.1; E_value=53; Accession=PF00560.24; Description=Leucine Rich Repeat
  Pfam annotation: Domain name=LRR_1; Domain location=934-958; Score =2.9; E_value=90; Accession=PF00560.24; Description=Leucine Rich Repeat
  Pfam annotation: Domain name=NACHT; Domain location=169-319; Score= -33.9; E_value=0.026; Accession=PF05729.3; Description=NACHT domain
  Pfam annotation: Domain name=NB-ARC; Domain location=138-431; Score =190.8; E_value=3.4e-54; Accession=PF00931.13; Description=NB-ARC domain
  Pfam module annotation: Pfam domain module=ABC_tran::LRR_1::LRR _1::LRR_1::LRR_1::LRR_1::LRR_1::LRR_1::LRR_1::LRR_1::LRR_1::LRR _1::NACHT::NB-ARC; Domain location=168-301::1000-1021::1205 -1225::1246-1268::584-604::606-627:...
  Pfam module annotation: Domain location=:629-652::762-783::818 -839::843-867::908-927::934-958::169-319::138-431
MGEIVVSIIAKIAEYTVGPILHHARYLCCFNNFAGNLPNAKEDLELTRDSVKKRVREATNRTEKIEPAVEKWLKDVEKVLQEVQTLEGRILEVRKSIFRSQCQYFLAKEIARKIEKMTQLNRDSKFDPFSSKTELPGMKYHSFEDFVPFKSTESTYNEILEELSDKSFIMIGLHGMGGSGKTTLVKEVGKKVEELKLFEKVVMAVVSQTPNIRSIQEQIADKLGLKFEENSEEGRAQRLSKRLSEGKTLLILDDVWEKLNFEAIGIPFNENNKGCGVLLTTRSREVCTSMQCQSIIELHLLTDEEAWDLFQFYAKITDDSSAALKGVATKIVNQCKGLPIAIVTLGSTLRGKTLEEWELALLRLEDSKPLDIPKGLTSPHVCLRSSYDNLTNQLAKSLLLLCSIFPEDHEIDLEDLFRFGRGWGLIGTFGTLEKSRKEMHVAINILRDSCLLLHTKIKEKVKMHDLVRDVALWIASESDREILAGAAMDPTILVQGGNIKDKKAISLWNWRNGQLPDDQLNCPRLEILLLHSLYDGFEVSNACLERLKMLKILAFLGSGYEWIADYAERSKTLLLPQSFESLKNLHTLCLRGYKLGDISILESLQALEILDLRWSSFEELPNGIVALKNLKLLDLFCCKIEKDNAYEVIGECLQLEELYLYLLQSKKNFPQNAIFSRLRRYVIIQFTKESDRYFFFFQWSYFFRKQRPSRVLCIEGFNASVQSFISLPIKDFFQKAEYLELRHLKGGYKNVIPSMDPQGMNHLIFLILEYCPEIKCVFDGTTMQTEDAFSSLVILRLYELDNLEEVFHDPSSRCSLKSLEELTLESCRQLYNISFPKNSKLCHLKSLRIYNCPMLTCIFYPSIVQTLELLEEVRISECYELKQMIEEVEEGSVDYVSSQSHTSLMLPKLRTLTIHGCRSLKYIFPMCYAHGLASLEKLDIGFCDKLKYVFGSEKEHDLRVYQHQSHPQTNIHINLGALWLNDLPNLVEIWPKYFDPHLPNLKELRCYYCPRLPDSWVRRVMIIDSDLQQDSTATEKELLCSVTTTFNQLSDQVLSSKLTHLQLHGLGVKGLFQFQIREHGSNRELAPLNLDLIYAELSDLPELEFIWKGPTNFLSLHMLKWIFVLECPKLKTIFSPTIVRSLPMLRSLHIIDCEKLEQIFDSGDAQSLYTCSQQVCFPNLEDICVKKCNKLKYLFHNFVAGHFHNLTLLEIADCSELQKVFAFECETDDDGQEGIVKGGENVLLHNLRTITLCSLPNFKEIHHGFKLKDDVTRHDINDCPKYSPSLYLY

SEQ ID NO: 125795 - protein, 1190 aa, Glycine max
  Coding DNA Sequence Number=SeqID_34110
  Gene Ontology: Mol. function=nucleotide binding; Cellular component =intrinsic to membrane; Biological process=defense response
  Homolog annotation: Hit_ID=A5BH36; Match level="QueryCoverage=97%, HitCoverage=74%, E-value=1e-106, Identity=28%"; Hit description =Putative uncharacterized protein
  Pfam annotation: Domain name=LRR_1; Domain location=1066-1089; Score =1.1; E_value=1.9e+02; Accession=PF00560.24; Description=Leucine Rich Repeat
  Pfam annotation: Domain name=LRR_1; Domain location=1093-1117; Score =1.9; E_value=1.4e+02; Accession=PF00560.24; Description=Leucine Rich Repeat
  Pfam annotation: Domain name=LRR_1; Domain location=1119-1143; Score =0.5; E_value=2.5e+02; Accession=PF00560.24; Description=Leucine Rich Repeat
  Pfam annotation: Domain name=LRR_1; Domain location=584-604; Score =2.8; E_value=92; Accession=PF00560.24; Description=Leucine Rich Repeat
  Pfam annotation: Domain name=LRR_1; Domain location=606-627; Score =11.7; E_value=2.1; Accession=PF00560.24; Description=Leucine Rich Repeat
  Pfam annotation: Domain name=LRR_1; Domain location=629-655; Score =1.6; E_value=1.6e+02; Accession=PF00560.24; Description=Leucine Rich Repeat
  Pfam annotation: Domain name=LRR_1; Domain location=760-783; Score =2.4; E_value=1.1e+02; Accession=PF00560.24; Description=Leucine Rich Repeat
  Pfam annotation: Domain name=LRR_1; Domain location=813-837; Score =5.4; E_value=30; Accession=PF00560.24; Description=Leucine Rich Repeat
  Pfam annotation: Domain name=LRR_1; Domain location=878-902; Score =3.2; E_value=79; Accession=PF00560.24; Description=Leucine Rich Repeat
  Pfam annotation: Domain name=LRR_1; Domain location=904-928; Score =3.9; E_value=58; Accession=PF00560.24; Description=Leucine Rich Repeat
  Pfam annotation: Domain name=LRR_1; Domain location=970-990; Score =2.9; E_value=88; Accession=PF00560.24; Description=Leucine Rich Repeat
  Pfam annotation: Domain name=NACHT; Domain location=169-316; Score= -40.8; E_value=0.091; Accession=PF05729.3; Description=NACHT domain
  Pfam annotation: Domain name=NB-ARC; Domain location=130-428; Score =156.3; E_value=8.4e-44; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::NACHT::NB-ARC; Domain location=1066-1089::1093-1117::1119-1143::584-604::606 -627::629-655::760-783::...
  Pfam module annotation: Domain location=813-837::878-902::904 -928::970-990::169-316::130-428
MEDFVLSIVAKMVEYAVDPILHHAGYLCCFNNFARNLRKAKEELELTQDNMKKQVREATKRNEKIEPMVEKWLKDAEKVLEEVQLLEGRISEVSKCYFSRRCQYFLAKEIARKTEKMTQLNGNIKFEPFSRLTELQGMKYYSSKNFVLFKSIESTYNKLLEALKDKSVCMIGLCGIGGSGKTTLTKEVGKKAEDLQLFEKVVMVTVSQTPNIRSIQEQIADQLDFKLREDSNIGKARRLSERLRKGTTLVILDGVWGKLDFEAIGIPLNENNKGCEVLLTTRSRQVCTSMQCQSIIELNLLTGEEPWALFKLHANITDDSLDALKVVARNIVNECKGLPIAIVTVGSTLRGKTFEEWESALSRLEDSIPLDIPNGLTSPHVCLKLSYDNLTNQFAKSLLLLCSIFPENHEIDLEDLFRFRRGLEPFGTFGTMEKVRREMHVAVNILRDSCLLMHTSNKEKVKMHDIVRDVALWIASERGQPILASTATDPRMLVEDETIQDKKAISLWDLKNGQLLDDQLNCPTLQILLLHSSKVNFEVSNVYFERMKMLKILAFLTSSYKLKLSRFERRYTLSLPQSIESLKNLHTLCLRGYELGDISILERLQSLEILDLRGSCFDELPNGIVALKKLKLLDLYKCQIVNNNAYKVIGGCLQLQELYLHLYPHVKEFPHNVSFSRLRRYVIIQHHAESYPLHQQTDILEEHRLGRALCIDGFNASAQSFISLPIKDLFLRAEYLHLERLRGGYENVIPSFRDPEGMNQLIVLILKFCPEIECIFDNTIITNTNVFSCLVTLGLYDMDSLKEVFPRNSKLCCLKVLRIERCPMLTSLFMPSIVQTLEVLENLEISYCSELMHIIKEVEEGYVDYVSSQGHTSLMLPKLRRLVIYGCDRLEYILPMYFARRLVSLEELGIRDCNELKHVFGSEKEHHLSVYQHQSHHQTNIDINLYTLWLGSLPNLVGIWFDYCHTCLPNLKRLDCTECPRLSNFPMHKAMIDSDLQQDTTGMENEILWLVATTFNHLGDQMFSSELKVVLKSRYLDLSHLGVKGLFQFQMVELGINGVQVPLNLDLSILDLTNLPELKFIWKGPTNFLSLQMLEIIRVYGCPKLKTIFSPAIVRSLPMLRELDILNCEELEQIFDSSDAQELKSLYTCSQQVCFPKLYEVKVQEKFLLLNVNMMIMVKKELARMENKYC

SEQ ID NO: 125796 - protein, 141 aa, Glycine max
  Coding DNA Sequence Number=SeqID_34111
  Gene Ontology: Mol. function=ATPase activity, coupled to transmembrane movement of substances; Cellular component=integral to membrane; Biological process=transport
  Homolog annotation: Hit_ID=Q9LF78; Match level="QueryCoverage=70%, HitCoverage=13%, E-value=3e-41, Identity=82%"; Hit description =Mitochondrial half-ABC transporter
  Pfam annotation: Domain name=ABC_tran; Domain location=23-138; Score=- 31.7; E_value=0.0003; Accession=PF00005.18; Description=ABC transporter
MAEIGSYHAAMLHSLMPIAKCFTGKSTILRLLFRFFDPHSGSIKIDDQNIREVTLESLRKSIGVVPQDTVLFNDTIFHNIHYGRLSATKEEVYEAAQQAAIHNTIMNFPDKYSTVVGERGLKGKKGYGIANLNLLDQTPPM

SEQ ID NO: 125797 - protein, 784 aa, Glycine max
  Coding DNA Sequence Number=SeqID_34112
  Gene Ontology: Mol. function=binding; Cellular component =extracellular region
  Homolog annotation: Hit_ID=A7NXY1; Match level="QueryCoverage=86%, HitCoverage=99%, E-value=0.0, Identity=73%"; Hit description =Chromosome chr6 scaffold_3, whole genome shotgun sequence
  Pfam annotation: Domain name=TPR_2; Domain location=407-440; Score =4.2; E_value=9.1; Accession=PF07719.8; Description=Tetratricopeptide repeat
  Pfam annotation: Domain name=TPR_2; Domain location=487-520; Score =18.1; E_value=0.034; Accession=PF07719.8; Description=Tetratricopepti de repeat
  Pfam annotation: Domain name=TPR_2; Domain location=5-38; Score=16.1; E_value=0.13; Accession=PF07719.8; Description=Tetratricopeptide repeat
  Pfam annotation: Domain name=TPR_2; Domain location=528-561; Score =6.4; E_value=4.8; Accession=PF07719.8; Description=Tetratricopeptide repeat
  Pfam annotation: Domain name=TPR_4; Domain location=487-512; Score =7.2; E_value=5.4; Accession=PF07721.5; Description=Tetratricopeptide repeat
  Pfam annotation: Domain name=TPR_4; Domain location=5-30; Score=9.7; E_value=2.7; Accession=PF07721.5; Description=Tetratricopeptide repeat
  Pfam annotation: Domain name=TPR_4; Domain location=528-553; Score =6.7; E_value=6.3; Accession=PF07721.5; Description=Tetratricopeptide repeat
  Pfam module annotation: Pfam domain module=TPR_2::TPR_2::TPR_2::TPR _2::TPR_4::TPR_4::TPR_4; Domain location=407-440::487-520::5-38::528 -561::487-512::5-30::528-553
MEAVAEGLWGLAEYHEKRGEIGKAVKCLEAICQSDASFFPIVEVKTRLRIATLLLHHSHNVNHAKSHLERSQLLLKSIPSCFELKCRAYSLLSQCYHLVGAIPPQKQVLHKGLELAASVGYEISMKLWSCNFNSQLANALSIEGDYQGSISALECGYVCATEVCFPELQMFFATSILHVRLMQWDDDNLVEQAVNRCNQIWESIAPDKNAAPHVDNLDAAMKIDMQQTQRIQELVKELNTLDQSLSRSDLHYRDRTALSKKQTMIQEQLQNMTGLSSIGQESLQPVYFGNVRRIIGDKLQLAPPPIDGEWLPKSAVYALVDLIVVVFGRPKGLFKECAKRIQSGMNIIQDELLKLGITDGVREVDLQHSSIWMAGVYLMLLIQFLENKVAIELTRAEFVEAQEACECIFEMLRGQYAHSVGCYHEAAFHFIEAVKLTDSKSMQAMCQVYAAVSYICIGDAESSSQALDLIGPVYGVMDSFVGVREKTGVLFAYGLLLMKQQDLQEARNRLARGLQLTHTYLGNLQFVSQYLTILGSLALALHDTVQAREILRSSLTLAKKLYDIPTQIWVLSVLTALYKELGERGNEMENAEYQNKKLEDLQRRLANAHASIYHIEIVSSPRQRIVHQLNDLDIKRAMADPTMGVNLDIPESIGLSAPLSAPSSSRLVDIDTRRRPSGLKSLADRVSTYQQGGGGVRIAMLEDGVFHKILQDLVMHDSVKVGIVALAKRSTRSGGSEKEKAEEGEVVEEGGGGGLREEAILEVVEHFAAVALEHGNEASVAELL

SEQ ID NO: 125798 - protein, 114 aa, Glycine max
  Coding DNA Sequence Number=SeqID_34113
  Gene Ontology: Mol. function=thiamin pyrophosphate binding; Cellular component=peroxisome; Biological process=fatty acid alpha-oxidation
  Homolog annotation: Hit_ID=A7QTE9; Match level="QueryCoverage=92%, HitCoverage=20%, E-value=2e-49, Identity=85%"; Hit description =Chromosome undetermined scaffold_167, whole genome shotgun sequence
  Pfam annotation: Domain name=TPP_enzyme_C; Domain location=1-97; Score=-43.7; E_value=0.024; Accession=PF02775.12; Description =Thiamine pyrophosphate enzyme, C-termina
HVCDTSSFIQTLVRYQLPVVVIVFNNGGVYGGDRRRPEEIDGPHKDDPAPTDFVPNAGYHALIEAFGGKGYLVGTPDELKSALSESFSARKPAVVNVVIDPYAGSESGRMQHKN

SEQ ID NO: 125799 - protein, 825 aa, Glycine max
  Coding DNA Sequence Number=SeqID_34114
  Gene Ontology: Mol. function=protein dimerization activity; Cellular component=nucleus; Biological process=regulation of transcription, DNA-dependent
  Homolog annotation: Hit_ID=A7L5C4; Match level="QueryCoverage=88%, HitCoverage=91%, E-value=0.0, Identity=64%"; Hit description=Auxin response factor 8
  Pfam annotation: Domain name=Auxin_resp; Domain location=333-416; Score=203.9; E_value=4e-58; Accession=PF06507.4; Description=Auxin response factor
  Pfam annotation: Domain name=B3; Domain location=206-311; Score =111.5; E_value=2.5e-30; Accession=PF02362.12; Description=B3 DNA binding domain
  Pfam module annotation: Pfam domain module=Auxin_resp::B3; Domain location=333-416::206-311
MAISENVLPLKLLFCSNWVPLVRACGASWIPLKGFWGGFDFWECIGKWEEWNMGECNNDNYNNNNNGFGEIEDGGSELGFHGHEDNLMFGMMVGGEKKCLNSELWHACAGPLVSLPTAGTRVVYFPQGHSEQVAATTNREVDGHIPNYPSLPPQLVCQLHNVTMHADVETDEVYAQMTLQPLTPQEQKDTFLPMELGVPSKQPSNYFCKTLTASDTSTHGGFSVPRRAAEKVFPPLDFSQQPPAQELIARDLHDVEWKFRHIFRGQPKRHLLTTGWSVFVSAKRLVAGDSVLFIWNEKNQLLLGIRRANRPQTVMPSSVLSSDSMHIGLLAAAAHAAATNSCFTVFYNPRASPSEFVIPLSKYIKAVYHTRVSVGMRFRMLFETEESSVRRYMGTITGISDLDPVRWPNSHWRALLSPFFTNDLVTDGRDEATNGLMWLRGGPGDQALNSLNFQGSGLLPWMQQRMDPTLLGNDHNQQYQAMFASGLQNLGSGDLMRQQMMNFQQPFNYLQQSGNPNLPLQLQQPQAVQQSVSSNNILQPQAQVLAENLSQHLQKSHNNREDQTQQQQHTYQDTVLLQSDQLHQRQHSGLPSPSYSKPDFLDSSMKFPASVSPGQNMLGSLCPEGSGNLLNLSRSSQSMLTEQLPQQSWAPKFTPLQINAFGNSMQHVQYSGKDTAMVPPHCNPDSQNPILFGVNIDSSGLLLPTTVPRYTTASAEIDASAMPIGESGFQSPLYPCVQDSSELVQSAGQVDPQNQTRTFVKVYKSGSVGRSLDISRFSSYHELREELAQMFGIEGKLEDPLRSGWQLVFVDRENDVLLLGDDPWE

SEQ ID NO: 125800 - protein, 100 aa, Glycine max
  Coding DNA Sequence Number=SeqID_34115
  Subcellular localization annotation: CTP_CleavageSite=71; ConfidenceScore=5.13e-01
MEELINKTQLSSKIIPTSSRRLGGSTKNLTSCTLLQLFCSHEHGSRSSQGNCAISVEATLSCTVTPPMVISLGHKGVPKPSDTPLVQVLLLTRNYKYILP

SEQ ID NO: 125801 - protein, 27 aa, Glycine max
  Coding DNA Sequence Number=SeqID_34116
MAQGWWPEMMHPVPIEKARFLARIPSQ

SEQ ID NO: 125802 - protein, 127 aa, Glycine max
  Coding DNA Sequence Number=SeqID_34117
MTRGNPSDLQPFDPKIDRTFHRLFRHHFIPFDHSEHSITGESVHFVIGDFEHPDLEHYNFEHSDSEHSDFAHSENMAQPPPRERTLREMAAPDFTYESLCIQYPDEDVPYVLKTGLIHLLPKFHALQ

SEQ ID NO: 125803 - protein, 112 aa, Glycine max
  Coding DNA Sequence Number=SeqID_34118
MVILCLAAQARTCPTKRRDKLWFRWQGGSLAEWCFARTKLVSYLYFPFISNKRQVKRGNCHTLISSGDHLLLGCDPHLTTSRYLAPIVRKFVKFWDVPEVKRKHCSTIREVP

SEQ ID NO: 125804 - protein, 105 aa, Glycine max
  Coding DNA Sequence Number=SeqID_34119
MEESLSPFLVRDFDTQSFKIIQRVHKAWESPLRKDKELRGIRNGIIGGYHEWLRVIHEEPLNKKPRGLARKSMAEINSEELCGAATMSSISRERKETSHEYMAWS

SEQ ID NO: 125805 - protein, 46 aa, Glycine max
  Coding DNA Sequence Number=SeqID_34120
MVPRMSSGPPPLDDKGSVSQRLWDGRKKRGSCSYVSSICDEELRPT

SEQ ID NO: 125806 - protein, 170 aa, Glycine max
  Coding DNA Sequence Number=SeqID_34121
DRTHKIPSGPRGVQQGTGVSNFGYGPLSILQGARPPQQGIAPARHPMDPEKSNRVLGFPALITGLCQFYGVPIAPSKVIRPPTNRAFIKKYCAPRQAQGETPQQPGDGRQQATDKQPPPPEPLSSSTTAGALPMTRGRPVGDQVQSQRKAKVPVTNKSSRVRLKILKKRY

SEQ ID NO: 125807 - protein, 52 aa, Glycine max
  Coding DNA Sequence Number=SeqID_34122
MWDRHKLQGALKPGVFTPKTYTPKSPSGPLPPDSAHITSNVTSSVNHTLIHN

SEQ ID NO: 125808 - protein, 208 aa, Glycine max
  Coding DNA Sequence Number=SeqID_34123
  Homolog annotation: Hit_ID=Q5XM22; Match level="QueryCoverage=52%, HitCoverage=76%, E-value=1e-38, Identity=63%"; Hit description =Resistance-like protein HAAS-2
FHALSTEEARFLLTELLEAPRWIVAAHTYLLHLVGCTLFANKSATYVHVVHLDAFRDLAQSGGYAWGVAALVHMYDQLDEACRTTTRQLAGYLTLLQCWIYEHFPSVHQCVTDDTYQETSPRASRWLTSKAHMKESQEHLTGHVVMEISSFQGQLRWGPMVVTARPERVSIPPPPVGARLSHDEIDDRWMQFAEHLLPAGQLCLVPEQ

SEQ ID NO: 125809 - protein, 178 aa, Glycine max
  Coding DNA Sequence Number=SeqID_34124
MTTLTWIWMTLLFSNILPSDHNANLPLQMYQLGSRPQDAQWTRRSPTGPWGFQLWLRASVSPIGCPSPPARSCHRDIGKDRAHKTPSGPKEVQQGPGVSSSDYEPLSILRGASFPQQGHRGPKYTYGFYYIELSSRSTAPPGRLAGRNTPTAVGMAGSGSTDALPPPLEFTLAHPQKG

SEQ ID NO: 125810 - protein, 129 aa, Glycine max
  Coding DNA Sequence Number=SeqID_34125
  Gene Ontology: Mol. function=oxidoreductase activity; Biological process=electron transport
  Homolog annotation: Hit_ID=Q1VWJ1; Match level="QueryCoverage=93%, HitCoverage=37%, E-value=9e-33, Identity=56%"; Hit description =Pyridine nucleotide-disulphide oxidoreductase, putative
MPRWKHTARLRRIAEGSITAHFNSELIEIKEHSVVFKDKNGEINEIQNDFVLAMTGYLPDFGFLINAGIELQGECLNPVYDPETMETNIQNLYLAGVVCGGKDTHLWFIENSRIHADMIIKNILKTREH

SEQ ID NO: 125811 - protein, 38 aa, Glycine max
  Coding DNA Sequence Number=SeqID_34126
MPRALNSTAHQSAYFKKRALEAGFFCNGWLNTLVGDFY

SEQ ID NO: 125812 - protein, 90 aa, Glycine max
  Coding DNA Sequence Number=SeqID_34127
  Subcellular localization annotation: CTP_CleavageSite=48; ConfidenceScore=5.16e-01
MAEINQGKTMTGHDWPRIFVSYLQVHRDRSSGARVTTDRSLPLPGAKQAENVTARQPSLRPRLCSEAMGHATLLPFSCNLRPNMHPPSAR

SEQ ID NO: 125813 - protein, 100 aa, Glycine max
  Coding DNA Sequence Number=SeqID_34128
MVKKQKFIGHQEAGYPPNDISRRDNPVYILSSLLDVLLLKKDITNSCIYESANARGEAGLRIGRSSASSLTDSLRSVVRLRRAVSAHSKAVIRFIHRIRG

SEQ ID NO: 125814 - protein, 70 aa, Glycine max
  Coding DNA Sequence Number=SeqID_34129
NAPARHLVDPEKSNKVLGFPALITSLCQFYGVSVTHNKVIRPRVNRAFIKKYCAPRQAQGETPQQHWDGR

SEQ ID NO: 125815 - protein, 75 aa, Glycine max
  Coding DNA Sequence Number=SeqID_34130
MCSAVRCCNIGGDGVTVSGQMSYRMSRHHASEHAVYVCPYEQIKQVNNTRELFTQFGATSPTSGGYQAREEIHSQ

SEQ ID NO: 125816 - protein, 17 aa, Glycine max
  Coding DNA Sequence Number=SeqID_34131
VDDYEEPDARGHENTML

SEQ ID NO: 125817 - protein, 117 aa, Glycine max
  Coding DNA Sequence Number=SeqID_34132
MPTPFAYQSNKVVPWKYIPPAFGERVATEVDSLSAKVTNITGLSGVTHSGRVFAPPHSAELPSKGKAPMLQEPTDVATPSKEVDPPLVKGAEKKEGKTVTLEEAHEFLRLIQQSEFK

SEQ ID NO: 125818 - protein, 83 aa, Glycine max
  Coding DNA Sequence Number=SeqID_34133
MPFKPNVCDEDMTKSKGKNPLEGLGGPMTRARARKAKEALQQVLSILFEYKPKFQGEKSKGPIGNLGISLLGDQMVADLLAVG

SEQ ID NO: 125819 - protein, 164 aa, Glycine max
  Coding DNA Sequence Number=SeqID_34134
  Gene Ontology: Mol. function=DNA binding; Cellular component=nucleus; Biological process=regulation of transcription, DNA-dependent
  Homolog annotation: Hit_ID=A7PVU5; Match level="QueryCoverage=59%, HitCoverage=25%, E-value=3e-26, Identity=64%"; Hit description =Chromosome chr8 scaffold_34, whole genome shotgun sequence
  Pfam annotation: Domain name=SBP; Domain location=76-139; Score=70.8; E_value=4.6e-18; Accession=PF03110.5; Description=SBP domain
  Subcellular localization annotation: CTP_CleavageSite=76; ConfidenceScore=5.59e-01
MSSGSVTKAPPPSSSSSPNSSSESLDGLKFGQKIYFEDVSVAATTTTQGAYKTSRVVSSPSSASKKGRGGSLQPPRCQVEGCKVDLSGAKAYYSRHKVCTMHSKFPTVIVAGLEQRFCQQCSSWLAILGNSTSALVSFPHLTSIVFAIFSAFAILLCYSHALVF

SEQ ID NO: 125820 - protein, 92 aa, Glycine max
  Coding DNA Sequence Number=SeqID_34135
MREICLKIRDEGGSRTRVRLRRMTGFVGIYRGGRSVIDYKVYGQERFHSQKVVASSIRFVHNNCRQKYIPLLQWIKQHYFVSYYAKKLEQIQ

SEQ ID NO: 125821 - protein, 116 aa, Glycine max
  Coding DNA Sequence Number=SeqID_34136
MASMMEAMLGMRQLMEKNVATTAAVSSAAEVDPTLLATAHHPPPNTVGREKSTQGHNINPRLGYNRVAYPYGLSPNYTPPVMHDDVGHVSSPILEREPPQQPHEAHEDHQEHAQGD

SEQ ID NO: 125822 - protein, 94 aa, Glycine max
  Coding DNA Sequence Number=SeqID_34137
  Subcellular localization annotation: CTP_CleavageSite=63; ConfidenceScore=5.18e-01
MSLKKLSAKRSRRDVAAEGTSAGPEFDSHRFRAPSTSSVSRPSKDGRSTERDASSSGTMKGVRDMQSWVRGQWIPFDADAFSQFLGDPLVLEEG

SEQ ID NO: 125823 - protein, 293 aa, Glycine max
  Coding DNA Sequence Number=SeqID_34138
MEPIASLSQYYDQPLRCFTFEDFQLVPTVKEFEEILGCPLGGRKPYLFSGFYPSTTRVAKYQGSVWRKGQRPWQIKANGLSFIDILALLIFGVVLFPNMEGLVDLAVIDAFLAFHHGKESPVVAILAMYDTFDRGCEKSSARIVCCALALYVWLVSHLFLQEGRPVYPLQGHRSILSSCEGCPMRGVPSDESITPFIARGFSDHNVRYSKEFARHGMRREERTESLGEATVRDDEVKASEESDEVQALKAELERARVVEEKFKAAIVSSSSEEVKGIITGQRHDLEGRAKGLP

SEQ ID NO: 125824 - protein, 66 aa, Glycine max
  Coding DNA Sequence Number=SeqID_34139
MRASEGWVTGNRLPGRFSALWSGYYHAYSYRLVEPVQVIEVTSFEEDPEEDPEELPPELAADALDF

SEQ ID NO: 125825 - protein, 97 aa, Glycine max
  Coding DNA Sequence Number=SeqID_34140
MERSMIDAASGGALGDMTPAEARNLIEKMMQSYPPRVLDRRLQEARARATKEGLRVLMNLRGILSSLCSRNFFCIFKYFVKELFKEVLLRKLLKEAT

SEQ ID NO: 125826 - protein, 224 aa, Glycine max
  Coding DNA Sequence Number=SeqID_34141
  Gene Ontology: Mol. function=metal ion transmembrane transporter activity; Cellular component=membrane; Biological process=metal ion transport
  Homolog annotation: Hit_ID=Q2KBW5; Match level="QueryCoverage=30%, HitCoverage=20%, E-value=5e-27, Identity=86%"; Hit description =Magnesium/cobalt transporter protein
MTVKTSDTCSSRRRSQLVCKRMPGADKPVRARQRMRKEKIPHQAPFAIQAAQLLGRAIGAGLFAITPAGERGMCCKAIKLGQALPYRRPRNGRACDDGDHGKARTRLETGPLITAYCSNCKSVEIGDLSQTAAFPDDVVWIDMVEPTREEELYVEKVIGIEVPTRDDLKDIEPSARLYGTELEFVIMVIAVSFGKPVVPAALMNRPTRGERRFAYWALFRFLAH

SEQ ID NO: 125827 - protein, 181 aa, Glycine max
  Coding DNA Sequence Number=SeqID_34142
  Homolog annotation: Hit_ID=B0HC01; Match level="QueryCoverage=18%, HitCoverage=70%, E-value=5e-11, Identity=100%"; Hit description =Putative uncharacterized protein
GGGAYGKTPATRPFYGSWPFAGLLLTCSFLRYPLILWITVLPPLSELIPLAAAERPSAARNSYDHDYEFELGTIETGRWFDILEVVAGRHFDADHFFDVELFLARRLDHVDPDDVIRKCGGLRQIANLDGFAIGAIGGDQRAGLQPRSRLAMIAIIARPSITRPPIGQRLPCSLTETDGIL

SEQ ID NO: 125828 - protein, 39 aa, Glycine max
  Coding DNA Sequence Number=SeqID_34143
MALAWALPGGTFFSSDCMQICGSSLPPMDTSSCPQSMNR

SEQ ID NO: 125829 - protein, 146 aa, Glycine max
  Coding DNA Sequence Number=SeqID_34144
MTQELVACGDTLRLSAPRFSESVIDRAEANMVICTLSEDVHLLVETFSSLTSYPELQAGSPMIRGDTLWLSAPFCHPEAAGPMTSRDQVWSFCTLVSSRGGGPDDTRRYLTVIRTLLSSRGGGPDDKQRPSLVILHPCIIQRRRAR

SEQ ID NO: 125830 - protein, 60 aa, Glycine max
  Coding DNA Sequence Number=SeqID_34145
MGNAMSLLSEHAALSEFISTHCVYRRSQKNSLSAPTALKLVPLSAAFKELSAYPCGRCSA

SEQ ID NO: 125831 - protein, 61 aa, Glycine max
  Coding DNA Sequence Number=SeqID_34146
LKSKWSGPFTIKKVWPYGVVELCDPQSKDPDRTWVVNGQRLKQYHGGAMERLNTILHFKLE

SEQ ID NO: 125832 - protein, 59 aa, Glycine max
  Coding DNA Sequence Number=SeqID_34147
MDKLRAKRPAKPVDRHMTETSMRAGNASVYGLLKPQPIQRYRQLQFESKDYIKKWMQNS

SEQ ID NO: 125833 - protein, 65 aa, Glycine max
  Coding DNA Sequence Number=SeqID_34148
MAFVDDWVMGNEKGQYWLSDDIVGLVGSLAILASILSPVKTKSAKLKGAYPTIGIISFSIIGGAT

SEQ ID NO: 125834 - protein, 99 aa, Glycine max
  Coding DNA Sequence Number=SeqID_34149
  Homolog annotation: Hit_ID=Q1RSH0; Match level="QueryCoverage=100%, HitCoverage=51%, E-value=1e-11, Identity=37%"; Hit description=H+ -transporting two-sector ATPase, alpha/beta subunit, central region, related
MGYFSEHGWEWNFSWRHNLFDSEMGVASNFLETIAAIRICGTLKDTWLWGAEPNGIFSTKSAYNLIKAEQLLEDQDSGFHQLWDLKVPPKVLSFAWRLL

SEQ ID NO: 125835 - protein, 96 aa, Glycine max
  Coding DNA Sequence Number=SeqID_34150
  Subcellular localization annotation: CTP_CleavageSite=29; ConfidenceScore=5.12e-01
MEPLKMRTRSLLKVRACSPLQVRMCSPLMARTYSPLKVLGTSTQGSTFMRKQEIDSSRGPIDCPFEKGDNSCNPILSFANLSGNSLRVYVLFDLVT

SEQ ID NO: 125836 - protein, 127 aa, Glycine max
  Coding DNA Sequence Number=SeqID_34151
  Homolog annotation: Hit_ID=A5BEV8; Match level="QueryCoverage=61%, HitCoverage=9%, E-value=3e-08, Identity=42%"; Hit description =Putative uncharacterized protein
MNSICPPLEKVKTKGAPKKPLAKQQKSTKRDPSYWEYVDALHFMQNTALLGMGEESWSLVRNHLHKELTSWSDEYMNLVGGIERFEELKRSLLADDLSKLTMDKWMNITDMGYVITSRYNVIVVSLS

SEQ ID NO: 125837 - protein, 65 aa, Glycine max
  Coding DNA Sequence Number=SeqID_34152
MIMRGQDIYSSQDEATSSPSSSESEEAKGEESSEEIYPQEKEQPLMVLLGIKPSFVKSLVHPTSS

SEQ ID NO: 125838 - protein, 229 aa, Glycine max
  Coding DNA Sequence Number=SeqID_34153
  Gene Ontology: Mol. function=signal peptidase activity; Cellular component=integral to membrane; Biological process=signal peptide processing
  Homolog annotation: Hit_ID=A6T7R6; Match level="QueryCoverage=100%, HitCoverage=37%, E-value=1e-123, Identity=95%"; Hit description =Protease IV, a signal peptide peptidase
  Pfam annotation: Domain name=Peptidase_S49; Domain location=1-143; Score=147.7; E_value=3.2e-41; Accession=PF01343.9; Description =Peptidase family S49
SYTQGQYYLASFANKIWLSPQGEVDLHGFATNGLYYKSLLDKLKVSTHVFRVGTYKSAVEPFIRDDMSPAAREADSRWIGELWQNYLNTIAANRQITAQQLFPGAQGVIDGLRKVDGDTAKYALDNKLVDELATSTEVEKALTKQFGWSKADNNYRAISYYDYNVKAPTEQGSAVAVIFANGAIMDGEETPGNVGGDTTAALIRDARLDPKVKAIVLRVNSPGGSVSAS

SEQ ID NO: 125839 - protein, 79 aa, Glycine max
  Coding DNA Sequence Number=SeqID_34154
MRTRSPLKARACSPLQARMCSPLMARTYGPLKIDCPFEKGDNSCNLILSFANLSGNSLRVYVLFDLVTLPFWSDGNGAV

SEQ ID NO: 125840 - protein, 172 aa, Glycine max
  Coding DNA Sequence Number=SeqID_34155
MNFHAIYLHLRGNSTSYIHLGSILVPFSPWIFEMHYLLYIHTLQAWVPRPRIAFGHLFYPLRVVLIHINQPHSPKFTKPCSYVVEAFHRALGGRMFRHEYQENGGNVACPITSECPLGLRPSLTTPQFNKNKQQFKDKSLTFFSKYMQLRVPKYINGKLESPRMRYLLVGDE

SEQ ID NO: 125841 - protein, 84 aa, Glycine max
  Coding DNA Sequence Number=SeqID_34156
MVGQGGRALESMGGPHFVQVQSKHSFPPYGLPPNYTPPNVAYAPDENVDNSAPIPIESQQPQSGHAQVPRPPWERHMKYLETTL

SEQ ID NO: 125842 - protein, 61 aa, Glycine max
  Coding DNA Sequence Number=SeqID_34157
MVINYSFVNQFEKQCWLLVIDYYLLVIDYQKVCHHQKGGDCRSKLHDDEPNNFDDAKSPSD

SEQ ID NO: 125843 - protein, 149 aa, Glycine max
  Coding DNA Sequence Number=SeqID_34158
  Gene Ontology: Mol. function=RNA-directed DNA polymerase activity; Cellular component=nucleus; Biological process=regulation of transcription, DNA-dependent
  Homolog annotation: Hit_ID=A5BHZ8; Match level="QueryCoverage=73%, HitCoverage=7%, E-value=1e-10, Identity=28%"; Hit description =Putative uncharacterized protein
DLQQSSSREVEMGFVSPKQGVDLMAVTHDQQFNNVLQQGTVWRVGNGDKIRFWEDCWTGSAWEWNLSWRRPLFDNEVASAVGFLEDISHTALQQYAADSRVWKPESNGYYSSKSAYILLQGNSEEGNMDDTFKDLWKLKIPAKASIFAW

SEQ ID NO: 125844 - protein, 98 aa, Glycine max
  Coding DNA Sequence Number=SeqID_34159
  Subcellular localization annotation: CTP_CleavageSite=29; ConfidenceScore=5.28e-01
MSPPPLGPLNHSQTQLMLSGRLPFPALVSANLHTTKSLKLSGIWTSLSRTEDMQEILKKNGQTPPLNMILGLNRWLCSCSCDSSSRSAEEGCAQQMAR

SEQ ID NO: 125845 - protein, 119 aa, Glycine max
  Coding DNA Sequence Number=SeqID_34160
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSVEDESSGSCTTEFGTELEFVIMVIAVS

SEQ ID NO: 125846 - protein, 136 aa, Glycine max
  Coding DNA Sequence Number=SeqID_34161
MSRNFTDCLTMGVKYLEVVKRRSHPNKQMGLVDKPSGGHHVVQRLGPARPTRLDGINRSPSMIGKRALFGGVALEGKFLIALEPAPKWALPAGRVGVGVVAWGVSLWIGGGTLACIGAELEDSPTRVEKLGLCCAY

SEQ ID NO: 125847 - protein, 105 aa, Glycine max
  Coding DNA Sequence Number=SeqID_34162
MNKIRNGQDKGKWITTNVRAALDEHWGSTNFLNKSSTAKVNRSVDRGVIRRVERRHHFKEKMSLEEAHHHRRSWIRVLRKKEMNEGKGREEHEIFCSKRALNFEV

SEQ ID NO: 125848 - protein, 243 aa, Glycine max
  Coding DNA Sequence Number=SeqID_34163
  Homolog annotation: Hit_ID=A4W8P5; Match level="QueryCoverage=98%, HitCoverage=75%, E-value=1e-83, Identity=64%"; Hit description =Putative uncharacterized protein
  Pfam annotation: Domain name=DUF535; Domain location=27-243; Score =86.2; E_value=1e-22; Accession=PF04393.4; Description=Protein of unknown function (DUF535)
MSSIAENPDSELSQPKSGWKLFCRLASGEITPGRAWRNPAYRRKFILRSLMKPFATAQLLNDLARQPQLPAMLNVQPGLPCRLHRPWLSVNCSQQQILDALNFHYQAMSEQLTPLALNGYLSRAGTLLATISGKDDRQFRIVLRAEPNLDKEGEATLSFVTEEDIVLAELTFTLCRLEGKRVMWIGGLQGAKANVSHQLIQDATKACHGLFPKRLLVEAAMSMGQSFSVERLQAVSNTTQGIL

SEQ ID NO: 125849 - protein, 33 aa, Glycine max
  Coding DNA Sequence Number=SeqID_34164
MANVFLAGNVRSASSDDASVLNLDRLTFHADVG

SEQ ID NO: 125850 - protein, 58 aa, Glycine max
  Coding DNA Sequence Number=SeqID_34165
MGSNQAHSFKKRVSSSQGQVWKLMVAEWRWKNTDWKCHFKEKMSQEEAHHHRKPWIRA

SEQ ID NO: 125851 - protein, 174 aa, Glycine max
  Coding DNA Sequence Number=SeqID_34166
MISRLSQEQFKNQEKVSSRRFKIQDSKIQESREDSIKISIKKFFKTLSSTSSFLQNHYQRVLLSGNCHTLISSGDHCLAPCNLRLTASRVAYGGSNPARLGELGGNLLPHFPINRRREVVPNIPNPLGYAFQLFWVKKIISVKKIQVEVLPRRFCEKIREGFPSFFIRSSFFNG

SEQ ID NO: 125852 - protein, 99 aa, Glycine max
  Coding DNA Sequence Number=SeqID_34167
MAFGLKVARLGELSSPKRADNFILKQPCSPKRAGYFIMKLSSPMKDKGEDFESYEGIKVRTLSPIKDDVRTLSPMKDQVRTMSPIKARTLSPMKQANGH

SEQ ID NO: 125853 - protein, 265 aa, Glycine max
  Coding DNA Sequence Number=SeqID_34168
LMFPPERSMLELSSQDALLAQNKLLAKQLKSLTETLSKLPTQLQAAQPSYSTVMQVRGYSICGGAHESDCCITQDEVSKEGQGWRSHPGNQFNKDQGGPSNRSLNQGPNLYERTTKLKETLSQFMQNSFGGFGANTEKNPKEECKAVMTRSKKETIVEDKSRTNEEKELEVEGEKENEGNQINERKINDEEEEKNEKKRDSEEEKKTKSELAREKKKEAVPSSGKEAPYPLKDWRNGSPTNKNDTAISGSLNHKAIWYSGGRVGQ

SEQ ID NO: 125854 - protein, 182 aa, Glycine max
  Coding DNA Sequence Number=SeqID_34169
  Homolog annotation: Hit_ID=Q84VI1; Match level="QueryCoverage=98%, HitCoverage=30%, E-value=8e-92, Identity=82%"; Hit description =Envelope-like protein
MDLIKAAGLLKTVSKLGDCYEGLIREFIVNIPSDISNRKSDEYQKVFVRGKCVRFSPAVINKYLGRPTDGVIDIAVSEHQIAKEITAKQVQHWPKKGKLSAGKLSVKYAILHRIGAANWVPTNHTSTIATESFAVKLPIAFPTVLCGIMLSQHPNMLNYTDSVMKRESPLSLHYKLFEGGIL

SEQ ID NO: 125855 - protein, 90 aa, Glycine max
  Coding DNA Sequence Number=SeqID_34170
  Subcellular localization annotation: CTP_CleavageSite=40; ConfidenceScore=5.07e-01
MEKNSKKTLQLLDATSATNLVTSKQISPQTSNGLRRIRRKVMKKEDPVRHILHEMTIIHPMVRRRRLTFYPKTMRAMRTSLKKTKQKAKV

SEQ ID NO: 125856 - protein, 110 aa, Glycine max
  Coding DNA Sequence Number=SeqID_34171
  Gene Ontology: Mol. function=hydrolase activity, acting on carbon -nitrogen (but not peptide) bonds; Cellular component=cytoplasm; Biological process=nitrogen compound metabolic process
  Homolog annotation: Hit_ID=A4WEJ5; Match level="QueryCoverage=100%, HitCoverage=19%, E-value=1e-52, Identity=91%"; Hit description =Urease subunit alpha
  Subcellular localization annotation: CTP_CleavageSite=52; ConfidenceScore=5.40e-01
MGDINASIPTPQPVHYRPMFGALGAARHATRLTFISQAASANGVPQQLNLQSATAVVKGCRTVKKTDMIHNGLLPNITVDSQTYEVRVDGELITSEPADVLPMAQRYFLF

SEQ ID NO: 125857 - protein, 58 aa, Glycine max
  Coding DNA Sequence Number=SeqID_34172
MKKVDINEKSTKGKSVEFVRLLNEPMVTIQSTSYCIGTIDSKAGSVLMRVAAIRSKTS

SEQ ID NO: 125858 - protein, 75 aa, Glycine max
  Coding DNA Sequence Number=SeqID_34173
  Homolog annotation: Hit_ID=UPI0000ECBAF8; Match level="QueryCoverage =54%, HitCoverage=48%, E-value=1e-16, Identity=100%"; Hit description= UPI0000ECBAF8 related cluster
MRVVEDQVFGISLTINIQSRPAGMQAWHWPSFYNVVTGKTLALPNLIALQHIPLSPAGVIAKRPAPIALPNSCAA

SEQ ID NO: 125859 - protein, 100 aa, Glycine max
  Coding DNA Sequence Number=SeqID_34174
MGSFLKYLQHGAVFYVETVACKTQTAIVNGEFGVNPKSPVLMAICGSHREPPVKLASSMVQATGGFCRGAGAAFQKRELQLPLASCLQVATPIGGLHKKK

SEQ ID NO: 125860 - protein, 52 aa, Glycine max
  Coding DNA Sequence Number=SeqID_34175
ERGTGRMIGVGHESHGLYYLKPNLSWRRAFSISPLVLILLNRMALPKGRIGI

SEQ ID NO: 125861 - protein, 69 aa, Glycine max
  Coding DNA Sequence Number=SeqID_34176
MEEDLKKTLKFLDATNATKLATSKQIVLQMKNGLREAIRKGMMKEGPRKPTLHGLTMTHPTVERRRSTF

SEQ ID NO: 125862 - protein, 184 aa, Glycine max
  Coding DNA Sequence Number=SeqID_34177
  Homolog annotation: Hit_ID=A6FJQ2; Match level="QueryCoverage=20%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGIMSWYPVAPRAIASHLAVTRLEQLFFAAKIVENSGQNRYVVLNNCYDLGRETCRASCINESANARGEAVCVLGALPLPRSLTRCARSFGCGERYQLTHR

SEQ ID NO: 125863 - protein, 112 aa, Glycine max
  Coding DNA Sequence Number=SeqID_34178
  Subcellular localization annotation: CTP_CleavageSite=61; ConfidenceScore=5.77e-01
MCSPLASTPPLPPLPPPSPPSPPPPPLDASALPSTMKRTRKASRLRSLSTRPPGAERPVVLVDHATGKADGPHRKKLRTYLGIVARDKVDITYENWKEVPIAQKDLIWEDIQ

SEQ ID NO: 125864 - protein, 150 aa, Glycine max
  Coding DNA Sequence Number=SeqID_34179
STTQVDVPSTCTTKDVPSNVLRQRSQAVKPLILCEWGYKRILRREKGDTKEFRQLVLHSFGNGRRETQKEFRRSQVVKPLILCEWGYKDSQREKRMKRMNSTSFQGLENQKTSESFWYKEEEDVQRDSRLVKDCNEMIGKVFKIVVRKID

SEQ ID NO: 125865 - protein, 55 aa, Glycine max
  Coding DNA Sequence Number=SeqID_34180
MARTCSPMMARTCNPLKVKIDCPFEKADNSCNLILSFANLSGNSLRVYVLFELVT

SEQ ID NO: 125866 - protein, 81 aa, Glycine max
  Coding DNA Sequence Number=SeqID_34181
MTTFKVPNKTLTILREKLPKIITHKWKFGKLLEAPNTLLMKGLFVSKFESNAVLLSPIALKVVGPLLLDSKLSRDDTNPPF

SEQ ID NO: 125867 - protein, 206 aa, Glycine max
  Coding DNA Sequence Number=SeqID_34182
HNSCKSLSEELRYYYEGRHRSHLRPHSHRREKERKPQEANINLSYFHGKDNVEANLDWEIKVEQQLKKKSTSKSYGSLSYPKKDLGQGILGVTPSNPKYDKGKAIEKQAPKASMQEKTSSINQDEATTSPSSSESEEAKGEGSSKEIYPQEEEQPLMVKEYKEVSVSSKSTATPLGLDIIPQVKELLDGGLVRKSLNPCALLVPKI

SEQ ID NO: 125868 - protein, 37 aa, Glycine max
  Coding DNA Sequence Number=SeqID_34183
MMQSYPAKVLDRRLQEDWARDAREGPRVLMSLRGSIM

SEQ ID NO: 125869 - protein, 113 aa, Glycine max
  Coding DNA Sequence Number=SeqID_34184
  Homolog annotation: Hit_ID=A5BKB8; Match level="QueryCoverage=30%, HitCoverage=9%, E-value=1e-10, Identity=91%"; Hit description =Putative uncharacterized protein
MGGGAWPFLVGGAICLVNSVNERDLSLLNSYVEMFWADARYTDVFNESIALADRSGSLQLLVFNEEFLVSASHQLALTTSLPFVHTARRSYRLNGPVKCSDCGDVSGSLPATL

SEQ ID NO: 125870 - protein, 83 aa, Glycine max
  Coding DNA Sequence Number=SeqID_34185
PLGPSRIFLQKAVASGGSNLARLGELGGNHLPYFAINRGGSEEGRAEALPKRFRNVFREEFRKGFNRSSTFFIRSSSFFDLQR

SEQ ID NO: 125871 - protein, 94 aa, Glycine max
  Coding DNA Sequence Number=SeqID_34186
MKIVISIPLINCDFDGEEHYRDNCYFYSINKSVWRQDSTMYNHYEKRRALDLENVLANFMTYQASSKGDCYSAQQQGTQFGKDYSFEDYQWESE

SEQ ID NO: 125872 - protein, 97 aa, Glycine max
  Coding DNA Sequence Number=SeqID_34187
MLDKQEAMGPAKPADRSNRKVDDPLYLMTSTIPQFFLKPLQVMWDATMFRVFNQDFPLHLTETSMRARNPDVYGFLESQSIQRSGQSQFESESYMKN

SEQ ID NO: 125873 - protein, 85 aa, Glycine max
  Coding DNA Sequence Number=SeqID_34188
  Homolog annotation: Hit_ID=A6FJQ2; Match level="QueryCoverage=44%, HitCoverage=84%, E-value=2e-11, Identity=92%"; Hit description=50S ribosomal protein L5
MTVKTSDTCSSRRRSQLVCKRMPGADKPMRKEKIPHQAPFAIQAAQLLGRAIGAGLFAITPAGERGMCCKAIKLGNARVFPVTTL

SEQ ID NO: 125874 - protein, 28 aa, Glycine max
  Coding DNA Sequence Number=SeqID_34189
MVIFHHGDATEDKGEEVASLRKFLEKLL

SEQ ID NO: 125875 - protein, 203 aa, Glycine max
  Coding DNA Sequence Number=SeqID_34190
MNQKSAPVTRLCGLCSSADHHTYLCPFVQQSEAIEQPEAYAANIYNRPPQPQQQNQPQQNNYDLSSNRHYVPPLIQQQQQQQPQKQQTIEAPPQPSLEELVRQMTMTNMQFQQETRASIQSLTNQMGQLATQLNQQLSQNSNRLPSQSVQIPKNVSAITLRSGKQCQGPQPVASSSSANEPAQPHSIPKKGDDKNLKTNSKIC

SEQ ID NO: 125876 - protein, 187 aa, Glycine max
  Coding DNA Sequence Number=SeqID_34191
DPFKSAAVRIRKKNAELRDVNIATTKALEQETKRASKEEHGRNKFRGAQWGSNNELKLQREERDQLRLDGIILKDKLKTCLRSKRSLSQQLCETETNMLAIISQYKEELNLATAHEHKVADEYAQVYAEKEARGRVIDSLHQEATMWMDRFALTLNGSHKLPRLLAKAKAMADVYSAPEEIHGLLSY

SEQ ID NO: 125877 - protein, 64 aa, Glycine max
  Coding DNA Sequence Number=SeqID_34192
PHIFTVGICEIKFTEREKRIARRQYKWKLQSLLCLSDVWKLYRSSQRKRLEESQGIARDAAITV

SEQ ID NO: 125878 - protein, 225 aa, Glycine max
  Coding DNA Sequence Number=SeqID_34193
MANEHQQRVTLEDYSSSLVPQFFTSIACPEEEVVEKFLKKYFPESKTTEGKVVISSFHQFPDESLSEALERPQTKQLLDASVRGKIKLKTPEEATELIENMSASDHDILCDRVHQATKKSLLELSSHDALLAQNKLLSKQLEILTETLGKLMKQANVFPLKNTLKKFTIWEINRDKDILKEDFQASSRVLLMNKDNGDHTLPIQQGPNIFQRTTKLEETLTQFMQ

SEQ ID NO: 125879 - protein, 100 aa, Glycine max
  Coding DNA Sequence Number=SeqID_34194
MHRSPTGNSVPLDLEIEATLRRNRAERRRKLLQDKTVAVILEEETHFSDCSSSDSPLSRESVTYLPEAVSMADEHQQRVTLEDYSSSSVPQFFTSIARPE

SEQ ID NO: 125880 - protein, 86 aa, Glycine max
  Coding DNA Sequence Number=SeqID_34195
MSWMNIKGAFPFNLKQHFMQHISIQIEGLRAKRWRYWWLAVTWSIWKLRNRILFANAEFDTNRLFEEFCLQMQNFILIGFLKMLSL

SEQ ID NO: 125881 - protein, 150 aa, Glycine max
  Coding DNA Sequence Number=SeqID_34196
MWMDRFALTLNGSHELPRLLAKAKAMADTYSAPEEIHGLLRYWKNTITKRATRHPYRTRSKSRTMGDQEETQEQMKADMLALKEQMASMMEAMLGMRQLMEKNAATAAAVSLAAEADPTLLATAHHPPSNIVGRGRDTLGHDGNPHLGYN

SEQ ID NO: 125882 - protein, 207 aa, Glycine max
  Coding DNA Sequence Number=SeqID_34197
AKLAKEKFKLAATHIRKECAGLREENATTARALEQEAKRARKEEYGRNKFRGALWGSNNELKLRREERDQSRAHSMVLKEELVACSRSKRSLSQRLCETETNMLAIIAKYQEELGLATTHEHRVADEYAQVYAEKEARGRVIDSLHQEATMWMDRFALTLNGSQELPRLLAKAKAMADTYSAPEEIHRLLGYCQHMIDLMAHMIRNC

SEQ ID NO: 125883 - protein, 65 aa, Glycine max
  Coding DNA Sequence Number=SeqID_34198
TLVSTATPLGLEVIPQVKELLDEGVPTDPKRIKVIPDWPPPPSVEGRIPEYEEPRDLMSNPFQGG

SEQ ID NO: 125884 - protein, 220 aa, Glycine max
  Coding DNA Sequence Number=SeqID_34199
  Gene Ontology: Mol. function=coproporphyrinogen oxidase activity; Cellular component=cytoplasm; Biological process=porphyrin biosynthetic process
  Homolog annotation: Hit_ID=Q8UD80; Match level="QueryCoverage=100%, HitCoverage=78%, E-value=1e-115, Identity=82%"; Hit description =Coproporphyrinogen 3 oxidase, aerobic
  Pfam annotation: Domain name=Coprogen_oxidas; Domain location=14-220; Score=-34.9; E_value=8.6e-14; Accession=PF01218.9; Description =Coproporphyrinogen III oxidase
MERPILPKGLPEDIEDKKAVAQAWFQHLRDTIVASFETLENELTGPLSDQEPGRFVQKDWLRDNGEGGGGKMSMMEGRVFEKIPGAEEDPRFWASGLSLIAHPVNPNVPAVHMNTRMVVTTSHWFGGGADLTPVLGRRRTQQDADTQLFHRAFEITCNRHPVADYPRYKTWCDEYFYLKHRDEPRGTGGIFFDWLHPQEQNGGWDANFAFVQDVGRAFNL

SEQ ID NO: 125885 - protein, 126 aa, Glycine max
  Coding DNA Sequence Number=SeqID_34200
  Subcellular localization annotation: CTP_CleavageSite=44; ConfidenceScore=5.75e-01
MATQSNSPPPPPPSTGVASHSSSPPLKRTRKASRLRLLATRPVRAERPLVHVDPVTLKADGPHSKKFRTYLGIVARDKVDVTYENWKHVPITQKDLIWEDIQAEFDIPEASDLRTKKKILQTVGIL

SEQ ID NO: 125886 - protein, 93 aa, Glycine max
  Coding DNA Sequence Number=SeqID_34201
MARSVSASCPYSRALYGRELKGFLVIIPKVVISLLMVSRVPSGVANCRNLPFGRKATCDSWMRVPRKEYARSRHQRLFEEIIGKTGKDGIYEL

SEQ ID NO: 125887 - protein, 50 aa, Glycine max
  Coding DNA Sequence Number=SeqID_34202
MPSRLPTRELAGRGTPRDPTTSPAKVLIPGTRPSILSKKRVRRRMKKMKM

SEQ ID NO: 125888 - protein, 115 aa, Glycine max
  Coding DNA Sequence Number=SeqID_34203
MAAEWRRKRERRRHFKEQMSLEEAHHHRRLWIRAWRKKEMNEWGGREDDQGVPVNLKRIKVIPEWPTPPNIRKIWGFHDLTNFYKRFVPYFSILVALLIELLLREKAQSLKNLGI

SEQ ID NO: 125889 - protein, 163 aa, Glycine max
  Coding DNA Sequence Number=SeqID_34204
MKVHISSPSKDYMSSPSKDYMSSPSKDYMSSPSEGCVPSPLEDYTSSPLEDYTSSPSEDYMSSPLEDYTSSPSEDYTTTRPHLQRAARPRLQRTTRPHLWWTTRPLLKRTTRPHLQRTTRPRLQRTTCPHLYRATRPRLQRTTRPCLQRTRRPHLQRATRPRL

SEQ ID NO: 125890 - protein, 141 aa, Glycine max
  Coding DNA Sequence Number=SeqID_34205
  Gene Ontology: Mol. function=protein serine/threonine kinase activity; Biological process=protein amino acid phosphorylation
  Homolog annotation: Hit_ID=A6FJQ2; Match level="QueryCoverage=26%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTFAVDHFKKQFAYLEEHYGKGGTVTPPERQHASLPSRETCRASCINESANARGEAVCVLGALPLPRSLTRCARSFGCGERYQLTQR

SEQ ID NO: 125891 - protein, 114 aa, Glycine max
  Coding DNA Sequence Number=SeqID_34206
MWAFQTGHQINWAHLVRYQMHKALRANAPLPYPHLVTLFLHHFNVPLDDEPFVKVKRSFSTGAGAVTSFGYRKDVDDTRLDEMDTRIDGMDMRITQLEDDMSFNWQFFDPQADS

SEQ ID NO: 125892 - protein, 138 aa, Glycine max
  Coding DNA Sequence Number=SeqID_34207
MAPRKLSTKRSRKDAAAEGTSAATDFDSHRFKSAEHQQRFEAIKGWSFHQERRVQLRDNEYTDFLEEIARRCWTSLVAPMAKFDPDIVLEFYANAWPIEEGVRDMRSWVRGQWIPFDADALIQFLRYPLVLEGGPGVR

SEQ ID NO: 125893 - protein, 78 aa, Glycine max
  Coding DNA Sequence Number=SeqID_34208
MAVVVEQHYFLQYDIIFPTLYQISNQQQQPISLLGSHKEERWEWNFKWRGNLFDNESTMAAEFLEETVGLAVQQQGTD

SEQ ID NO: 125894 - protein, 75 aa, Glycine max
  Coding DNA Sequence Number=SeqID_34209
  Subcellular localization annotation: CTP_CleavageSite=44; ConfidenceScore=5.73e-01
MGSPPASPLPPPPSPPSSDASASPSAVKWTRKASRLRSLSTRPPGAEKPVVHVDPATGKADGPHRKKLRTYLGIV

SEQ ID NO: 125895 - protein, 73 aa, Glycine max
  Coding DNA Sequence Number=SeqID_34210
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLEIICILYGTILHESGETMGGKAHSSNI

SEQ ID NO: 125896 - protein, 130 aa, Glycine max
  Coding DNA Sequence Number=SeqID_34211
LRHSSPSLSIYYGTQSNIRVKSYCRLNLLRASIINFERLDLLRDLVRHPKLRSSISSVSTYYGTQSDIRVKSYCHLNLLRASIINFERLDILRDSVRQPSEKLLSFEFAQSFDIPFRASRYITGLNQTTE

SEQ ID NO: 125897 - protein, 158 aa, Glycine max
  Coding DNA Sequence Number=SeqID_34212
  Pfam annotation: Domain name=G-patch; Domain location=1-42; Score =8.5; E_value=0.017; Accession=PF01585.14; Description=G-patch domain
MVARVMLRNGFEPAMGLGKDYLGNADVVDIKGNPYKYGLGYEPGMPGRRNVPSRFRADRVWPGRISQRFTSAGMVSEEEVAAIEEEFPQDPPSFVQPCHLDFQVGNWRVISQSEVYTADSIYEGRFFEESNNEGLTIDFDRDISQTINEEKEEDVLSP

SEQ ID NO: 125898 - protein, 65 aa, Glycine max
  Coding DNA Sequence Number=SeqID_34213
MNTSLKHTPHSVGLFGNEAAIPPSDEAWTLIPDPTTIRAKGRPKSTRIQNKMDWFCSMYLLVGLQ

SEQ ID NO: 125899 - protein, 96 aa, Glycine max
  Coding DNA Sequence Number=SeqID_34214
EKLAAQLAQASKVASSRSKSLLEESSGGPKWAWGQWISFDTNALSQILGDPLVLEEGHQCEFSQRRNRADGFDEEAIAQLLCTPGQGFARTAVRRR

SEQ ID NO: 125900 - protein, 85 aa, Glycine max
  Coding DNA Sequence Number=SeqID_34215
MRVVIAKRAGRTKSVSYLCFPLISDERLARSVKFRNVAEVEKSFLQKAVASGGSNLARLGELGGKHLPYFAINRGGSEEEKGSAP

SEQ ID NO: 125901 - protein, 128 aa, Glycine max
  Coding DNA Sequence Number=SeqID_34216
EPAMYNYHEKGRAPDLKSVLADFMTYQASSKEYAEIEAHQESILQDTTIHHQLVNKEEKDEVSSTPEYPCMATTGYVVGKDKGHLELSVEDQKISFDLFEAMKHSDTGDAYVEEEEVDHEIALSASTM

SEQ ID NO: 125902 - protein, 84 aa, Glycine max
  Coding DNA Sequence Number=SeqID_34217
MPGKSVSSYEKKMQLPQKPLNKKPRGLARKSMAVINSVEHCGAATRLCETETNMLAIITKYQEELSLATTHEHRVADEYAQVYA

SEQ ID NO: 125903 - protein, 392 aa, Glycine max
  Coding DNA Sequence Number=SeqID_34218
MAPRKLASKRSWKDKAAEGTSSAPEYDSHRFRSAVHRQRFEAIKGWSFLQERRVQLRDDEYTDFQEEIGRRRWASLVTPMAKIDPEVVLEFYANAWPTEEGVHDMRSWVRGQWIPFDADAIGQLLGYLLVLEEGQECEYGQRRNRSDGFDEEAIAQLLCIPGQDFARTAAGRRVRIMRTNMTTLTQIWMTLLLSNILPTDHNSDLPLPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQASPAGSFDMEQYLLHLVCQQAANHRAHVQTHDCLYQLSLSMQSQGFASFSCPTPDQFRAEVAWPGDWPEAQAGEAPPETLG

SEQ ID NO: 125904 - protein, 254 aa, Glycine max
  Coding DNA Sequence Number=SeqID_34219
  Gene Ontology: Mol. function=transporter activity; Cellular component= integral to membrane; Biological process=transport
  Homolog annotation: Hit_ID=A6UGU4; Match level="QueryCoverage=98%, HitCoverage=49%, E-value=1e-101, Identity=75%"; Hit description =Sulphate transporter precursor
  Pfam annotation: Domain name=STAS; Domain location=152-254; Score =22.0; E_value=0.00035; Accession=PF01740.12; Description=STAS domain
  Pfam annotation: Domain name=Sulfate_transp; Domain location=1-144; Score=-45.9; E_value=3e-08; Accession=PF00916.11; Description =Sulfate transporter family
  Pfam module annotation: Pfam domain module=STAS::Sulfate_transp; Domain location=152-254::1-144
IVDDMTDTPSNKSQECVGQGAGNIASALIGGMGGCAMIGQSVINVTSGGRGRLSTFVAGSFLLFLIVVLNDLVRIIPMAALVAVMIMVSIGTFSWRSILDLRRHPLPSSVVMLATVITVVATHDLAKGVIVGVLLSGIFFAGKVARLFKVTRLENPEQTSVTYAVVGQVFFASAEAFIHAFDFTDKGKRIIINLAKAHLWDITAIGALDKVVLKLRQAGNEVEVLGFNEASADMVDRFALHDKDERLAASAALH

SEQ ID NO: 125905 - protein, 198 aa, Glycine max
  Coding DNA Sequence Number=SeqID_34220
  Homolog annotation: Hit_ID=A6FJQ2; Match level="QueryCoverage=19%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPTVNSTMILKEVFNLEVSIRLPHTKPLRLGSEATKYYRYHHDQTITKQEQDLQDGRETCRASCINESANARGEAVCVLGALPLPRSLTRCARSFGCGERYQLTQR

SEQ ID NO: 125906 - protein, 55 aa, Glycine max
  Coding DNA Sequence Number=SeqID_34221
MDEDQWAYYSAMSEEVDMDFQNEEDCGVNEAHVDCLDAFNTSQVFETREDVLKWA

SEQ ID NO: 125907 - protein, 155 aa, Glycine max
  Coding DNA Sequence Number=SeqID_34222
MVVPGNIFQSPFPKWYNPSAQAFGGRKDPLKVYLQGLAKGGHDSLRRAQRRLLLNASGEREEEQHVYMQSADEEGPKKPKPLVIHFTRNTTPQRPQHPSAVSGGRSIPFPYENNRAVSWRYAPPSSRKEEATDISSLSAKVTNITGLSGITHSDR

SEQ ID NO: 125908 - protein, 198 aa, Glycine max
  Coding DNA Sequence Number=SeqID_34223
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTRSRLVCSLGGACSVYLIRPAGMQAWHWPSFYNVVTGKTLALPNLIALQHIPLSPAGVIAKRPAPIALPNSCAA

SEQ ID NO: 125909 - protein, 52 aa, Glycine max
  Coding DNA Sequence Number=SeqID_34224
MASYGVASPIIFLPSLFRCHDLLEAKDSIDEEDPRPTSSTWSYIMWYQSIFI

SEQ ID NO: 125910 - protein, 84 aa, Glycine max
  Coding DNA Sequence Number=SeqID_34225
  Homolog annotation: Hit_ID=A0ST23; Match level="QueryCoverage=32%, HitCoverage=55%, E-value=5e-07, Identity=96%"; Hit description =Putative reverse transcriptase
MASQEKWGPFVDILALLIFGVVLFPNVDGLVDIKLIDTVDLEGGPVGKPVVPAALMNRPTRGERRFAYCALAECILAYYVGTDE

SEQ ID NO: 125911 - protein, 134 aa, Glycine max
  Coding DNA Sequence Number=SeqID_34226
MKREKGIARRQYIWRLQSLLHLSDVWELYRSSRRKNWRNLRELLEIPLSLSEHTVIPKIIQVLEFENIMIRFEGLDLNQEGEALTNSSEYRPWESPDLSAPLSLCRSHMVGAFSQNSMTLTILPMILLSESNLT

SEQ ID NO: 125912 - protein, 116 aa, Glycine max
  Coding DNA Sequence Number=SeqID_34227
  Gene Ontology: Mol. function=structural constituent of ribosome; Cellular component=ribonucleoprotein complex; Biological process =translation
  Homolog annotation: Hit_ID=Q2PMQ2; Match level="QueryCoverage=100%, HitCoverage=100%, E-value=1e-51, Identity=78%"; Hit description =Chloroplast 30S ribosomal protein S11
  Pfam annotation: Domain name=Ribosomal_S11; Domain location=28-115; Score=134.4; E_value=3.3e-37; Accession=PF00411.10; Description =Ribosomal protein S11
MAKPISKKGSRKNVRIGSRKHTRKIPKGVIHGQATFPQYYCTRRGTPFAAQTAAGNAIRTVSDQGMQRAEVMIKGPGLGRDAALRAIRRSGILLNFIRDVTPMPHNGCRSPKKRRV

SEQ ID NO: 125913 - protein, 148 aa, Glycine max
  Coding DNA Sequence Number=SeqID_34228
  Gene Ontology: Mol. function=endonuclease activity
  Homolog annotation: Hit_ID=Q9AY32; Match level="QueryCoverage=40%, HitCoverage=90%, E-value=3e-25, Identity=96%"; Hit description=RRNA intron-encoded homing endonuclease
  Subcellular localization annotation: CTP_CleavageSite=67; ConfidenceScore=5.19e-01
QSKSLNEDPLEGKSGASSRVKKLVVGPWVGSIGPPPVCTRSARPFCRRCAPVLTGRVVPPDSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 125914 - protein, 146 aa, Glycine max
  Coding DNA Sequence Number=SeqID_34229
MTETSMQEGNSDVYGFLEPQSIQRYGQSQFELESYMKNWMQNLKRDVYLGAYLNGPDNYLKGIISSALKGLDDTPQPKSKAGARKKGSTKCGYYVMHWLSTIILGSFKNNWETIIYFNDARPLESERLKALRIQWAKYYLKVRNET

SEQ ID NO: 125915 - protein, 31 aa, Glycine max
  Coding DNA Sequence Number=SeqID_34230
MGRIILGHSQMSRPVDSGSQPRYLGMGANGG

SEQ ID NO: 125916 - protein, 224 aa, Glycine max
  Coding DNA Sequence Number=SeqID_34231
MAVTNFVELYGATTVSSSFEGKRETQSQAHSMVLKEELAACSRSKRNLSQRLCETETNMLAIVSKYQEELNLATAHEHKVAGEYARVYAEKEARGRKNAITKCAPRHPYRTRSKSRTMGDQKETQEQMKADMSALKEQMPSMMEAMLGMRQLMDNNVATAAAVSLNAEADPTLPTTAHHPLPNAVGQERSTLGHISNPHLGYNRVAYPFGLPPNYTPPVMRDDA

SEQ ID NO: 125917 - protein, 113 aa, Glycine max
  Coding DNA Sequence Number=SeqID_34232
  Homolog annotation: Hit_ID=UPI0000ECBAF8; Match level="QueryCoverage =36%, HitCoverage=48%, E-value=1e-16, Identity=100%"; Hit description= UPI0000ECBAF8 related cluster
MTMITNSSSVPYLVLECLAERTLADHYQIMMSGGDVSNWIHMLLPLALERGTCIITNMGASMQAWHWPSFYNVVTGKTLALPNLIALQHIPLSPAGVIAKRPAPIALPNSCAA

SEQ ID NO: 125918 - protein, 90 aa, Glycine max
  Coding DNA Sequence Number=SeqID_34233
NDQTWSLLVVATYPSAGGRRVTRGMRVPRKEYARSRHQRLFEENVGKTGKDEIYELFSERFGSCIYARGRGETLRRWTINDLLFLKGEKR

SEQ ID NO: 125919 - protein, 136 aa, Glycine max
  Coding DNA Sequence Number=SeqID_34234
  Homolog annotation: Hit_ID=Q84VI1; Match level="QueryCoverage=70%, HitCoverage=14%, E-value=1e-33, Identity=79%"; Hit description =Envelope-like protein
MLSQHPNMLNYTDSVMKRESPLSLHYKLFEGTHVPDIVSTSVSTSGKAAASGAVSKDALIAELKDTCKVLEATIKATTEKKMGLDLLIKRLSESGIDDEEAAEEEGEAAEEEEEAAEEEEDAAEETESDDDSEATP

SEQ ID NO: 125920 - protein, 275 aa, Glycine max
  Coding DNA Sequence Number=SeqID_34235
  Homolog annotation: Hit_ID=Q84VI1; Match level="QueryCoverage=98%, HitCoverage=39%, E-value=2e-89, Identity=68%"; Hit description =Envelope-like protein
MATSPKETAASGSPAVPSSPHQEQPEFNIQPIQIIPGQASVPEKLVPRRQQGVKISENHSLATSPREVDTEMDKKIRSIVSSILKDASVPEADEDVPTSSTPNVSVPDVNKDVPTSSAPNAEALPSPSEEESTEEEDQASEETPAPRAPEPAPGNLIDLEEVESDEEPIANRLAPGIAERLQGRKGKTPIKRSGRIKTMAQKKSTPVTPTTSRRSKVAIPSKKRKEISSSDSDDDVELDVSTSKRAKKSGRKVPGNVPDAPLDNISFHSIGHTCG

SEQ ID NO: 125921 - protein, 64 aa, Glycine max
  Coding DNA Sequence Number=SeqID_34236
MVAIIPAKVPQPPFFRRYDSNATCVYHGRVLGHSVEHCRTLKHKVQGLIDAVGLFAQATCAPEF

SEQ ID NO: 125922 - protein, 116 aa, Glycine max
  Coding DNA Sequence Number=SeqID_34237
HNFVQENFSKKNLLPRVLHSGNRLPEGSNRLPVANILFKMIYKDVIDCRSKIHDESRLIPGVLMITKMMTKSSKVKDHFMITKMMTFKIESRTLQGSRGNLISRIKNQDSRFKIQE

SEQ ID NO: 125923 - protein, 57 aa, Glycine max
  Coding DNA Sequence Number=SeqID_34238
LQVELVGLGSSSSMESFASLRSMAAEWRRRKGDWRCHFKENMSQEQAHHHWKPWIRA

SEQ ID NO: 125924 - protein, 164 aa, Glycine max
  Coding DNA Sequence Number=SeqID_34239
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRASRPAGMQAWHWPSFYNVVTGKTLALPNLIALQHIPLSPAGVIAKRPAPIALPNSCAA

SEQ ID NO: 125925 - protein, 156 aa, Glycine max
  Coding DNA Sequence Number=SeqID_34240
  Homolog annotation: Hit_ID=Q86AI8; Match level="QueryCoverage=46%, HitCoverage=19%, E-value=3e-08, Identity=37%"; Hit description =Similar to Homo sapiens (Human). Mucin 2
MPSPSKDYTSSPSEGYTPSLLEDYMSLPYEGCTPPPSEDYTSSPSEGCTPSPSEDYTFSPSEDCMPSPSESYTGLHVLAFKGLHALAFRGLHILTFRGLHVLTFRGLHVLAFKGLHALAIRGPHVLAFRGLHVLTFKGLHVLTFRGLHAPTLKGLH

SEQ ID NO: 125926 - protein, 126 aa, Glycine max
  Coding DNA Sequence Number=SeqID_34241
MERLVDLAAIDSFLAFHHSKESPVVTILANIYDTFDRRCERSGASIVCCTLALYVWLVSHLLCQEGRHVCPLQGHHSCAKKGKVCINYNPVLAIRQLGYPMRGAPSEENLTPFITRGFNDPSVRVL

SEQ ID NO: 125927 - protein, 93 aa, Glycine max
  Coding DNA Sequence Number=SeqID_34242
MFVFNNALKGLDDTPQPKSKAGARWIVVKCNRQKGSIECGYFVMHWMSTIILGSFKNNWETPWMSSIIWDPRTMAMSSSPKIATSIKDEVIDK

SEQ ID NO: 125928 - protein, 79 aa, Glycine max
  Coding DNA Sequence Number=SeqID_34243
MAIPMTCGGTLWLSAPFVNQRQVLLSSSTDIQVQRHAKFFSARTIEFDSMWKRHGYPILSLSRHGSFADASDAFFILSE

SEQ ID NO: 125929 - protein, 113 aa, Glycine max
  Coding DNA Sequence Number=SeqID_34244
KKLGWRLDLVLVIIYNLTGHGSNLASPMDLILVVGKLVVCSQAKDVVLAGFIFVLLTSIFMYLKAGKIISWFSFAMGVVLAISIAHSKGWGKLWLEVDSLLVLKAFNVISVAP

SEQ ID NO: 125930 - protein, 54 aa, Glycine max
  Coding DNA Sequence Number=SeqID_34245
MAQDISMEGFEGNVNNITTNNYLTFAEEEIPVEGRGHNKALHVSVKCMDHIVAK

SEQ ID NO: 125931 - protein, 96 aa, Glycine max
  Coding DNA Sequence Number=SeqID_34246
  Homolog annotation: Hit_ID=A5BZE4; Match level="QueryCoverage=60%, HitCoverage=13%, E-value=5e-13, Identity=59%"; Hit description =Putative uncharacterized protein
  Pfam annotation: Domain name=Chromo; Domain location=10-61; Score =27.6; E_value=4.5e-05; Accession=PF00385.15; Description='chromo' (CHRromatin Organisation MOdi
MLTIELELRVEPLAVKAVRNHPAGTAEVLIQWKDLPDFEATWESVDVMKQQFPAFHLEDKVALLGGVLLGYRLRKCMKEGHVASIKGSQSSSQNLD

SEQ ID NO: 125932 - protein, 49 aa, Glycine max
  Coding DNA Sequence Number=SeqID_34247
NLQDSGTLKRVAWGLDIGTRGYTILGTETGRSFPEGGNQILPGANARSF

SEQ ID NO: 125933 - protein, 66 aa, Glycine max
  Coding DNA Sequence Number=SeqID_34248
MHPEFLDEDIMALFKEKRTHKDIDKWIVCFDGASNALGHGVGAVLVSPDDQCIPFTARLVERGMGY

SEQ ID NO: 125934 - protein, 58 aa, Glycine max
  Coding DNA Sequence Number=SeqID_34249
HLPAIRSENLAQPEPEIEPRRGKRARIAKDYGPDYMAYTLEEDPSNLQEALSSLDADL

SEQ ID NO: 125935 - protein, 90 aa, Glycine max
  Coding DNA Sequence Number=SeqID_34250
  Homolog annotation: Hit_ID=A6FJQ2; Match level="QueryCoverage=42%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARRKRDGGDRGGVGGDDNPGGWNNVSEGGGMVMVTVIVMTMF

SEQ ID NO: 125936 - protein, 186 aa, Glycine max
  Coding DNA Sequence Number=SeqID_34251
  Homolog annotation: Hit_ID=UPI0000ECBAF8; Match level="QueryCoverage =22%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLRNRTDVEGMQAWHWPSFYNVVTGKTLALPNLIALQHIPLSPAGVIAKRPAPIALPNSCAA

SEQ ID NO: 125937 - protein, 91 aa, Glycine max
  Coding DNA Sequence Number=SeqID_34252
MKTKAHDRITKNIVSETEQKAPYQDDELVGLQEVLEVESDVINESLVDVDGGGEEIDAYLLKQLDLVESDEDEWILSKNEIESDIDDTNTY

SEQ ID NO: 125938 - protein, 101 aa, Glycine max
  Coding DNA Sequence Number=SeqID_34253
MELIENMAASYVICGGAHDSSRCIPMEDTAHEGGPPNRPQQQGPSLYDRTMKLEETLAQFMKVSMSNQKSIGSTIKNLEVQVGQLAKQLADRPLSSFGANT

SEQ ID NO: 125939 - protein, 178 aa, Glycine max
  Coding DNA Sequence Number=SeqID_34254
GVEEVKDAEAPIPIPTDEVILVGQTLNTFLAWPTHLMKHVSEHVVVSPAKPPDRTDHEVDDPLYLMTLTIPQLFLKPLQVMWDVTVFGVFNQDFLLYIKHEDLSEIAHGGQCLSISVIQLWIFALKGLDDTPQPKSKAGARWIVVKCNRQKRTTECGYYVMHWMSTIILGTFRNNWET

SEQ ID NO: 125940 - protein, 83 aa, Glycine max
  Coding DNA Sequence Number=SeqID_34255
MKKQQWKRSGRQRRRGERRRHPLGNKPWKKELHHQDEPWIRSLEECFNGGKERGRERERGEHEIEGIKEGEKWNFEKKQKKIS

SEQ ID NO: 125941 - protein, 100 aa, Glycine max
  Coding DNA Sequence Number=SeqID_34256
MRPDEVVPLEPIVPTIHEIVEAEGPLSPGMDLSFAQQVADPPTPVRERQANPPTPMMEMPEDPTMPILRLSSTPSITPVLHLTDEEDMQDQDTQDQSQEF

SEQ ID NO: 125942 - protein, 92 aa, Glycine max
  Coding DNA Sequence Number=SeqID_34257
FPESSILGSYHFILLVRFGTLAGCEQRWCVVLQGKTIGVNVEDDDSYMDTCVSPLSTKITPNVVGEEEADDEVAAEVVQKLQPRETSTLFIE

SEQ ID NO: 125943 - protein, 170 aa, Glycine max
  Coding DNA Sequence Number=SeqID_34258
MNLSKRKGHALRRPYRTRARARVMGEAEEVPREDERPKMEAIKEQMATMMKAMMSMKKIMEANAVIVAAISAVAKVNPMLPSGLKQMNHPTSNMVGKDFGSTDDPMMCKFKTSTPSHHMACLPTIHHPMWHTLSMKISITPLRYSLRTNNLIRHISLKPWGRHMKFPSTI

SEQ ID NO: 125944 - protein, 20 aa, Glycine max
  Coding DNA Sequence Number=SeqID_34259
MAPDAVFTPYASVRDITPNM

SEQ ID NO: 125945 - protein, 101 aa, Glycine max
  Coding DNA Sequence Number=SeqID_34260
MAKFDPEVVLEFYANAWPTEEGVRDMRSWVRGQWIPFDADAINQLLGYPMVLEEGQECEYGQRRNRSAGFDEEATYRTHLVAHDPGNLNKTSASSEGRKIP

SEQ ID NO: 125946 - protein, 67 aa, Glycine max
  Coding DNA Sequence Number=SeqID_34261
MEDCLEGPHLSNHETSSKLENGGHMNDNPAIKFMWLRKRMRMEDCLEGPHLGNHETQLQTRKWRTHE

SEQ ID NO: 125947 - protein, 262 aa, Glycine max
  Coding DNA Sequence Number=SeqID_34262
MEGNIDVTIMKEFYANLYVPGDKPPKQVRVRGHLIKFDSDSFNTFLETPIVLEPRETLPTYSKFCRLRPDPQELAAQLCIPGRGFVLNVEGLPWKLLRKDLTTLAQTWSVLSYFNLAPTSHTFDLNLDRSRLVYGLVMKMDMNVRAFISGQITLMVQSNSSRLEFPALITALCMARGVTLDSLTFESLIPTINLAYIKKNCWNLDDPTVSFPGTRKARARESEGPSSAAPQTSTTPAPTPSALVTVISGHSAQSTDLMMAML

SEQ ID NO: 125948 - protein, 78 aa, Glycine max
  Coding DNA Sequence Number=SeqID_34263
MRDDNRSSYAIGIEVNSGIGLRGKFLITLESAPKWALPTGRVVVGAGAWGASLWMGAGALDCTGAELEKFPARAEKLG

SEQ ID NO: 125949 - protein, 200 aa, Glycine max
  Coding DNA Sequence Number=SeqID_34264
MDNVEAYLDWEIRVEQKLKRKPTLKSYGYHSYPKKDQGLGILAAAPSKPNDDKGKTIEKQPPKAKDTLLLNAPPRNLYSSQDEATTSPSSSESEEAKGEESSEEIYPQEEGKPLMVKEESKEVSVFSKRLTKKESHFEIKTNIKETSPLRQPPHFLLCKKTLVSIAIPLRLEFIHQVKELLDKGLVHKSLNPCALSVPKI

SEQ ID NO: 125950 - protein, 97 aa, Glycine max
  Coding DNA Sequence Number=SeqID_34265
MELQVDMWFDAMESRITKVEEDVSFIRTCFDPPPPPPSSSRLFLVLISGIVIIKKGGDCRQRIKLNVLMMPKDHMLLKALFKTKKLKIFKMDDQDSL

SEQ ID NO: 125951 - protein, 241 aa, Glycine max
  Coding DNA Sequence Number=SeqID_34266
  Gene Ontology: Mol. function=iron-sulfur cluster binding; Cellular component=cytoplasm; Biological process=electron transport
  Homolog annotation: Hit_ID=A6U8H2; Match level="QueryCoverage=80%, HitCoverage=34%, E-value=2e-96, Identity=89%"; Hit description =Nitrite/sulfite reductase hemoprotein beta-component ferrodoxin domain protein
  Pfam annotation: Domain name=NIR_SIR; Domain location=7-163; Score =216.7; E_value=5.6e-62; Accession=PF01077.13; Description=Nitrite and sulphite reductase 4Fe-4S domain
MHALQTSGNCIRNVTADHFAGAAADEVADPRPYAEILRQWSSVHPEFSFLPRKFKIAVTGAERDRAAIQVHDIGLHLKKNDKGEIGFAVYVGGGQGRTPMIAKKIRDFLPEEDLLSYTTAVMRVYNLHGRRDNKYKARIKILVHETGAEELARQVEVEFAELKNSELKLPDADIAAITAYFAPPALKDRPERLGKPGALEAGRRGFCPFCGAERRPAQASGLRHGNDLAEADRWHSGRRDG

SEQ ID NO: 125952 - protein, 133 aa, Glycine max
  Coding DNA Sequence Number=SeqID_34267
MYKDNWTQPWPMGSEIYPKVHENPRAFFSSSSPIFLEPLAHGDEDDKEEETPIKEKEKERIKEEDKEKEKKLKNEKQKEKVVDDEMRKGQSEANTNKKKDTAPNEGQEVPYPLVPSQKEKKYIWLNFLISSRN

SEQ ID NO: 125953 - protein, 117 aa, Glycine max
  Coding DNA Sequence Number=SeqID_34268
MSLPVEDYTSSPSEDFTSSPLEGYMPSPSEDYTASHLEDYTSSPLEDYTSLPLKGYTPSPLEDYTSSPSEDYTSSPSEDYMSSPLEDYTSSPSEDYMSSPSEGCTPSPSEGCMPLPS

SEQ ID NO: 125954 - protein, 127 aa, Glycine max
  Coding DNA Sequence Number=SeqID_34269
MTRGNPFDLQPFDPEIDRTFHRLVRHHFIPFDHSEHSITGESVHSVIGDFEHPDLEHYNFEHSNSEHSDFAHSENMAQPPPRERTLREMAAPDFTYESLCIQYPDEDIPYVLKTGLIHLLPKFHGLA

SEQ ID NO: 125955 - protein, 81 aa, Glycine max
  Coding DNA Sequence Number=SeqID_34270
MLVCGGLWKEKYRMSSGCLLVDPNGHNLGRIDGDPVLRGTRIWATWEYVSSVGGGQQGMVGFMRAFVDVENFVVHHRPTAT

SEQ ID NO: 125956 - protein, 115 aa, Glycine max
  Coding DNA Sequence Number=SeqID_34271
  Gene Ontology: Mol. function=RNA-directed DNA polymerase activity; Biological process=regulation of transcription, DNA-dependent
  Homolog annotation: Hit_ID=A5B388; Match level="QueryCoverage=100%, HitCoverage=9%, E-value=6e-15, Identity=36%"; Hit description =Putative uncharacterized protein
MTIQDLQTEINNLKREVKELRQQQEIHQIILSQLEVESDSENTNKTMALFDTGADSNCILEGLIPTKFFEKTSEKLSTTNGSKLKINFKFSNAIIEIQGLRINTNFLLVKTLKTK

SEQ ID NO: 125957 - protein, 116 aa, Glycine max
  Coding DNA Sequence Number=SeqID_34272
MPLDSEPYVPIKRSFLIGASGIASFGYQKEHDGSWVKRGTRHVDEEGHGGEDSSLLQKILDRFDGLQAFVGERFDTLELQVDMRFNEMESRITKVKEDVSYIRSSFDLPPPQPPSS

SEQ ID NO: 125958 - protein, 77 aa, Glycine max
  Coding DNA Sequence Number=SeqID_34273
MSPDFMGQDDKGAEDDVSLRLSTAIVCADNSLGIFACHPTSRVRMTQTVYTDNRLGTHMSPDFTGQDDKGAEDDVSL

SEQ ID NO: 125959 - protein, 223 aa, Glycine max
  Coding DNA Sequence Number=SeqID_34274
MASMMEAMLGMRQLMEKNVATAAAVSSAAEADPTLLATAHHPPSNIVGRGRDTLGHDGNPHLGYNRAAYPYGLPPNYSPPILQDDAGHIASPVLEREPPQQPDEVHKDPQDYARRDVEFYPPIPEGPAPSTLPQPNITTQPIVLSTEGPPPAIEERRKLDLLEERLRAVEGFGDYPFADMTNLCLVPDVVIPPKFKVPDFDSIKGRLVPKTISDVLSQDGRTL

SEQ ID NO: 125960 - protein, 66 aa, Glycine max
  Coding DNA Sequence Number=SeqID_34275
SKNDEERMKNVEERFKPLRDPHGKRYGNVVAAQLAQASSARPGEQGCFLQKQPPSGGIFWRAQMGL

SEQ ID NO: 125961 - protein, 56 aa, Glycine max
  Coding DNA Sequence Number=SeqID_34276
  Homolog annotation: Hit_ID=A5BTR2; Match level="QueryCoverage=98%, HitCoverage=2%, E-value=8e-15, Identity=78%"; Hit description =Putative uncharacterized protein
MFIKTKISVRICGSVDQHGKVQDLLKDIDDQFITSDKTLASTLIMKFSSLRLTSVK

SEQ ID NO: 125962 - protein, 59 aa, Glycine max
  Coding DNA Sequence Number=SeqID_34277
MYVNLAKEMCVMNGTEEACLKEVQEGQGGRRELVPPRSTTVTALGALYTSSVRSHQGMV

SEQ ID NO: 125963 - protein, 127 aa, Glycine max
  Coding DNA Sequence Number=SeqID_34278
MTRGNPSDLQPFDPEIDRTFHRLVRHHFIPFDHPEHSITCESVHSVIGDFEHPDLEHYNFEHSDSKHSDFAHSEHMAQPPPRERTLREMAAPDFTYESLCIQYPDEDVPHVPKTGLIHLLPKFHGLA

SEQ ID NO: 125964 - protein, 284 aa, Glycine max
  Coding DNA Sequence Number=SeqID_34279
  Subcellular localization annotation: CTP_CleavageSite=98; ConfidenceScore=5.56e-01
VGPLGTSTYHLQRTVRPHLKRATRPRLQRATHPHRQRTTRPHRQRTTRPRLQRTTCPRLQRTTRPRLQRATRPHPQRTTCPRLKRTTRPHLQRTTRPRLQRVMYPHLQRTTRPLAFRGLHVLHFRGLHILHFRVLHVLAFRGPHALAFRGLHVLTFRGLHVLAFKGLCTFAFRGLHALAFRGLRVLTFIFGPPPDIGGRPTVQAQPEREAITQLLCISGQDFTRAAAKRRVRIMHTNMTTITQIWMTLLLSNILPSDRNADLRLRKDRAHKTPSGPGEVQQGPG

SEQ ID NO: 125965 - protein, 134 aa, Glycine max
  Coding DNA Sequence Number=SeqID_34280
MPLAIGGGEAQIAETIIRRIAIGYGSADLAFQIGPGQHGARQPKADGERQKRGDKMPVGQEHADQHPRKRPIVASVRVRQKPTFRVDIPTAEPGSAPPVALPGIVLGPGVGCQGLPAGAANMPAGIADLHRGAR

SEQ ID NO: 125966 - protein, 115 aa, Glycine max
  Coding DNA Sequence Number=SeqID_34281
MNSTSFQGLENQKTSESFWYKEEEEVQRDSRLVKDCKKLIGKKQSLVIDYQISVIDYTKLLCVSYPNFVRGLLLDDMQPLIGRFKILGTLGCTICKSRDAPEVKRKQGYAIREIP

SEQ ID NO: 125967 - protein, 395 aa, Glycine max
  Coding DNA Sequence Number=SeqID_34282
  Gene Ontology: Cellular component=integral to membrane; Biological process=cellular response to starvation
  Homolog annotation: Hit_ID=P15078; Match level="QueryCoverage=83%, HitCoverage=46%, E-value=1e-152, Identity=81%"; Hit description =Carbon starvation protein A
  Pfam annotation: Domain name=CstA; Domain location=32-374; Score =622.2; E_value=4.6e-184; Accession=PF02554.5; Description=Carbon starvation protein CstA
MNNSGKYLIWTLLSVIGAFALGYIALNRGEQINALWIVVAAVCVYLIAYRFYGLYIAKTVLGVDPTRMTPAVRHNDGLDYVPTDKKVLFGHHFAAIAGAGPLVGPVLAAQMGYLPGMIWILAGVVLAGAVQDFMVLFVSTRRDGRSLGELVKEEMGPTAGVLALVACFMIMVIILAVLAMIVVKALTHSPWGTYTVAFTIPLAIFMGIYIRYLRPGRIGEVSVIGLVMLVFAIISGGWVAESPTWAPWFDYTGVQLTWILVGYGFVAAVLPVWLLLAPRDYLSTFLKIGTIVGLAIGILIMRPTLTMPALTKFVDGTGPVWTGNLFPFLGWSIRWAASYPVAAVRYRQPDAGGDGADAVRGGTVQDETPALCVGGAAADKLAADLYVDRWLAEVV

SEQ ID NO: 125968 - protein, 138 aa, Glycine max
  Coding DNA Sequence Number=SeqID_34283
MWMTLLLSNVLPSDHNSDLPLPKCQQVIRPPITRAFIEKYCTPRQAQGDVPQVADAPLPPHQVDPAGSLGMERYLQHLVRQQTTNHRGQFRAEVAWPGDWPEDQTEEAPAGAPDDAEDARMDEEMTDLLGFLGGSGAT

SEQ ID NO: 125969 - protein, 140 aa, Glycine max
  Coding DNA Sequence Number=SeqID_34284
NAGGYCNLEGDASDGSDDDASDEGEVFNIDGFLDIAKFDMNNIRSGDVGRYQFADLELTYRYFIYDSPFGKAYFRAPGSPRLASGSLGLPNSLVVNVKRNWREIKEKKKKEEKNEAEALPNCNRNRLLHCSSFGVLRLSS

SEQ ID NO: 125970 - protein, 117 aa, Glycine max
  Coding DNA Sequence Number=SeqID_34285
MVVISLSMKLKEEHCSIGFSRPLTNQNKNPFSYGSMELFHKLPSFFLPLPPKLLSSFASASAAPFPFLSFPFKRMFLHVGLNQQVVIAKHKGYVSGSLSDEGKVGLGGDSEPTRGYW

SEQ ID NO: 125971 - protein, 49 aa, Glycine max
  Coding DNA Sequence Number=SeqID_34286
FTSDSPPQILASLHQSDLASYVSGSYNAQWNAQSVKIHNIPEAKKSIVA

SEQ ID NO: 125972 - protein, 43 aa, Glycine max
  Coding DNA Sequence Number=SeqID_34287
MDFVLCIIMPRSAKGINETLGLIQILVVDLKRGNKAALTSVNF

SEQ ID NO: 125973 - protein, 191 aa, Glycine max
  Coding DNA Sequence Number=SeqID_34288
  Homolog annotation: Hit_ID=Q949K7; Match level="QueryCoverage=24%, HitCoverage=53%, E-value=2e-09, Identity=55%"; Hit description =Putative gag polyprotein
  Pfam annotation: Domain name=G-patch; Domain location=105-149; Score =26.6; E_value=9.2e-05; Accession=PF01585.14; Description=G-patch domain
MGAYSTDEKLLMHFFQDSLAGAAVAWYTNLEASQIRSWKDLATTFIRPPYLQCGFSSDGHKSRLQLPLGETLDSCARSGPFDASPEIEIRGWWTLGDSVRRRRYVALMVARVMLRHGYEPGMGLGKDSLGNTNVVDIRGNPYKYGLGYEGRFFEDPNNEGLIIDFDREVSRTINEEEEENVLSPELERLIA

SEQ ID NO: 125974 - protein, 178 aa, Glycine max
  Coding DNA Sequence Number=SeqID_34289
MAEPSKKRKGSSSRSQRHSETQETQIPSSISSSSLFSLEEQWIRYTNIFSSRSIIDPKFIGMDFFSNESFECIQAFENSNLIHFMSLKLPVYSELVKALYSNLEIQEGNLISEVYGIKMVIDQSLFYDLTQLSSEGVPFEGTLNDDWKFDFNVHDAHRLVCTNQADMTGKASCRVIGF

SEQ ID NO: 125975 - protein, 63 aa, Glycine max
  Coding DNA Sequence Number=SeqID_34290
  Gene Ontology: Mol. function=RNA-directed DNA polymerase activity; Biological process=RNA-dependent DNA replication
  Homolog annotation: Hit_ID=Q946S9; Match level="QueryCoverage=57%, HitCoverage=14%, E-value=4e-09, Identity=80%"; Hit description =Reverse transcriptase
MVEKSIEVFMDDFSVFGPSFGSCLRNLEMVLQRCQKFLRACRILQEVYQGLLEDCQTPKQPAE

SEQ ID NO: 125976 - protein, 96 aa, Glycine max
  Coding DNA Sequence Number=SeqID_34291
MTHYNPYPRKQEKERRKFPIKEKAKKEGKEIPNQRVGEREKRKRKEIPNQRVGERKKKRKKIPNQRMGESKKGREESSWSKKPEEMCREVFRPDNI

SEQ ID NO: 125977 - protein, 164 aa, Glycine max
  Coding DNA Sequence Number=SeqID_34292
  Homolog annotation: Hit_ID=A6FJQ2; Match level="QueryCoverage=23%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPPPRPIVIEKGVGGTYIYVEAGVQLQLKATVDTANVFWTRVGTGGEILDSGTWPATTRGDDSVIVENISAENASTTTIQPVVLDQNSGEISITIAEPEKEEQ

SEQ ID NO: 125978 - protein, 63 aa, Glycine max
  Coding DNA Sequence Number=SeqID_34293
SFASQVLQGKVVEEPQLFVVSEAVAIVVVVVGLVEECMVCLGQQHSENKAVVVAAAVVKDSTI

SEQ ID NO: 125979 - protein, 118 aa, Glycine max
  Coding DNA Sequence Number=SeqID_34294
MKNVEERLNLCEILHGNVTETFRKCLGLDFLHGNDFPAIRKREKCQRGSTHSFFISSPIYSKIGEVFAAQLAQASSARPGELSSPRRARLLPPEATAFWRNILEGPSGPGCYLHPHFY

SEQ ID NO: 125980 - protein, 62 aa, Glycine max
  Coding DNA Sequence Number=SeqID_34295
MPISPCGSISWSVPSCHRDRACKTPSGSGEVQQGLGVSSSDYGPLSVLRSACRPQQGHQAPY

SEQ ID NO: 125981 - protein, 212 aa, Glycine max
  Coding DNA Sequence Number=SeqID_34296
  Homolog annotation: Hit_ID=UPI00006A2939; Match level="QueryCoverage =77%, HitCoverage=87%, E-value=2e-10, Identity=30%"; Hit description =UPI00006A2939 related cluster
MTGPLNESISCFHIRVDPWVLVPSPFRGLHALALRGLHVLALRGLHVLTFRGLHVLAFRGLHALAFRGLHVLTFRGLHTLAFRELHVLTFRGLHAFTFRGLHALTFRGLHTLTFRGLHVLAFRGLHILAFRGLNSLAFRGLDIVAFRGLHGCTPSPSEDYTSSPLEGCTPSPLEDYTSLPLEGFTPSPLKDYTSSPSEGCTPSPSGGSTFAP

SEQ ID NO: 125982 - protein, 93 aa, Glycine max
  Coding DNA Sequence Number=SeqID_34297
  Gene Ontology: Biological process=primary shoot apical meristem specification
  Homolog annotation: Hit_ID=Q2HW32; Match level="QueryCoverage=49%, HitCoverage=4%, E-value=2e-18, Identity=89%"; Hit description =Lissencephaly type-1-like homology motif; CTLH, C-terminal to LisH motif; Nitrous oxide ...
  Homolog annotation: Hit description=reductase, N-terminal; WD40-like; Quinonprotein alcohol dehydrogenase-like
MRKEKIPHQAPFAIQAAQLLGRAIGAGLFAITPAGERGMCCKAIKLGNARFIFSTAIDGKIKAWLYNNMGSRVDYDAPSHWCTTVLYSADGSR

SEQ ID NO: 125983 - protein, 170 aa, Glycine max
  Coding DNA Sequence Number=SeqID_34298
  Homolog annotation: Hit_ID=Q949K7; Match level="QueryCoverage=23%, HitCoverage=45%, E-value=8e-08, Identity=62%"; Hit description =Putative gag polyprotein
MGEAEEVQEKMKADMEAMKEQMATMMEAMMSMKKIMEANAVIVAATSAVAKVNPMLLSGLKQMNHPTSNMIGKDLGRPSVSPTTTTLTFHSGKKPSCYGRNGKEERLRAIEGGKDYAFPNLEELFLVPNIITPPKFKVLDFDKYKGTTCPKNHPKMYCRKIRAYAKMRNC

SEQ ID NO: 125984 - protein, 167 aa, Glycine max
  Coding DNA Sequence Number=SeqID_34299
MIQYHSYVLSAAPDVWNYNTSSSDSVLIKKIIQIRDFIISKELSTEEANKRIQSWSTNEQLLVGKAYEYIRGVKPTGSLCPLCSNEAESNAHLFFSSRKSLQVWAHIRDLALFRRRFTSLQCITDSLIRGRSKSGVQGKLRCLAIAITVYYIWLSRNKLIFEDYPFK

SEQ ID NO: 125985 - protein, 115 aa, Glycine max
  Coding DNA Sequence Number=SeqID_34300
MEAMMSMKKIMEANVYERPHDVQIQNEHAFLPYGLPPNYTPPNVAYTPSENVNNSTPILIESRQPQNDHGHVSQTMGETHEISHHNLADFEPCLGYAIEGQAVGGIPLQNTSEGP

SEQ ID NO: 125986 - protein, 162 aa, Glycine max
  Coding DNA Sequence Number=SeqID_34301
MRSDGDLAAQVAPPMVEREMITMMVDTLPSLIANQLAVVTPGKDRPNVKTNPLANHGGGAVNAVESDRPRRSKPLRDVATPRRFIFKALQKGGVIPHIGRKEDSCLLHSGELHNMETCLEVEELLQRMIDQGRLEVGSEGREEKHICMQSTEGSNVAKPKPL

SEQ ID NO: 125987 - protein, 179 aa, Glycine max
  Coding DNA Sequence Number=SeqID_34302
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=89%, HitCoverage=11%, E-value=4e-79, Identity=91%"; Hit description=DNA -directed RNA polymerase subunit beta''
  Pfam annotation: Domain name=RNA_pol_Rpb1_5; Domain location=1-179; Score=-145.8; E_value=0.038; Accession=PF04998.8; Description=RNA polymerase Rpb1, domain 5
TAVRTSDAGYLTRRLVEVVQHIVVRRTDCGTIQGIAVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQENHTGPVQSLFQSEKIKIK

SEQ ID NO: 125988 - protein, 52 aa, Glycine max
  Coding DNA Sequence Number=SeqID_34303
MSLPSPVHVSSTFESGAPRKKKEGVEMRVVITERAGRTKSVSYLCFPLISDE

SEQ ID NO: 125989 - protein, 98 aa, Glycine max
  Coding DNA Sequence Number=SeqID_34304
MANNTINNRDNGGTTLEINSIEIKVSMSNQKSIEFAIKNLEVQVGQLAKQLADRSSSSFIANTEKNPMEECKAMMTRSKKAIHVDESEAEKKMEEHKK

SEQ ID NO: 125990 - protein, 144 aa, Glycine max
  Coding DNA Sequence Number=SeqID_34305
  Homolog annotation: Hit_ID=A5AK77; Match level="QueryCoverage=56%, HitCoverage=10%, E-value=2e-08, Identity=37%"; Hit description =Putative uncharacterized protein
MAQPPPRERTLREMAAPDFTYESLCIQYTDEDVPYVLKTGLIHLLPKFHGLAGEDPHKHLKEFHIVCSTMKPPDVQEDHIFLKAFPHSLEGDVQGPSRAGMTLRETTAIRKDISGLSNMERSMIDAASGGALGDMTPAESQKFN

SEQ ID NO: 125991 - protein, 264 aa, Glycine max
  Coding DNA Sequence Number=SeqID_34306
MSPFLVRDFGAQNSKTIQRIHKAWETPLKKDQELRGIRNGIIGGHHEWLKVHIRGLDWLAKLKVVSKESFEAPEEDEKSKLSKAKIAITARALEQETKRARKEEYGRNKIRGALWGSNSELKFRREERDQSRAHSMVLKEELIACSRSKRSLSQRLCETETNMLAIIAKYQEELGLATAHEHRIADEYAQIYAEKEARGRVIDSLHQEATMWMDRFALTLNGSQELPRLLAKGQGNGKHLLHPRRDSWASRLLSAYDRLNGPHN

SEQ ID NO: 125992 - protein, 109 aa, Glycine max
  Coding DNA Sequence Number=SeqID_34307
  Subcellular localization annotation: CTP_CleavageSite=45; ConfidenceScore=5.38e-01
MPSISKRLTKGCMSSSNNPQTKLGYDRCVFHGRKMRGVATNVYLRKMSEKPERCGLRTLSVKGSGVVFMHGEGGETLRRWTINDILGWSTKVGLLLLRILNCDEEIRPT

SEQ ID NO: 125993 - protein, 118 aa, Glycine max
  Coding DNA Sequence Number=SeqID_34308
  Gene Ontology: Mol. function=phosphoinositide phospholipase C activity; Biological process=intracellular signaling cascade
  Homolog annotation: Hit_ID=Q69L69; Match level="QueryCoverage=88%, HitCoverage=14%, E-value=2e-09, Identity=31%"; Hit description =Calcineurin-like phosphoesterase-like protein
MCIATNYNVKSIGGFTLLIQLWAWERCPTLAPSFIPPPQQNAPLAYRWLGGEIHHIDNANLLDFHRKLDVMKRDEFVWVPYFGHVEMNLSQVCFIGYVLWTCIVPLNLFSKSGMAPAG

SEQ ID NO: 125994 - protein, 178 aa, Glycine max
  Coding DNA Sequence Number=SeqID_34309
  Gene Ontology: Mol. function=glyceraldehyde-3-phosphate dehydrogenase (phosphorylating) activity; Cellular component=cytoplasm; Biological process=metabolic process
  Homolog annotation: Hit_ID=Q53I52; Match level="QueryCoverage=39%, HitCoverage=23%, E-value=3e-26, Identity=78%"; Hit description =Glyceraldehyde-3-phosphate-dehydrogenase
  Pfam annotation: Domain name=Gp_dh_C; Domain location=69-156; Score= -39.0; E_value=0.00022; Accession=PF02800.11; Description =Glyceraldehyde 3-phosphate dehydrogen
MLKVVRYDAIFSLTHEETLDHQCKTGSTLGSDYKTENLEIEHEEGRKFACGKRRRRLGEAHLKSEWKKICVTNKLKENNKIQIDIVRKKHPEKLLMGQAKESGDAEESEGKLKAILGYTEDDVVSTNFVGDSRSSIFYAKAGIALNEKFLKLITWYNNEWGYSNYIVDLIAHIVKMSR

SEQ ID NO: 125995 - protein, 280 aa, Glycine max
  Coding DNA Sequence Number=SeqID_34310
  Homolog annotation: Hit_ID=A0MKC7; Match level="QueryCoverage=51%, HitCoverage=31%, E-value=3e-09, Identity=34%"; Hit description=26S proteasome subunit RPN7
  Subcellular localization annotation: CTP_CleavageSite=92; ConfidenceScore=5.35e-01
MESGFWSNVPQRLQTKRKSKFNGKGALSTSKAVLSKTKEALSRSNEALSAPKEALSKPKEAHSRPNKAHSRPNKALSTPKKALSTLKEALSRSKEKLNSGDFDIYLKLGTSQGDKQDRCSWTEDALLFYTLQLGFVDMDFDLNAKGNEKVESLCEEGGDWERKNWLKVRPASGVAAAIATERHPSATKRVVVARFNVADVAAAIRYRGGVEWRSGAGSEPDFRAATVTLWKFQKCPLMWKSEATTSLHPAKLRPDTCVLRPVAPTTSLHCAATLLEVRKT

SEQ ID NO: 125996 - protein, 517 aa, Glycine max
  Coding DNA Sequence Number=SeqID_34311
MKEEVDPSTKREKHKENGVTNVGSEDDFLDNPITDLIKKVVEAGDSTKPHCFQDSNFHKKIVMVKQKSFMKMVGTTMVLESWNVNLLGEPLALNFVASMVDSLAMELRQKECTEPVKLIKVIWSPPLSLPPPKPPDLSLHAGAMDSNLEDKIDFKEGAVFGIIGTGARDRFSVTKSPSFVIQQYVGILLLVNVNIGNVNHLFISVRFDFTHSPAERCTVGREQHAGRKSDIADQNFCYNSEKEAVTGSGDVVGEIRSKEEEARNPFMEQENISNVIGFSFPTPDITPTPHVFSPNRNKGDTASPWKGIGNLIPAERTERVCEKGNYEGELHGDITGRQVIKVKESRESEGASESGLGCATHTPHATTERQFSRPQTSKLQVYSRKRCFKKKLELGCTAGPSSDTDMATDLIISSPRQQQRENKEKCGSVQEEITSNIDDISAQIENEEAEFANIQKQEAAALWDVAKTLGVAALWDVAKTLGVTCGSLQRNYVDKIMEMEERDRKEAERLRNRRSSP

SEQ ID NO: 125997 - protein, 606 aa, Glycine max
  Coding DNA Sequence Number=SeqID_34312
  Gene Ontology: Mol. function=histone acetyltransferase activity; Cellular component=nucleus; Biological process=regulation of transcription, DNA-dependent
  Homolog annotation: Hit_ID=Q93ZR1; Match level="QueryCoverage=99%, HitCoverage=99%, E-value=0.0, Identity=83%"; Hit description =Elongator complex protein 3
  Pfam annotation: Domain name=Acetyltransf_1; Domain location=497-594; Score=24.4; E_value=0.00042; Accession=PF00583.15; Description =Acetyltransferase (GNAT) family
  Pfam annotation: Domain name=Radical_SAM; Domain location=109-321; Score=46.6; E_value=8.9e-11; Accession=PF04055.12; Description =Radical SAM superfamily
  Pfam module annotation: Pfam domain module=Acetyltransf_1::Radical _SAM; Domain location=497-594::109-321
MAAVAVAEVGKAPRPGQGGYEAHGLSEEEARVRAIAEIVSSMVDLSHKGQNVDLNALKSAACRKYRLSRAPKLVEMIAALPDAERETLLPKLRAKPVRTASGIAVVAVMSKPHRCPHIATTGNICVYCPGGPDSDFEYSTQSYTGYEPTSMRAVRARYNPYVQARCRIDQLKRLGHSVDKVEFILMGGTFMSLPADYRDYFIRNLHDALSGHTSANVEEAVAYSEHGATKCIGMTIETRPDYCLGPHLRQMLSYGCTRLEIGVQSTYEDVARDTNRGHTVAAVADCFCLAKDAGFKVVAHMMPDLPNVGVERDMESFREFFESPLFRADGLKIYPTLVIRGTGLYELWKTGRYRNYPPEQLVDIIARILAMVPPWTRVYRVQRDIPMPLVTSGVEKGNLRELALARMEDLGLKCRDVRTREAGIQDIHHQIKPEEVELVRRDYMANQGWETFLSYEDTRQFITGLVPLAHIFPSLIVNQEGRVSTCCSNTAMTLSELSACKQDILVGLLRLRKCGRNTTCPELMGKCSIVRELHVYGTAVPVHGRDADKLQHQGYGTLLMEEAERIACREHRSTKIAVISGVGTRHYYRKLGYELEGPYMVKYLVK

SEQ ID NO: 125998 - protein, 73 aa, Glycine max
  Coding DNA Sequence Number=SeqID_34313
GKPVIKMEEAQIWAKKVELPAFMGTNPIVWIARAEKFFEGAATHWFYIWGQNNPDSNWESFSTTLIKRFGDHH

SEQ ID NO: 125999 - protein, 804 aa, Glycine max
  Coding DNA Sequence Number=SeqID_34314
MEPIERTDPRLSYEGNRHGQQPKYHHANWRDGTDITSFYFTRFLEDARGGAVDHFQKMGGRKGDIHIQTEEQRRQEIDEMREVREGRTREGRTRERVSLRGRLRRRVHDSVRGSARDSVRGRVRVREREKGGQVHYPASDGQHGEKYTARERRRNTEYGESRGLAESRRASYEVDNSPTRTDEGWVEVSHRRKKKTAVDRGPSVLNKRQRQHRRGTWRDKEDVTSFYFSRFPDGEVQDVQRLERQLDNSIFLGGIKMFVNKPKFERDTVNRGHLHGTLTNGKGRIQEVDNGGQKTYDTGGRLGSYVEVARGVIPPVDNLSNQKVAVQGDNRLVLSPEELRWVLDPDINPRYWVDDWVILPNLEDDKALRLVNEERTKGSTPILDLHKWSPHIRPTHRLAWVLLWGLPPTVWEVVYMEKVVAELGELVEVDEMVEERWRMDAARILIRTNLRPGIAMAVPVVIDGVDAVIHIVEDMQGLRTKTKPKQSLTWYPPSPLSTEPNTPMTYAAQTPGVDTKGASSDGGSQGSDGGFSGHWRRTQSFLAGRVNRTQSAHICHMDWSAADKPDMAQSYGDNNGVEDQSPKEHNNGHLRQEGKTFNASSHSRCCVDMQKEIITLTTMGAAEEQKEDAVEVADFDQNQKGVEEQNEDAVVALSGSKVGIMEGEKQIIGPFEESHHHSLPSVTGALTTFPGGGYNISIGLATLLRTPTLLHARLGQTMLFSCTCRRVAHRLGLRFYCRSLFSEHNLRVCLKQSILADTPLELDFVYPFLSTVWFVILGTVQSIFYVFCIVAKKFPVAYPTVVSY

SEQ ID NO: 126000 - protein, 856 aa, Glycine max
  Coding DNA Sequence Number=SeqID_34315
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9SJM0; Match level="QueryCoverage=95%, HitCoverage=98%, E-value=0.0, Identity=59%"; Hit description =Putative glucan synthase
  Pfam annotation: Domain name=Glucan_synthase; Domain location=74-768; Score=453.0; E_value=4.1e-133; Accession=PF02364.6; Description=1,3 -beta-glucan synthase component
MLVITPEIWLFSLHCPLPLPFLFNGGENLDTWNLLARARDEGRLFSRIVWPNDPEIKELVKRLHLLLTVKDSAANVPKNLEARRRLEFFSNSLFMDMPSAKPVSEMLPFSVFTPYYSETVLYSTSELQKENEDGISILFYLQKIFPDEWENFLERIGRGASTGDAELQENSSDSLELRFWASYRGQTLARTVRGMMYYRRALMLQSFLESRSLGVDNYSQNNFITTQDFESSRESRAQADLKFTYVVSCQIYGQQKQRKAPEAADIALLLQRNEALRVAFIHVDESTTDGNTSKVFYSKLVKADINGKDQEIYSIKLPGDPKLGEGKPENQNHAIVFTRGEAVQTIDMNQDNYLEEAMKMRNLLEEFHANHGLRPPSILGVREHVGKGRDVGLNQIALFEGKVAGGNGEQVLSRDIYRLGQLFDFFRMLSFFFTTVGYYVCTMAFSGLDEAVSEKAKLQGNTALDAALNAQFLVQIGVFTAVPMIMGFILELGLLKACFEGWLNWFRDQFPVGLVGLAVFSFITMQLQLCSVFFTFSLGTRTHYFGRTILHGGAKYRATGRGFVVRHIKFAENYRLYSRSHFVKALEVALLLIVYIAYGYAEGGAVTYVLLTLSSWFLVISWLFAPYLFNPSGFEWQKTVEDFDDWTSWLLYKGGVGVKGENSWESWWDEEQTILSARFFLFQYGVVYKLHLTGNDTSLAIYGFSWAVLVGIVLIFKIFAYSPKKAANFQVVLRFAQGVASIGLVAAVCLVVAFTQLSIADLFASILAFIPTGWGILSLAIAWKKIVWSLGMWDSVREFARMYDAGMGMIIFAPIAFLSWFPFISTFQSRLLFNQAFSRGLEISIILAGNKANVET

SEQ ID NO: 126001 - protein, 974 aa, Glycine max
  Coding DNA Sequence Number=SeqID_34316
  Gene Ontology: Mol. function=nucleic acid binding; Cellular component= intracellular; Biological process=regulation of transcription from RNA polymerase III promoter
  Homolog annotation: Hit_ID=A7PCK1; Match level="QueryCoverage=98%, HitCoverage=51%, E-value=9e-90, Identity=49%"; Hit description =Chromosome chr17 scaffold_12, whole genome shotgun sequence
  Pfam annotation: Domain name=zf-C2H2; Domain location=858-883; Score =20.3; E_value=0.0071; Accession=PF00096.17; Description=Zinc finger, C2H2 type
  Pfam annotation: Domain name=zf-C2H2; Domain location=886-905; Score =7.9; E_value=1.6; Accession=PF00096.17; Description=Zinc finger, C2H2 type
  Pfam annotation: Domain name=zf-C2H2; Domain location=911-935; Score =20.7; E_value=0.0056; Accession=PF00096.17; Description=Zinc finger, C2H2 type
  Pfam annotation: Domain name=zf-C2H2; Domain location=941-967; Score =24.1; E_value=0.0005; Accession=PF00096.17; Description=Zinc finger, C2H2 type
  Pfam module annotation: Pfam domain module=zf-C2H2::zf-C2H2::zf -C2H2::zf-C2H2; Domain location=858-883::886-905::911-935::941-967
MNVVPVGWMKKNVQDGIHDVPFQSSQVALNTVSENGNTALALLASAYGNSSDSEEDQIAVDSHESNVINSASESLLSDTRDSHASRTALDRGDYIPSKSSSYEDFIHRRLECFENTRTVPNSTSNCSQDAYDAKRSLSSKSMVPFDYKKALMVLQSDEDSSRMHVFCLEHAAEAEQQLRSIGGADILLLCHPDYPKIEAEAKMVAEDLGIDYVLKNIVYRHASTEDEERIQSALDNEEAIPGNGDWAVKLGINLFYSANLSRSPLYSKQMPYNSVIYSAFGCSSPASSLVEPKVYQRRVNKQKKIVAGKWCGKVWMSNQVHPLLAKRDSEDIEDEKLLQGLTLPDEKIERSESTPKREAISRKSGKKRKKTAENGRFRKGSYAKKNILSDDSTEDKPNSQPRRILRSKKARHVERDCAALKRDYSPPYHHRKPTSHQTNFTESDAVSDDSLDDDDHMRQRRNVKVEKAKFMDNDVVSNDTMDYDSDCLQREEHSSKQVEDMERDANSEDFLDVGSLQLQRKISRAMHVKSIREEDIISDDQMESPFQKRQKRIPKSRQGKYLTGKDIISDDQLELKMQKRQQTNPKSRQAKYLNKEDIASDDQLEDHYRRYQRNPKGRQATCVAGEDEMSDDHLENHCQKQQTNFSRKRQNKDVVREVKNEMCDDQLEDHFLKQHRRFPKSRQNKHTEKEIMDDLAENNSHLLHRTPKRKQAKCMEEDDMNSDDEMEDDQPLRRALRSKQAKPKTLLKQANSFQAKKQASRPIKQGSRLLVKSKAPQQIKQPAHLRNKQSNNTQEFSLYMEEEEDGGPSTRLRKRATKAQESEGKLKDKQTKRKKVKNAAAAKVSVGHAKMKDGEAEYQCDIDGCTMSFGSKQELMHHKKNICPVKGCGKKFFSHKYLVQHRRVHEDERPLKCPWKGCKMTFKWAWARTEHIRVHTGARPYVCAEPDCGQTFRFVSDFSRHKRKTGHSAKKNCQ

SEQ ID NO: 126002 - protein, 92 aa, Glycine max
  Coding DNA Sequence Number=SeqID_34317
  Gene Ontology: Mol. function=hydrolase activity; Biological process =metabolic process
  Homolog annotation: Hit_ID=A7PCK8; Match level="QueryCoverage=41%, HitCoverage=11%, E-value=1e-15, Identity=100%"; Hit description =Chromosome chr17 scaffold_12, whole genome shotgun sequence
MSYTADEDFLNADAVFDCIGDPPEERFDLAFCGSLLEKQYKEGNKHRHGYGTRHEYGHVDTCNIQNIERNTGVVSVSDTDTDACRTPDTAKG

SEQ ID NO: 126003 - protein, 250 aa, Glycine max
  Coding DNA Sequence Number=SeqID_34318
  Gene Ontology: Mol. function=cysteine-type peptidase activity; Cellular component=cellular_component; Biological process=ubiquitin cycle
  Homolog annotation: Hit_ID=A7PCL4; Match level="QueryCoverage=26%, HitCoverage=10%, E-value=3e-27, Identity=90%"; Hit description =Chromosome chr17 scaffold_12, whole genome shotgun sequence
  Pfam annotation: Domain name=Peptidase_C78; Domain location=55-196; Score=-12.0; E_value=2.5e-07; Accession=PF07910.4; Description =Peptidase family C78
MEATSTLELAKNTGTGFGKKVNELLSRMVVLDGRDKSELEKLGRRETKKEMVDRTVCQALWGDSKVKWAANPAVNSAGGTNLKMKIPSKTLVEIGDKDPSFVGSRDWIGAIELSFVLDKLLGVTCKVINVRSGAELPERCRELALHFENQSTPNLSLGHKSSSSSSSSACEELTLTAAVYSLDCASEYAGRLIPVLVVDELENGHRELDEDLFSGGRGIGVVREVGGSTGMVSMYQGLKQLPLSTENLSG

SEQ ID NO: 126004 - protein, 102 aa, Glycine max
  Coding DNA Sequence Number=SeqID_34319
MRNPIEALSTFLLRRSASHTPWLFPFPQHLGFKEKRRILIIKEKRNVGQGRRRSETTKLGGVKKKAPQDRHNANSKNKHRRAYFYMVLFRGKRKAVAWEAGC

SEQ ID NO: 126005 - protein, 84 aa, Glycine max
  Coding DNA Sequence Number=SeqID_34320
  Pfam annotation: Domain name=zf-CCHC; Domain location=56-73; Score =17.1; E_value=0.004; Accession=PF00098.14; Description=Zinc knuckle
MCMNCTNQGSHSVYYVSHRGNQGTRKKFVKKHDKGRGPLKINDGSMQLQKKTSKSNNCHLCGKSKHFQKDCQKRIPYHQNHKPK

SEQ ID NO: 126006 - protein, 63 aa, Glycine max
  Coding DNA Sequence Number=SeqID_34321
  Gene Ontology: Mol. function=protein-L-isoaspartate (D-aspartate) O -methyltransferase activity; Cellular component=cytoplasm; Biological process=protein modification process
  Homolog annotation: Hit_ID=A7PCN2; Match level="QueryCoverage=73%, HitCoverage=21%, E-value=6e-18, Identity=91%"; Hit description =Chromosome chr17 scaffold_12, whole genome shotgun sequence
GRQGWPEFAPYDAIHVGAAAPEIPQPLIDQLKPGGRMLSPVGNIFQRWWIMLNCEVTKIEPKS

SEQ ID NO: 126007 - protein, 143 aa, Glycine max
  Coding DNA Sequence Number=SeqID_34322
MTLEASSIGENVIEQPLIDHTDNEENVIEQPPINNTDNDVEQPPRDDTDNGENVIEQPPINNTDNTNSHNFNQELEDNILEIGVEGNVEHNNTSSEDNIKIDILYNILSLFKILVKKDSFNIFALSSKMSVHGPVCKQTMYPF

SEQ ID NO: 126008 - protein, 241 aa, Glycine max
  Coding DNA Sequence Number=SeqID_34323
  Gene Ontology: Mol. function=hydrolase activity
  Homolog annotation: Hit_ID=A5CB22; Match level="QueryCoverage=95%, HitCoverage=65%, E-value=1e-100, Identity=74%"; Hit description =Putative uncharacterized protein
  Pfam annotation: Domain name=Metallophos; Domain location=24-237; Score=17.6; E_value=0.012; Accession=PF00149.19; Description =Calcineurin-like phosphoesterase
MTEAQREGDIMVSSNGLATTQPLFSFGLISDVQYADIPDGRSFLGVPRYYKHSILVLRRAVKEWNTHQKHKFAINFGDIVDGFCPKDQSLGTIKKLVDEFEMFRGGPVHHIIGNHCLYNLPRSELLPLLKIKTLDGRAYYDFSPVPEYRFVVLDGYDISAIGWPKDHPKTLEALKILREKNPNENKNSPINMEGLERRFLMFNGAIGKEQMKWLDDVLLEATKLKQKVVICCHLPLDPGAA

SEQ ID NO: 126009 - protein, 179 aa, Glycine max
  Coding DNA Sequence Number=SeqID_34324
MTKEKPQALALRRKLDKQLKLELTNSSPRTWGSSIYGIGVDADDLKSDGGNYSVFNYTDEDQHAKSLFRCPFCDFEFEFSSAHICLEELCPMCDKKLGKDAIRVAHNSSPQKRTLKSDKSSILSGDSVAIDKKIGKGFSSVASDISNAIGSRSDAPPNTGDEQVIEGKRVRPSFVLELD

SEQ ID NO: 126010 - protein, 47 aa, Glycine max
  Coding DNA Sequence Number=SeqID_34325
MDGIKTPIMILRSKTERWLWWSKSTSWLLENDIIEAYFWVGISFVRR

SEQ ID NO: 126011 - protein, 229 aa, Glycine max
  Coding DNA Sequence Number=SeqID_34326
MAERYSPFVYVEDQDVLYEICGYVVERVLGLDASVPVEGSSSEESVGSGSGVRGYNDEVFEVSSDSHSLGLNFSSSIDLLAIEGSSDILPFLSQLQKNMGKKVGGSVVALMVATIAETGTSTGAFPQPKKRSVLKEKCLPPPITLLGYMWVDREVRIYLTRPHGGRQNIHVTNELKTYPYAKESSVVSKGLLGPLTWGFTPLYTNLTGPEICGPKCPNYQLSNTPLNLA

SEQ ID NO: 126012 - protein, 161 aa, Glycine max
  Coding DNA Sequence Number=SeqID_34327
MDVRWIRCRRKRRSGVGLSSVPRFQRCDVNDGERAHRQLPRTDSDGGAAADEAVWLKPKASRGEAAARDQMVLKLLSFNAKEVSITVTKFWWLSERLKALRSNIISFVSVKFVGGNSNSTNEEKELKMLCLVCMVFSTAMVTVANAHIDDCLVMAIKKNEL

SEQ ID NO: 126013 - protein, 807 aa, Glycine max
  Coding DNA Sequence Number=SeqID_34328
  Gene Ontology: Mol. function=solute:hydrogen antiporter activity; Cellular component=integral to membrane; Biological process =regulation of pH
  Homolog annotation: Hit_ID=A7R3F8; Match level="QueryCoverage=95%, HitCoverage=65%, E-value=1e-153, Identity=37%"; Hit description =Chromosome chr4 scaffold_519, whole genome shotgun sequence
  Pfam annotation: Domain name=Na_H_Exchanger; Domain location=40-424; Score=169.5; E_value=8.5e-48; Accession=PF00999.12; Description =Sodiumhydrogen exchanger family
MEEPENHTLHSQLIVDNPNEIWKSENILRFFLPQFTLLLFFIVSMTRFIHYILRPFNQPHFVAEFFAGLLLCPEIVGKSEITAYVIPPKALLGVETVAHVGLIYNVFLTGLEMNLDAVLLARKKATTIAIAATIIPMALGTAIYSLGQALYPDDKSSFNTPSAYLFCALVLSVTNYPVLAHILADLKILYTGLGRVAVTAATINDFYNWAMFVILIPFATHSEKPFVSVMLTMIFVLFCYYMLRPSLNRLIEKITDKNEWDNYKLSYVLVGVLFCAHVTEMLGTHSIVGALVFGLILPRGKFADMLMERSDDLVSMYLAPLFFIGCGIRFNFATFEKTKLRNVMIITLLSCCTKIVSTVIATGFYRMPFRDGVALGALLNTKGLLPLVMLNIASDREILSRDFYTIMTTANVLMTILVSPTINYIYKPRKQFEKDKLRTIQNLKADADIRVVACVHNARQAAGMITILEACSATNASRLRVFSLQLIELKGRGTAFLVDHNSSHQSQADTEAIANIFAEISPEQGHTNTSLETLSAVSSYETIHKDIYNIADEKRASLILIPFHKHSSAEGTLEVTNPAFKEINQNVMNYAPCSVGILVDRGHGSLSKVSLRVCVVFIGGPDDREALAISWRMAKHPGIHLSMVHVLLYGKAAEVDTNATTNDESHGILSTIIDSGKEKELDEEYVSLFRLMAVNNEDSITYSEKEVHTGDDIPLVLNELDRGSYDLYILGHGKGRNSLVLSNLMEWTDCPELGVIGDMLASNSFDSCSSVLVVQQYGFGGMNFNKGSNEATSSKHGDVEALFGKGE

SEQ ID NO: 126014 - protein, 700 aa, Glycine max
  Coding DNA Sequence Number=SeqID_34329
  Gene Ontology: Mol. function=acid phosphatase activity; Cellular component=chloroplast; Biological process=RNA processing
  Homolog annotation: Hit_ID=Q8VXF4; Match level="QueryCoverage=100%, HitCoverage=67%, E-value=0.0, Identity=76%"; Hit description =Putative metallophosphatase
  Pfam annotation: Domain name=Metallophos; Domain location=105-321; Score=59.8; E_value=9.6e-15; Accession=PF00149.19; Description =Calcineurin-like phosphoesterase
MTVTWTSGYDINEAVPFVEWGPKGGKKTRSHAGTLTFNRNSMCGEPARTVGWRDPGFIHTSFLKELWPNFRYTYKLGHMLSNGSYVWSKKYSFKASPYPGQNSLQRVIIFGDMGKAERDGSNEYADYQPGSLNTTDQLVKDLENYDIVFHIGDMPYANGYISQWDQFTAQVQEISSTVPYMIASGNHERDWPNTGSFYDTPDSGGECGVPAETMYYFPAENRAKFWYKADYGLFRFCIADSEHDWREGSEQYKFIEHCLATVDRKHQPWLIFSAHRPLGYSSNLWYGMEGSFEEPMGRESLQKLWQKYKVDIGFYGHVHNYERVCPIYQNQCVNEEKHHYSGTVNGTIHVVVGGGGSHLSDFTPSPPIWSLYRDVDYGFGKLTAFNHSYLLFEYKKSSDGEVYDSFTISRDYRDVLACVHDGWFCIAPLLRYTYRLEHVRSNDSYIWSKKYSFKASPYPGQNSLQRVIIFGDTGKVERDGSNGYAVINMETCLTQMDISQWDHFTAQVQEISSTVPYMIASGNHERDWPNTGSFFDTPDSGAECGVPAETMYYFPAENRAKFWYKADYGLFRFCIADSEHDWRKGSKQYKFIEHGLATEGSFEEPMARESLQKLWQKYKVDIAFYCHVHNYERICPIYQNQCVNQENHHYSGTVNGTIHVVVGGGGSHLSDFTTPPIWSLYRDLDYGLGKLTAFNHPSLV

SEQ ID NO: 126015 - protein, 231 aa, Glycine max
  Coding DNA Sequence Number=SeqID_34330
  Homolog annotation: Hit_ID=A9P0B1; Match level="QueryCoverage=83%, HitCoverage=92%, E-value=9e-54, Identity=56%"; Hit description =Putative uncharacterized protein
MEQTIWGHLPVLVRANSKESIEYILQALWRTRKTGLGTTDRCIIQEMLQLQNESDLDPLLVCLRMLIRRCVYENTSKEDIPKLFPSEVLPELQKLLTLLLHKFQREWQEDVMKDQNIVPRLKAMTWNMANLDKESADPAAVINLKFSLHPFQLQNDGQFHSGEQDVKFKLATDSIDMMLKAMHCIRDQFSTVVNTMLKFVLLSGLNFILVFAVWFSNEPVICCQDEALNGH

SEQ ID NO: 126016 - protein, 158 aa, Glycine max
  Coding DNA Sequence Number=SeqID_34331
  Subcellular localization annotation: CTP_CleavageSite=35; ConfidenceScore=5.36e-01
MEKQVITSSQASIHKTNYYKPIKHTFPTSSNGTTKAGTAETNPMSKYSSSVNFYQIEGNNNAETKGEPERGVEKEEEFAPSFAGVWSQPRTGRSRSCSNQSPKIRERERGSWFSGCERDEMRCEDVAITNNVTPVSLMEGARQGEMEAVSSMGGSETG

SEQ ID NO: 126017 - protein, 99 aa, Glycine max
  Coding DNA Sequence Number=SeqID_34332
MGRNCIGCSPGIAESEAESVVGLGRRESVRRESERDVRADIPTRKSENPLQFEGFYKLEGAPPRSRSIAGNGVLFIRFVKYLSYRVLYYGTCLAHVWCV

SEQ ID NO: 126018 - protein, 332 aa, Glycine max
  Coding DNA Sequence Number=SeqID_34333
  Gene Ontology: Mol. function=nucleoside-triphosphatase activity
  Homolog annotation: Hit_ID=A7PHF9; Match level="QueryCoverage=93%, HitCoverage=24%, E-value=1e-113, Identity=69%"; Hit description =Chromosome chr17 scaffold_16, whole genome shotgun sequence
MWLLAAVASFISCIIHLKHKEHAKYTTDLTTINPRILLSGPAGSEIYQEMLAKALAKYFGAKLLIFDSHSLLGGLSSKEAELLKDGFNAEKFCAYAKSPSSSDMARCMDPSASEPDTPNSSNAPTPYGFESQPKLEADNVPSTSGTAKNCVFKLGDRVKYSSSSGGLYQLQTISSNNCLYRGPANGSRGKVVLLFDDNPLSKIGVRFDKPIPDGVDLGGLCEGGQGFFCNVTDLRLENSGIEELDRLLINTLFEVAFHSTDLIKVVVSESRNAPFILFMKDAEKSIVGNGDPFSFKSRLENLPDNVVVIGSHTHTDSRKEKKNILAANYMII

SEQ ID NO: 126019 - protein, 665 aa, Glycine max
  Coding DNA Sequence Number=SeqID_34334
  Gene Ontology: Mol. function=metallopeptidase activity; Cellular component=vacuole; Biological process=proteolysis
  Homolog annotation: Hit_ID=Q8LF32; Match level="QueryCoverage=99%, HitCoverage=100%, E-value=1e-109, Identity=70%"; Hit description =Aspartyl aminopeptidase-like protein
  Pfam annotation: Domain name=CHB_HEX_C; Domain location=122-176; Score=-7.0; E_value=0.084; Accession=PF03174.4; Description =Chitobiasebeta-hexosaminidase C-terminal domain
  Pfam annotation: Domain name=Peptidase_M18; Domain location=17-651; Score=455.1; E_value=9.1e-134; Accession=PF02127.6; Description =Aminopeptidase I zinc metalloprotease (M18)
  Pfam module annotation: Pfam domain module=CHB_HEX_C::Peptidase_M18; Domain location=122-176::17-651
MAAKLDTHAVASDLIDFLNASPTAFHAVDEAKRRLRSAGYHQLSEREVWELQPGNKYFFTRNHSTIVAFAIGKKAFGFPVDPELSPEASVLWLAMYVAGNGFYIIGAHTDSPCLKLKPVTKVVKAGILEVGVQTYGGGLWHTWFDRDLTVAGRVIVREENAGSVSYSHRLVRIEEPIMRIPTLAIHLDKTVNDGFKFNNENHLIPILATSLKGELNKVSSENGPVESGNQTDGKKANDKTGTSNTKHHLLLLQLLASKLGCEPDDICDFELQACDTQPSTIAGAAKEFIFSGRLDNLCMSFCSLKEVGIFDEYVYYDHDINHYGVNTEPYPCICKEAVSGFEPMTNKSPRHNFTAAPGLTLTQDTIIQEYICGTECVPYNKTISVVMIHWSLTVAGILGVNIYNLGLFPSLASGGGLCQAYLKCGLHKGTYGLELFTSSPQLVNFLGEVSEGYIIGGFDALSALIDATSSDSSLEEESGVRMVALFDHEEVGSNSAQGAGSPVMLNAVTRVTNSFSSNPNLLEKAAQLSYLVSADMAHALHPNYMDKHEANHQPKLHGGLVIKTNASQRYATNVVTSFIFREIASKHKLPVQDFVVRNDMSCGSTIGPILASGVGIRTVDVGAPQLSMHSIREICAVDDVKYSYEHFKAFYQEFSHVDGKMVVDI

SEQ ID NO: 126020 - protein, 788 aa, Glycine max
  Coding DNA Sequence Number=SeqID_34335
  Gene Ontology: Mol. function=kinase activity; Cellular component =nucleus; Biological process=DNA mediated transformation
  Homolog annotation: Hit_ID=A7PHD1; Match level="QueryCoverage=97%, HitCoverage=100%, E-value=0.0, Identity=52%"; Hit description =Chromosome chr17 scaffold_16, whole genome shotgun sequence
  Pfam annotation: Domain name=Bromodomain; Domain location=209-298; Score=116.7; E_value=6.9e-32; Accession=PF00439.16; Description =Bromodomain
MAPTLPIEFAGQKESRKYSHSQNMGKSRKYSKGYATGFVPDFRHAVETIDESEGLGSLGRVDMELTALADSCAPKRKRPGLNTCGGDYAGSFNVPFRHFSLSAMSGFERKDLKVRLTWELEQVREFQKKIDGMNSSVVGGLSLFSDIRGCSAGQKRPKLESQHSTMEVSVPPGKKRPVPGHNGPKSKKSMSERLEHAKPAAPVTSYAMLMKSCENVLNRLMSHQFAWVFNDPVDVVKLNIPDYFTVIKHPMDLGTVKKRITSGEYSNPMDFAADVRLTFDNAMFYNPAGNDVHIMAETLSKFFETRWKAIEKKIPVIDCVASEPSRPTRVETEISDRVPPTKKKKITPNDSSVKPEPVKRIVTVEEKQKLSLELETMIGELPDSIVDFLREQSYNEGQTNDDEIEIDIDTLSDDTLFKLRKLLDDYMLEKQKSQAKAGQCEMELLNESGFSNSSMQPCKDAGNEQVEEDVDIVGGNDPPISNYPSLEIENDVTKRNSKCSSSSSSSSESGSSSSDSDSVSSSGSELDMAKTSEPLSATKENIGFGLTSDQNKGDPGNSETGKDSTNVGGQVEESSQSRPVATEPESHQEGESAASKRQVSPEKLYRAALLRSRFADTILKAQEKALEKDEKRDPEKLRIEREDLERRQKEEKARLQAEAKAAEEAQRKAEAEAAAEAKRKRELEREAARQALQKMEKTVDINENSQFLEDLEMLSAVHDEHLPSFKEETSTDQPQDGLGGIKLQGNPLEQLGLYMKDEDEEEDEEEEDELPPSGAVGPSNDVEEGEID

SEQ ID NO: 126021 - protein, 154 aa, Glycine max
  Coding DNA Sequence Number=SeqID_34336
HPLDPDKSNRALGFPALITGLCQSFDVPITPSKVIRPPITRAFIEKYCTQRQVPEQYLRHLVRQQAANHRAHVQTPDCLYQMSLSLQSQGFTSFPCPTLDQFRAEVAWPGDWPEAQAGEAPAGAPAEAPDEADEAREDEEMTDLLDFLGGSSAT

SEQ ID NO: 126022 - protein, 377 aa, Glycine max
  Coding DNA Sequence Number=SeqID_34337
  Homolog annotation: Hit_ID=Q84VI1; Match level="QueryCoverage=99%, HitCoverage=59%, E-value=1e-153, Identity=72%"; Hit description =Envelope-like protein
FNIQPIQIIPGQASVPEKLVPRRPQGVKIAENPSSATSSREVDTEMDKKIRSIVSSILKDASVPDAEKDVPTSSNPNVSVPDVKKDVPTSSAPNAEALPSSSEEESTEEEDNASEETPAPRAPETAPGDLIDLEEVESDEEPIANRLAPGIAERLQNRKGKTPIKRSGRIKTMAQKKSTPVTPATSRRSKVVIPSKKRKEISSSDSDDDVELDVSTSKRAKKSGRKVPGNVPDAPLDNISFHSIGNVEEWKYVYQRRLAVERELGRDALDCKETMDLIKAAGLLKTVTKLGDCYEGLVREFIVNIPSDISNRKSDDYQRVFVRGNIKLPRKSLPNESSIGQRKGSFQQGKLSVKYAILHRIGAANWVPTNHTSTVAT

SEQ ID NO: 126023 - protein, 47 aa, Glycine max
  Coding DNA Sequence Number=SeqID_34338
MVTKGWSFVGASMVEEEERNSNPRFACHFSGSSPSRFSAPVGASFRK

SEQ ID NO: 126024 - protein, 138 aa, Glycine max
  Coding DNA Sequence Number=SeqID_34339
  Subcellular localization annotation: CTP_CleavageSite=72; ConfidenceScore=5.28e-01
MAATMFSKLFNVMRLNDKPACSITRVRKLIFFTSITSNRFTKFKISYICHITTARTIYSFNSSITFGGVFLQAATLPDFPIRCCLARVIPPLVIFPQKLQTMVFVSPSTSEWQYFQPGSALFFLVALAVAASDDGLAI

SEQ ID NO: 126025 - protein, 330 aa, Glycine max
  Coding DNA Sequence Number=SeqID_34340
  Homolog annotation: Hit_ID=Q84VH5; Match level="QueryCoverage=100%, HitCoverage=48%, E-value=1e-132, Identity=76%"; Hit description =Envelope-like protein
  Subcellular localization annotation: CTP_CleavageSite=21; ConfidenceScore=5.03e-01
MATSPKETSAPGSPSVPSSPSSTKAPSIQEQPEFHIQPIQMIPGQAPVPEKLVPKRQQGVKTSENPSLATSPREVDTEMDKKIRSIVSNILKNASVPDADEDVPTSSTPNATVPDVEKDVPTSSAPNAEVLSSSSKERSTEEDDQAAEETPAPRAPEPAPGDLIDLEEVESDEEPIANKLAPGIAERLQSRKGKTPIKRSGRIKTMAQKKSTLITPTTSRRSKVAIPSKKRKEISSSDSDDDVELDVPDIKRTKTSGKKVPGNVPDAPLDNISFHSIGNAERWKFVYQRRLALERELGRAALDCKEIMELITGAGLLKTVTKLGDCYESL

SEQ ID NO: 126026 - protein, 103 aa, Glycine max
  Coding DNA Sequence Number=SeqID_34341
MAVQLIHDRVEMECLEGAWETLEGNARCRFRGTIRFTATSLAHPDEPVRTLQRTMEWILPTLTSYRLVEPVQVIEVTSSEEDPEEDPEELPPEPAVDTLDFLE

SEQ ID NO: 126027 - protein, 69 aa, Glycine max
  Coding DNA Sequence Number=SeqID_34342
MVMGDFISRLSFPGYVGARASLLSTTPLFVAMTQELIRGDTLRLSAPLCYADTVVSDGTQRPSLVILHP

SEQ ID NO: 126028 - protein, 131 aa, Glycine max
  Coding DNA Sequence Number=SeqID_34343
MARNGDGRERGAPLQEKMSLEETHHHRRPWIRAWRKKEMNEGRGREEHKILCSKRALKSEISGLIIAHGPEIYPKAHENPRAFSCISGPIFLESSIQCPWGVGLHHSLPLEKDLTSNPEVLETLGFLPQHL

SEQ ID NO: 126029 - protein, 99 aa, Glycine max
  Coding DNA Sequence Number=SeqID_34344
MVARPGTQPSLHREDEGEEAGETQVRQVAAATLERYLETTLEPLAPVVDLPSPQHTADPSTIILEMQEDPTTPVLAMDTSPPATPVLHLTDEEDVQTQD

SEQ ID NO: 126030 - protein, 68 aa, Glycine max
  Coding DNA Sequence Number=SeqID_34345
MGFPLPAVTYLAENLSGLEGQGSTRSKVVSPPRSFIVGTPILISGVKQIWVSRCRFRAELPYYSIRHA

SEQ ID NO: 126031 - protein, 72 aa, Glycine max
  Coding DNA Sequence Number=SeqID_34346
MGSCQMPSLKKSFYQVKVKSLGTTSLKELGQLMGQLQRQAFRKAYGKIRDLAMVEVSTEASASLAQYYDQPM

SEQ ID NO: 126032 - protein, 124 aa, Glycine max
  Coding DNA Sequence Number=SeqID_34347
MGSEIYPKVHENPRAFFSSSSPIFLEPLAHGSCDWSLPKEDCIMHGYFMVSRTFRQPGGNEPVDARRLTSSSAPFVILTREVSDMRCYLMVTPTFGQPVANKPVDAQRLGSSAAPFVVLTREVR

SEQ ID NO: 126033 - protein, 265 aa, Glycine max
  Coding DNA Sequence Number=SeqID_34348
MASRKLSAKRSRRDAAVEGTSAAPEFDSHRFRSAEHQQPFEAIKGWSFPRERRVQLRDDEYTDFQEEIARRRWTSLVTPMAKFDPEIVLEFYVNAWPIEEGVRDMRSWVRGQWIPFDADALSQFLGDPLVLEEGQECEFSQRRNRADGFDEEAIAQLLCIPGQDFARTAAGRRVRIMRTSMTTLTQMWMTLLLSNVLPSDHNSDLPLPKCQLVYAILTRMSIHVAQLIADTIYLFAGMPPTRHPLDPDKSNRPLGDAILPRKGIG

SEQ ID NO: 126034 - protein, 24 aa, Glycine max
  Coding DNA Sequence Number=SeqID_34349
MAFLRYRPRIFGSIPRRVVGNGVY

SEQ ID NO: 126035 - protein, 39 aa, Glycine max
  Coding DNA Sequence Number=SeqID_34350
LPSFVTDAWGANTFPMRKYNSRTFHLKRTRESRVALPPK

SEQ ID NO: 126036 - protein, 127 aa, Glycine max
  Coding DNA Sequence Number=SeqID_34351
MQVLMTPKRVCLIMIVIIKKGKNVNNAVFDDAEKNSLDNDCHHKKWRDCECCFQDYFNKHSKVKHCFKIKARLLQQTSIASRFIEDQLLPQNTLFPTYQGSGNRLSGSIIDYQKTSLQISFLKGFEI

SEQ ID NO: 126037 - protein, 164 aa, Glycine max
  Coding DNA Sequence Number=SeqID_34352
  Gene Ontology: Mol. function=protein binding; Cellular component =integral to membrane; Biological process=protein amino acid phosphorylation
  Homolog annotation: Hit_ID=A7QKX8; Match level="QueryCoverage=92%, HitCoverage=14%, E-value=1e-45, Identity=63%"; Hit description =Chromosome chr8 scaffold_115, whole genome shotgun sequence
  Pfam annotation: Domain name=LRR_1; Domain location=49-71; Score =13.1; E_value=1; Accession=PF00560.24; Description=Leucine Rich Repeat
  Pfam annotation: Domain name=LRR_1; Domain location=73-95; Score =10.8; E_value=3.1; Accession=PF00560.24; Description=Leucine Rich Repeat
  Pfam module annotation: Pfam domain module=LRR_1::LRR_1; Domain location=49-71::73-95
MELSRHFHPKKLWMGVTCDKDGHVIGLDLSGEFISGGFDNSSTLFSLQHLQSLNLAANCFLSKIPSGFNKLENLTYLNLSESSFMGQIPIEISQLTRLATLDLSSISYARGPKLLLENPNLQKLVQNLTSIRQLYLDGVDRTAPGHEWSNALSSLHDLQGLSMP

SEQ ID NO: 126038 - protein, 320 aa, Glycine max
  Coding DNA Sequence Number=SeqID_34353
  Homolog annotation: Hit_ID=A8GJZ0; Match level="QueryCoverage=82%, HitCoverage=39%, E-value=1e-115, Identity=80%"; Hit description=LppC family lipoprotein precursor
  Pfam annotation: Domain name=LppC; Domain location=45-320; Score= -213.4; E_value=0.00044; Accession=PF04348.4; Description=LppC putative lipoprotein
  Subcellular localization annotation: CTP_CleavageSite=18; ConfidenceScore=5.05e-01
MLSSTFVRTKAGRSKPVRLTAVVAAALFLAGCPSRAPQTPPANIQDEASASSDYYLQQLQQSSDDNKADWQLLAIRALLREGKLPQAGDQLNQLPKNLSGAQQTERQLLTAELQIANKSYVSARSTLGHLDSGSLSPNQKVRYYQAQIAANQGKASLPLIRAYIAQEPLLTGKPHQDNLDQTWQALLQLTPQEMNSLVINADENVLQGWLDLLRVYQDNKQDPDLLKAGIKDWQNRYPKNPAAKTLPARLNQVLNFTQASTSKIAPAAAVERPSESVRRRHPPRLQSGEKRRFHAGAASSRRATGQRTGPNGAGQSGRHG

SEQ ID NO: 126039 - protein, 123 aa, Glycine max
  Coding DNA Sequence Number=SeqID_34354
MAPTRHPLDLEKSNMALGFPSLITGLCHSYGVPVTPSKAANHRGQVQIHKCLYRFSLSQQGQGSAPFVCPTPEQFGAEVAWPGDWLDAQAGEEPAGSPSEADESHMDEDMTDLLGFLGGSGAT

SEQ ID NO: 126040 - protein, 111 aa, Glycine max
  Coding DNA Sequence Number=SeqID_34355
MQGYLMVIRTFLLILTSEVRWQAEIPEWLSVQRQLLLILTREVKWHVGGYLMVICTFLLILTREVRWQAEIPKWLSVQRQLPLILTREVSRHVGVHYGYPHLLSTRGKRAR

SEQ ID NO: 126041 - protein, 87 aa, Glycine max
  Coding DNA Sequence Number=SeqID_34356
  Subcellular localization annotation: CTP_CleavageSite=78; ConfidenceScore=5.40e-01
SACHPQQGHQAPYQSSFHQEVLRPQAGAGRNTTSALGWPVAGNRHTATTSRVHLSSSTKSHIGTHLVAHDPGNLNKTSASSEGRKIP

SEQ ID NO: 126042 - protein, 121 aa, Glycine max
  Coding DNA Sequence Number=SeqID_34357
MEKGQGRSCLAQRLLLTGRELRFARPAAGGVLILCDNTTERVALLGGQLCDNTTEKAALSFNMLWSQRPYEIVMSFTRSKPGPRAVRKIGRNLSGTTHPTLPPIGGRPFYSRPKRNCSDLE

SEQ ID NO: 126043 - protein, 96 aa, Glycine max
  Coding DNA Sequence Number=SeqID_34358
  Subcellular localization annotation: CTP_CleavageSite=30; ConfidenceScore=5.05e-01
MHLKRTHILTLKALRHVATYPSAGGRRVTRGMRVPRKEYARSRHQRLFEENVGKTGKDAIYELLSERFGSCIYARGRVFPFAPTYSSIWDEKIRPT

SEQ ID NO: 126044 - protein, 202 aa, Glycine max
  Coding DNA Sequence Number=SeqID_34359
  Homolog annotation: Hit_ID=A2Q4S5; Match level="QueryCoverage=74%, HitCoverage=26%, E-value=2e-15, Identity=32%"; Hit description=IMP dehydrogenase/GMP reductase, putative
  Pfam annotation: Domain name=DUF1723; Domain location=126-175; Score =65.3; E_value=2.1e-16; Accession=PF08330.1; Description=Protein of unknown function (DUF1723)
MVRTRGLGRALGAGRGRGISEDAHEADVPRRCRPTASAQMTGAADAVQTEGVATDGSLGSPAADEGFPSGPRDPSILTDYAEHERPDLKLVSHGRKVDKIGRPAPEIEGLIAGTRLSPLIRCYVITTDPGLISAFVERWHRETSTFHLPVGELTITLGDMASLLHLPITGALHTFEPLVTSDAIGLLTELLEVSHEEATFET

SEQ ID NO: 126045 - protein, 135 aa, Glycine max
  Coding DNA Sequence Number=SeqID_34360
AYADDVVRVSVETVIDPEAEVPYATSEIQYVKQAVYTFVAWPTHLVKAVLDEDPQSIPHNEDAHVPKPANMDADDPLRGIDKDRRSECEQYLERWLKESDREVYIGPYFHHVMTKLKKTLSPETKAVAPKWIEVK

SEQ ID NO: 126046 - protein, 216 aa, Glycine max
  Coding DNA Sequence Number=SeqID_34361
  Homolog annotation: Hit_ID=A5ADW6; Match level="QueryCoverage=51%, HitCoverage=4%, E-value=2e-08, Identity=32%"; Hit description =Putative uncharacterized protein
  Pfam annotation: Domain name=Retrotrans_gag; Domain location=112-216; Score=-2.8; E_value=0.1; Accession=PF03732.8; Description =Retrotransposon gag protein
NPSDLQPFDPEIDRTFHRLVRHHFIPFDHREHSITGESVHSVIGDFKHPNFEHYNFEHSNFEHSENIAQPPPYERTLREMAAPDFTYESLCIQYPDKDVPYVLKTGLIHLLPKFHGLAEGVAKDWLYYLALRSIMSWDDLKIVFLEKNFPASRTTTIRKDISGLSNMERSMIDAASGGALGDMTPVEARNLIEKMASNSQQFSTINDAIVIRGVHE

SEQ ID NO: 126047 - protein, 146 aa, Glycine max
  Coding DNA Sequence Number=SeqID_34362
MNLLRTSVFNSERLDILRDSIRHPSKKLLSFEFSQSLRYSISSVSIYYGTQSDIRVISYCRLNWLRASVFYSSVSTYYVTQSDIRVKSYSRLNLLRASPYSISSVSIYYGTQSDIRIKSYCRLNFSELRYSISSVSIYYVTQSDIR

SEQ ID NO: 126048 - protein, 482 aa, Glycine max
  Coding DNA Sequence Number=SeqID_34363
  Gene Ontology: Mol. function=nucleoside-triphosphatase activity; Cellular component=chloroplast
  Homolog annotation: Hit_ID=Q2PMM5; Match level="QueryCoverage=100%, HitCoverage=21%, E-value=0.0, Identity=96%"; Hit description=Protein ycf2
MDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLFVSWGKSPHESDFLRNNMSRENWIWLDNVWLVNKDRFFSKVRNVSSNIQYDSTRSSFIQVTGSSQLKGSSDQSKDYFDSIRNEDSKYHTLINQREIQQLPARSILCWDPSFLQTERTEIESERFPKILSGYSSMCRLFMEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLVYHKGFAFSIDSSGLGQKHFLNELFNSRDESKNHSLLVLPPLFYEENESFYRRIIKKWVQTSCGNNLEDPKPKI

SEQ ID NO: 126049 - protein, 173 aa, Glycine max
  Coding DNA Sequence Number=SeqID_34364
  Homolog annotation: Hit_ID=A5AZG1; Match level="QueryCoverage=54%, HitCoverage=30%, E-value=5e-07, Identity=32%"; Hit description =Putative uncharacterized protein
LSEELRDYYEGRHRSHLRPHSHSREKERKYQEANINLPYFHGKDNVEANLDWEIRIEQQLKRKSTSKSYGSHSYPKKDQGQGIFGVTTSKPKDHKGKTIEKQPLKASMQEKTSSMKYFKCLGRGHITSQCPTKKTMIMRGQEIYSSQDEATTSPSSSESEEAKASTPKKKDNL

SEQ ID NO: 126050 - protein, 149 aa, Glycine max
  Coding DNA Sequence Number=SeqID_34365
KDLIWEDIQAEFEIPEASDSRMKRKLLQTQKLLTEKTRKKLEEDAQSGSVDDVIDPPSPVRRHMKSKMVRTKKTGEMTTEAAKEITEKIGSFVPRGHQDVLTIAIGRPEHPGRVRATGSGVTIKKYFGSVPWTSHSSSLLPPEELQQLT

SEQ ID NO: 126051 - protein, 114 aa, Glycine max
  Coding DNA Sequence Number=SeqID_34366
MARRDQVWSFCTHDTRRYLTVIRTPLPFRHSRVRWHAETKFGHSAHMIRGRYLTVIRTHSLPFETQSCPMARRADTGHSAHMFVPPGTTKSFTCGNFGRPRLSSTERSEISVIH

SEQ ID NO: 126052 - protein, 88 aa, Glycine max
  Coding DNA Sequence Number=SeqID_34367
MAKKISKIWIKYGWLSTTYQKNMKMEWMSSLGLLLIMQKTQGGSVSNLMPPDALASSGMLPVGEAIPLVLHVGLMPPFFLAKYMLSRH

SEQ ID NO: 126053 - protein, 69 aa, Glycine max
  Coding DNA Sequence Number=SeqID_34368
  Homolog annotation: Hit_ID=A5B5L1; Match level="QueryCoverage=50%, HitCoverage=12%, E-value=6e-08, Identity=71%"; Hit description =Putative uncharacterized protein
MTIFHCHSLTRCLNAWQEKTIFTCSFDTFAYRRMPFGRCNAPGFYRRFIRDCNKVALPLSNLLQKDIPF

SEQ ID NO: 126054 - protein, 80 aa, Glycine max
  Coding DNA Sequence Number=SeqID_34369
MDSGRFQVSVPGQSKNEFKMFKIESRTLQDSRGKLNSRIKNQDSRDQGSRLKIQESRKGYSTIKRKLNQDKYEKVFSKTE

SEQ ID NO: 126055 - protein, 155 aa, Glycine max
  Coding DNA Sequence Number=SeqID_34370
  Subcellular localization annotation: CTP_CleavageSite=44; ConfidenceScore=5.15e-01
MERSMIDAASGGALTTRFLNSCSSNIQNLFLNLSSKICHNRTIMTSPATGTIPGGGIIPTLDGRILHNSSNNNNNSLIFKMSGKQCQGPQPVASSSSANEPAQPHSTLEKDDDKNLKSKLPNNFYAEAAYPSSIPSKSNFQQKNGRGREGDLENI

SEQ ID NO: 126056 - protein, 55 aa, Glycine max
  Coding DNA Sequence Number=SeqID_34371
GETPQQPGDGQQRATDAPPSPLEFTSAQQPGDGQQRATDAPPSPLEFTSAHPQKG

SEQ ID NO: 126057 - protein, 122 aa, Glycine max
  Coding DNA Sequence Number=SeqID_34372
MGSSQKPSLRKRFYQVKIKSLEVTSLRELGQLMGQLQQQAFRKAYGVLFPNMEGLVDLAAIDAFLAFHHGKGSPVVAILAMHDTFDKRCEKSGARILCCTPALYVWLVSHLFLQEGRPVYPL

SEQ ID NO: 126058 - protein, 145 aa, Glycine max
  Coding DNA Sequence Number=SeqID_34373
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MYNVGRLGFFVRAQPTFCYGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 126059 - protein, 60 aa, Glycine max
  Coding DNA Sequence Number=SeqID_34374
  Subcellular localization annotation: CTP_CleavageSite=21; ConfidenceScore=5.02e-01
MVLVAAIAAALTSIISFMLIMASIIVAICSFEASVSTFICSCTSFTSPITLALARVRTWG

SEQ ID NO: 126060 - protein, 45 aa, Glycine max
  Coding DNA Sequence Number=SeqID_34375
MSYAVKDNRGKWASNYEGPFVQGAESSQATVRSQDKSMAEINQGT

SEQ ID NO: 126061 - protein, 128 aa, Glycine max
  Coding DNA Sequence Number=SeqID_34376
MSISIVSIYYGTQSYIRVKSYCGLHLPRASALTYECLDILRDSTGHQSKKLLSLEFILSFRFQFGASRYITGLNRTSEASVFNYEHLDVLRDSIGHPSKKLLSFEFAQSCGNQFRSSQSITGLHRTSE

SEQ ID NO: 126062 - protein, 178 aa, Glycine max
  Coding DNA Sequence Number=SeqID_34377
MMFMNDWSTSIGFSPVYGFLEPQSIRCIKDTREECQKYIETWVKESHREIYLGPYFNQAHWQLLVLCPRENIIVWLCSIRRKPDVHIKFAVNKKYAVISKARTMHLHLHLNGLRLSHVQQGGYECGYYVMHWMWCIVSAGLKNELHNYFSDGTALDTDTMTTIHKKWAAYFLEVGKWM

SEQ ID NO: 126063 - protein, 118 aa, Glycine max
  Coding DNA Sequence Number=SeqID_34378
  Gene Ontology: Mol. function=structural constituent of ribosome; Cellular component=ribonucleoprotein complex; Biological process =translation
  Homolog annotation: Hit_ID=P61841; Match level="QueryCoverage=72%, HitCoverage=55%, E-value=8e-42, Identity=98%"; Hit description =Chloroplast 30S ribosomal protein S7
  Pfam annotation: Domain name=Ribosomal_S7; Domain location=1-112; Score=88.6; E_value=2e-23; Accession=PF00177.12; Description =Ribosomal protein S7pS5e
MSKVQYGKNFRGFPILAGKGGERILNFNNTWSTPDIAVKARRVGGSTHQVPVEIGSTQGKALAIRWLLGASRKRPGRNMAFKLSSELVDAAKGSGDAIRKKEETHRMAEANRAFAHFR

SEQ ID NO: 126064 - protein, 114 aa, Glycine max
  Coding DNA Sequence Number=SeqID_34379
  Subcellular localization annotation: CTP_CleavageSite=36; ConfidenceScore=5.57e-01
MASSSSSILCRSSHSKISQTLWNLDLSLSRKPYTCRSFKKSATLDRLTLISGFRLSACFSRLVDGLKQCASLDDPSLSEHAQLILLPDSYSRSAEGVVRSADALLSQQIGLARD

SEQ ID NO: 126065 - protein, 141 aa, Glycine max
  Coding DNA Sequence Number=SeqID_34380
ATLPEGRKADRYPESGRVGTGERTRELPGGNACLWKNASNAAFLRFLAFCWPFAHMFFPALSPDSVDNRITAFEKRKSAQYANRLSPRVGRFINAAGTTGFPTGKRAAGGGLVAVAISRVNFGLQMKWRRDGVADEGEKEI

SEQ ID NO: 126066 - protein, 193 aa, Glycine max
  Coding DNA Sequence Number=SeqID_34381
DAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPDQLGSLVAGFDEKGHGIEGSEFKLESGKELKPIQPGELGFHIGSDDDDDKETKIWQRFCHSGFSVEEVVITPR

SEQ ID NO: 126067 - protein, 255 aa, Glycine max
  Coding DNA Sequence Number=SeqID_34382
MAPRKLASKRSRKDKAAEGTSSAPEYDSHRFRSAVHQQRFEAIKGWSFLRERRVQLRDDEYTDFQEEIGRRRWTSLVTPMAKFDPEIVLDFYANAWPTEEGVRDMRSWVRGQWIPFDADAIGQLVGYPLVLEEGQECEYGQRRNRSDGFDEEAIAQLLCIPRQDFARTAAGRRVRIMRTNMTTLTQIWMTLLLSNILPTDHNSDLPMSKCQLVYGAYMAPTRHPLDPDKSNRALGFPALITGLCQSFGVPVAPTK

SEQ ID NO: 126068 - protein, 92 aa, Glycine max
  Coding DNA Sequence Number=SeqID_34383
DAGSRQARQGASAGVGGCRGWLNYAASEQIVLRVHHMRAIGAGLFAITPAGERGMCCKAIKLGNARVFPVTTLLNFGGIVAFGALGVPSSNS

SEQ ID NO: 126069 - protein, 73 aa, Glycine max
  Coding DNA Sequence Number=SeqID_34384
MLRNLADYIIIPFLTYGMLRNLTNCATMLPFDFRDQGVPMNPKRIKVIPEWPTPPSIRKFWGFHDLTNFYKRC

SEQ ID NO: 126070 - protein, 162 aa, Glycine max
  Coding DNA Sequence Number=SeqID_34385
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
  Pfam annotation: Domain name=Transposase_23; Domain location=5-75; Score=-3.7; E_value=0.003; Accession=PF03017.5; Description =TNP1ENSPM transposase
NDPETGDSDQCGLYIEENPSRLVALGRVYEGSTNIHNIPLLHDQVKVGVEEVKDADAPIPIPTNEVILVGQTLNTFLAWLTHLVKHLSEQGAVGPAKPANRLDHESRPAGMQAWHWPSFYNVVTGKTLALPNLIALQHIPLSPAGVIAKRPAPIALPNSCAA

SEQ ID NO: 126071 - protein, 313 aa, Glycine max
  Coding DNA Sequence Number=SeqID_34386
  Gene Ontology: Mol. function=motor activity; Cellular component=cell projection
  Homolog annotation: Hit_ID=UPI00016621D1; Match level="QueryCoverage =96%, HitCoverage=40%, E-value=9e-22, Identity=34%"; Hit description =UPI00016621D1 related cluster
MCDKQEGQGHIVALSQLRLALSQIRGLHVLTFRALHVLAIRGLHALTIRGLHVLVIGELQALTFRGLHVLTIRGLHVLIFRGLHALAFRGLHAFAFRGLHILAFRGLHVLPFIGLHVLTFRGLHVLTFKGLHVLPFRGLHVITFRGLHALTFKGLHILAIRGSRTLTFRGLHILAIRGSCTLTFRGLHVLAYRGQLVLPFKGLYVLTFRGLHALAFKGVHVLAIRGLHALTFIGLHVLAFRGLHVLTFRRLHILTFRGLHVLTFRGLHTLAFRELHVLVFKGLHALTFKGLNILAIIALHALTFRGLHVLPFS

SEQ ID NO: 126072 - protein, 52 aa, Glycine max
  Coding DNA Sequence Number=SeqID_34387
MEESQGIARDAAITVGRHVSLLKGINETLGLIWILVVDLKRANKAALTLVNF

SEQ ID NO: 126073 - protein, 103 aa, Glycine max
  Coding DNA Sequence Number=SeqID_34388
EVNSRGGGGVPAARCHPSPGCCGVSPYACLGAQYFLMKARLVGGLDDLTGGDRHSVELIEAHNQRWQLQDPVGLFRVHWVSCGSTGCLVGTIPANSGWHQKSV

SEQ ID NO: 126074 - protein, 74 aa, Glycine max
  Coding DNA Sequence Number=SeqID_34389
  Subcellular localization annotation: CTP_CleavageSite=40; ConfidenceScore=5.02e-01
IFNFHRNWVQAIGLFAQATCAPEFGLPRPFNQRLLVLHVGGATGQPFPCVQESPTTRDPRSLNPFSEIRRRGLS

SEQ ID NO: 126075 - protein, 104 aa, Glycine max
  Coding DNA Sequence Number=SeqID_34390
  Gene Ontology: Mol. function=endonuclease activity
  Homolog annotation: Hit_ID=Q9AY32; Match level="QueryCoverage=54%, HitCoverage=86%, E-value=2e-23, Identity=96%"; Hit description=RRNA intron-encoded homing endonuclease
MINRDSRGHSYFIVRERKLGARRRSDTVLVSTINDADQGSADVAFRTPLAPYEKSKSLGSGGSMVARLKLKGIDGRAPPRSGACGFKFDSTRGNLPGPDIVPPP

SEQ ID NO: 126076 - protein, 110 aa, Glycine max
  Coding DNA Sequence Number=SeqID_34391
  Subcellular localization annotation: CTP_CleavageSite=39; ConfidenceScore=5.07e-01
MSADVTFFEDTPFFPSSTNHSSSIQDVLPIPSPCPLGTSHQDVSEVPSSPAHPPEVAPPPLLTYQRRIQPVGSIVSEDPPDSHPSSINPQAMDPATSHPSDSDWPIAIRK

SEQ ID NO: 126077 - protein, 102 aa, Glycine max
  Coding DNA Sequence Number=SeqID_34392
MGAKYLEVIKRGSHPNNGWSPNEIRTQNDHNLSLRFVGHDQAWAARHRMAIICLCVPPDSIASGWRKGRRICLCAFITHSAYLNDKGRRICIYAFTHSACRS

SEQ ID NO: 126078 - protein, 366 aa, Glycine max
  Coding DNA Sequence Number=SeqID_34393
MGTLLKNPTEHVMRSCHPGYGGRWRLLRPFGGRALGLGGLLDRMLHRLLGGLLAGGLALGGGGLDLLALAGGRTRTHQLAGLPGFDVFRGGVDHVLADLGIVAIVQVGQRNADGPGRPAEPAAVHQHHARLLGQAEQEVDRLVVGRHVFAEGVAIGVLGPDHEVQFDVVPATHRILGRQRHAQPAPQRIAPRPHDLHGQVLVRVLQVQQVRQGEKAHLHLLRQRQAGSVVQRHVAAVGHHAVDELELLGLHGHGAIALVQAVLPRCRQFGDAAVHGVLFMGRDHAQAPAGAAEVLREGIHADGVVRHFGHQRTEVRHEGAVHVVRHQHQVRILAESVPRSAVSVDRAEGHRRRIAGVDGHRQFESS

SEQ ID NO: 126079 - protein, 51 aa, Glycine max
  Coding DNA Sequence Number=SeqID_34394
MDPKSIKVILEWPTPPSVEERIHEFQEPLDLRSNPFQGGGNDAILPPKGIG

SEQ ID NO: 126080 - protein, 144 aa, Glycine max
  Coding DNA Sequence Number=SeqID_34395
MDINPAYSCLLGTPVDPHGRSRSLYTPPKLKFVVEGVFGHCIGGGRRLGNCPSSMPYAESAEESLETAFHILRLGNGYEPRMGLGKNNGSRTSLEEQRPRLQLGRQVEGIPPCHISRSLISVGLGHEGQVVAICEDDSPSGSAL

SEQ ID NO: 126081 - protein, 223 aa, Glycine max
  Coding DNA Sequence Number=SeqID_34396
MRKIEPLYLECALVYLVTYQASSKGYCYSVQQQGTQFERNQSSVGYQWESYQQSDYHNEAERGSNLDKLLMQFKETTKSTQQALQSVEIQVGVLAEEVTQFMTRREKYFVKVEAQEENPVKEHESREKDEEQAQQQWEKYSIVENNQESILQINNLPHQRIDKKRRQGEHEETLSAILSLITTTFLEIIWIVLPFYMKCHLEGITLCVKLMTLKKCFLGGNPV

SEQ ID NO: 126082 - protein, 121 aa, Glycine max
  Coding DNA Sequence Number=SeqID_34397
MDDFSEDEDQQFFDYINHQSDDQSDDKGVGRPTTPSSPSLQYHQPSCPVDLNFDHLPHYIDRHHFVQQQHNVQPPTGALEVGMTFDEKAQCIRAIKEYNIRNHFDCRTIYFDQRRLKLSWW

SEQ ID NO: 126083 - protein, 256 aa, Glycine max
  Coding DNA Sequence Number=SeqID_34398
  Homolog annotation: Hit_ID=UPI00016621D1; Match level="QueryCoverage =96%, HitCoverage=39%, E-value=3e-13, Identity=29%"; Hit description =UPI00016621D1 related cluster
LRALAFVGLHALTFGGLHVLTFGGQHVLALTFRGLHVLTFRGLHVLAFRGLHVLTFRGLHLLAFKGSCTFTFVGLHALTFRGLHVLANRGLHALTLERATRPRQQRAARPHLERSTRPRQQRAARPHLGEGYTGLHTLAIRGLHVLTFRGLHALAIRGLHVLTFRGLHALAIRELHVLTFRGSHPLAIRGPHVLTFRGLHALAIRGVHVLTFRRPHALAIREPHVLTFVGLHALTFRGPHVLTFRGLHALAFRGPH

SEQ ID NO: 126084 - protein, 122 aa, Glycine max
  Coding DNA Sequence Number=SeqID_34399
MSLATLFGKLQEHEMELLRLHQNEENDKKKKGIALKASSSIQEESDQDNDPDDDDDLSFFVKRFNKFLKKKMEKSEKKNHSEKKLKKAYITWDENDLESSEDSENEEINLCLMAKSYESDEE

SEQ ID NO: 126085 - protein, 211 aa, Glycine max
  Coding DNA Sequence Number=SeqID_34400
  Gene Ontology: Mol. function=motor activity; Cellular component=cell projection
  Homolog annotation: Hit_ID=UPI00016621D1; Match level="QueryCoverage =95%, HitCoverage=42%, E-value=2e-14, Identity=28%"; Hit description =UPI00016621D1 related cluster
MPSPSEGCTSSPFEGSTGLHVFAVRGLHVLTFRGLHALAFRGLHVLAFRGLHVLAFRGLHVLAFRGLHVLTFKGLHILTFRGLHILAFRGLLALRGLHVFTMGTSNLTFRGLHTLAFRGLHVLTFRGLHILAIRVLHPLAFRGLHMLAFRGLHIIDFRGLHILAFKGLHALAFIGLHALAFRGLHALAFRGLHALTFRGLHILAFRGGDPL

SEQ ID NO: 126086 - protein, 82 aa, Glycine max
  Coding DNA Sequence Number=SeqID_34401
MKNVEERSKTFAKSLVETLRKRLGLDFLHGTNFPQLFREREKKLGEKLATQLAQASKVASSRSNTLLEGPSGPGCYLHPHFY

SEQ ID NO: 126087 - protein, 97 aa, Glycine max
  Coding DNA Sequence Number=SeqID_34402
GDAPQAADAPPPHQAGPAGSFDTEQYLRHLSQGFTSFPCPTLDQFRAEVAWPGDWPEAQAGEAPAEAPVEAPDEADEAREDEEMTDLLDFLGGSGAT

SEQ ID NO: 126088 - protein, 57 aa, Glycine max
  Coding DNA Sequence Number=SeqID_34403
MGLFAQATCAPECWLPRPFNLKLLVGCENKTTIGTSKPYTGAMKGTMQKPQANLGAD

SEQ ID NO: 126089 - protein, 194 aa, Glycine max
  Coding DNA Sequence Number=SeqID_34404
  Subcellular localization annotation: CTP_CleavageSite=54; ConfidenceScore=5.11e-01
MDMNVSYMISAQISMIAQHDSSRLGFPTLTTSLYKARGVTSYSLSFESLSPTINLAYVKKNCWNLDDLSVTFRGPRKTKGKRSEALPSSTLPTPAPSTFTAAPSTLASSLLAPALAPSTSTTALSAPATSTPLSAPASTPVSTGSSSFSSDTLYAMLQSLHKGQIIIMQRLQSSGLHLMISMEEFLSQVAWPGV

SEQ ID NO: 126090 - protein, 65 aa, Glycine max
  Coding DNA Sequence Number=SeqID_34405
WIASGGSNPARLGELGDNLLPLFPINRLKGVVLRIPDAPGEVSVSKSMKVFLRYSPFFIRSSFFN

SEQ ID NO: 126091 - protein, 94 aa, Glycine max
  Coding DNA Sequence Number=SeqID_34406
MTNRLRYLLFPLTKIQGTNRLRILCLNTLEGTSFMVQVERTSTWVVILRTREGTSLVDQFKWSIHPLGVSKRTREGFYKVIGNFKNRWLLGDWM

SEQ ID NO: 126092 - protein, 45 aa, Glycine max
  Coding DNA Sequence Number=SeqID_34407
MFLLAFDAAGREAGDDASLEDQNEDDEGRGNDDGRGHDRSPGNFE

SEQ ID NO: 126093 - protein, 38 aa, Glycine max
  Coding DNA Sequence Number=SeqID_34408
NYGTKLMQSYPARALGRRLQVDWARDPREGPRVLMSLR

SEQ ID NO: 126094 - protein, 90 aa, Glycine max
  Coding DNA Sequence Number=SeqID_34409
MDDTNPVGTPMECGSKLSKHDTLDPRGTNSSQKFGWKFTLLDMYKAGYSLCCRSSKSLHGSSNHNSLQGGKENPSIHQRYNKLWLALLLF

SEQ ID NO: 126095 - protein, 348 aa, Glycine max
  Coding DNA Sequence Number=SeqID_34410
  Homolog annotation: Hit_ID=Q6WAY6; Match level="QueryCoverage=88%, HitCoverage=54%, E-value=5e-31, Identity=30%"; Hit description =Putative uncharacterized protein
MVEVSTEAIASLAQYYDQPLRCFTFGDFQLLPMVEEFEEILGSRISKIVQISAQELDYRKKVKNGVVGIPRKCLEAKARIWANRGEWAPFIDILALLIFRGVLFPNVDGLVDLAAIDAFLAYHDHKESPVVAMLADLYDTFDRRCEKSSTRIVCFTRALYVWLVSHLFRQEVRHACPLESHRSCTEKGGANWDRLLANKEGASVSWFLRWKEGGTEVLISCEGFPNVALMGTRGCISYNLVLAIRQLGYPMRGTPLEEELTPVISRGSNKTNVEVLQKVRKAWEAVQKKDKELRGSNNGPIGGYHKWLKAHVQGLDWLPSLRTAKREEVEAPEVDEEMQALRAELEQA

SEQ ID NO: 126096 - protein, 405 aa, Glycine max
  Coding DNA Sequence Number=SeqID_34411
  Gene Ontology: Biological process=response to stress
  Homolog annotation: Hit_ID=P75838; Match level="QueryCoverage=99%, HitCoverage=68%, E-value=0.0, Identity=78%"; Hit description=UPF0142 protein ycaO
  Pfam annotation: Domain name=YcaO; Domain location=1-210; Score =117.0; E_value=5.5e-32; Accession=PF02624.7; Description=YcaO-like family
MSAGNTANEARVQGLSEVFERHIKNRIIAESISLPEIPEAVMQRYPGVVVAINRLEAEGFPIFSYDASLGGNYPVICVVLFNPANGTCFASFGAHPDFGVALERTVTELLQGRGLKDLDVFTPPTFDDEEVAEHANLETHFIDSSGLISWDMFKDDADYPFVDWSFAGTTHEEFDTLMAIFRAEDKEVYIADYEHLDVYACRIIVPGMSDIYPAEDLLLANNNMGASLRETLLSLPATQWQPEEYLALIEQLDEEGHDDFTRVRELLGLATGKDNGWFTLRIGELKAMLALAGGDLDQALIWTEWTMEFNQSIFSPERANYYRCLQTLLLLAMEEDRDPLQYHHAFVRMYGEAAVDAASAAISGEAPFYGLQVVDRDLHAFPAHQALLAAYEKLQAAKRRYWSAK

SEQ ID NO: 126097 - protein, 132 aa, Glycine max
  Coding DNA Sequence Number=SeqID_34412
  Pfam annotation: Domain name=G-patch; Domain location=1-42; Score =10.7; E_value=0.0096; Accession=PF01585.14; Description=G-patch domain
MVARVMLGNGYEPGMGLGKNNGGRTSLISARGNCEKFRLDYKPTQADIRKRVAGRKSGSQGLRLGREVKGGPPYHISRSFISAGLGHKGQVVAICEDDSPSGSDLVRPCPPGFRLGNWRVEERPDIYMTSIM

SEQ ID NO: 126098 - protein, 114 aa, Glycine max
  Coding DNA Sequence Number=SeqID_34413
MEHFPEQVAWPEAQLLLMRPNEAAPPEPTLVQVNSEPANPQSLVVNPPSSPELEAVPPSPPLIVISDASSDEAATPPDSPATEIADPLVSPIGGIPNLSDSSSREVVALTDSPV

SEQ ID NO: 126099 - protein, 52 aa, Glycine max
  Coding DNA Sequence Number=SeqID_34414
MASFEVLFFTFSLSQSAGLASSAKRNTHWLSARKNLEEDELYRFAKCTASSH

SEQ ID NO: 126100 - protein, 49 aa, Glycine max
  Coding DNA Sequence Number=SeqID_34415
MWMDRFALTMNGSQELPRLLAKAKAMADTYSAPEEIHRLLSYYLDKLSE

SEQ ID NO: 126101 - protein, 131 aa, Glycine max
  Coding DNA Sequence Number=SeqID_34416
ALASIATPLGLEFIPQVKKLLDEGLVRKSLNPCALLVPKIGIIRHQVPKIGGMMNVLSGGTLFCKITRTPNIFMSDQGVPMNPKRIKVIPEWPTPPSVEGRSPEYGEPQDLRSNPSQGGGDDAILPRKGIG

SEQ ID NO: 126102 - protein, 153 aa, Glycine max
  Coding DNA Sequence Number=SeqID_34417
  Pfam annotation: Domain name=G-patch; Domain location=36-82; Score =20.8; E_value=0.00059; Accession=PF01585.14; Description=G-patch domain
MPYVEAAEESLETAFQSFEVVSISSVDSFSGQACLSDAAVMMTRVMLGNGYEPGMGLGKDNGGITGLINAKGNRGKYGLDYKPTQADIKRSIAGRKNGSQSSRLRQEGEGSPPCHISRSFISAGLGDEGQVVAIYEDDVPSTLDLVRPRPPDF

SEQ ID NO: 126103 - protein, 180 aa, Glycine max
  Coding DNA Sequence Number=SeqID_34418
  Gene Ontology: Mol. function=hydrolase activity, acting on ester bonds; Biological process=lipid metabolic process
  Homolog annotation: Hit_ID=A7PDQ4; Match level="QueryCoverage=46%, HitCoverage=21%, E-value=2e-20, Identity=57%"; Hit description =Chromosome chr11 scaffold_13, whole genome shotgun sequence
MRKEKIPHQAPFAIQAAQLLGRAIGAGLFAITPAGERGMCCKAIKLANVILSPWRVLNLFLHADATEYAKLPQIPPFLQPNVDYSNGINFASGGAGVLAETNQGLVIDLPTQLRYFEEVRKSLAEKLGKKKAKELISEAIYFISVGGTELEFVIMVIAVSCVKLLSAHNSTQHTSRKHKV

SEQ ID NO: 126104 - protein, 106 aa, Glycine max
  Coding DNA Sequence Number=SeqID_34419
MADNTRMKELTGDVKRILKMMENRNKEYAARFETLETTLEMTLKDKTRDPGSISLAMNNHPFKSYYVQFTALANRVQGITQEALLDCFVGGLKPDIRRDVIAQSPT

SEQ ID NO: 126105 - protein, 149 aa, Glycine max
  Coding DNA Sequence Number=SeqID_34420
NAPRKLASKRSRKDKAVEGTSSAPEYDSHRFRSAEHQQCFEAIKGWSFLRERRVQLRDDEYTDFQEEIVRRRWASLVTPMAKFDPRRSPRVLCQCLAYRGGCARYAIWGEGSVDPFRCRCPQPVPGIPFSAGGRPGVRVWPEEEPGRWV

SEQ ID NO: 126106 - protein, 550 aa, Glycine max
  Coding DNA Sequence Number=SeqID_34421
  Gene Ontology: Mol. function=transcription regulator activity; Cellular component=nucleus; Biological process=regulation of transcription
  Homolog annotation: Hit_ID=A5BCG5; Match level="QueryCoverage=68%, HitCoverage=82%, E-value=8e-26, Identity=26%"; Hit description =Putative uncharacterized protein
  Pfam annotation: Domain name=Ank; Domain location=182-216; Score =17.3; E_value=0.058; Accession=PF00023.21; Description=Ankyrin repeat
  Pfam annotation: Domain name=Ank; Domain location=217-249; Score=8.7; E_value=1.8; Accession=PF00023.21; Description=Ankyrin repeat
  Pfam annotation: Domain name=Ank; Domain location=299-332; Score=3.2; E_value=11; Accession=PF00023.21; Description=Ankyrin repeat
  Pfam module annotation: Pfam domain module=Ank::Ank::Ank; Domain location=182-216::217-249::299-332
FKAICNHFIVKFEHNGNNFIEVEVVDEGVEHDDVIGEVVLEKLPEDVECKSDLVDVAKAIDEDGVWNEEEKTMVVEVLGQGLFNYLVVNLVLNENLLMVFGSGENMQNKLSNLEEHPNASNFSWNYVIFKQFLQSKYGDWVLGIAGSLKEDLTRHIWWDKWLESKSIIDKCPDMVRIPLNDRGDTALHVAVSQWSLETVKELVQRMSPEDMLIPNLDGMLPVHLAALYGRNIMVQILSSQKVLDKMDSKHIELLFLMTIRFNMFDMEDNKESKAGPLFRKLWTKVNQLEHNRIMDLITHPSPVLFDAIKSGNVEAVKMLIDKNPELVTIKDPKNGRNLLHLVVLFRQKRIFISMLWGLEEHIVRAVEVDNEGNNILHLAAHLPVEFQELSSLRASIQMQRELEWFKTCVPRELRRMRNNMGKRPIDVFYEEHKKLSEEIKDAAKGIAEYGMLVSTLVATVAFAAALTVPGDKTNAWFTVFILTNAVALFTSSASLLSFLSNFTSSRFAQSEFVKSLHPSLTFGRALLFISVFAMVVAFTAASFLMFDHKS

SEQ ID NO: 126107 - protein, 128 aa, Glycine max
  Coding DNA Sequence Number=SeqID_34422
MPSSFADLVFARERSEVGLKRGKFDYVSSTSANAKRIGTTGAKRKEGDAHAITSAPAWVKPPQTSHGTHQYAQHHPSFSAHAGNSSNSAPMQPKAPVQREAPQVPTPATTRSAGNPNATRNFPPRPIP

SEQ ID NO: 126108 - protein, 181 aa, Glycine max
  Coding DNA Sequence Number=SeqID_34423
MNSFQKKKWLRKSFSQRDLGGTPRLKGLVPAPEFDSHRFRSAEHQQRFEAIKGWSFHRERRVQLRDDEYTEFQEEIAHRHWTSMVTPMAKFDPDIVLEFYANAWPIEDGVRDMRSWVRGQWIPFDADALSQFLGDPLVLEEGQECEFSQRRNRADGFEEEAIAQLLCIPGQDFARIAAGRR

SEQ ID NO: 126109 - protein, 127 aa, Glycine max
  Coding DNA Sequence Number=SeqID_34424
MSKEESNKAHFASRLIQDCFNKQSLDSRFLQDQALPHNERFQVIQGSQLFKKNNCVIDYTNSVIDYQRGFSRNIANSHILSFGCVSIYNAFESDLLVIIYDHLNFSRASIVQFRASRYMTYLNRTSV

SEQ ID NO: 126110 - protein, 75 aa, Glycine max
  Coding DNA Sequence Number=SeqID_34425
MSRGSGDLGDVRWGAIAQKLDQSRPTPGIVGQLENEVRKTKGASGNRLPACVIDYTEGWVTGNQLPDRDGGTANP

SEQ ID NO: 126111 - protein, 106 aa, Glycine max
  Coding DNA Sequence Number=SeqID_34426
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=65%, E-value=2e-33, Identity=100%"; Hit description=LacZ protein
MSVEWDTWGIGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 126112 - protein, 198 aa, Glycine max
  Coding DNA Sequence Number=SeqID_34427
  Homolog annotation: Hit_ID=Q51617; Match level="QueryCoverage=17%, HitCoverage=50%, E-value=8e-11, Identity=91%"; Hit description =Putative uncharacterized protein
MTVKTSDTCSSRRRSQLVCKRMPGADKPVRARQRMRKEQIPHQAPFAIQAAQLLGRAIGAGLFAITPAGERGMCCKAIKLGNARVFPVTTFVPLLSSRAAHSSLVSGDIKEQVPTGRESCRASCINESANARGEAVCVLGALPLPRSLTRCARSFGCGERYQLTQRRSFAPSWAVCTNPPVQPDRCALSGNYRLESNP

SEQ ID NO: 126113 - protein, 135 aa, Glycine max
  Coding DNA Sequence Number=SeqID_34428
MPGADKPVRARQRGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSSFSRPYTVVGSMSKEA

SEQ ID NO: 126114 - protein, 163 aa, Glycine max
  Coding DNA Sequence Number=SeqID_34429
  Gene Ontology: Mol. function=phosphoprotein phosphatase activity
  Homolog annotation: Hit_ID=A5C1K9; Match level="QueryCoverage=33%, HitCoverage=4%, E-value=1e-14, Identity=65%"; Hit description =Putative uncharacterized protein
  Pfam annotation: Domain name=DUF1723; Domain location=26-65; Score =36.5; E_value=9.5e-08; Accession=PF08330.1; Description=Protein of unknown function (DUF1723)
MEMFNACNLNMFPNMFGMENQTGNYISDELPETHTFHLRCGEATITLQDVSVLLGLHTEGAPLIGQTNLDWAELCEELLGVRPQEGGVLFVDKSSSKVSLREMCSATDYKIKSLGRYVHLNPNVGMGTLHDLAPKRTPPVMENNHSDIGGYDVETNILAMMIS

SEQ ID NO: 126115 - protein, 138 aa, Glycine max
  Coding DNA Sequence Number=SeqID_34430
MARHKAQGGGGAWSSVRPGTHLVSTRQAKRERADERVCLVIWRGGTNQSDKGLNLQWIVAARATLATLQYPGAYLKSSCKRILPPRFDGNCASRRLVGLNPPHEGSPTARAFWGAEAPYCWSANGRRAHASLLARILT

SEQ ID NO: 126116 - protein, 157 aa, Glycine max
  Coding DNA Sequence Number=SeqID_34431
MVCVVPTWGSHPQRHPVDLKKSNRALGFPALVTGLCRPYRAPVPPASSCHHDIGKDRARKTPSGPEEGQQGLGVASSKYGSLSVQGSACCPQQGHQAPYQSSFHQEVLRPQAGAGRNTTAALGWPVAGNRHTATTSKVHLSSSIKRLERCLRHMADQ

SEQ ID NO: 126117 - protein, 228 aa, Glycine max
  Coding DNA Sequence Number=SeqID_34432
  Gene Ontology: Mol. function=siderophore-iron transmembrane transporter activity; Cellular component=cell outer membrane; Biological process=siderophore transport
  Homolog annotation: Hit_ID=A8GAI0; Match level="QueryCoverage=92%, HitCoverage=29%, E-value=1e-108, Identity=91%"; Hit description=TonB- dependent siderophore receptor precursor
  Pfam annotation: Domain name=TonB_dep_Rec; Domain location=5-228; Score=37.2; E_value=6.1e-08; Accession=PF00593.15; Description=TonB dependent receptor
MCRCTAAIPSRSSRTLSIATQIGSLPPEQGKSWEVGGKLALPNGVTGTLALFDITKRNVMVSELVEGETVTRTAGRVRSQGVELDVAGNLTDSLSLIGSYAYTDARVVDDPDNKGKEMTNVARHTASLFLTQNLGSPGLYSGDEVRIGAGARYVGRRPGDAANSFYLDNYTVADAFAAYTMPINGYRVKWQLNVKNLFDKTYYPSSGGNLRVAVGEPREVVLRGSVDF

SEQ ID NO: 126118 - protein, 146 aa, Glycine max
  Coding DNA Sequence Number=SeqID_34433
  Gene Ontology: Mol. function=aspartic-type endopeptidase activity; Biological process=RNA-dependent DNA replication
  Homolog annotation: Hit_ID=Q6WAY3; Match level="QueryCoverage=86%, HitCoverage=6%, E-value=3e-10, Identity=31%"; Hit description =Gag/pol polyprotein
FDDESPEGTNTWDPSINFEQEMNQTEDEGDEDVGLPSELERMVAHEDQEMGPHQEETELVDLGIGSGKREVKIGTGITAPIPPVASKSRVSPSKTEIEEDEARNVLEDKEEVKKQFDAGFLAVARYQNGWPTSYQFLKKMGKGECV

SEQ ID NO: 126119 - protein, 240 aa, Glycine max
  Coding DNA Sequence Number=SeqID_34434
MTLTYKNRRITRPFRLARFGDDADAGSRQARQGASAGVGGCRGWLNYAASEQIVLRVHHMRPRIPHRCVRRKYRIRRHSPFRLRNCWEGRSVRASSLLRQLAKGGCAARRLSWVTPGFSQSRRCPTPASAKLACLQVDSRGSPRASVGLTGRSFPPASSCRRGIGKDCARKTPSGPEEGQQGLGVASSKYGSLSVLGSACRPQQGHQAPLPIELSSRSTTPPGRRRAKHHISIGMAGSGQ

SEQ ID NO: 126120 - protein, 141 aa, Glycine max
  Coding DNA Sequence Number=SeqID_34435
MVLAEGESLPAYSKYCRMPTDIREIEVALCIPNRGFILNAEGHLAPILRKDLTTLAQVWSVLSYSNLAPTSHKSDLAVDRARLIFGLVTQLDMNVRALIFGQITSIAKSNSSRLGFPALITALCRTKGVASDNLIFERLSP

SEQ ID NO: 126121 - protein, 124 aa, Glycine max
  Coding DNA Sequence Number=SeqID_34436
  Subcellular localization annotation: CTP_CleavageSite=64; ConfidenceScore=5.31e-01
MFAHSIKGCRPLGRTYGVLIPSPWRKYNSRTFHLKVRRSRLFRFFRRFPQINVGGDSARIPFVEHASRESRVALPPKVNIYSFVAHIHQHYFAHTVSEKGPYTRVHGSIRSGGESVIMLGLRLA

SEQ ID NO: 126122 - protein, 92 aa, Glycine max
  Coding DNA Sequence Number=SeqID_34437
  Subcellular localization annotation: CTP_CleavageSite=23; ConfidenceScore=5.10e-01
MTTRPPLQRSSCPHLKRSKGPPLGRATRPRLHRATLPHLQRKDYTPSPLEDYAVLTFRGLRVLTFRGLHVLTFIGLHVHAFRGLHVVAFVIP

SEQ ID NO: 126123 - protein, 85 aa, Glycine max
  Coding DNA Sequence Number=SeqID_34438
MLRSILSQPILLRASKARLTGASSKGGKCAESPPTFICGKHRKNQRKPVMKNIPDSGVVFTFEEGRQKRGSCSYVPFIEEEIKPT

SEQ ID NO: 126124 - protein, 90 aa, Glycine max
  Coding DNA Sequence Number=SeqID_34439
MTLLLSNILPSDRNADLPLRKYQLGSRPQDTQWTRKSPTGPWGFQLWLRASISPTGCPYPPARSRHHRDRACKTPSGPEEVQQGLGVVKL

SEQ ID NO: 126125 - protein, 102 aa, Glycine max
  Coding DNA Sequence Number=SeqID_34440
MVRRFRPFSPHLPVFQQFLYSFLIIIPLLEFFGNVLYSGLETCLLTEQGSLIQTLTSWLLRYSHHGRWIRSTGPSFLATEGGLSMGEFHDASPSRSCRIHPF

SEQ ID NO: 126126 - protein, 171 aa, Glycine max
  Coding DNA Sequence Number=SeqID_34441
MFSLAGTVQLSQFCRSCISATFAKRLHMSLSDAWTRYTDNILGRNILPERKVEIYHYELDEFKAELERQNSHKRLTNLVDGSIDLALVKEFYANLYSSEDHPPKQSRVRGHLVKIDADSLNTFLETPVVLAEGETLPAYSRYCRLPTDYREIEAALCIPAKRVHLELRGAS

SEQ ID NO: 126127 - protein, 257 aa, Glycine max
  Coding DNA Sequence Number=SeqID_34442
KCLCIAGYGKVDPTVNESEQRECYWGVDGDPVLRGTRIRATWGYVSSVEELICTIAQSPPSTTYDGVVPGDMSQGSGDLGDVRRAPGSQPIKEQRPQSKEACVVAGQLWILSGIWNLASGFHVQKLCNSSLGTGNRLHTVIVMAAQLIHDRVEMECLEGEPTRMLQRTVEWILPTPTPYRLVELVQVIEVSSSEEDPEQDPEELPPEPVVDALDFPEDDEDPLPDLDSPEDVMSASEADSTKESGPGGTTNSGDSSS

SEQ ID NO: 126128 - protein, 87 aa, Glycine max
  Coding DNA Sequence Number=SeqID_34443
MIHQAQGDAPQATNAPPPPHQANPAGSLGMERYLQHLVRQQAVNHRGQVQIHECLYRFNLSQQRQDFAPFACPTPEQFGAEVAWPVD

SEQ ID NO: 126129 - protein, 109 aa, Glycine max
  Coding DNA Sequence Number=SeqID_34444
MKSLEIPLLLACSDEPARTLQRTVEWILPTPTPYRLVEPVQVIEVTSSEEDPEEDLEELPAVDALDFLEGDEDPLPEMDSPEDVMSASEADSTEDSGPGEMAISGGSSS

SEQ ID NO: 126130 - protein, 148 aa, Glycine max
  Coding DNA Sequence Number=SeqID_34445
MPGARQARQGASTGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLELVFQFNLCGGGRIDMDNIELGCKVIA

SEQ ID NO: 126131 - protein, 87 aa, Glycine max
  Coding DNA Sequence Number=SeqID_34446
  Homolog annotation: Hit_ID=A6FJQ2; Match level="QueryCoverage=43%, HitCoverage=84%, E-value=3e-11, Identity=92%"; Hit description=50S ribosomal protein L5
MPGADKARQGASAGVGGCRGWLNYAASEQIMRKEKIPHQAPFAIQAAQLLGRAIGAGLFAITPAGERGMCCKAIKLGNARVFPVTTL

SEQ ID NO: 126132 - protein, 205 aa, Glycine max
  Coding DNA Sequence Number=SeqID_34447
  Homolog annotation: Hit_ID=Q6WAY6; Match level="QueryCoverage=83%, HitCoverage=36%, E-value=1e-07, Identity=26%"; Hit description =Putative uncharacterized protein
MGTNQTGKRFYQVKVKSVDTTSIKELGRLMEPLQMQAFRKTYGKILELTIAEVSIEAIASLTQYYDRPLRIATVVKDSARGLDRIKQTRNGIAGLPQKYLEDKARGMANQGDWVPFMDVLALLIFGVVLFPNVDGLVDLAAIDAFLAYHHSKESPVVAVLADLFDTCGARGARRVAHGSSVAYPPSVFGWFHTCSNKTQDIHVRS

SEQ ID NO: 126133 - protein, 136 aa, Glycine max
  Coding DNA Sequence Number=SeqID_34448
  Gene Ontology: Mol. function=transcription factor activity; Biological process=regulation of transcription, DNA-dependent
  Homolog annotation: Hit_ID=Q79AD4; Match level="QueryCoverage=100%, HitCoverage=81%, E-value=2e-62, Identity=90%"; Hit description=HasI protein
  Pfam annotation: Domain name=Sigma70_r2; Domain location=9-76; Score =53.9; E_value=5.7e-13; Accession=PF04542.5; Description=Sigma-70 region 2
MSNSELQALFLRHMRPLQAYLNAKLRDPQLAADLAQESFTRLTEQYPQGNILDIEAYLYKTAKNLMLDHVRQQQRRQTEAVEDDILAQYPSGEPALEQLAIDSQLLQLLQQALADMPPRTQQIFRLNRLDGLTQAQ

SEQ ID NO: 126134 - protein, 172 aa, Glycine max
  Coding DNA Sequence Number=SeqID_34449
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPY

SEQ ID NO: 126135 - protein, 122 aa, Glycine max
  Coding DNA Sequence Number=SeqID_34450
MTLLLSNILPSDRIANLPLQKYQLVCVVPTWVRIAPTKTPSGPEKVKQGPGVSSSGYGPLSVLQGARTPPARSRHHSSTEYLSPPARASGPLLIELSSRSTAPPGRRRAKHHSSIGMAGSGQ

SEQ ID NO: 126136 - protein, 88 aa, Glycine max
  Coding DNA Sequence Number=SeqID_34451
VGVEEVTDAYAPVPVPTDEVSLVGQAIHTFLAWPTHLVKSLSQQAAVSSAKPPQKPDPKVDDPLNLMTLTIPELVYEALSGYMGCVIP

SEQ ID NO: 126137 - protein, 68 aa, Glycine max
  Coding DNA Sequence Number=SeqID_34452
MGEVKEIQEKMKADMEAMKEQMATMMEATLSMKKIREVDMVAATNAVAKVNPMPPSGLNQMNYPTSNM

SEQ ID NO: 126138 - protein, 74 aa, Glycine max
  Coding DNA Sequence Number=SeqID_34453
MMVGIFLKGQNSLEGRHTLDLKGGPTVRAQPEEGYRATTVHSGARFHPCHYKETSVDHAHQHDHSYTDLNDVAT

SEQ ID NO: 126139 - protein, 286 aa, Glycine max
  Coding DNA Sequence Number=SeqID_34454
  Gene Ontology: Mol. function=glycerol-3-phosphate dehydrogenase [NAD(P)+] activity
  Homolog annotation: Hit_ID=UPI000038DB83; Match level="QueryCoverage =87%, HitCoverage=63%, E-value=6e-30, Identity=31%"; Hit description =COG2848: Uncharacterized conserved protein
  Pfam annotation: Domain name=DUF711; Domain location=1-278; Score= -113.8; E_value=0.0008; Accession=PF05167.3; Description =Uncharacterized ACR (DUF711)
MVADEQGINIRASHDVARFMLQVAHRSNNGFDNFRLGASLRCPPNAPFFPFSRHEGETLKFSFALETTDIALELSEQVREGNMLLADFADQFILRLCARLREIDAFGHELASDSGLEYAGLDASLAPFPDGSISVGRLVENLGARPGGVQGSLFITSILTNAIKSAVAISGARATGFNGVMFSVLEDDALASTNNRRALSIDTLNAWSTVCGCGLDMLPVPGSTLPEDIAAIILDTAALAVRLTKPLGVRLLPIPGGEGKRYLISAPGSGSGLFAFSIRAQKKSPL

SEQ ID NO: 126140 - protein, 63 aa, Glycine max
  Coding DNA Sequence Number=SeqID_34455
MDEIAPKKLSAKRSRRDAAAEGTSAAPEFDSHRFRSTEHQQRFKAIKGWSFDRERRVQLSDQI

SEQ ID NO: 126141 - protein, 73 aa, Glycine max
  Coding DNA Sequence Number=SeqID_34456
MEARKKKKGSEAEKKKEQESGQDLFESKREKSLLKGIPRFKEVFAKYKARTGKRASNHWAIRVGVWSSRSQGS

SEQ ID NO: 126142 - protein, 125 aa, Glycine max
  Coding DNA Sequence Number=SeqID_34457
GGLFAGSRATNSFSEGHHFKNSVAPPTYLALLILLPVAAASGDKSCLTGATLPEGRKADRYPVSGRVGTGERTRELPGGNAWGAEPMENASNAAFLRFLAFCWPFAHMFFPALSPDSVDNRITAF

SEQ ID NO: 126143 - protein, 163 aa, Glycine max
  Coding DNA Sequence Number=SeqID_34458
MGPRTMYGEIWNKWLNPKGIEEQRGITFENSISFSMSTFNQYTMYIKYGPKYIMKHSQQNKLSNETKTPHTYSQNNSKAPKFLKDMNIMVFHLRLVVSFKTRKGKQGSKGLSKELIQGKSIWLEAYKNKIASIISKYACELGHINKNQAKAIVQAINGAKHTK

SEQ ID NO: 126144 - protein, 125 aa, Glycine max
  Coding DNA Sequence Number=SeqID_34459
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=Q6EM64; Match level="QueryCoverage=82%, HitCoverage=31%, E-value=8e-47, Identity=76%"; Hit description=NADH dehydrogenase subunit B
  Pfam annotation: Domain name=Oxidored_q1; Domain location=6-116; Score=-81.9; E_value=0.0021; Accession=PF00361.11; Description=NADH -Ubiquinoneplastoquinone (complex I)
MFLCGANDLITIFVALECFSLCSYLLAGYTKKDVRSNEATTKYLLMGGASSSILVHGFSWLYGSSGGEIELQEIVNGIGFKLSPAPSHQWTPDVYEGVRCYIVGSHPSETTSIIGASVNKRITLR

SEQ ID NO: 126145 - protein, 161 aa, Glycine max
  Coding DNA Sequence Number=SeqID_34460
DIYSSQDEATTSPSSSESEKAKGEESSEEIYPQEEGQPLVVKEKCKEALASIATPLGLEFIPQVKKLLDEGLVRKSLNPCALLVPKIGVPMNPKRIKVIPEWPTPPTPLIELVRNHVPSWEDAQEMGVEGRSPEYEEPRDLRSNPFQGGGNDAILSRKGIG

SEQ ID NO: 126146 - protein, 241 aa, Glycine max
  Coding DNA Sequence Number=SeqID_34461
  Gene Ontology: Mol. function=RNA-directed DNA polymerase activity; Biological process=regulation of transcription, DNA-dependent
  Homolog annotation: Hit_ID=A7QBE5; Match level="QueryCoverage=69%, HitCoverage=29%, E-value=9e-30, Identity=40%"; Hit description =Chromosome chr13 scaffold_74, whole genome shotgun sequence
  Pfam annotation: Domain name=zf-CCHC; Domain location=154-171; Score =30.0; E_value=8.9e-06; Accession=PF00098.14; Description=Zinc knuckle
WYRDTFLTRVYTREDSQQPFWKEKFLAGLPRSLGDKVRDKIRSQSANGDIPYESLSYGQLISYVQKVALKICQDDKIQRQLAKEKAQTKRDLGSFCEQFGLPACPKQKKKQSSKKEIHENKPINTKRFPRRRYSHKPSTNRGMENPKQKTKSKITCYNCGKQGHISKYCRLKKKLRNLNLEPAIEEQINNLLIETSEEETKTSSSVLSDENLNLIQHDDQLSSTDDDDGKINTLTREQISV

SEQ ID NO: 126147 - protein, 191 aa, Glycine max
  Coding DNA Sequence Number=SeqID_34462
MLSNPSRAQKKAKTSKRKQGECSQATFNRLDTWFTDGSKKNDYKMIYIVKNMKGTFYSELVKVFHTCARIDLEVHKFEETTDGYNKMQTYRGMLLDLTRNLRNLLGVGGLRTEDRMLVNLITYILTRRSSNHTQIVDYKFPYVVLASRFSNYFNVDVSNKIMDFTKASKPPAARNMEHMDEEAEAPQEPGN

SEQ ID NO: 126148 - protein, 45 aa, Glycine max
  Coding DNA Sequence Number=SeqID_34463
MDKSLKGREDEWRERERRGTKFCASNEPTNPRSSPTFSTKCAYVS

SEQ ID NO: 126149 - protein, 192 aa, Glycine max
  Coding DNA Sequence Number=SeqID_34464
EGEPPRQSDEVHEDHREYAQVDVDFYPPVPVEGPTPNILPQPNLPAQPIFLSTEGPPPAVEERRKVDLIEERLRAVEGFGDYPFADMADLCLVPDVVIPPIFKVPDFDKYKGEVGRLYALQLRGLGIRRGENRIGLKRGKFDYVSSISTNARRIGATGAKRKEGDTYSSLQRLHGSSHRRPLMVPISTRNIT

SEQ ID NO: 126150 - protein, 212 aa, Glycine max
  Coding DNA Sequence Number=SeqID_34465
MAKFDPDIVLEFYANAWPTEEGVRDMRSWVRGQWIPFDADAISQFLGYALVLEEGQECEYGQRRNRSDGFDEEAIAQLLCIPGQDFAWTAAGRRAQIMSTNMTTLTQIWMTLLLSNILPSDHNSDLPLPKCQLVYAILTRMSIHVAQLIVDAIYLFAGMAPTRHPMDPDKSNRALGFPALITGLYQSFGVPVAPTKVIQLPITRAFMRSVSA

SEQ ID NO: 126151 - protein, 60 aa, Glycine max
  Coding DNA Sequence Number=SeqID_34466
MPHPIAVDTAQVMTVNEEAVVSSVLSARLALSQIPLTRAKHAFEVLRGGGRGGGDIPIAL

SEQ ID NO: 126152 - protein, 41 aa, Glycine max
  Coding DNA Sequence Number=SeqID_34467
MTTMMETMMSMRQLMEVNMATVVAASTTTEVDPTHPSGLNQ

SEQ ID NO: 126153 - protein, 76 aa, Glycine max
  Coding DNA Sequence Number=SeqID_34468
RVNGCCRVSGLAKLCGIRADCTESAPYAAPFAIQAAQLLGRAIGAGLFAITPAGERGMCCKAIKLGNARVFPVTTL

SEQ ID NO: 126154 - protein, 267 aa, Glycine max
  Coding DNA Sequence Number=SeqID_34469
  Gene Ontology: Mol. function=transcription regulator activity; Cellular component=intracellular; Biological process=regulation of transcription termination
  Homolog annotation: Hit_ID=A9ITY0; Match level="QueryCoverage=92%, HitCoverage=50%, E-value=1e-128, Identity=95%"; Hit description=N utilization substance protein A
MQPLATPACVPRSPWWHTSKRIDPIGTCVGMRGSRVTAVRNELGGEQVDIVLWSEDPAQFVIGALAPANVESIVVDEDKHAMDVVVDDENLPKAIGAKGQNVRLASELTGWQINIMTPEESLNRQEVERSGLRATFMNKLDVDEEVADILIDEGFTGIEEIAYVPMQELLEIEAFDEDTINELRARARNALLTEAIAQEERLETAQDLLELEGVTPELAAKLAERQVHTRDDLAELATDELAEIAGLTEQEASDLIMRARAHWFDEE

SEQ ID NO: 126155 - protein, 22 aa, Glycine max
  Coding DNA Sequence Number=SeqID_34470
MDIVSLAWAALMVVLGFPRRRV

SEQ ID NO: 126156 - protein, 187 aa, Glycine max
  Coding DNA Sequence Number=SeqID_34471
MDNEEGMQEQMKADLSALKDQMASITEAMLKLQKTLEDNATTTASNAVREAEPVLQPTINLGRDRNLTVFGQRYSPQAYPYGLSLDFTPRAAPEDVSQAPTFEGQLPPYADYPLQEDEEGDTHLGPLLPLKDPSPHELPQPNIVGHVPSSPAPVKESVPFTEDKGNIDALEERLRVIEASAITRSRI

SEQ ID NO: 126157 - protein, 68 aa, Glycine max
  Coding DNA Sequence Number=SeqID_34472
MKNGEESLRNRSRKCLRSITEGPRGKKGGGCRQACPGELLLPPEGTAFCWNTPEGPSGPSFYFHTLFY

SEQ ID NO: 126158 - protein, 147 aa, Glycine max
  Coding DNA Sequence Number=SeqID_34473
  Pfam annotation: Domain name=Transposase_23; Domain location=68-132; Score=-8.8; E_value=0.011; Accession=PF03017.5; Description =TNP1ENSPM transposase
MTGQIREELRTQIKEELRTQLEEENRRSLEIMTNALKEAIKKELEVMLLPMRRLHKNIDADAIPLMGLFVQRNDGTQRLVAMGKIMEGDSIIHTVAYADDVVRVSVETVIDPEAEVPYATSEIQYVKQAVNTFVAWPTHLVKAVLDE

SEQ ID NO: 126159 - protein, 82 aa, Glycine max
  Coding DNA Sequence Number=SeqID_34474
MAAQLIHDRVEMECLGGSLGDPRRQHEVPISGHHSIHGYFFEGDEDPLLEVDSPEEVMSASEADSTEDSGPREMAISGGSSS

SEQ ID NO: 126160 - protein, 138 aa, Glycine max
  Coding DNA Sequence Number=SeqID_34475
MPPTRHPLDPDKSNKALGFPALITGLCQSFGVPVTPSKAADASPPPHQADPAGSFGMERYLQHLVHQQATNHRGQSQGYTPFACPTPDQFKAEVAWPGDWPEAQAGEAPAEAPSDAEEARMDKEMTDLLGFLGGSGAT

SEQ ID NO: 126161 - protein, 155 aa, Glycine max
  Coding DNA Sequence Number=SeqID_34476
MAHGCLVSCWNRCETNQTQRADLPRQLPPDFPCYGGRQGKRRLLLGLSNHPRLERGRPQKLAKLTHPYGTQSPRLAIPLALSSRYFCGRPAMPFRVCFMRSKPLAESLTTVAILLKEGRHPEGRYGFLPPRGHPRISSNSSMVGTNWKSANVKHL

SEQ ID NO: 126162 - protein, 142 aa, Glycine max
  Coding DNA Sequence Number=SeqID_34477
  Subcellular localization annotation: CTP_CleavageSite=62; ConfidenceScore=5.81e-01
MATPPGSSPPPPSPSSSPPPTPPADPSTSPSTIKRTCKATWLRSLATRPPGAERPVVHVDPVTSKADDPQKKKLRTYLGGYTEFEILEASNNRTKKKVLQTVGERWRQFKSDLTRKWAPAAHKDDVDDTICEKYNISKEKWA

SEQ ID NO: 126163 - protein, 373 aa, Glycine max
  Coding DNA Sequence Number=SeqID_34478
  Gene Ontology: Mol. function=hydrolase activity; Cellular component =cytosol; Biological process=metabolic process
  Homolog annotation: Hit_ID=A6TGG6; Match level="QueryCoverage=80%, HitCoverage=90%, E-value=1e-111, Identity=68%"; Hit description =Putative amidohydrolase 2
  Pfam annotation: Domain name=Amidohydro_2; Domain location=20-305; Score=110.1; E_value=6.6e-30; Accession=PF04909.5; Description =Amidohydrolase
EALRNGRNYMDNVEKRLLETELRLKDMDACGIRHAILSLTSPGAQSILDVAAATHFVTCTNDYIAEYFVQPHPDRFSAFATVALQNPQAAADELERAVKKLGMKGALINGYTNMSGTEEGRYLDDPAVEVFWQKVSELNVPVYLHPREPLPAACGIYRGYESLVGSAWGFATETAVHAIRLMMSGLFDRYPNITIILGHLGEGLTFMLPRTAHRLEKQFEGIGLGGNQQPLTDYLTNNFYVTTSGHFTTSALHNAIEVMGKDRVMFSVDYPYEDMCQAADWFDPLVLDADVKQSIAYGNTWKCGRTPGGNLSGNRGQQLSTGYNVPYAQEAREQHFGSQLNTAACQAGNQSNLAYISHCDSKASLTGAGIERQ

SEQ ID NO: 126164 - protein, 93 aa, Glycine max
  Coding DNA Sequence Number=SeqID_34479
  Homolog annotation: Hit_ID=A5BSW9; Match level="QueryCoverage=47%, HitCoverage=3%, E-value=4e-07, Identity=56%"; Hit description =Putative uncharacterized protein
SAKRNTPGLSARKTLEEDELYRFAKRTASVYPLSEKGTLSQKSLTCAKRFIRALSPSSRDFVKDFTTLATPLNEVLKKNVGFKWGEKQEEAFN

SEQ ID NO: 126165 - protein, 132 aa, Glycine max
  Coding DNA Sequence Number=SeqID_34480
MTSQRINSGRYTIFNSKLIEHILHDTDDELDITQGDIVTNYSFDDIATEDFAHTDYDDNLEAPYDNENTGFYIHCANYVELSFITFDNVQVTKILEILFGNASNVKRRCGMMRGLTKINRLKIQSFHYVVVM

SEQ ID NO: 126166 - protein, 133 aa, Glycine max
  Coding DNA Sequence Number=SeqID_34481
MTLKITDQSRLVMRMDMNIGALISGQISLIAQSNSSRLGFPALITALCKAKGVISYSLSYESLSPTINLAYIMKNCWNLDETSVYFPRTRKARARAAEIPSSSTPQDLLVPTSAPPPAPAHPGPSIDLIMAML

SEQ ID NO: 126167 - protein, 139 aa, Glycine max
  Coding DNA Sequence Number=SeqID_34482
  Homolog annotation: Hit_ID=Q5XM22; Match level="QueryCoverage=61%, HitCoverage=48%, E-value=2e-22, Identity=60%"; Hit description =Resistance-like protein HAAS-2
MPIIGAFHSFEPLLVDEAVVLLMELLEVLGEEARVEIVWAHGAYVCLSWLRDIYLRRREAGRWIVAARAYLFHLVGCTLFANKSATHVHVMHQEAIQDLGESGSYAWGAAALVHIAGYMSTFLVLMIASLTMRTMRHPQ

SEQ ID NO: 126168 - protein, 137 aa, Glycine max
  Coding DNA Sequence Number=SeqID_34483
  Subcellular localization annotation: CTP_CleavageSite=80; ConfidenceScore=5.10e-01
MSGIRGDILDVTTPLGAAVPPCLSIDTQLSRPITNATGVGAILPNRDSTPPTSSAPLYRLNHSKSLVGGTGEPRELGTLSLGEGKKGPKHGRCRTLEWQRKGRSYLFFQACSDIWFPRKIKLVSRVMGNLPARFGEH

SEQ ID NO: 126169 - protein, 107 aa, Glycine max
  Coding DNA Sequence Number=SeqID_34484
  Subcellular localization annotation: CTP_CleavageSite=27; ConfidenceScore=5.48e-01
MAEPSKKRKGTSSRSQRHSRSQKMPIPSSTPSGSLFSSEEQRIRYTNIFSSRSIIDPKFIDMDFFSSESFECFQAFENSNRIPFMSLKLPVYSDLAKAFYSNLEINE

SEQ ID NO: 126170 - protein, 70 aa, Glycine max
  Coding DNA Sequence Number=SeqID_34485
AKEEKVKVADDSLSEAVWLSETHLLSEASSSLNGWETLEEDKSEICVPSAQPARPARTLYILTLSTPKLT

SEQ ID NO: 126171 - protein, 73 aa, Glycine max
  Coding DNA Sequence Number=SeqID_34486
THLLLEVASPLSLPFSIPLPFIFQEAKESIDEEDPRPTSSNGACISISACPLTSRDAEDDVSLCMLLGVESYR

SEQ ID NO: 126172 - protein, 136 aa, Glycine max
  Coding DNA Sequence Number=SeqID_34487
  Gene Ontology: Mol. function=transcription factor activity; Biological process=regulation of transcription, DNA-dependent
  Homolog annotation: Hit_ID=A1FWJ2; Match level="QueryCoverage=100%, HitCoverage=46%, E-value=2e-68, Identity=97%"; Hit description=RNA polymerase sigma factor
  Pfam annotation: Domain name=Sigma70_r4; Domain location=80-132; Score=59.7; E_value=1e-14; Accession=PF04545.7; Description=Sigma-70, region 4
MNAAEVSAVAKDLNVSEREVMEMESRLSGRDIGFDAPTDEDNEHAPPSPAAFLVADDEDPSMAYEREDSEDNQMQLLREGLAELDARSRDIIRRRWLDADSKVTLQELADEYGVSAERIRQVEANALKKMKALFTA

SEQ ID NO: 126173 - protein, 83 aa, Glycine max
  Coding DNA Sequence Number=SeqID_34488
MSGFTRDSPQISASPHQLDLAPYVSEPYNAKWNTPGLLRDKHTLRSSRILGEMEVDEPWLGLSRCKIHFLVGVLVYAKGGVFH

SEQ ID NO: 126174 - protein, 37 aa, Glycine max
  Coding DNA Sequence Number=SeqID_34489
MSVYMEDRNSGKARKRLKWENRRLHLSWTHSERRCLK

SEQ ID NO: 126175 - protein, 84 aa, Glycine max
  Coding DNA Sequence Number=SeqID_34490
  Homolog annotation: Hit_ID=A6FJQ2; Match level="QueryCoverage=45%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARLVTWTRLMLEITSFFFEKGVRKKVHKTYTFFFAT

SEQ ID NO: 126176 - protein, 102 aa, Glycine max
  Coding DNA Sequence Number=SeqID_34491
DAGSRQARQGASAGVGGCRGWLNYAASEQIVLRVHHMRAIGAGLFAITPAGERGMCCKAIKLGNARVFPVDSRGSPWHVFRKVPVDMRGAIEEAIIGVNLLR

SEQ ID NO: 126177 - protein, 106 aa, Glycine max
  Coding DNA Sequence Number=SeqID_34492
MGETHEIPHHNLADFEPWLGYATEGQAVGGIPLQNPLEGPQYHPQLHLLHSTTSKNPHAMAEMGKLDYLEERLRAIEGGEDYAFANLEKLFLIPKHGRSQVQGAGL

SEQ ID NO: 126178 - protein, 41 aa, Glycine max
  Coding DNA Sequence Number=SeqID_34493
MGLPKKVENGELHYSNLYASLHNSKMGGHMNENAIHGAPKK

SEQ ID NO: 126179 - protein, 196 aa, Glycine max
  Coding DNA Sequence Number=SeqID_34494
  Homolog annotation: Hit_ID=Q6WAY6; Match level="QueryCoverage=96%, HitCoverage=30%, E-value=2e-14, Identity=33%"; Hit description =Putative uncharacterized protein
MGQLQRQAFRKAYGKIWELARVEVSMEPIASLSQYMTSPQGLVDLAVIETFLAFHHGKESPVVAILAMYDTFDRGCEKSGARIVCCALALYVWLVSHLFLQEGRPVYLLQGHRSCVEKGKANWDQLLASKEGASVNWFPRWKEGRTGVLISCRGFPNVPLMGTRGCINYNLVLAIRQLGYPMRGAPLEDELAPVIS

SEQ ID NO: 126180 - protein, 129 aa, Glycine max
  Coding DNA Sequence Number=SeqID_34495
  Subcellular localization annotation: CTP_CleavageSite=11; ConfidenceScore=5.31e-01
SFPGTRKARARGSEGPSSATPQTSTAPSPIPSAPVLATSGEAFAAQEPQPDLETTPTAQEDDSEATPLESFAPETDPKADPVIAEASPQASPISTPVLELSTPQGSPVGTPVLHLTGDEAMDQDPPQDQ

SEQ ID NO: 126181 - protein, 237 aa, Glycine max
  Coding DNA Sequence Number=SeqID_34496
SEQESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPVVDLGIAFVDNWAVGKEKLGVILRAFRSVSRGIPPTACPSVAYRAKARSRLDCDGEFHVSPPRFRDMCMISSGLLALNGYRSGVIDILIGSVRHIGWRIVERQAIWREGVLVLNLHIMGAARTSQIFAYHI

SEQ ID NO: 126182 - protein, 40 aa, Glycine max
  Coding DNA Sequence Number=SeqID_34497
GWPLWITGCRNLPFGGRATRDSRDACSTKGIRAESPPTFI

SEQ ID NO: 126183 - protein, 136 aa, Glycine max
  Coding DNA Sequence Number=SeqID_34498
  Pfam annotation: Domain name=Transposase_23; Domain location=51-121; Score=1.1; E_value=0.0009; Accession=PF03017.5; Description =TNP1ENSPM transposase
  Subcellular localization annotation: CTP_CleavageSite=34; ConfidenceScore=5.23e-01
MASFSQMQSQIQSQMQSQGLALPTEPLVGPSGPRVNTKRSCVDPLGNDPKTSDSDRCGLYIKADPARLVALGRVYKGSTAVHNTPLLPGQVKVGMEKVTDADAPVPIPTDEVSLVGQAFHTFLARPTHLVKSLSQQ

SEQ ID NO: 126184 - protein, 122 aa, Glycine max
  Coding DNA Sequence Number=SeqID_34499
EKKDKLATQLAQASQNFTDCATMLPFDFRHVTELHRLCNNNITDCLTMGAKDLEAVKQKLHAVATYPFAGERGKVHGCVFQRRTMRRVATNEGISTSHVLKSGALAPTYPPSKRKSDLRSSF

SEQ ID NO: 126185 - protein, 196 aa, Glycine max
  Coding DNA Sequence Number=SeqID_34500
  Homolog annotation: Hit_ID=A7UQU7; Match level="QueryCoverage=48%, HitCoverage=17%, E-value=1e-10, Identity=40%"; Hit description=IMP dehydrogenase/GMP reductase, putative
MARTRGLSRAIGRLVGRGRHDDHDAADVPERRRPTASARGQRVHQMTADARDMAEDVADMIDDVPDLAAKAPEMRADVQGVDCAEGSDADDAAEGFPGGPRDPSVLASFADHVAHAVWSGQERPDLKLVSHGRKVTLIGRPVPEIEGLVAATGLSLLIDCLVITSDPGLISAFVERWHGETSTFHLPVGRVDDHIG

SEQ ID NO: 126186 - protein, 144 aa, Glycine max
  Coding DNA Sequence Number=SeqID_34501
MEEGSSVESHRRSALLFSLKPLFSRTFSLLLLLCRWSPPPRHCQGPWRLAPPQVHGPRPLGFCTNSIEVVLPSLAAGSLAEDKKSNALLKRAELKITMSERRVDSVLADLTESVKAESAKREGMVHVGGVLRRKQNGGRSKEGL

SEQ ID NO: 126187 - protein, 79 aa, Glycine max
  Coding DNA Sequence Number=SeqID_34502
SEVGQVHWRMRKMLLVEVLDTAFLTLMIRPSKVGMIPLSGIVPVAGEHKLQAVQLLQIVAQKGKGDGSLLVELLWRLDL

SEQ ID NO: 126188 - protein, 108 aa, Glycine max
  Coding DNA Sequence Number=SeqID_34503
MQSQGLALPSEPLVGPSSPRVGVEEVKDPDAPIPVPTNEVSLVGLAIHTFLAWPTYVLVVTRQLMASSPPPWKGFDLKSRGSSYSGLLPLTPVKRIKTYVLVVLGMLE

SEQ ID NO: 126189 - protein, 166 aa, Glycine max
  Coding DNA Sequence Number=SeqID_34504
  Homolog annotation: Hit_ID=A5APQ3; Match level="QueryCoverage=49%, HitCoverage=5%, E-value=1e-07, Identity=32%"; Hit description =Putative uncharacterized protein
MRQFGMQQPIPGPVMQPNNIHDLTLKGKEGKNWMRLMQPALNEWNSRYERRVEQTPPQTGTLSLNSEYMRWYRRKTKVYVDPKHARRGLLGEIAKTLHFMVSPVGRRVCTFDDLLPCIEKITLLSEEEDRILEAHEDAPPSQPQFEHQQFNILRQSVETRGLARHR

SEQ ID NO: 126190 - protein, 89 aa, Glycine max
  Coding DNA Sequence Number=SeqID_34505
MGIAPTKTPSEPEEVQQGPGVSSSGYGPLSVLQGARTPPARSRHHRVPVTSSKGIRPPTDRAFIKKYCVPRQAQGETPQQHCGMAGSGQ

SEQ ID NO: 126191 - protein, 257 aa, Glycine max
  Coding DNA Sequence Number=SeqID_34506
  Gene Ontology: Mol. function=motor activity; Cellular component=cell projection
  Homolog annotation: Hit_ID=UPI00006A2D9E; Match level="QueryCoverage =90%, HitCoverage=100%, E-value=1e-15, Identity=16%"; Hit description= UPI00006A2D9E related cluster
GLLALTFRGLHILAFRGRHPLSFRGLHVLVFRGLHAHAFRVLHVLAFRGLHVLTFRRLHVVAFRGIHALVFRGLHILAFRGLDALAFRGLHVLRFRGLHVLTFRGLHVLTFKGLHVLAFRGLHALPFSGLHALSFIRPHVLPFRGLHVLTIRGLHILTFRALHRVARPHLLRATCPHLQKAARPHLQEATCPPLKSTTRLHVVAPRGLHVLPFRGLHVIAFRVLHALALRGLHVLPFRGLHVLPFRGLHILTFRGLH

SEQ ID NO: 126192 - protein, 44 aa, Glycine max
  Coding DNA Sequence Number=SeqID_34507
MANRMQETWTHHLQSSFLSGSSKLCFILRSGRRRQPLPDGENIQ

SEQ ID NO: 126193 - protein, 86 aa, Glycine max
  Coding DNA Sequence Number=SeqID_34508
LHALAFRGLHVLAFIGLHALAFRGLHALAFRGLHVLTFRGLHTLTFRGLHVLAFRGLHVLAFRGLHVLAFRGLHICAFRELKVLCP

SEQ ID NO: 126194 - protein, 143 aa, Glycine max
  Coding DNA Sequence Number=SeqID_34509
  Subcellular localization annotation: CTP_CleavageSite=63; ConfidenceScore=5.04e-01
MTMQNMQFQQETRASIQSLTNQMRQLVTQLNQQQSQNSDKLPSQDVQNPKNKQHIPPLPFPPRAVSNKKMEEAEKEILETFRKVEELCTNKRKLKGSERISMGRNVSALIGKFVPQIPEKCKDPGPLQSTDVMDFLKDQFPSF

SEQ ID NO: 126195 - protein, 88 aa, Glycine max
  Coding DNA Sequence Number=SeqID_34510
  Homolog annotation: Hit_ID=A6FJQ2; Match level="QueryCoverage=43%, HitCoverage=84%, E-value=3e-11, Identity=92%"; Hit description=50S ribosomal protein L5
RITRPFRLARFGDDGEKPLTHAAPGDGHSLSMRKEKIPHQAPFAIQAAQLLGRAIGAGLFAITPAGERGMCCKAIKLGNARVFPVTTL

SEQ ID NO: 126196 - protein, 338 aa, Glycine max
  Coding DNA Sequence Number=SeqID_34511
  Gene Ontology: Mol. function=transporter activity; Cellular component= outer membrane-bounded periplasmic space; Biological process=sulfur metabolic process
  Homolog annotation: Hit_ID=A8AID6; Match level="QueryCoverage=70%, HitCoverage=73%, E-value=1e-117, Identity=88%"; Hit description =Putative uncharacterized protein
  Pfam annotation: Domain name=NMT1; Domain location=2-179; Score= -50.8; E_value=0.00019; Accession=PF09084.2; Description=NMT1THI5 like
MLEALNVGSIDLGSTGDIPPIFAQAAGADLVYVGVEPPKPKAEVILVPEKSDIKSVADLKGHKVAFQKGSSSHNLLLRALQEAGLKFTDIQPVYLTPADARAAFQQGNVDAWAIWDPYYSAALLQGGVRVLKDGTTLKQTGSFYLAAKPYAEKNGAFIQNVLDTFTQADALTQSQRQESIALLAKTMGLPEPVIASYLNHRPPTTISPVDAHVAALQQQTADLFYQNHLVPKQVDIREQEGSRPVDHGYLQQIAQAADRIGFTGVLIPTGRSCEDAWLVAASMIPVTQRLKFLVALRPSVVSPTVAARQAATLDRLSNGRALFNLVTGSDPQELAGDG

SEQ ID NO: 126197 - protein, 119 aa, Glycine max
  Coding DNA Sequence Number=SeqID_34512
MLPATILAATPAATPEPTLLPLSLGLVMQGNYLGQVIGPVALSAIVAAAGWAAPAWLVLAAAVSGALLALAFLSRRHKAGCLPIAKDKANDDRDPTMTRRRWPRNTPAGRQRRSVASSR

SEQ ID NO: 126198 - protein, 54 aa, Glycine max
  Coding DNA Sequence Number=SeqID_34513
MQSQGLALSPEPEVMWDVIVFRLFNNNFPLYIKHEDLSEIAHGGQCLSISVIQL

SEQ ID NO: 126199 - protein, 165 aa, Glycine max
  Coding DNA Sequence Number=SeqID_34514
MGEVEEVPEKMKADMEAMKEQMATMMEAKMIMKKIMEASAAVVVATRTVVKYGRPHDVQIQNEHAFPPHGLPPNYTPPNVAYTPNEDVNKCSLRADNLIIYMSLNPWGRHMKFPTTIKPTSGLASDMPLKGKQLLVYPYKTLWRALSIIPNYASCIPQQVKTLML

SEQ ID NO: 126200 - protein, 75 aa, Glycine max
  Coding DNA Sequence Number=SeqID_34515
MGSKIYPKVHENPKAFFINSSPILLEPLAHGSGIVPTRRPMDSEEPKMFLGFPALVTGLCQSYRVLVSPSKVTPS

SEQ ID NO: 126201 - protein, 165 aa, Glycine max
  Coding DNA Sequence Number=SeqID_34516
  Homolog annotation: Hit_ID=A5AK77; Match level="QueryCoverage=56%, HitCoverage=11%, E-value=2e-10, Identity=38%"; Hit description =Putative uncharacterized protein
MTRGNPGDLQPFDPEIDRTFHRLVRHSMHPGHSVHFEHSEHPVEGDFEYSDFEHSTTNFYTENMAQPPPRERTLREMATPDFTYESLCIQYLDESVPYVLKTGLIHLLPKFHGLAGEDPHKHLKEFHIVCSTMKPPDVQEDHIFLKAFPHSLEGVAKDWMYYLAP

SEQ ID NO: 126202 - protein, 258 aa, Glycine max
  Coding DNA Sequence Number=SeqID_34517
MTLKVGLKSSSRGNECYWWCGYGILESQELMFPDIIEYGVAMVALLGVIEYVAATCKMASPFRQALAGTYTGMLAYRSASELLGCWWGYASLAHVIFAEFLKDLFQVRHMLDYALRLDDHVAHIYLDVSSDLLFKDSVHQSLVSRKLSTWNPDAPSTSLSMLGRGAHSLFSIGLFDHDDIGKPNGIPDFSDEHVGDVPMLMAGKVPTKPCALSEFRFELQLDKLFDGFQASVRGSLVGGYDATSGSLHSVVVLAFGQP

SEQ ID NO: 126203 - protein, 82 aa, Glycine max
  Coding DNA Sequence Number=SeqID_34518
MHPMSGGLTLLVFEAFNFLNQLQCAHEDRAGVRFEGTTPQRTNLLSLTKMMIFQAGVHHMSPCHKMRRILTFFQDAPLMGRF

SEQ ID NO: 126204 - protein, 111 aa, Glycine max
  Coding DNA Sequence Number=SeqID_34519
MENNSGLWWLMVAVGDGERAWNLGNGFGRKKGEEMAFFLSYTKAKAETLKHLLKDPNSHIVDKCLVKLQTKIRKAPTVKEGWAAFLPRQLHVDSLRSFIKRLPQEASSWLL

SEQ ID NO: 126205 - protein, 105 aa, Glycine max
  Coding DNA Sequence Number=SeqID_34520
MEAMKEQMTTMMEAMMSMRKMMEDNTAIVIAASTATEMDPIHPAGFNKVNHPVSDVVGQEGEVVKNAYGPHHVQVQSKHFFPPYGLPPNYTPPTVICWIKWPQNN

SEQ ID NO: 126206 - protein, 42 aa, Glycine max
  Coding DNA Sequence Number=SeqID_34521
GKLAQASQLLRLKGISLPRRAGYLRLKLSHGPGELDAGLGKF

SEQ ID NO: 126207 - protein, 193 aa, Glycine max
  Coding DNA Sequence Number=SeqID_34522
  Homolog annotation: Hit_ID=A7R978; Match level="QueryCoverage=83%, HitCoverage=85%, E-value=6e-13, Identity=28%"; Hit description =Chromosome undetermined scaffold_3458, whole genome shotgun sequence
MKVHPLTSMHQCNSCLPTLQMEWFELCHELLGVMPDDAAVDGNSLLLSWLASHFANIHDFTGNQEGFERFARAWILRFIGGIMFVDKSSKRTLESAAVMHSAKSIGDFSLLIQLWAWKRCPTLAPSVIPPQQQNAPLTYRWLGGELHHIGNDNLLEFRHKLDVMKRDEFVWVPYSGHVEMNLSHVCFFGCGIL

SEQ ID NO: 126208 - protein, 149 aa, Glycine max
  Coding DNA Sequence Number=SeqID_34523
MLVCLTGYRRALWFKTNLCRSKEFDFDVLMMPYDRDDLMPYENVLLKFNSRQKFKNTRYNIRKISSVLGREFQIETTKGLAKKFKQKCLFQEIYSLGLRDRGSLVVKKSEHKGRVVLVWFRTCKGILQESGTLKRVAWGLDIGTRVWPN

SEQ ID NO: 126209 - protein, 202 aa, Glycine max
  Coding DNA Sequence Number=SeqID_34524
MSRLAEVADQLELHNSLSMHLYEQNVHSRNILPKRNVDVYVTQYDEFRKELERRRWHKALTRQPDNHRDKSPQQCRVRGKLIKFDAETLNTLETPMVLEPGERYSTYSRKNLTTLAQTWSVLSYSNLAPTSHTSDLNMDWAQISGVITVNPDDPMITFPGTRKDQARGPSDGSTSAPASTSAPTPAPAPVPPAITAPIGPYS

SEQ ID NO: 126210 - protein, 81 aa, Glycine max
  Coding DNA Sequence Number=SeqID_34525
IQRTNRLRILCGTSRGYIYLGCYTENKRGYISCGSVQVEGTSTWLFKENKGGYIPCGSLARKGFYKVERNLKNRWLLGDWM

SEQ ID NO: 126211 - protein, 438 aa, Glycine max
  Coding DNA Sequence Number=SeqID_34526
  Gene Ontology: Mol. function=binding
  Homolog annotation: Hit_ID=A7P540; Match level="QueryCoverage=52%, HitCoverage=13%, E-value=3e-44, Identity=41%"; Hit description =Chromosome chr4 scaffold_6, whole genome shotgun sequence
MEKDTSLLMEKGSVDTFAIIGCSIFSCATTLLTRCSSNTLQWPSGRVPELLPNKLKLNAKDKDDIGVLPSSGKRLNAGDLGFYSPTCPILSVNPHVCAKPKQSLGDPSNVTSRLGKSVDAYSLTCITFLGDSSFIAVGSDHADLYLTNYTSLKNCEEPCCEECHNYPMTLIQSFITGDSQLLLSSSSQDITLWDASSILSDYVWDECEKEIHLFHGCKATRFSHSGNFFAALSQESAQQGILLYDIQTCQLESNFSDTSTTFAGQAHLYSPIHFSHSDSMLLWNGVLRDRRVSGPIHRFDQFTDFGGGGFHPAGNELCYGERLVMGSNLETISWHMQVDMARKPVPVGDTRYPTGTRQVREWDNKLKPVGYRVRVWGYVEKSGEPLSTGGIRGVNFYEMTVFALLVKESSSPVPYLIASPSSMTFSTIREWNWFWQTD

SEQ ID NO: 126212 - protein, 298 aa, Glycine max
  Coding DNA Sequence Number=SeqID_34527
  Homolog annotation: Hit_ID=A5C169; Match level="QueryCoverage=81%, HitCoverage=22%, E-value=1e-08, Identity=23%"; Hit description =Putative uncharacterized protein
MDLFSNESFECIQAFQNSNLIPFMSLKLPVYSELVKAFYSNLETQESTLISEVFGIKMVIDQSLFYDLTQLSSEGVPFEGTLNDDWKFDFSVHDARQLVCTNQADMTGRLLAGSLAFESHILHYLIVRILLPRSSNLAQAFHTGQQIDWAHLVRYCMHKALRLNAHLPYPHLVTLFLQHFNIRLDFESYVPIKRSFLIGAAVIASFGYRKEHDGSWVKKGAQPHDDEGHLPVEEDSSLLQSILDRFDGLQTYVSERFDALELQVDMRFDEMDSRITKVEGDVTYIRTFFDLPPPPPSF

SEQ ID NO: 126213 - protein, 230 aa, Glycine max
  Coding DNA Sequence Number=SeqID_34528
MTTMIMIMILSSTTTIEISGGRSGTSDGDDDVGGGDGDRGSISRDDNDCDKDTMVVVVVMSVASMVTMMVVLVVTPSDGGDIGGGRSDNDNGSDSGEVFVVENDDSEARHTWDIRVCCVGEENQIIQLVIKMEGVGGKVKTRAIREIFATKDLARKVEERKKFSNTNGGGRDIREFNGFIFYMELEDIPIVQRMYTWFKPNSHVKSKLGRVFVSKEWVTHLARELSSCLE

SEQ ID NO: 126214 - protein, 89 aa, Glycine max
  Coding DNA Sequence Number=SeqID_34529
MDLDKVKAILEMHEPHTEKQVSVHVAQLISVPITPTKLIRPPINRAFIEKYCMPRQAQQQGQAQQQPAADASPPPLRQPPSLESIFAHL

SEQ ID NO: 126215 - protein, 112 aa, Glycine max
  Coding DNA Sequence Number=SeqID_34530
  Gene Ontology: Mol. function=selenium binding; Biological process =cell redox homeostasis
  Homolog annotation: Hit_ID=A7P4Z5; Match level="QueryCoverage=96%, HitCoverage=50%, E-value=1e-22, Identity=55%"; Hit description =Chromosome chr4 scaffold_6, whole genome shotgun sequence
KQCNSFKTRANQVKKGLEKADIGITVILNPEKRSLRTLMLRLQLWLQTIFENLILKLKGPNNPRKGCFEIRQEGSGKKFITLLDMKRPFKRMKDLDMDNVVSDIIDEISKAS

SEQ ID NO: 126216 - protein, 257 aa, Glycine max
  Coding DNA Sequence Number=SeqID_34531
MAVKRPSRDWQHKPKKAHWVNHGFPKPNWWKNKQIGTLNMWVQVYNQINCRTGTGTGANSNSNSNSNGNGVDEDKRPERFRSINVWGEKGFSGFELMNDTTSRRCIGDMLGISMRIRQVQLNDLINYPNKNGYNASMRGNETYFKTAQLFAKRGRQTRAMMNSGTQYSGVVFDTKHLLCSHVMAACKSVNVDPMNYVPIDKWAPDLRRMRTAKGPPVSTRIPTEMDEDENERASRKKCGLCQQHGHNRNNYPNISSS

SEQ ID NO: 126217 - protein, 254 aa, Glycine max
  Coding DNA Sequence Number=SeqID_34532
  Gene Ontology: Mol. function=structural molecule activity; Cellular component=chloroplast envelope
  Homolog annotation: Hit_ID=A7P500; Match level="QueryCoverage=63%, HitCoverage=68%, E-value=4e-62, Identity=70%"; Hit description =Chromosome chr4 scaffold_6, whole genome shotgun sequence
  Pfam annotation: Domain name=PAP_fibrillin; Domain location=63-223; Score=-42.0; E_value=0.0092; Accession=PF04755.3; Description=PAP _fibrillin
  Subcellular localization annotation: CTP_CleavageSite=47; ConfidenceScore=5.82e-01
MAATASASAASLSLRSSPFKLNPPKLNSVTLRFPHLNRRYNSAFRVVAASVSVSNPNVQTGPDDLVASILSKVVQTDGGVLLKEEEHKEVAEVAQELQKYCVSEPVKCPLIFGEWDVAYCSRPTSPGGGYRSAIGRLFFNTKQMVQVVEAPDIVRNKVSLSVLSFLDVEVSLQGKLKALDGEWIQVIFEAPELKVGSWQVQYGGQSEVKLRITYVDEKIRSLKRPLYSLAAEFVSKWTTEIWSGDEECGMVSNL

SEQ ID NO: 126218 - protein, 196 aa, Glycine max
  Coding DNA Sequence Number=SeqID_34533
  Homolog annotation: Hit_ID=A5C7H0; Match level="QueryCoverage=65%, HitCoverage=10%, E-value=2e-13, Identity=31%"; Hit description =Putative uncharacterized protein
MVDARQSAFLGDKNILDGIFVANEVIYEMREKKKYCLIFKANFEKAYDLGLSGLVREAEAKELFYEVNVGASNLKIGGLVVFHQSLIVKTMELPFMNLGLPMGADARKVSTWQLIIDKMKMKLSSWKRQHLSFRGCCDEMFGNDLGWFQVNIVKEVAVGSEVSFWHTRGMAVGIVVEKTVVPMETYTSLATMAYYQ

SEQ ID NO: 126219 - protein, 199 aa, Glycine max
  Coding DNA Sequence Number=SeqID_34534
MKGIKGAPYRARLDALMIMDVSWLPYTEHRAVRGFELISCYQGQLGWGHVVVYVKPKRVVRQFGYIQTIPPPPVTGSLSYEDIDDRWMHFGDHLAPADIYPFVTPTQEGDEPRHPPAPDVDAYVEPHILEVPIVVDLPRHSVVACEGCEAIAERLDRVLNLRMVTLGTKLHEIMEDCLRISRGDASDGSLRARCRQHID

SEQ ID NO: 126220 - protein, 162 aa, Glycine max
  Coding DNA Sequence Number=SeqID_34535
  Gene Ontology: Mol. function=peptidase activity; Cellular component =nucleus; Biological process=spore germination
  Homolog annotation: Hit_ID=A7P502; Match level="QueryCoverage=87%, HitCoverage=87%, E-value=1e-46, Identity=63%"; Hit description =Chromosome chr4 scaffold_6, whole genome shotgun sequence
  Pfam annotation: Domain name=DUF163; Domain location=38-162; Score =119.1; E_value=1.3e-32; Accession=PF02590.8; Description =Uncharacterized ACR, COG1576
MPAKPPSMEEEGEQGTPRKKEMRQAQRNSGSHTEQRALPIRILSVGKKRSRGLQLMVDEYADKLSDQRAQVDAEDEAVMNLIRSDDWVVMLDERGQDIESEQMAELVGDAGNTGASRLSFCIGGPYGHGRKMRQRANLSIKLSSLVLNHQIALLVLMEQLYR

SEQ ID NO: 126221 - protein, 311 aa, Glycine max
  Coding DNA Sequence Number=SeqID_34536
  Gene Ontology: Mol. function=translation initiation factor activity; Cellular component=cytoplasm; Biological process=translational initiation
  Homolog annotation: Hit_ID=Q9ZSW3; Match level="QueryCoverage=98%, HitCoverage=92%, E-value=1e-102, Identity=59%"; Hit description=CAK associated cyclinH homolog
MADFQTSTHRAKWIFSPQQLVEKYRAANQRAKQILEKCGATLMEVDVNGSLSYPEPHMTAKDSAEKHYRTKPLSIEEEQCIKVFYENKLQEVYNNFRFPHKIQDVCTCFSVCQIELFHRLTCVYAACKIEENHVSAEELGKGISQDHQMILNNEMISLEFDLIVYAPYRSVEGFINDVEVCLVGPDAAEFCNAGDDQLEMLKTLQETARFEVDKMMLTDAPLLFPPGQLALAALSNSNALHRVIDFDSYLRGIFSHENSMHTMSELSESLNAIDSWVRKYKSPSEKELKHINRKLKSCWGHSSHDEYFLYP

SEQ ID NO: 126222 - protein, 449 aa, Glycine max
  Coding DNA Sequence Number=SeqID_34537
  Gene Ontology: Cellular component=integral to membrane
  Homolog annotation: Hit_ID=A5BIV8; Match level="QueryCoverage=91%, HitCoverage=36%, E-value=8e-65, Identity=54%"; Hit description =Putative uncharacterized protein
MDMNWKMRAIRVLPMFLLPALSSATYTAFVSFTRMCDRKDQKILESLRAERKAKIDELKEKTNYYITQQLIQIIVVNSGRCDRYSGGAAPIRDRHVCSGAVSCCGWSSRYRGRAAWVAEQIAVIPLSAIPLSHFWGPPLRYAGVDNYGIDIHHNSAESLRAERKAKIDELNEKTNYYITQQLIQKLERLVGAFPPSVKPASVPDSASCYLAAYATGSCDPQRYDTDPAAKAAAATVLASKLGADSGLKVYVGDESSGVSTGKTKDVEVVQSSGLRNRKQVTSRSTSPGTTTPNYSDQQLVGSGKIDQTQTHEHNQLVVVEHHNPQSSTMNDGGWIARIAALLVGEDPTQSYALICGNCHMHNGLARKEDFPFITYYCPHCHALNKPKQSDERISGLNSHNTQSPKTDDGEEVKNASDSAVRSVIRSDNPVNTSPEIEEVSEPAISEEKS

SEQ ID NO: 126223 - protein, 233 aa, Glycine max
  Coding DNA Sequence Number=SeqID_34538
MVRIRGLRRALGRLLGRALGRHVSCDAEEAPKLRRPTTSACRQQATVAIAEDVNHVDHVVDEVHEQPQEPVTNHVGVDIEGFPGGPHDTSMLTSYVDHECTELKLVSHGRKVEKFEWHEPEIEGIVAATRLSSLITCSLNIGDKGLLSAFAERWGSSIVRHQPERIVRQFGYVQTIPPLPVAPSLSIEEIDDRWLQFLEYLAPVGQICSAPGQCAADYMEWFYRISHPFMSLT

SEQ ID NO: 126224 - protein, 103 aa, Glycine max
  Coding DNA Sequence Number=SeqID_34539
MTLEKVIVVVEMVDENPKIAQMQGRMIRSRTKQSVDTLQQMVSNILNKAKVEKDEGLEAETLLRILIVAEGSLLNQSQTYQGNSYGVYPDLSFLSGSGVIQTL

SEQ ID NO: 126225 - protein, 85 aa, Glycine max
  Coding DNA Sequence Number=SeqID_34540
MCKQTINHEVPKIKQLRSLYKIPTALREPFLELHPLLPELDLRQEESQQMRKDLCQWDRSGKNSTTMELGTKRALQLKNNFERSG

SEQ ID NO: 126226 - protein, 364 aa, Glycine max
  Coding DNA Sequence Number=SeqID_34541
  Gene Ontology: Mol. function=helicase activity; Biological process =viral genome replication
  Homolog annotation: Hit_ID=Q2A9E0; Match level="QueryCoverage=99%, HitCoverage=24%, E-value=3e-88, Identity=48%"; Hit description =Putative uncharacterized protein
MWYDERISKDRNTTSPKFSLCCGDGKVELPLLQSPLKYLERLLFDGKASDSKNYQCNIQTYNMMFAFTSAGIKLDKSINESRGPPTIRIQGQLCHRIGSLLPMPGKQPKFSQLYIFDTQNEGENRINTMSQHVGIQLEIVSTLSQMLDEYNVHAKSFRMVRDRLADTQVDNVKLRLIAIREKDGHTYNLPNVYEVTALIIGDFDLDSRRDIIVETQNGELQRIHELHSSYLGLQHPILFPYGEDGYRPDIFLRCTLSNRKRKRNRLTMREWFAYRLQSRSNEAQTLLHSRKLFQQFIVEAYTMVEFERLSYIRNNKKKLRVDKYCSLQTSLDAGSSKGSSKGKRVILPSTFVGSPRYMDQLYFD

SEQ ID NO: 126227 - protein, 87 aa, Glycine max
  Coding DNA Sequence Number=SeqID_34542
MVEGSDARDNLAPELKISSGEEAEVPKESEEVQALNVELERMQVVKKKFKMTAIKVRKECDELRDVNKATTEALEREMKRARREEWG

SEQ ID NO: 126228 - protein, 21 aa, Glycine max
  Coding DNA Sequence Number=SeqID_34543
MQEGRRRKIPEGKPVNKGITI

SEQ ID NO: 126229 - protein, 165 aa, Glycine max
  Coding DNA Sequence Number=SeqID_34544
MTRDRLKKAQYSDEDTTKGNDHEALEGPMTRGRLKQTQHVIETRLKASLRVSVEPNSDLSRLIPCGVTVTYLPSLEVAPLSVNIPVSNVLPRSKASLMDKFHSSLGIFHHASEGNVLKAIELTGQLAQDILEDNNDLLFDLLSLHLVDLVCSKEWAEALEFAQTK

SEQ ID NO: 126230 - protein, 171 aa, Glycine max
  Coding DNA Sequence Number=SeqID_34545
MLESFKQQQEMSVLELYIEKDVAGGSMFHSANSLTSCGNYLSNDETQPPTNMSNIHLDEDDDDDDDDDYLVSNLYVEESLDKDDSVDDISDTDNEVTEMIPLVRIVHPAEGVQGIQNQFWNDEEDICGLEMPSSFNVGQELYVGMDFDSKDAVKNAVKQYVMKVHQNFKVI

SEQ ID NO: 126231 - protein, 128 aa, Glycine max
  Coding DNA Sequence Number=SeqID_34546
  Homolog annotation: Hit_ID=Q2HW90; Match level="QueryCoverage=64%, HitCoverage=17%, E-value=6e-08, Identity=37%"; Hit description =Putative uncharacterized protein
MGLNQTPYFKKRFYHVKIKSLEVASLQELGQWMDQLQCKAFRKTYGKIWDLAMIEVSVEAIASLTQYYDQPLRCFTFGDFQLVPTVEEFEGILGCLLEEGSRIYFLGYTPPWRELLKWSRSRRKNWTE

SEQ ID NO: 126232 - protein, 48 aa, Glycine max
  Coding DNA Sequence Number=SeqID_34547
MGSNQTPFSKKRFYHVKIKSLEVASLQELGKRMGQLQRQAFRKTYGKI

SEQ ID NO: 126233 - protein, 231 aa, Glycine max
  Coding DNA Sequence Number=SeqID_34548
MEGLGSISGTPHGGKRNDHYDSRHIVGLRRGKFDYAASTSTNNRRFGASGAKKKEGDAYVVTLALTWPKTQQTPHNTYQYAPHQPSFSAHVGNPSKPTPVQQRVLAQPQRNPPQNSAPAQSRPAGNSNPSTSTNSGWNFPTKKPAKFTLISMSYIDLLSSLITNQMAVVEVDGRCVNLEEVHVGGAARSEHDLPQKGQGRCLFDTLRSSTRCRGMPCGRGFATRNDGQRRV

SEQ ID NO: 126234 - protein, 105 aa, Glycine max
  Coding DNA Sequence Number=SeqID_34549
  Gene Ontology: Mol. function=glutathione transferase activity; Cellular component=cytoplasm; Biological process=glutathione metabolic process
  Homolog annotation: Hit_ID=Q9FQD5; Match level="QueryCoverage=75%, HitCoverage=31%, E-value=1e-31, Identity=83%"; Hit description =Glutathione S-transferase GST 23
  Pfam annotation: Domain name=GST_N; Domain location=1-76; Score=63.7; E_value=6.2e-16; Accession=PF02798.11; Description=Glutathione S -transferase, N-terminal domain
MKLKVYADRMSQPSRAILIFYKVNGIDFEDVKVDLSQHHQLSPQFRVINPLMKVPAVVDGRFKLFESHAILIYLAYAFPDKYILQLHGTSIQRVFSYKNRYCRIN

SEQ ID NO: 126235 - protein, 97 aa, Glycine max
  Coding DNA Sequence Number=SeqID_34550
  Subcellular localization annotation: CTP_CleavageSite=14; ConfidenceScore=5.04e-01
MTNNNKIKSIRWTYAYALSTGKRREVSMRETVFTTRAPLLHGEVSRRECLTTRGRVLTTGVSARARWSCGLECSFDYRSKCSSSYKDGHRDVRRCVI

SEQ ID NO: 126236 - protein, 128 aa, Glycine max
  Coding DNA Sequence Number=SeqID_34551
MALRKRHASTSKPQEPYDSSRFVSEVAWERYEQNVHARNILPEKNVELAFSQYDEFLWELERYLALVNEFYTNLYDLEDRSPRQCKVWGKLIKFNAATLNKFLETLVVLDLGERYSAYSRFCSTYLDP

SEQ ID NO: 126237 - protein, 49 aa, Glycine max
  Coding DNA Sequence Number=SeqID_34552
MRPRRFQNVLVINSVIILHRSSSVLHRSLFIDRGPLLLFASSSLFFYHQ

SEQ ID NO: 126238 - protein, 121 aa, Glycine max
  Coding DNA Sequence Number=SeqID_34553
  Pfam annotation: Domain name=G-patch; Domain location=38-82; Score =24.9; E_value=0.00018; Accession=PF01585.14; Description=G-patch domain
MPYVEAAEESLEMSFQALEMVSNAYVESPPVQQRSSEAALMVARVMLWHGYEPGMGLGQNNDGMESLVEFTENRRRFGLGYKPTRADVRSDNDSYEGNDTEDLDVNFEQPVNQAEDEEDED

SEQ ID NO: 126239 - protein, 112 aa, Glycine max
  Coding DNA Sequence Number=SeqID_34554
MTRGNPGDLQPFDPEIDRTIHILVRHNVHPGHSVHFKHSVEGDFEYSDFEHSTTNFHTENMTQPSPRERTLREMAAPDFTYESLCIQYPDEGVPYVKILISILKSSILFVPP

SEQ ID NO: 126240 - protein, 89 aa, Glycine max
  Coding DNA Sequence Number=SeqID_34555
MTPTHDAMLYYNVRWNVSRQYEFVGYSFTGKNPKKFDIPSGCTIDEGFDQVMEMEDDVSQSQQTSMLIKFYVHGSPKSTNSVFSLDKVV

SEQ ID NO: 126241 - protein, 106 aa, Glycine max
  Coding DNA Sequence Number=SeqID_34556
MGRVKSIANKEQLLNSLCKEIKVMIARFDSGESSRRNLHWLSWNRLETSKSGGDSCKDFRQIQGVTTTTTVMTVSITTAMAAITTTTMIVNRHDHRDRRHDHYRHH

SEQ ID NO: 126242 - protein, 62 aa, Glycine max
  Coding DNA Sequence Number=SeqID_34557
MQYRLSRFIVTLTAKKRTQGMSNYMAGVCMSEHNMRLMTTEGNNIVAIGTTSDNALSSESET

SEQ ID NO: 126243 - protein, 158 aa, Glycine max
  Coding DNA Sequence Number=SeqID_34558
MAPLIALRFASIRVGDVRIFIKVLVDSLFSTVFPVFAQKHLDVVLDGHLDGYKYSVTSVNEFILAQLMRLSLCSSLEVQLKRNKLATTLDQMSINVTQKQFRSSGNGNRHGGNKGGHSGAPSLCWWVALTWTIWQQRNRIVFSNETFNGSKLMDDAVF

SEQ ID NO: 126244 - protein, 16 aa, Glycine max
  Coding DNA Sequence Number=SeqID_34559
MAETQPRYLGMEANGG

SEQ ID NO: 126245 - protein, 70 aa, Glycine max
  Coding DNA Sequence Number=SeqID_34560
MACNLCLTASRYLAAFVAQYVKFRDMMFLQKAVASGGRNLARLGELGGKLLPYFPINRGKSEGERGSALL

SEQ ID NO: 126246 - protein, 178 aa, Glycine max
  Coding DNA Sequence Number=SeqID_34561
MKRWWAMHPQSFADLVFASERIDVGPKRGKFNHPTRTTEKTGANEEGEKEGETHAVTAIPIRPSFPPTQQCHYSANNKLSPYPPPSYPQRPSLNLPQSLSTALPMTNTTFSTNQKHQPRTITLSKVHQPPFLREYDSNATCACHGEAPGHSIEHGRALKRKVQGLIDAGWLKFEENCV

SEQ ID NO: 126247 - protein, 52 aa, Glycine max
  Coding DNA Sequence Number=SeqID_34562
DVASGLPSIMHIKWEQEKEKAKALLDRRYAGVLCISFEDMMIVLGMQDNESP

SEQ ID NO: 126248 - protein, 334 aa, Glycine max
  Coding DNA Sequence Number=SeqID_34563
  Homolog annotation: Hit_ID=A2Q500; Match level="QueryCoverage=23%, HitCoverage=12%, E-value=5e-08, Identity=33%"; Hit description =Endonuclease/exonuclease/phosphatase
DNLVGKVLVKKAGTSFAKTDDVTHQVFDNFSECSAKSESSPEVSCTLGDNDSTTDDDSSHSCGSKSSPQLDDNKAPTPWVNLFKDNRSPSKGFGMKFSPPPSDDEVLLEETDLQPLEEAWGHSLIGYVAGRFPGKKALWDCCQKWGVKFSYSAHESGWLVMPAFFDFGNEELSKIPVWVPLRNLPLELWNPQALGKILALVEVDASLELIDEVQFRIPIGKTFVQKIEYENRPSFCTHCKMIGHRLTNCKTVTANKPVLITACPTSDQPQVGDSAMPPHTNTAGPSDNPKNVQTNLFVPPHRKHVLVANHVPVLQNSSDLKETGNTELDDPIEE

SEQ ID NO: 126249 - protein, 62 aa, Glycine max
  Coding DNA Sequence Number=SeqID_34564
TGKRGGIGTTGPPTSKGKTEVRVSAPAEKALSPYSNKANALYLTKAFSDRGSLAVVWVELKP

SEQ ID NO: 126250 - protein, 191 aa, Glycine max
  Coding DNA Sequence Number=SeqID_34565
MTLLLSNIPAPAIIILTSLCRSASWCMPPTRHPLDPDKSSRALGFPALITGLCQSFGVPVTPSKVIRPPITRAFIEKYCTASRHRVATRRPQTHRRHLLRLTQLGHLTRNSIYGIWFASRQPTTGRTCRPMTASTNSASACRAKVLPLFHALLRISSGHRSHGPEIGLRPRQGRHPQRHPARQMRPAWTRR

SEQ ID NO: 126251 - protein, 145 aa, Glycine max
  Coding DNA Sequence Number=SeqID_34566
VVPSVVRLMKQANVFPLKKTLKKFIIWEINSDKGILKEDFQASSKVPIINKDSGGHTLAICSTKTKVTMSNHKSTESALKNLEIPKEECKAVMTRSKRFVEAEDEDNVMHKKKTTDKKSTDGKKNEEIGNNHALQRSIVADATLL

SEQ ID NO: 126252 - protein, 137 aa, Glycine max
  Coding DNA Sequence Number=SeqID_34567
  Subcellular localization annotation: CTP_CleavageSite=67; ConfidenceScore=5.38e-01
MPISPCKSISWSVSSRHGDRTHKTPSGPGKVQQGPGVSNSGYGPLSVLQGARTPPTRSCHPDIGITPAGHPVDPKKSDRVLGFPALITGLCQFYGVPVAPTRSLGLALTGLSSRSTAPPDGRRARHHCSIGMAGSGQ

SEQ ID NO: 126253 - protein, 172 aa, Glycine max
  Coding DNA Sequence Number=SeqID_34568
  Pfam annotation: Domain name=G-patch; Domain location=2-41; Score =27.5; E_value=5e-05; Accession=PF01585.14; Description=G-patch domain
  Subcellular localization annotation: CTP_CleavageSite=48; ConfidenceScore=5.13e-01
MARVMLGYGYKPGMGLGKNNGGRTSLVSTRGNRGKFGLGYKPTQADIRKSVVERKSRGQSSQLGRQVEGVPPCHISRSFIGAGLGHEGQVIAICEDDSPRRSDLVRPWPPGFRLGNWRVEERPDIYATSIISDDESIEGTNTWDPTIDFKQEAGQTESEEDEDVDFPRSWRG

SEQ ID NO: 126254 - protein, 144 aa, Glycine max
  Coding DNA Sequence Number=SeqID_34569
  Homolog annotation: Hit_ID=A6FJQ2; Match level="QueryCoverage=26%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVLVPSFNPPHAYLWEMRGGGCIAACLGKLLASSRKQPSLPRRAGCFILSFLVGPGAKKCTGTELEFVIMVIAVSCVKLLSAHNSTQHTSRKHKV

SEQ ID NO: 126255 - protein, 97 aa, Glycine max
  Coding DNA Sequence Number=SeqID_34570
  Homolog annotation: Hit_ID=A1CR97; Match level="QueryCoverage=46%, HitCoverage=39%, E-value=5e-10, Identity=73%"; Hit description =Putative uncharacterized protein
MSGYSVRTNSLLNSYGRCSGPHARYTDVFNESIALADRSGSLQLLVFNEEFLVSASHQLALTTSLPFVHTARRSYRLNGPVKCSDCGDVSGSLPATL

SEQ ID NO: 126256 - protein, 94 aa, Glycine max
  Coding DNA Sequence Number=SeqID_34571
MAEPSKKRRDHPPPLPLLPIAVTAHPEHPQHLFLLLCHLQDHQHCFQSLMIILRHFFSLEFTQSSAPRAPLLMTGNSIIRVMMLVAWSAMIKLK

SEQ ID NO: 126257 - protein, 123 aa, Glycine max
  Coding DNA Sequence Number=SeqID_34572
  Homolog annotation: Hit_ID=UPI00006A2D9E; Match level="QueryCoverage =81%, HitCoverage=66%, E-value=4e-07, Identity=16%"; Hit description =UPI00006A2D9E related cluster
MGTSKPYTRAMRGITHEPQASIGADQNTLAFCGLHALAFRGLRVLTIRGLHVLAFRGLHAFAFVGLHVLAFRGLHALAFRGLHVLSFKGLHVLTFRGLHVLAFRGLHALAFKGLQALAFRGLH

SEQ ID NO: 126258 - protein, 19 aa, Glycine max
  Coding DNA Sequence Number=SeqID_34573
MRPKEEEKEDGGGGGGVEA

SEQ ID NO: 126259 - protein, 417 aa, Glycine max
  Coding DNA Sequence Number=SeqID_34574
MASRKCKSIGSRPTTQYDTRRFHSLDAWNRYMDNVLGRNILPERKVELYHTELDDFKTELERRNFHKRLTNLVDGSIDLALVKEFYANLYSFEGPSPKQARVRGHLVKIDADNLNTFLATPMVLTEGESLPTYSRYCRLPKDYREIEAALCITGRGVLSYSNLAPTSCTSDLIVDRARQIFGLVSCMDMNTWVPALITALCRARGVVSDSLTFERVRARPAELPSTSVAPTLASTSTASSVLAQSDSQHFEAMLQSIHQGQIILLQSLQVMAPPGSIPTVEQFLASVTWPGAQPSLHRENEGPTAQVPQHMEDESSEDTIPEPFIVEEEAGETQIRQEAAATPERSIKVTLEPPAPVVDLSSPQHVVDPSTPILEIPEDLTTLVLTLNTSPLATPVLHLTDEEAVQTQDTQDQSQEF

SEQ ID NO: 126260 - protein, 177 aa, Glycine max
  Coding DNA Sequence Number=SeqID_34575
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=64%, E-value=2e-32, Identity=100%"; Hit description=LacZ protein
  Subcellular localization annotation: CTP_CleavageSite=71; ConfidenceScore=5.74e-01
MEPLSFSTSHLSIPTKTTLFSPKHHPPSASAATTTVSFSHKPPSDSNSAATPRRPSKPPKATPITPPSDPLANKLWLTSKLWDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 126261 - protein, 182 aa, Glycine max
  Coding DNA Sequence Number=SeqID_34576
RSASGGRKRRKEAAQGGERREERGCGSEARAALGRGRKEAAQGRWRKKAAQGSDRGEKEKQGEHVVERGGRRGVGDTTLRANGAPGGGRQVVGAPRARARPRAGPPGKQPAKRRSQGAVWGGSAGGQGGGRKGGRRRAPRRRGRPRQRQGGKAPRKGAQGSAKSQPPEKPHKQAASKGEAEQ

SEQ ID NO: 126262 - protein, 184 aa, Glycine max
  Coding DNA Sequence Number=SeqID_34577
  Gene Ontology: Cellular component=integral to membrane
  Homolog annotation: Hit_ID=Q93X14; Match level="QueryCoverage=58%, HitCoverage=20%, E-value=8e-39, Identity=72%"; Hit description=Amino acid permease AAP3
MRKEKIPHQAPFAIQAAQLLGRAIGAGLFAITPAGERGMCCKAIKLGNARVFPVTTLSTLEDPRYDDDGRLKRTGTIWTTSSHIITAVVGSGVLSLAWAIAQMGWIAGPAVMILFSIVTLYTSSFLADCYRTGDPIFGKRNYTFMDAVSTILGYRARIRNHGHSCFLCEIVIRSQFHTTYEPEA

SEQ ID NO: 126263 - protein, 168 aa, Glycine max
  Coding DNA Sequence Number=SeqID_34578
  Subcellular localization annotation: CTP_CleavageSite=67; ConfidenceScore=5.69e-01
GALSSTSMKHNKGLAQQAALSLIQRLKNRSKVALSLTGMNVLSAIIWKSKNLTVVMNRLSTAGTLSRASAKRNTHGLSARKTLEEDELYRRHPDEDMTKSKGKDPLEGLGGPMTRARARKAKEDLQQVLSILFEYKPKFQGEKSKGPIGNLGISLLGDQMVADLLAVG

SEQ ID NO: 126264 - protein, 157 aa, Glycine max
  Coding DNA Sequence Number=SeqID_34579
  Homolog annotation: Hit_ID=A5C169; Match level="QueryCoverage=80%, HitCoverage=11%, E-value=2e-07, Identity=28%"; Hit description =Putative uncharacterized protein
MTGRLLTGSLAFESRILHYLIMRILLPRSSNLAQVSEEDLIIMWAFHTGRQLDWAHLVRYRMHKALRLNAPLPYPQLVTLFLRHFEILLDSESYIPIKRSILIGAAAIASFGYRKKRDGSWVKKGTQPADEEGLWTSLMDFKLLLVTSLMPWNYKLT

SEQ ID NO: 126265 - protein, 52 aa, Glycine max
  Coding DNA Sequence Number=SeqID_34580
MACNLCLTASRYWAPCVAQYVKFRDMPEIKRKHCYTVRGGVKEKGFSPSGTS

SEQ ID NO: 126266 - protein, 99 aa, Glycine max
  Coding DNA Sequence Number=SeqID_34581
MQQGQADILIARFPDPNYGVKVGFRSLPKPQAKLEILLRLKGSSRCGFSMENNDGLWWLMVDVGDGESTWNFRNGFGRKKEEEMAFFLSYKKAKAEMLK

SEQ ID NO: 126267 - protein, 215 aa, Glycine max
  Coding DNA Sequence Number=SeqID_34582
  Gene Ontology: Mol. function=protein kinase activity; Cellular component=chromatin; Biological process=protein amino acid phosphorylation
  Homolog annotation: Hit_ID=Q8RV60; Match level="QueryCoverage=99%, HitCoverage=19%, E-value=8e-42, Identity=38%"; Hit description =Putative uncharacterized protein At2g05640
MMLTTCKGPTSFEDIRTVENVLYPTYREVPLLNLKNFGIRHEIELDIDDDQLKNLTLLEIEKLVHANQKSLKDYPTMPYPEGANPAWCLENSLILSELNYNNDEARSEFENLFSSMTDEQKQIYQKIMQDVNNNEGGMFFLYGYGGTGKTYIWRTLASSLRAKNQIVIMVASSSITSLLLPGGRTAHSKFKILVPIFEDSTCNILQGSQLTELLN

SEQ ID NO: 126268 - protein, 65 aa, Glycine max
  Coding DNA Sequence Number=SeqID_34583
  Subcellular localization annotation: CTP_CleavageSite=30; ConfidenceScore=5.04e-01
MTLGAEFNVESLTCGDWNTSSKVSQKVCVRFYARKKRTTYISMKFSRFKKLGLGFDMLMKDRDTG

SEQ ID NO: 126269 - protein, 41 aa, Glycine max
  Coding DNA Sequence Number=SeqID_34584
LVCPCLTKGRLRVPTDSQVTIVKGGAVDKSGAFAPTYPQSR

SEQ ID NO: 126270 - protein, 33 aa, Glycine max
  Coding DNA Sequence Number=SeqID_34585
MTDREEVDVNLSRSGSFDTGYEGLDDATSGEGR

SEQ ID NO: 126271 - protein, 86 aa, Glycine max
  Coding DNA Sequence Number=SeqID_34586
MEKRRDVVQRDRHLPHRKMETRSLPLPPLHKGGYKSSIVDHTLPATWSAHSVSTDGSLGPPGNPTGSLMCHHFLLFSKPFLHHFNY

SEQ ID NO: 126272 - protein, 180 aa, Glycine max
  Coding DNA Sequence Number=SeqID_34587
MTLAIPELFLRPYQVRWDATVFGVVNPDFPLYIKHEDISEIAHGGQCLSISVLQLWILHLTETCMRAGNSDIYGFLEPQSIQRSGQSQFESESYIKSWMQSSQCDVYLGAYLNGFHCSGHWHMVVILPKEHLAVCAIKGLDDAPQPKSKAPARWIVVKCNRRRKYLSATTMRYTGCPPSF

SEQ ID NO: 126273 - protein, 50 aa, Glycine max
  Coding DNA Sequence Number=SeqID_34588
MFACSPFAKRKPRAKRISVHALSRESQALSAQTLHLRLIWFAKLAEVELS

SEQ ID NO: 126274 - protein, 243 aa, Glycine max
  Coding DNA Sequence Number=SeqID_34589
RIATVVKDSARGLDRIKQTRNGIAGLPQKYLEDKARGMANQGDWVPFMDVLALLIFGVVLFPNVDGLVDLAAIDAFLAYHHSKESPVVAVLADLFDTFDRRGAPTEESMSPFLVRDFGAQNSKTIQRIHKGVAKEKFKLAATHVRKECAGLREENAITARALEQETKRARKEEYGRNKFRGALWGSNSELKLRREERDQSRAHGMVLKEELVACSRSKRSLSQRLCETETNMLAIIAKYQEEL

SEQ ID NO: 126275 - protein, 63 aa, Glycine max
  Coding DNA Sequence Number=SeqID_34590
MSFPAFRYLGTGMSGGYAHDPQIAVPCPAPDKVSSPGRAPPGTKWFKKRGGVQFSPKELLPLT

SEQ ID NO: 126276 - protein, 124 aa, Glycine max
  Coding DNA Sequence Number=SeqID_34591
TAIPLELEVIPQVKELLDEGLVHKSLNPCALLVPKIGIIRHQIPMIGGMMNVLSGATLFCKITHAPNIFMICVHRDSLGRNNQHENKEKGMFYSNTFPNFVNSDKGLPMDLKRIKVIPEWPTPP

SEQ ID NO: 126277 - protein, 182 aa, Glycine max
  Coding DNA Sequence Number=SeqID_34592
MDVKRLKVINQEVDDHHHPRYYRTCSYLDGKRDFDSLWIGRVWATICCLRVSSDLLSLDDEGADNHEVSLHAIGPSSHNSRVVCTDNHKVSPYAIGPSSDHSRIVCTDNHKVSPYDIRPSSHDSRFVCMNNHKVSPYATRPSSHDSKGESFLRSRLEDADISGKGADDHIGICVSTGSLASS

SEQ ID NO: 126278 - protein, 183 aa, Glycine max
  Coding DNA Sequence Number=SeqID_34593
  Homolog annotation: Hit_ID=A0ST23; Match level="QueryCoverage=24%, HitCoverage=91%, E-value=2e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPRKNKGIMETVDFKDKPTFGHCSNDSNLLNIVLELYIVLLPGTELEFVIMVIAVSFGKPVVPAALMNRPTRGERRFAYWALFRFLAH

SEQ ID NO: 126279 - protein, 148 aa, Glycine max
  Coding DNA Sequence Number=SeqID_34594
  Homolog annotation: Hit_ID=A7Q538; Match level="QueryCoverage=85%, HitCoverage=33%, E-value=8e-07, Identity=27%"; Hit description =Chromosome undetermined scaffold_51, whole genome shotgun sequence
  Pfam annotation: Domain name=zf-CCHC; Domain location=91-108; Score =28.4; E_value=2.5e-05; Accession=PF00098.14; Description=Zinc knuckle
MSLATLFGKLQEHEMELQRLNLNEENDKKKRSIALKASSSIQEENEEEDTDDEEDFSFFVKKFQKYIKKRRIDRRQNFNNGRKSQDDSQVLRCYECNQIGHIKANCPSNEEWLEKSERKDLTKEELRKHTLHGMIMIHPMVQKRRLIF

SEQ ID NO: 126280 - protein, 115 aa, Glycine max
  Coding DNA Sequence Number=SeqID_34595
MVLVAAIAATLASIISFMLIMESSIVAILANLYDTFDRRCMVGFTPFSPRGEKRLPARRPPLMHQEKGGKLGPILSKQKRSVCQLVPPMERMKNRDFYFMWGISKCSLDGDEGFH

SEQ ID NO: 126281 - protein, 136 aa, Glycine max
  Coding DNA Sequence Number=SeqID_34596
  Homolog annotation: Hit_ID=A5AZG1; Match level="QueryCoverage=69%, HitCoverage=30%, E-value=4e-07, Identity=32%"; Hit description =Putative uncharacterized protein
  Pfam annotation: Domain name=zf-CCHC; Domain location=93-110; Score =23.2; E_value=0.00046; Accession=PF00098.14; Description=Zinc knuckle
MRENERKPQEANINPPYFHGKDNVEAYLDWEIRIEQKLKRKSTLKSYGSHSYPKKDQGLGILWAAPSKPKDDKGKTIEKQPPKASMQEKTSFIKCFKCLRRGHITSQCPTTKTMIIRGQEIYSSQDKATTSPSSSE

SEQ ID NO: 126282 - protein, 48 aa, Glycine max
  Coding DNA Sequence Number=SeqID_34597
MAPLINMASKISKIGKKLLIFHATQLPSSYQKVSSIRYSLSDQSGNAK

SEQ ID NO: 126283 - protein, 117 aa, Glycine max
  Coding DNA Sequence Number=SeqID_34598
MDNEEGVQEQMKADLSALKDWMASIMEAMLKIQKTIEDNATAAASNTAREAEPLLQPAINLGRDRNATGINRRYSPQAYPYGLPPYFTPRTAPDDLSQAPTFEGAGPSSCRLSSAGR

SEQ ID NO: 126284 - protein, 72 aa, Glycine max
  Coding DNA Sequence Number=SeqID_34599
TLPFIFQEAKESIDEEDPRPTSSNGACIMWYQSTRASSVEGRSPEYEEPRDLRSNPFQGGGNDAILSRKGIG

SEQ ID NO: 126285 - protein, 211 aa, Glycine max
  Coding DNA Sequence Number=SeqID_34600
  Homolog annotation: Hit_ID=A5B5V0; Match level="QueryCoverage=100%, HitCoverage=47%, E-value=1e-09, Identity=26%"; Hit description =Putative uncharacterized protein
MSLKLPVYSDLVKAFYSNLEIQEGTLMHEVYGIKIVIDQSLFYDLTQLPSEGVPFEGALIDDWKFDFSVHDAHRLVCTNQVDMTGRLLASSLAFESRILHYLIVRILLPRSSNLAQVSEEDLIVMWAFHKGLQIDWAHLVRYRMHKALRLNAPLPYPHLVTLFLQHFNIPLDYEPYVPIKRSFLTGASVIASFGYPTQHDGSWVKKGARHV

SEQ ID NO: 126286 - protein, 66 aa, Glycine max
  Coding DNA Sequence Number=SeqID_34601
EHEMELQRLNQHEENDKKKKGIALKASSSIQEELCLFVKRFNKFLRMRETQRTQNFKPKRRIEESS

SEQ ID NO: 126287 - protein, 105 aa, Glycine max
  Coding DNA Sequence Number=SeqID_34602
MIIKSSNIFALICIPTSPSGSENSKQYPPLQRHAFVKWWSQFDTSKAAPEQVKNWFQSNPKFLKPADPETSLFLNQKSQLAAFMASSKSKESLAQNLKEVLQLLQ

SEQ ID NO: 126288 - protein, 352 aa, Glycine max
  Coding DNA Sequence Number=SeqID_34603
AGAEVGVVAQEDQGARGGYRIGVEALLFQRGQRDVVEADLGERRGVAVAAQRVGVDLVDQLADGVHAVAGHLRRIAARGRDQRAAHHQQAEVVAGDVALDDDFGADLLGHFESLDHALARLDVDRHAAALAAVARLDHHRAAQLLGRGPGVFGRGDRAAQRHGHAGRVQQHLGQVLVLRDRFGDGAGQVGFGGLDAALLAAPAELHHAALRQAAVGNVAGGGGVDDGAGAGAQAHVLVQLAQALEGVGQVERRIVQRRLHQLLRQVHGQAADFFLAVFHHHLEHAGLDGRRSAARARSRRRPGGPRDAAGRLSMEHSASAHDTMASIAVFLLHRLGPRSARIRETSMAGIPV

SEQ ID NO: 126289 - protein, 75 aa, Glycine max
  Coding DNA Sequence Number=SeqID_34604
KASSKESGVKKLQESSFKESRFKNNQVSKNQDSRIIKFQDSIKFQESRFKNNQDQDSRLKIQESREDSIKISTKK

SEQ ID NO: 126290 - protein, 101 aa, Glycine max
  Coding DNA Sequence Number=SeqID_34605
  Subcellular localization annotation: CTP_CleavageSite=46; ConfidenceScore=5.13e-01
SGRQKGAEDDVSLGAPTCSFAPGAVNHMVTPHVTLAHGSRRKKVPRTMLISARERARLTLVDQRLVCPWLTKGVDNHKLTKGAGNHKVTPHVIDFTGQDDK

SEQ ID NO: 126291 - protein, 86 aa, Glycine max
  Coding DNA Sequence Number=SeqID_34606
  Subcellular localization annotation: CTP_CleavageSite=41; ConfidenceScore=5.44e-01
MWCKLSRFIVFLLSFFFVFCFLKRKMQGSCMSGHNMRTMKRCMMRSRNKPDDNASPREETLDEASLVSSELETRHDHKSASLRWLT

SEQ ID NO: 126292 - protein, 176 aa, Glycine max
  Coding DNA Sequence Number=SeqID_34607
MYEYPRRTRARKHSFQNSCGYSCFVGKREMAPKKLATGEGSSAAPEFDSHRFRSAEHQQRFEAIRGWSFHKERRVQLREDEYTDFQEEIAHRHWTSLVTPMAKFDPEIVLEFYANAWPTEEGVRDMRSWVRGQWIPFDADALSQFLGDLLVLEEGQQCGFSQRRNRANGFDEEAIA

SEQ ID NO: 126293 - protein, 59 aa, Glycine max
  Coding DNA Sequence Number=SeqID_34608
MEGDNRITRRQYKWRLQSLLLLFNVWEPYQSNQRKKLRNLRKFLEMSLSLSEDTEIMKW

SEQ ID NO: 126294 - protein, 105 aa, Glycine max
  Coding DNA Sequence Number=SeqID_34609
MADVPRGGPKRKDKSSCKRFILKALREADIICFDGGEGNTCLVHPGAAHDVEACPVAEDLLQWIMDQGRFEVCGTSKEEQYVCMQSADKSPSKPKPDGSLLMKFQ

SEQ ID NO: 126295 - protein, 208 aa, Glycine max
  Coding DNA Sequence Number=SeqID_34610
MTGPLDESISCFLIKVDPWVLVPITFRGLYVLACRGLHALAFRGLRILVFSVLHIHTLREYKVLCPYMLHRDLRSRNRTHKDTQWTRRSPTGPWGFQLWLRASVVLQGARSPRQGHGSRLQDTQWTRRSPTGSWSYQALITGLCQFYGVPFTSSKGIRPPTNRAFIKKYCVSRQAQGETPQQPGDGQQRATDAPPSPLEFTSAHPQRG

SEQ ID NO: 126296 - protein, 67 aa, Glycine max
  Coding DNA Sequence Number=SeqID_34611
MTKASMQAGNAFMYGFLEPQFMEKSGQSQFESEDYIKKWMQNSQRDVYLGAYLNDVLMIKDYWNQRE

SEQ ID NO: 126297 - protein, 136 aa, Glycine max
  Coding DNA Sequence Number=SeqID_34612
MIHVVAPTPNTLPTAQDQPNPNFVRESIPTTPIRDASPSTLDDYFTPEYPPDPNCEHIVDQRPFIRAYKGEFQPTYGYSNIISNIIRTKFDEPAASWLKVSVDLRDRWFGEFKRIGGTYKKSEPLEPFLRPKVHAF

SEQ ID NO: 126298 - protein, 321 aa, Glycine max
  Coding DNA Sequence Number=SeqID_34613
MSHHSSSVNGKGTSHKDPLSRILDELSSLKLWKEKQERKEKGKKRVEEISQDERKKIREEARRKIMKEMKREKHAYYSSHNSCKSLSEELRDYYEGRHRSHLRPHSHRREKERKPQEANIKLSYFHGKDNVEANLDWEIRVEQQLKKKSTSKYYGSHSYPKKDQGQDILGVTPSKPKDDKGKTIEKQAPKARAKIYSSQDEATTSPFSSESEEAKGEESKEEIYPQEDGKPLVVKEKCKEVSVSSKRLAKKETHFTIKTNIKETFPLRQPPHFLFSKKTLASIATPLGLEFIPQVKKLLDEGLFRKSLNPCPLLVPKIGIT

SEQ ID NO: 126299 - protein, 179 aa, Glycine max
  Coding DNA Sequence Number=SeqID_34614
MSHLFEFGVTEPLNESISCFLKRVDPWVLVPSPLEDYTSSPLEDYTSSPSEGCTPSPSEGYTSSPSEGYTSSPSEGYMHAIRGLRVLTFRGLYPLAFRGLHAFTFRGLHVLTFRGLHVLAIRGLHVLAFRGLHALIFRGLHVLTFRGLHVLTFRALHTLSFSGLHAFAFRGLDALAFKG

SEQ ID NO: 126300 - protein, 235 aa, Glycine max
  Coding DNA Sequence Number=SeqID_34615
  Homolog annotation: Hit_ID=Q6WAY6; Match level="QueryCoverage=79%, HitCoverage=31%, E-value=1e-19, Identity=34%"; Hit description =Putative uncharacterized protein
MGWSEYRGSTGGESEGFGSKESPVVAILADAYDTFDQRCKKSGTRIVCCTPVLYGWLAWHLFCHESRPIYPLQGHHMCTEKGKTNWEQLMASMVGASINWFPRWKEGRVGVLSSCEGFSNVPLMGTRGCINYNSILAIRQLGYPMRGAPSEESITPFIAWGFSDPNARIFQRVQKAWSMMQRKDKELRGSSNGIIDIYHKWLKARTQELDWLPKLKTSREEKVETSEESEEVQAL

SEQ ID NO: 126301 - protein, 90 aa, Glycine max
  Coding DNA Sequence Number=SeqID_34616
  Homolog annotation: Hit_ID=A5BSR3; Match level="QueryCoverage=85%, HitCoverage=24%, E-value=2e-07, Identity=40%"; Hit description =Putative uncharacterized protein
  Subcellular localization annotation: CTP_CleavageSite=28; ConfidenceScore=5.09e-01
MLVATPRVFLSWNTHPASLASPSRRRVGCDTRTKKTGEMTIEAAKEIAEKIDSFEEQATQGSFVPHGRQDVLAATIGRPEHPGRVCAVGA

SEQ ID NO: 126302 - protein, 99 aa, Glycine max
  Coding DNA Sequence Number=SeqID_34617
MKGGQAYDAMMQRILFESCGRRVRWRARDRVHPHMSLYGLCDPSASPSHKRSLAGKQQQMSQDQCTDDEAPDYRDHWLRDVSLHCQTENHVAMGRQLQY

SEQ ID NO: 126303 - protein, 37 aa, Glycine max
  Coding DNA Sequence Number=SeqID_34618
MASILTYIPSPGSGIYPDLSSFTGSGVYPDLVSSDFV

SEQ ID NO: 126304 - protein, 128 aa, Glycine max
  Coding DNA Sequence Number=SeqID_34619
  Homolog annotation: Hit_ID=A6H5B3; Match level="QueryCoverage=52%, HitCoverage=84%, E-value=7e-28, Identity=88%"; Hit description =Putative ribosomal protein S3
RGKESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYDPNLGDLSMTRMKLG

SEQ ID NO: 126305 - protein, 73 aa, Glycine max
  Coding DNA Sequence Number=SeqID_34620
MTKLGLCVPSDTTVSEWQRGSDNRKVSPRIMGISAYHGCRMTKLGLCLSSGPPPLDDKRGANNHKVSPRATGS

SEQ ID NO: 126306 - protein, 77 aa, Glycine max
  Coding DNA Sequence Number=SeqID_34621
MSSGPPPLDDKGADDHNLSLHVNGLACLWLTKGVLMITMMTTKDDDKGDEQKAQRSKNISSESRTSQEFKKRIKKKA

SEQ ID NO: 126307 - protein, 195 aa, Glycine max
  Coding DNA Sequence Number=SeqID_34622
LALNQKSVPVARVCGLCSSADHHTDLCPSMQQPGAIEQSEAYAANIYNKPPQPQQQNQPQQNNYDLSNNRYNPGWRNHPNLRWSSPQQQQQEPSPSFQNVVGPSRPYIPPPIQQQQQPQKQPTVEAPPQPSLEELVRQMTMQNMQFQQETRASIQSLTNQMGQLATQLNQQQSQNSDKLPSQSVQNPKNVKDLNP

SEQ ID NO: 126308 - protein, 95 aa, Glycine max
  Coding DNA Sequence Number=SeqID_34623
MSQRLCETETNMLAIISKKNTITKRAPRHTYHTRSKSRTMGDQEETQEQMKANMLALKEQMASMRKTWPPLPLLVRLPKQTQLSQLPRTILPQTR

SEQ ID NO: 126309 - protein, 108 aa, Glycine max
  Coding DNA Sequence Number=SeqID_34624
MRRSWILHELCEFVSAEGDVWTYEKRCICSGIDKTKGEQEYAKLRIPGAGCLLQPIECLFEATNMIRKVFVDKTRWLYHEDFLLKCPLKKCIVDIKLTYGPPLTNYKS

SEQ ID NO: 126310 - protein, 280 aa, Glycine max
  Coding DNA Sequence Number=SeqID_34625
MGELDEVQARIKVDLEAMKEKIATMMEAMMSMKKIMEVNAAAITATSVVAKVDPTPSSSLNQINHPTSDMSKHAFLPYGLPPNFAPPSVMRPPDENVNNSTLVLIKNQQPLSNHAYVPQLMGETCEIPHHNLADFEPRLGYAVEGQAVGGVPLPNTLEGPQFLPQPQPLHFVAGRIPLAMAKKGKLDQIEERLRAVERGGSYAFANMAELCLVPDIAIPPKSKVSQHALLRACEARLTGALSKGGKMRGVATNVYLWETSEKPKETGQNENSKFGSCIYV

SEQ ID NO: 126311 - protein, 103 aa, Glycine max
  Coding DNA Sequence Number=SeqID_34626
MVIPKFKVPDFDKYKGTTCPKNHLKMYCRKMGAYAKDEIKVGLKIGKFNHPAWTNEKTGENEEGEDEGETHAVTAIPIRPSFPPTQQCHYSTLLLTYHPVIHN

SEQ ID NO: 126312 - protein, 87 aa, Glycine max
  Coding DNA Sequence Number=SeqID_34627
MGAKPLVCLLKRPVLLNLDFQDRSIRDYSSCALEQPFPCVQESPTTRDPRSLNPFSEIGRREEEISLKRDRLYNEDQSKFLIEYASG

SEQ ID NO: 126313 - protein, 34 aa, Glycine max
  Coding DNA Sequence Number=SeqID_34628
AKLHGESKVIQRCFDDNSDDDKKLKDQSKNNSTE

SEQ ID NO: 126314 - protein, 129 aa, Glycine max
  Coding DNA Sequence Number=SeqID_34629
MTPRKLPAKKSRKDKAAEGTSAAPKYDNHRFWSAEHQQRFEAIKGWSFHRERRVQLRDDEHSPRILCQCLAYTGGRAGYVILGEGSVDPFRCGCPQPVPGIPFSAGGGPGVRVWPEEDQADGFDEEAIA

SEQ ID NO: 126315 - protein, 97 aa, Glycine max
  Coding DNA Sequence Number=SeqID_34630
  Subcellular localization annotation: CTP_CleavageSite=69; ConfidenceScore=5.13e-01
IYQGNPCGVYPDLSSFTISGVYLDLSSFTGSSVYPDLSSFTGSGVYPDLSSITGSGVIQNLRSLYQTFRSYSGSHQMVITFNSDVQFRRIIYRDARN

SEQ ID NO: 126316 - protein, 140 aa, Glycine max
  Coding DNA Sequence Number=SeqID_34631
MTLLLSNILPSDRNANLPLQKYQLGSHPQDTQWTRKSPTGPWGFQLWLRASISPIGCPYPPRQGHVIIGIAPARHPVDPKKSNRVLELSSSNYGSLSVLQSVCRPQQSHQTPPTNRAFIKKYCAPRQAQGETPQQHWDGR

SEQ ID NO: 126317 - protein, 104 aa, Glycine max
  Coding DNA Sequence Number=SeqID_34632
MRQVMASFSQLQSQMQSQGTPEPLWLVLVSVDEVKDADAPVPVPTDEVSLVGQTLHTFPAWPTHLVKSLSHQVVVSPPKPPPKPDGPLNLMTLTIPELFLRPYQ

SEQ ID NO: 126318 - protein, 122 aa, Glycine max
  Coding DNA Sequence Number=SeqID_34633
MRRDEVVLLEPIVPVIHESAEAGESQLRLEAATPERTSQTPEGPLSLGMDLSFAQQVTDPPTPVQERQVDPPTPIMEMPEDPTTLVLRLSSTPPATPVLHLTDEEDMQDQDTQGTQDQPQEF

SEQ ID NO: 126319 - protein, 77 aa, Glycine max
  Coding DNA Sequence Number=SeqID_34634
MDKPKCSSPREKTSEVVTNAYLRKMLEKPKRVAKPSTRVLSESKESGRASSMLSARLALSSNSLTRAKRENGAKRDV

SEQ ID NO: 126320 - protein, 80 aa, Glycine max
  Coding DNA Sequence Number=SeqID_34635
MITKDDDKGDDKKLKDQSKNNSSDQVRIKNNSRVQDRIKRRIQDSRGKLRVKNQDSRFKISRIKRRLNQDKYEKFFSKIE

SEQ ID NO: 126321 - protein, 85 aa, Glycine max
  Coding DNA Sequence Number=SeqID_34636
KEEDKHKIYTGSATTRAYVQSPSNQPVLEISFNLVKYFTSQRSTRDYNNPQVDVPSTCTTKDVPSDVLGQRILRRGREESKEFSG

SEQ ID NO: 126322 - protein, 51 aa, Glycine max
  Coding DNA Sequence Number=SeqID_34637
MDPKRIKVIPEWPTPPSVEGRSPRYEEPRDLKSNPFQGGGNDAILPHKGIG

SEQ ID NO: 126323 - protein, 136 aa, Glycine max
  Coding DNA Sequence Number=SeqID_34638
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=86%, HitCoverage=13%, E-value=5e-10, Identity=35%"; Hit description =Gag/pol polyprotein, 3'-partial, putative
  Pfam annotation: Domain name=G-patch; Domain location=49-93; Score =27.5; E_value=4.9e-05; Accession=PF01585.14; Description=G-patch domain
EEDVLVSCPSSMPYVEAAEESLETAFQSFEVVSIASIDSLSGQPCLSDTVMMVARVMLGYGYEPGMGLGRNNGSRTSLVSTRGNRGKFGLGYKSTQADIRKSLRHEGQVTAICEDDSPRRSDLVWLCPPSFQLGNW

SEQ ID NO: 126324 - protein, 41 aa, Glycine max
  Coding DNA Sequence Number=SeqID_34639
MAFHWKELERRIDVIPGGEEFESRSKGSTTLRAIGLRSTPN

SEQ ID NO: 126325 - protein, 73 aa, Glycine max
  Coding DNA Sequence Number=SeqID_34640
ETKDIELVEEEEARIGANSSSATCNKYENYKEEPRNAAQKHKAKRVESVNVDVEAFGDHWKVQIAKCILKLKH

SEQ ID NO: 126326 - protein, 56 aa, Glycine max
  Coding DNA Sequence Number=SeqID_34641
  Subcellular localization annotation: CTP_CleavageSite=31; ConfidenceScore=5.06e-01
MSAFTFSCTSSALPITLALAQVRFSTWSMISCQGGTGSNRDIDIPKMCLAVNEAAM

SEQ ID NO: 126327 - protein, 112 aa, Glycine max
  Coding DNA Sequence Number=SeqID_34642
MEIIIYVPPITCDLCRREHYQDNCYMYSTSNFGWREELTPYNQYEDERVPNLDIVFAEFMAYHASSKDTIGSIQWAFKSVEIQVGKLVEEVTQAMSRREEEIVEVDTQRRAL

SEQ ID NO: 126328 - protein, 65 aa, Glycine max
  Coding DNA Sequence Number=SeqID_34643
MFAYSPFAKRKPCAKHIFGHALSREFLALSAQPLHLRLIWSAKLAKAELSPFQFDLNWAKRRPAR

SEQ ID NO: 126329 - protein, 51 aa, Glycine max
  Coding DNA Sequence Number=SeqID_34644
MGSKIYPEVHENPKAFFINSSPILLEPLAHGSGDDTSRNHQERYDYLGGYH

SEQ ID NO: 126330 - protein, 169 aa, Glycine max
  Coding DNA Sequence Number=SeqID_34645
CVIDYTEEWVTGNRLPGMKSLEIPLLLACSGYETHCVAAELGRPSKATRGAGFRGPIRFTTTSLVHPDEPVRTLQRTVEWILPMPTPYRLVELVQVIEVTSSEEDPEEDLEELPPEPAVDALDFLEGDEDPLLEVDSPKEVMSASEADSTEDSGPGEMAISGGSSSQWT

SEQ ID NO: 126331 - protein, 84 aa, Glycine max
  Coding DNA Sequence Number=SeqID_34646
MAYTNWHLGSGRSELWLLGKTLLSSSVIHIWVKIVMMVRMIRTRLPATVRVKSCPGSLDVLMPASYLSLEVGVLVFPELDMPLP

SEQ ID NO: 126332 - protein, 94 aa, Glycine max
  Coding DNA Sequence Number=SeqID_34647
  Homolog annotation: Hit_ID=A5C693; Match level="QueryCoverage=62%, HitCoverage=26%, E-value=3e-08, Identity=45%"; Hit description =Putative uncharacterized protein
MVSLDTLSSKVFQEQDIHDDDEDQVNLYLMTKSDENNKEDSVRKTWYIDSGCSKHMTSDVSKFTTISPKKSGHVTYGDNNISKISKEATSKPSL

SEQ ID NO: 126333 - protein, 115 aa, Glycine max
  Coding DNA Sequence Number=SeqID_34648
MERSVIDAASGGALGVHEVATDSSSSTENKKLEGKLDALVNLVTQLAMNQKSTPVARVCGLCSSADHHSDLCPSLQKFGVNEQPEAYAANIYNRPPQQQNQQQNNYDLSSNRYNP

SEQ ID NO: 126334 - protein, 53 aa, Glycine max
  Coding DNA Sequence Number=SeqID_34649
MAPKKLSMKRSRRDVAAEGPSATPEFDSHRFRSAEHHQRFEAIKGWSFHRERH

SEQ ID NO: 126335 - protein, 320 aa, Glycine max
  Coding DNA Sequence Number=SeqID_34650
  Homolog annotation: Hit_ID=Q84VH5; Match level="QueryCoverage=100%, HitCoverage=51%, E-value=1e-132, Identity=72%"; Hit description =Envelope-like protein
  Subcellular localization annotation: CTP_CleavageSite=21; ConfidenceScore=5.23e-01
MATSPKDTSSPGSPFVPSSPSSTKAPSNQEQPEFHIQPIQMIPGQAPVPEKLVPKRQQGVKISENPSLATSPREVDTEMDKKIRSIVSSILKNASVPDADKDQREINRGRGSSHRGDPAPRAPEPAPGDLIDLEEVESDEEPIANKLAPGIAERLQAEKGKPPLLGLGRIKTMAQKKSTPITPTTSRWSKVAIPSKKRKEISSSDSDDDVELDVLDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDDYQKV

SEQ ID NO: 126336 - protein, 23 aa, Glycine max
  Coding DNA Sequence Number=SeqID_34651
MGFSRNFLKEASQGSVSRKLLKE

SEQ ID NO: 126337 - protein, 224 aa, Glycine max
  Coding DNA Sequence Number=SeqID_34652
  Homolog annotation: Hit_ID=UPI0000ECBAF8; Match level="QueryCoverage =18%, HitCoverage=48%, E-value=3e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTLMEADIPLGWKPLNLERYDGTTDPNEHLDAFLTQANLYTNDDVTLCRMQAWHWPSFYNVVTGKTLALPNLIALQHIPLSPAGVIAKRPAPIALPNSCAA

SEQ ID NO: 126338 - protein, 34 aa, Glycine max
  Coding DNA Sequence Number=SeqID_34653
MADQQTTKSKAKAQDVKEALLGGNLVPFKSMLVI

SEQ ID NO: 126339 - protein, 80 aa, Glycine max
  Coding DNA Sequence Number=SeqID_34654
MTSPSMPCGNDSSGITAFYHNDAVHRSNDFVDWILLDCLRLHCVCLGSYSSTLYRESMTIHSYYFDIKEEFDPMLDFCPS

SEQ ID NO: 126340 - protein, 698 aa, Glycine max
  Coding DNA Sequence Number=SeqID_34655
  Gene Ontology: Mol. function=calcium ion binding; Cellular component =extracellular region; Biological process=pathogenesis
  Homolog annotation: Hit_ID=Q8XQP2; Match level="QueryCoverage=95%, HitCoverage=85%, E-value=5e-88, Identity=32%"; Hit description =Probable hemagglutinin/hemolysin-related protein
MANITAADNATVISTKDQFYKWIDKSVAGANGGKLEITIDGEVHMVDISEDGKWSFDPKTSWLDGTHVIQLVSIDKATNPSPPRIFILDMDTTPPAKPEIWRVIDDAAAEDHYLTPGEATSDKTPALAGVAEPGTIVTLYDNGKEIGSVVADKMGAWSITPELADGEHQLTVMAKDTVGHESPISDAFNLTIADGVVTQAVNEAVSVTPAESTTMDAVPFPGKPIKTINKNIISLSADNAEPNALVQIVIDQTVYTTRADASGKWQFDSPEMKEGLHVAGIRYLDRAGNWGPSTQLIRNIDTSAPEAPQIMRVIDNEGSADTYLTPGNYTNDKTPTLYGVAQPDSVVKIYDIRSNVIGSVKAGADGRWSFTPELTTDGTHVFSASYTDRFGAESPRSDNFALTLDTSVPGTPSLSEVLDDEGRVTGPLKSGDITDDKTPTLSGKADAGVIVRVWDGDKLIGSTKADNRGEWKLDVELGEGEHSLVVDSISKGGTVSEKTDPFKLVIDSNILPAPVVDEMVANNGDEERVLQPGDSTNDTTPVLRGEGNDGDIIYVIVDGEKEPVASTVVKDGKWEIELPELAEGSHDIELIAKDPATGKESPTSDPINVIIDITPPDQPQPPTIVDNEGDNTGPVEPGKPIDDNRPGFGGEGGTPGDKVEVIIDDGKGNPVVIGTGIVGEDGKWEVKPENPIDDGNYQ

SEQ ID NO: 126341 - protein, 625 aa, Glycine max
  Coding DNA Sequence Number=SeqID_34656
  Gene Ontology: Mol. function=calcium ion binding; Cellular component =extracellular region; Biological process=pathogenesis
  Homolog annotation: Hit_ID=Q8XQP2; Match level="QueryCoverage=68%, HitCoverage=85%, E-value=3e-49, Identity=30%"; Hit description =Probable hemagglutinin/hemolysin-related protein
MNVSPVSVAVIDKKTITKAEVLRAGKDGKAVKIQAITNGKYLLTQNQDGTAPENITVKRAGKNLLVMLEGSDASKPDLIIEDFFAKSGTLVGKAEDGEMHAYVATDGNADHEAAALADGETTALALGEGSVDDNSGYALASGFEWSPALIALGGLAAIAAAAGLGYVAAKHHYDNNDGSHSGKGEGGGGSGGGDISKPTISDVIDDIGDVTGSVANGGRTDDTMPTFNGTGTPGNTIEIWDGETLLGEVLVDDEGNWTFTPEKPLAAGNHSIVTAERNAEGVVGEESDPWEFIIDLTAPAKGTIGSVMDDMQDPPVLIEKGGVTKDNTPTLTGKAEAGSTVEIWNDGVKLGTAKVDAEGNWTFTAPALQDGRHELSIVVVDQVGNKSLPSDPFIVDVDTVAPENPGIGVIKDSEGNPLEDGSTTKDLRPTLEGSGQRWRYRGDYRQRQANWFENNLQPGEHELEIVVRDPAGNESPASDKVTIGFEGDTQVPVDPEPVDGLPDPDVPVSGVIEHIFKDNNDAGVRTPIENGGAMNDPSIIVSGKGAPGELVTIYIVGLENSYSFTTTIGADGKWELTTTDLADDIYQLRGVFSSDGEVTGKTDIYEVEVDTIPPPPPEINALELP

SEQ ID NO: 126342 - protein, 631 aa, Glycine max
  Coding DNA Sequence Number=SeqID_34657
  Gene Ontology: Mol. function=DNA topoisomerase (ATP-hydrolyzing) activity; Cellular component=chromosome; Biological process=DNA topological change
  Homolog annotation: Hit_ID=P0A2I6; Match level="QueryCoverage=99%, HitCoverage=99%, E-value=0.0, Identity=90%"; Hit description=DNA topoisomerase 4 subunit B
  Pfam annotation: Domain name=DNA_gyraseB; Domain location=219-387; Score=207.6; E_value=3e-59; Accession=PF00204.16; Description=DNA gyrase B
  Pfam annotation: Domain name=DNA_gyraseB_C; Domain location=552-621; Score=108.3; E_value=2.4e-29; Accession=PF00986.12; Description=DNA gyrase B subunit, carboxyl terminus
  Pfam annotation: Domain name=HATPase_c; Domain location=28-173; Score= 93.5; E_value=6.7e-25; Accession=PF02518.17; Description=Histidine kinase-, DNA gyrase B-, and HSP90-like ATPase
  Pfam module annotation: Pfam domain module=DNA_gyraseB::DNA_gyraseB _C::HATPase_c; Domain location=219-387::552-621::28-173
MSQSSYNADAIEVLTGLEPVRRRPGMYTDTTRPNHLGQEVIDNSVDEALAGHAKRVEVILHADQSLEVIDDGRGMPVDIHPEEGVPAVELILCRLHAGGKFSNKNYQFSGGLHGVGISVVNALSKRVEVTVRRNGEIYQIAFENGDKVQDLAVIGTVGKRNTGTSVHFWPDESFFDSPRFSVSRLKHLLKAKAVLCPGVEIVFKDKVNDTEQTWLYQDGLTDYLSEAVNGLPTLPEKPFVGSFAGDVEAVDWALLWLPEGGELLTESYVNLIPTMQGGTHVNGLRQGLLDAMREFCEYRNILPRGVKLSAEDIWDRCAYVLSVKMQDPQFAGQTKERLSSRQCAAFVSAVVKDAFSLWLNQNVQAAEMLAELAISSAQRRMRAAKKVVRKKLTSGPALPGKLADCTAQDLNKTELFLVEGDSAGGSAKQARDREYQAIMPLKGKILNTWEVSSDEVLASQEVHDISVAIGIDPDSEDLSQLRYGKICILADADSDGLHIATLLCALFVRHFRSLVQQGHVYVAMPPLYRIDLGKEVYYALDEDEKEGVLEQLKRKKGKPNVQRFKGLGEMNPLQLRETTLDPNTRRLVQLTVDEEDVEQTLRMMDMLLAKKRSEDRRNWLQEKGDLADLEV

SEQ ID NO: 126343 - protein, 334 aa, Glycine max
  Coding DNA Sequence Number=SeqID_34658
  Gene Ontology: Mol. function=hydrolase activity
  Homolog annotation: Hit_ID=Q6DAC2; Match level="QueryCoverage=58%, HitCoverage=70%, E-value=8e-80, Identity=70%"; Hit description=CAMP phosphodiesterase
  Pfam annotation: Domain name=DUF1249; Domain location=1-129; Score =259.9; E_value=5.3e-75; Accession=PF06853.3; Description=Protein of unknown function (DUF1249)
  Pfam annotation: Domain name=Metallophos; Domain location=150-329; Score=44.8; E_value=3.1e-10; Accession=PF00149.19; Description =Calcineurin-like phosphoesterase
  Pfam module annotation: Pfam domain module=DUF1249::Metallophos; Domain location=1-129::150-329
MMRLCETNFAQLRRLLPRSDEAGASVMYQVNGASYQLTIEESTRYTTLVEIRQVAPAVSYWSLPSMSVRLYHDAMVAEVCSTQQIYRFKARYDYPNKKLHQRDEKHQINQFLADWLRYCLAHGAMAVPRGEKGNALDSLLTLPAANGSDIRILQITDTHLFAGKHQSLLGVNTWSSFDAVLDAIAAQQRDYDLIIATGDLAQDHTVEAYQHFVAGIARLPKPCVWLPGNHDFQPAMVDTLAQAGIAADKHVLLGEHWQLVLLDSQVPGVPHGMLSDYQLEWLDRTLRQFPDRYTLVLLHHHPLACGCTWLDQHSLRNPHQLDAVLQNFPLARYL

SEQ ID NO: 126344 - protein, 457 aa, Glycine max
  Coding DNA Sequence Number=SeqID_34659
  Gene Ontology: Mol. function=ligase activity; Biological process =intracellular signaling cascade
  Homolog annotation: Hit_ID=A7MJT4; Match level="QueryCoverage=54%, HitCoverage=63%, E-value=1e-118, Identity=80%"; Hit description =Putative uncharacterized protein
  Pfam annotation: Domain name=GSP_synth; Domain location=201-457; Score=334.6; E_value=1.7e-97; Accession=PF03738.5; Description =Glutathionylspermidine synthase
MKIMKRTKNIRHAAFRKSWQARHLTPVALAVTAVFMLAGCEQSDETVSMYQNADDCAKANPGQSAQCTTAYNNALKEAERTAPKYATREDCVAEFGENQCQQTPAQAGVGTTANNAEAQQSGSFWMPLMAGYMMGRLMGGGAGFAQQPLFSPKTPNSPANGQFVDASGKNYDGSQTEHHAAQQCHQHRQPLAGRLSPRMQRIAISERPNWREKATEYGFQFHTMYGEPYWCEDAYYQFTLAQIEQLEAATAELHQMCLQAVEKVVNSEALLTRFCIPKHTWDFVRESWQQRQPSLYSRLDLAWDGTGEIKLLENNADTPTSLYEAAFFQWIWLEDQLNAGNLPQSSDQFNSLQEQLIERFATLHQQHGFNWLHFACCRDTEEDRATVQYLQDCATEAGLPSEFLYIDEIGLGEKGQFTDQHDQVISNLFKLYPWEFMLREMFSTKLADARRALAGAG

SEQ ID NO: 126345 - protein, 829 aa, Glycine max
  Coding DNA Sequence Number=SeqID_34660
  Gene Ontology: Mol. function=[glutamate-ammonia-ligase] adenylyltransferase activity; Cellular component=intracellular; Biological process=regulation of transcription, DNA-dependent
  Homolog annotation: Hit_ID=A6TE32; Match level="QueryCoverage=98%, HitCoverage=91%, E-value=0.0, Identity=64%"; Hit description =Glutamate-ammonia-ligase adenylyltransferase
  Pfam annotation: Domain name=GlnE; Domain location=2-167; Score =225.3; E_value=1.4e-64; Accession=PF03710.6; Description=Glutamate -ammonia ligase adenylyltransferase
  Pfam annotation: Domain name=GlnE; Domain location=442-696; Score =501.8; E_value=7.9e-148; Accession=PF03710.6; Description=Glutamate -ammonia ligase adenylyltransferase
  Pfam module annotation: Pfam domain module=GlnE::GlnE; Domain location=2-167::442-696
STGQSLTQLSTLAEVLITAARDWVWQDCCRDFGTPCNAAGEAQPMLILGMGKLGGGELNFSSDIDLIFAWPENGVTHGGRRELDNAQFFTRMGQRLIKVLDQPTVDGFVYRVDMRLRPFGDSGPLVLSFAALEDYYQEQGRDWERYAMVKARLMGDDGGHWSQELQQMLRPFVYRRYIDFSVIQSLRNMKGMIAREVRRRGLKDNIKLGAGGIRETEFIVQVFQLIRGGRERSLQLRSLLPTLQAIGELALLTPEQVDHLRAAYLFLRRLENLLQSINDEQTQTLPENPLDRQRLAWAMGMADWAMLLAQLEQHMAGVRHIFDELIGDDAPDVDDQPQLAEFASLWQDALEESDLLPVVPQLQAEQRHALYRALNDFRQDVSRRTIGPRGRLALDQLMPRLLSEVCARDDADVVLARLTPLLLGVLTRSTYLELLTEYHGALRHLIRLCGASPMIASQLARYPLLLDELLDPATLYQPTATDAYRDELRQYLLRIPTDDEEQQLEALRQFKQAQHLRIAAADIAGTLPVMKVSDHLTWLAEAIIESVVQQAWQMMVQRYGRPSHLTSDSERGFAVVGYGKLGGWELGYSSDLDLVFLHDCPDDAETDGERVIDGRQFYLRLAQRVMHLFSTRTSSGILYEVDARLRPSGAAGMLVSTFAAFDDYQRHEAWTWEHQALVRARIVFGEPALCERFDAIRRGILCLPREGAKLQTEVREMREKMRAHLSNKHKGRWEIKTDEGGYAASQPALTRWSDNVRIFELMARHGIMADEEAQALTHAYVTLRDALHHLALLELPGRVDPASFADERAVVHASWQRWLAASDADDTEQ

SEQ ID NO: 126346 - protein, 405 aa, Glycine max
  Coding DNA Sequence Number=SeqID_34661
  Gene Ontology: Mol. function=O-sialoglycoprotein endopeptidase activity; Cellular component=extracellular region; Biological process=proteolysis
  Homolog annotation: Hit_ID=Q57JQ1; Match level="QueryCoverage=69%, HitCoverage=94%, E-value=1e-125, Identity=73%"; Hit description =Probable O-sialoglycoprotein endopeptidase
  Pfam annotation: Domain name=Peptidase_M22; Domain location=50-304; Score=188.3; E_value=1.9e-53; Accession=PF00814.16; Description =Glycoprotease family
TMDNLEPTGAFACAAAGVSRPVLHCAPQEEGDKAMRVLGIETSCDETGIAIYDDASGLLANQLYSQAGEIDAVAYTAGPGLVGALLVGATIGRALAFAWNVPAVPVHHMEGHLLAPMLEDNPPAFPFVALLVSGGHTQLISVTGIGEYTLLGESIDDAAGEAFDKTAKLLGLDYPGGPMLSRMAQQGTPDRFKFPRPMTDRPGLDFSFSGLKTFAANTIREHDGDEQARADIARAFEDAVVDTLMIKCKRALEQTGFKRLVIAGGVSANRTLRERMATMMSARGGEVFYARPEFCTDNGAMIAYAGMVRLKGGTRAAEQYRQQPGAGHQAGQVPANRRDGAKRGGHTFAAAKAEKHRIDMAEAGGDGREAKIHRRDVQPPGDPHRHHSLCHVENQYRGGGGFTAN

SEQ ID NO: 126347 - protein, 116 aa, Glycine max
  Coding DNA Sequence Number=SeqID_34662
  Homolog annotation: Hit_ID=A5AUB4; Match level="QueryCoverage=65%, HitCoverage=7%, E-value=8e-07, Identity=38%"; Hit description =Putative uncharacterized protein
MIIIINAEACGYVSMNYYQYIDVVYTNEHILKAYSAQWWPLGNEAAIPPSDDAWTLIPDPTTIRAKGRPKSTRIRNEMDWVEPSEHRQNVVDVEPKVITGVAVQCNLSMEVVQIID

SEQ ID NO: 126348 - protein, 138 aa, Glycine max
  Coding DNA Sequence Number=SeqID_34663
  Gene Ontology: Mol. function=amino acid transmembrane transporter activity; Cellular component=integral to membrane; Biological process=amino acid transport
  Homolog annotation: Hit_ID=A1FXY8; Match level="QueryCoverage=99%, HitCoverage=28%, E-value=1e-70, Identity=97%"; Hit description =Arginine/ornithine antiporter precursor
  Subcellular localization annotation: CTP_CleavageSite=35; ConfidenceScore=5.26e-01
MAATSQRLGLPALTALVVGSMVGAGIFSLPQNVARSAGPAAALIGWAVSGAGMLMLAFVFQALANRRPDLDTGIYAYAREGFGNYIGFSAAWGYWVASVLGNASFFALIFSGLGHFMPVFGEGNTPAAVTASSLLLWT

SEQ ID NO: 126349 - protein, 131 aa, Glycine max
  Coding DNA Sequence Number=SeqID_34664
MDKLQRLKQESMNVEEYRQQMELLLLRVGLREEKRTSIARFFSGLNMEVRDKESQAQGILGAAPSKPKEDKGKTIEKTMILRGQDIYSSQEETTSSSSSSGSEDEVRGEESSEEVYPHEEDDLLMVRRLLG

SEQ ID NO: 126350 - protein, 102 aa, Glycine max
  Coding DNA Sequence Number=SeqID_34665
RGYISCGSVLVEGTSTRFKENKGGNYEEIVGDLTDGVEETGDTRGTDESADMTMDDRGGELNAGFDEQGVTLQNMDTQDTVLPSISLTEPLLGRELLVVIYD

SEQ ID NO: 126351 - protein, 63 aa, Glycine max
  Coding DNA Sequence Number=SeqID_34666
ICCSKFNCAHFHRWDLRDNIRGGRKRNRMKTVQVEASISSPSLTLENSIGAVRGKTGGISGNR

SEQ ID NO: 126352 - protein, 207 aa, Glycine max
  Coding DNA Sequence Number=SeqID_34667
MPSPSEGYKTSPSEDKHVLAFRGLHVLAFRGLHVLAFRELHASPSEGYTSSPSEGYTLAFRGLHVLASQDYTPSEDFTSSPSEGYTLLALEGYYTSSAFRALHVLALEGYTRSLVEDYSRTTRPSPSEGYTPSPSRGLHALAFRGLHVLAFRGLHFLAFRGLHVLAFRGLHALRFQRTTRPRIQRATRPRHQMVAVPSPSEDYTPSI

SEQ ID NO: 126353 - protein, 159 aa, Glycine max
  Coding DNA Sequence Number=SeqID_34668
  Subcellular localization annotation: CTP_CleavageSite=36; ConfidenceScore=5.14e-01
MSISPCGSISWSVSSRHRDRGHKTPSGPGGAQQGPRVSSSGYGPLDHARKTLSGPGEVQQGPGVSSSDYGPLSVLRSACHPQQGHQAPYQPSFHQEVLCPQVGAGRDTTAARGWPTAGNRRIAATSRAPQLIYKGWSVAYDPLPTSGRPSPKPKISKST

SEQ ID NO: 126354 - protein, 90 aa, Glycine max
  Coding DNA Sequence Number=SeqID_34669
QAQEVALVCIKRLLKRLALTDPLKLLQEHNKGKGNFTKEKKHRVVTMLELNMRYPSHEKKHRLLTMLECDEHDARPYTKRWSDGEHTTSR

SEQ ID NO: 126355 - protein, 208 aa, Glycine max
  Coding DNA Sequence Number=SeqID_34670
  Subcellular localization annotation: CTP_CleavageSite=72; ConfidenceScore=5.77e-01
MPLPEASRIRCSAFGSSTGATPCNSAAKSTARHSARCVAAAPPLLSARSRSAGMGVLMRRLPARCPCAARPYAAAVTAAARLGQTLARCGQHDLQTTAILVIAAPLQQAFALQAIEQAADGGPGHASALGQRVRRQCAAGPVQQEQHDEATLAEPVRCQPCSAVAIDRRGQREQLEAQAQLRDVGVAAPLCFLQQRLMLGFDHPSLAA

SEQ ID NO: 126356 - protein, 151 aa, Glycine max
  Coding DNA Sequence Number=SeqID_34671
  Homolog annotation: Hit_ID=Q6WAY6; Match level="QueryCoverage=98%, HitCoverage=29%, E-value=5e-09, Identity=28%"; Hit description =Putative uncharacterized protein
MGTRGCISYNPVLAIRQLGYPMRGAPLEEELAPVISRGFNKTNVETLQKVRKAWEVVQKKDKELRGSNNGPIGGYQRWLKAYVQATTKALEQETKRARREEHGRNKFRGALWGSNNELKLRREERDQSRVHGMVLKKELAACSRSKKRLAQ

SEQ ID NO: 126357 - protein, 124 aa, Glycine max
  Coding DNA Sequence Number=SeqID_34672
  Homolog annotation: Hit_ID=Q6WAY4; Match level="QueryCoverage=83%, HitCoverage=18%, E-value=3e-08, Identity=31%"; Hit description =Putative uncharacterized protein
MVEVSVEATASLTQYYDQPLRCFTFGDFQLVPTVEEFEEILGCPLGGRKPYLFSGFYPSMERVAKVVKISVQELDRVKQNRNGAVEIPRKHLEEKAKALANQGTADIWSRPLSKCGGFSGPSSD

SEQ ID NO: 126358 - protein, 25 aa, Glycine max
  Coding DNA Sequence Number=SeqID_34673
MLNTSSKRHVRRYMEKNEETTMEEK

SEQ ID NO: 126359 - protein, 148 aa, Glycine max
  Coding DNA Sequence Number=SeqID_34674
  Subcellular localization annotation: CTP_CleavageSite=60; ConfidenceScore=5.26e-01
MSVGSLMGSTERSWTSTSDHAIPVSCAGGLLLFITNRRGSCGSLATRKPFLLLMSIHGSRMMIYTAGGCTTRIISFQQAPQTDIPRVPEPEASLTSAVEPRHVVEVCDDIAERLERHLSLGVVTPGSSTHEVIEECLRSRRRRRTDQE

SEQ ID NO: 126360 - protein, 68 aa, Glycine max
  Coding DNA Sequence Number=SeqID_34675
MKMILIPHDASSIGASEWRRKRARRRHFKEKMSLEEAHHHRRPWIRAWRKKEMNEGRGREEHEILCSK

SEQ ID NO: 126361 - protein, 118 aa, Glycine max
  Coding DNA Sequence Number=SeqID_34676
  Gene Ontology: Cellular component=cytoplasm; Biological process =embryonic development ending in birth or egg hatching
  Homolog annotation: Hit_ID=Q94IP9; Match level="QueryCoverage=44%, HitCoverage=10%, E-value=5e-20, Identity=88%"; Hit description=WD-40 repeat protein
  Pfam annotation: Domain name=WD40; Domain location=72-110; Score =26.5; E_value=9.9e-05; Accession=PF00400.23; Description=WD domain, G-beta repeat
MASNKRHFTEEDDDPHSFSKKSKESESESDASPSSLRIFLNPADYDLGIHSHFTIILVWDYISGKLKKDLQYQADEVFMMHDDVVLCVDFSTDSEMLSSGSQDGKIKVCTAHIALIFL

SEQ ID NO: 126362 - protein, 115 aa, Glycine max
  Coding DNA Sequence Number=SeqID_34677
  Gene Ontology: Cellular component=chloroplast thylakoid membrane
  Homolog annotation: Hit_ID=A7PEX9; Match level="QueryCoverage=88%, HitCoverage=26%, E-value=4e-39, Identity=76%"; Hit description =Chromosome chr11 scaffold_13, whole genome shotgun sequence
MTTPVFTQANDADLSKLSIQIVLPFDKETESLPNPNQETARLRKVEGGIVAIMKFSGKPTEDIVREKEKTLRANIIKDGLKPQPGCLLARYNDPGRTWTFIMVCCKTCLSVSVDF

SEQ ID NO: 126363 - protein, 205 aa, Glycine max
  Coding DNA Sequence Number=SeqID_34678
MRDQDIYSSQDEATTSPSSSESEEEKGEESSVEIYHQEDGQPLVVKEKCKEVSVSSKRLAKKENHFTIKTNIKETFPLRQPPHFLFCKKTLASNATPLVGLEFIPQVKKLLDEGLVRKSLNPCALLVPKIGIIRHQVPNIGAPLIELVRNHVPSWEDAQEMGFQTLPYFNFPYTTNIRLQEDWAKDAREGPKVLMSLRVDFGLVG

SEQ ID NO: 126364 - protein, 78 aa, Glycine max
  Coding DNA Sequence Number=SeqID_34679
DDKGDDKKLKDQSKNNSSESKINQRTTQVNQEEFKTQEESLESRIKIQGSRSQESRIKIQGSRSQESRSRFKNQEKAQ

SEQ ID NO: 126365 - protein, 47 aa, Glycine max
  Coding DNA Sequence Number=SeqID_34680
WAKHASTAKRSFNALSVIEESGRASISRWHAKRKISALSAAIVFSQA

SEQ ID NO: 126366 - protein, 670 aa, Glycine max
  Coding DNA Sequence Number=SeqID_34681
  Gene Ontology: Mol. function=cation transmembrane transporter activity; Cellular component=integral to membrane; Biological process=potassium ion transport
  Homolog annotation: Hit_ID=P0AGJ0; Match level="QueryCoverage=41%, HitCoverage=60%, E-value=1e-130, Identity=88%"; Hit description=Trk system potassium uptake protein trkA (K(+)-uptake protein trkA)
  Pfam annotation: Domain name=F420_oxidored; Domain location=57-247; Score=-41.9; E_value=0.0043; Accession=PF03807.8; Description=NADP oxidoreductase coenzyme F420-dependent
  Pfam annotation: Domain name=MscL; Domain location=283-413; Score =210.1; E_value=5.3e-60; Accession=PF01741.9; Description=Large -conductance mechanosensitive channel, MscL
  Pfam annotation: Domain name=Shikimate_DH; Domain location=40-164; Score=-14.4; E_value=0.0036; Accession=PF01488.11; Description =Shikimate  quinate 5-dehydrogenase
  Pfam annotation: Domain name=TrkA_C; Domain location=2-49; Score =10.0; E_value=0.22; Accession=PF02080.12; Description=TrkA-C domain
  Pfam annotation: Domain name=TrkA_C; Domain location=206-275; Score =41.9; E_value=2.2e-09; Accession=PF02080.12; Description=TrkA-C domain
  Pfam annotation: Domain name=TrkA_N; Domain location=58-173; Score =130.8; E_value=3.8e-36; Accession=PF02254.9; Description=TrkA-N domain
  Pfam module annotation: Pfam domain module=F420_oxidored::MscL::Shikim ate_DH::TrkA_C::TrkA_C::TrkA_N; Domain location=57-247::283-413::40 -164::2-49::206-275::58-173
MPHIDTRVAAIFRQDRPIRPQGSTIVEAGDEVFFIAASQHIRAVMSEMQRLEKPYKRIMLVGGGNIGFGLAQRLEKQYSVKLIERNQQRAAELAEHLQDTIVFYGDASDQELLAEEHVDQVDLFIAVTNDDEANIMSAMLAKKMGAKKVMVLIQRRAYVDLVQGSVIDIAISPQQATISALLGHVRKADIVGVSSLRRGIAEAIEAIAHGDETTSRVVGRLIEDIKLPPGTIIGAVVRGDDVIIANDNVRIEQGDHVIMFLTDKKFVPDVEPIGQGKEITMSLFKEFRDFAMRGNVVDLAVGVIIGAAFGKIVSSLVANIIMPPLGLLIGGVDFKQFKWVLKPAEGDIPAVVMEYGNFIQTVFDFIIVAFAIFIAIKVMNKLRPEVSTVAYRWPPDSLPSHVYLYAGSCLSPSDCAQHAGDTADRVTGLPGLPARQNSILATTNFRMRIFAGFQRLEDRTAGATVPVATTGVMLWINTDRQQVADRFQAETKLPAVTDKTQALQIVIAVQAEAALGAYLMIHHLLLFIKADGVRRHVRQFCQLANAIHTISPAVAADRSPGGIRHAENRCSCQPAVASLPAAIEFAKQIAQCQRVAAHLQFRREIAGVFQQSPGAAQFRRHTTVIIQRERRTLTRQIAQLTLFLRGADVLLSQLIDKPHRNLLQACLPTA

SEQ ID NO: 126367 - protein, 44 aa, Glycine max
  Coding DNA Sequence Number=SeqID_34682
MVGHITLPPTPFLLIPKLVEVRIRDKNKDLDLGIQAFGFECKKA

SEQ ID NO: 126368 - protein, 141 aa, Glycine max
  Coding DNA Sequence Number=SeqID_34683
MIGQEGKELRRTGGPHFVQVQNKHAFLPYGLPPNYTPPNVAHALDENANNSTPIPIESQQPQSDHAHVSQPMGETHKIPYHILSDFEPCLGYATEGQAVGGVPLPNTLDGPQFRPQPQPLHFAIGRVPPAMVEKGRLDHIE

SEQ ID NO: 126369 - protein, 40 aa, Glycine max
  Coding DNA Sequence Number=SeqID_34684
MENKMRNKSRTVEWRRKKDDWRCHFKEKMSQEQAHHHKKA

SEQ ID NO: 126370 - protein, 234 aa, Glycine max
  Coding DNA Sequence Number=SeqID_34685
SNTSRLGFPTLITALCGARGVVSDSLTFERLSPVINLAYIRKNCWNPEDLTIFIRGARRARARLTELPSTSIAPTPASTSVAPSVPAKTNSQCFKAMLQSIHQGQIILLQSLQMMAPPDSIPIVPQHMEDESSEATIPEPFDIGKEAEEIQVRQVAATTLERFLEATSEPSAPVVNLPSPQPVAEPSTPLLQMPEDPTTPVLDLDTSPPITPVLQLTDEEDGQTQDAQDQSQEF

SEQ ID NO: 126371 - protein, 358 aa, Glycine max
  Coding DNA Sequence Number=SeqID_34686
  Gene Ontology: Mol. function=glycerol kinase activity; Cellular component=mitochondrial outer membrane; Biological process=glycerol -3-phosphate metabolic process
  Homolog annotation: Hit_ID=Q848P3; Match level="QueryCoverage=90%, HitCoverage=64%, E-value=1e-145, Identity=78%"; Hit description=GlpK
  Pfam annotation: Domain name=FGGY_C; Domain location=115-349; Score =144.2; E_value=3.6e-40; Accession=PF02782.7; Description=FGGY family of carbohydrate kinases, C-terminal domain
  Pfam annotation: Domain name=FGGY_N; Domain location=1-112; Score= -85.5; E_value=0.00015; Accession=PF00370.12; Description=FGGY family of carbohydrate kinases,
  Pfam module annotation: Pfam domain module=FGGY_C::FGGY_N; Domain location=115-349::1-112
MRWLLDATPDGYQLAARGERCLGTIDSWLLWNLTGGQSFFCDYSNAARTQLLNLHRGEWDDEMLTLFGIPRAALPEIKPSSGLFGYTKGLAAIPDGIPVMAMIGDSHAALFGHALGEAGCVKATYGTGSSVMAPVQSAQCDIAALATTVAWHDGDRLVWGLEGNIPHTGDAVAWMADSTGLSELSAADLAHELNTLPASVDSTLGVYFVPALTGLGAPWWDDSARGVICGLSRGVKRAHLIRAALESITYQIADVVAAMRQHAEFTLTALMVDGGPTNNNWLMQYQADLLGCPVMRSDIPELSAIGAALLARKALTPGETADLQALFNRTQRFSTRHGPPPATTAALAGVAPCVNRTL

SEQ ID NO: 126372 - protein, 65 aa, Glycine max
  Coding DNA Sequence Number=SeqID_34687
MRHQIPMIGGMMNVLSGATLFGKIIHASNIFMINIYRDLLGVEEKKPRVSRTSGFEAKSFSRGRE

SEQ ID NO: 126373 - protein, 113 aa, Glycine max
  Coding DNA Sequence Number=SeqID_34688
MKKRDTGHQSVSLENKTRDSTVLKIGDSTKVVIKQDMKGRRHKYGFNNNKREKLEKIMGSPPASPPPPPPPLSLPPPPAPSDASASPSAMKRTRKASHLRSLSTRPPGAERPV

SEQ ID NO: 126374 - protein, 73 aa, Glycine max
  Coding DNA Sequence Number=SeqID_34689
MSKHIWTYEITQAMLGAPYPLGIGDKYIVQPWYKFLQEGDFSHGDELSFYYRRDEKIWEVVIRRAIDWDDNDM

SEQ ID NO: 126375 - protein, 189 aa, Glycine max
  Coding DNA Sequence Number=SeqID_34690
  Homolog annotation: Hit_ID=A5W9H5; Match level="QueryCoverage=31%, HitCoverage=21%, E-value=2e-25, Identity=100%"; Hit description=CBS domain containing protein
  Subcellular localization annotation: CTP_CleavageSite=41; ConfidenceScore=5.24e-01
MRKPRKWKAWNGNCWQNWVTPTLMPTMKPTQSHTDTRRITRTAMSEDRSSNGQKSWLGKLTQAFAHEPKNRQELLELLREAHQNKLLDSEALTIVEGAIQVAVFSCARHHGAALADDQHQGQPVATRVPAGGDRRRALALPGNRRKPRRCAGDPARQGPAAADPQGERRQLQHQRTCCARPPSCPSPSA

SEQ ID NO: 126376 - protein, 95 aa, Glycine max
  Coding DNA Sequence Number=SeqID_34691
MAFIAPPPRLASGAKHFSTECPGTPPWYLQVALGSYHFGKGGWRTLPGVTRPNGKFLVALELPAGRVVFGVGTWGASLWVGALGCTGAELEAFPV

SEQ ID NO: 126377 - protein, 73 aa, Glycine max
  Coding DNA Sequence Number=SeqID_34692
REFAKRNLQWLSARKNLEDDELSSSLSTPLQVIKRTASAHPLSETSALSQYPLMRAKRARSALSARERTRPSI

SEQ ID NO: 126378 - protein, 42 aa, Glycine max
  Coding DNA Sequence Number=SeqID_34693
MDKSLKVGEDEWREKDRRGTKFCASNEPTNSRSSPRFSTKCA

SEQ ID NO: 126379 - protein, 160 aa, Glycine max
  Coding DNA Sequence Number=SeqID_34694
AFVYRQQKVYTDNHSGISACQHDLKGAEDDVSLCVLSGFSSYRQQKVYTDNHSGISARQRDSKVSMTDLVSAEDDVNLRVSTGMSAAINEGREDDVSLCVLSGFSSYRQQKVYTDNHSSISARQRDSKVSMTYLVSAEDGVNLRVSTVLSAVIDEGRRRR

SEQ ID NO: 126380 - protein, 117 aa, Glycine max
  Coding DNA Sequence Number=SeqID_34695
MTLLLSNILPSDRNANLPLQKYQLVCVVPTWGLHPQRHPVDLKKFNRDLGFPALVTGLFRPYRAPVPPSKFMSSWHRDRARKTPKGLSIAYTTWPTSRLPSPKPKISISARSVTNKS

SEQ ID NO: 126381 - protein, 285 aa, Glycine max
  Coding DNA Sequence Number=SeqID_34696
  Pfam annotation: Domain name=Transposase_23; Domain location=185-255; Score=-16.8; E_value=0.082; Accession=PF03017.5; Description =TNP1ENSPM transposase
MGPVLPDSQRPFLGGMYIAIQKQNIAPHVLSHGGYEYLEQKLLAEKTKKKLEKAGQSGSIDGIIDPPSPVKRHVKWKMVRVKTIGEMTTEAAKEIAEKIVRILHPSWASGCLTAAIRRPEHPGHVRAAGFGVTIKQYFGSAPWTSRSSSSLPLEELQQLTYPSSVLDAISGTCTASRASGNDPETGDSDRCGLYIEANPARLVTLGKVYEGSTIVHNTPLLLGQVKVGAKEVKDPNAAVPVPTDEVSLVGQTIHTFLAWPTHLVKSLSQQLVVSSAKPPEKSDPE

SEQ ID NO: 126382 - protein, 145 aa, Glycine max
  Coding DNA Sequence Number=SeqID_34697
  Subcellular localization annotation: CTP_CleavageSite=37; ConfidenceScore=5.42e-01
MSQASSFSVSVLPGDTRDLGVIGVVQCQNSNRAYLSRAVNSSRMGAAIPVPIFTSLFPLPVPKLLVLSLLDEAPFLDPRGRLSFPSPGEVPHPRSLHLLFDSFLARSRWVGPRFTLCLSRKCPGAPPLANFLVGNQEGMVVPGIL

SEQ ID NO: 126383 - protein, 180 aa, Glycine max
  Coding DNA Sequence Number=SeqID_34698
  Homolog annotation: Hit_ID=B0FIH7; Match level="QueryCoverage=35%, HitCoverage=8%, E-value=3e-07, Identity=44%"; Hit description=Tail fiber
  Subcellular localization annotation: CTP_CleavageSite=71; ConfidenceScore=5.15e-01
APRPNDANSSFISDADGNTSWAPANGCGYQSSYNTQRIAQMWVTTGGAGYCRFLLNTNPQTAKTDAPWTVFQSAGTSDINFKKVTGDLDLNESLSNIEAMDFKTFYYLADEEKAIRRGVIAQELEKIDPQYVHSAEESGKMTLDLNPLVLDALAAIKALAIRVSALEGDAKPPVPGSFAG

SEQ ID NO: 126384 - protein, 231 aa, Glycine max
  Coding DNA Sequence Number=SeqID_34699
  Gene Ontology: Mol. function=transcription regulator activity; Biological process=regulation of transcription, DNA-dependent
  Homolog annotation: Hit_ID=A8GBE4; Match level="QueryCoverage=88%, HitCoverage=87%, E-value=6e-82, Identity=74%"; Hit description =Transcriptional regulator, TetR family
  Pfam annotation: Domain name=DUF1956; Domain location=100-226; Score =144.9; E_value=2.2e-40; Accession=PF09209.2; Description=Domain of unknown function (DUF1956)
  Pfam annotation: Domain name=TetR_N; Domain location=22-68; Score =65.5; E_value=1.7e-16; Accession=PF00440.14; Description=Bacterial regulatory proteins, tetR f
  Pfam module annotation: Pfam domain module=DUF1956::TetR_N; Domain location=100-226::22-68
MPASVPHQAAGRARGEQARRQLLAAATDLFGEYGLQGATTRDIAQRAGQNIAAITYYFSSKEGLYLAVAQSLADFIQQAFVPLAEEVDRFWQQPVAQRSPDAALRLLQRGLLAFSELMTQPHTLNLSKIMSREQLAPTDAYPLIHSQVIAPMHERLCRLLAAATGIDERAPRLVLHTHALIGEVLSFRVARETIRRQAGWQEIGEGEAAQLAPVLSEHIEILVVGLRQRHG

SEQ ID NO: 126385 - protein, 272 aa, Glycine max
  Coding DNA Sequence Number=SeqID_34700
  Homolog annotation: Hit_ID=Q6WAY6; Match level="QueryCoverage=88%, HitCoverage=54%, E-value=6e-18, Identity=26%"; Hit description =Putative uncharacterized protein
MVEVSTEAIASLAQYYDKPLRCFTFGDFQLSPMVEEFEEILGCPLGGRRSYLFLGFYPSLARISKIVQITAQKLDHRKQVENGVVGIPRKCLEAKARILAAIDAFLAYHDHKESPVVAMLADLYGTFDQRCEKSSMRICLLYFGSLCMVGFTPFSPRGFPNVPLMGTKACISYNPVLAIRQLGYPMRGAPLEEELAPVISRGFFKTNVETLQKVHKAWEVAQKKDTALWGSNNGPIGGYRKWLRAHVQGLDWLPSLRITNREEVEASEEDEE

SEQ ID NO: 126386 - protein, 319 aa, Glycine max
  Coding DNA Sequence Number=SeqID_34701
  Homolog annotation: Hit_ID=A4WA89; Match level="QueryCoverage=100%, HitCoverage=36%, E-value=1e-144, Identity=74%"; Hit description =Putative uncharacterized protein precursor
IPQSAPSTVAPKTLAQWQAVLPNTWLTVHRLTLSPWQQWQGELNASLTPARQEIAYKGEQVSIQGTLRGQTLSVTQFDVQLPDQPQPVKLVGEFTLPLVPDGVPVKGHAVATFNVPQLTSLVDADLDWEDNQGQLVVMARDNPEPLLDLPWQITAEQLDISDGRWNWVLSGMPLSGRISLRADNWQQGLEKATLTGRLNVLTHGDAGKGNAVLNIGPGRLSMENSDMPLHLSGEAKQNDLILYARLPAKLTGSLYEPQLAFEPGALLRSRGRIIDSLDIDEIRWPLAGVKLTQKGVDGRLQAILRAHENEMGDFELHLD

SEQ ID NO: 126387 - protein, 132 aa, Glycine max
  Coding DNA Sequence Number=SeqID_34702
  Gene Ontology: Mol. function=catalytic activity; Cellular component =endoplasmic reticulum membrane; Biological process=metabolic process
  Homolog annotation: Hit_ID=A2WTT6; Match level="QueryCoverage=97%, HitCoverage=25%, E-value=7e-41, Identity=56%"; Hit description =Putative uncharacterized protein
MVHGVGAIEFIICHSEVSIALAEEKKIPELFKTFPNATKYLKRSNSELELPIKKMMYTYLTFPLAHTFFRTIEEIFIWHGASIGFWRGDVKLLIDDVGELKPTIFCVVPRVLDRVYSGLTQKISSGGFLRKT

SEQ ID NO: 126388 - protein, 169 aa, Glycine max
  Coding DNA Sequence Number=SeqID_34703
DSESSVMYAFRDYYSLPLPSRDKQSPLAIQRQASLLARGDKTWSSAPFLISEDNQVRWHAETNMVIRTLFAIQRQSSLMAHGDKHGHPYPFYNPETIKSDGTRRQNMTIKVIRTLLAIQRQSSPMACGDHHGHPCPLCYPETIKSDGMRRPSWSFAFIVFETILVSFAI

SEQ ID NO: 126389 - protein, 98 aa, Glycine max
  Coding DNA Sequence Number=SeqID_34704
  Subcellular localization annotation: CTP_CleavageSite=41; ConfidenceScore=5.22e-01
MMITKGDDKKLKDQSKNNSSESKINQRTTQVNQRSIKNNSRVQAKNQEEFKTQEESLETRIKIQGSRSQESRSRFKTQDSRIKRRLNQDKYKKFFSKN

SEQ ID NO: 126390 - protein, 94 aa, Glycine max
  Coding DNA Sequence Number=SeqID_34705
MEKCPVKLQTKFREYPTTKFRKDPTVSEGWAAFLPRQLHVAFSRSFIKRLLAHSKYLLKDPNGQIMDKCLVKLQSKCREDPTVNECWTAFLPRQ

SEQ ID NO: 126391 - protein, 207 aa, Glycine max
  Coding DNA Sequence Number=SeqID_34706
EFLFSISSISIYYGTQSDIRVKKLLSFEFAQLLFSITSVSIHYGTQSDTRVKSLLSFEFAQSFCFQFERLDILRDSIGHPSKKLLSFEFARPSVFNFEHLDILRDSIGHPIKNLLSFDLLRAAVLISSVSIYFKTQSDIRVISYYGLNFQRAFVFNYERLDILLDSIGHPCKNLLSFEFPTSFRFQLRAPSISNVSIYYETQSDNPS

SEQ ID NO: 126392 - protein, 309 aa, Glycine max
  Coding DNA Sequence Number=SeqID_34707
  Homolog annotation: Hit_ID=Q652R5; Match level="QueryCoverage=29%, HitCoverage=36%, E-value=1e-16, Identity=53%"; Hit description =Putative uncharacterized protein P0603C10.50
PTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGLVGSVRARKGSSMGPELTGSHVIGLERGSSTIYHGEVGHEPRFQPTTRRVLAGGRRALGLMASGATCVQRLDGSRDSAIHTKYRISLRSSSMQEPRYPLPRVIVSPGFVFVREDEEAGRTGRRGHPLPPD

SEQ ID NO: 126393 - protein, 79 aa, Glycine max
  Coding DNA Sequence Number=SeqID_34708
MQRGADNRKNDQTWSLLVIDTCALNDKGVRITVRMTKLCLCLSSALDDKRVRITVRYLRVSWVQNDQTWSLRAIGHDCV

SEQ ID NO: 126394 - protein, 71 aa, Glycine max
  Coding DNA Sequence Number=SeqID_34709
MENSSLTVNHLIQPYFNLLSENQLRGELPGNHITSGNLKESWALSSKGNNTRKSSLPWIQTENAMKHEAET

SEQ ID NO: 126395 - protein, 48 aa, Glycine max
  Coding DNA Sequence Number=SeqID_34710
MKIPETKCGPPRENRGEACRPSSPRRARLLPPEATAFWRNLLEGPKWA

SEQ ID NO: 126396 - protein, 109 aa, Glycine max
  Coding DNA Sequence Number=SeqID_34711
  Gene Ontology: Mol. function=hydrolase activity, acting on carbon -nitrogen (but not peptide) bonds; Biological process=nitrogen compound metabolic process
  Homolog annotation: Hit_ID=A1FZP4; Match level="QueryCoverage=82%, HitCoverage=16%, E-value=4e-34, Identity=85%"; Hit description=NAD+ synthetase
AAGAVVYNAASVLRDGLVEQTYRKRELPNYAVFDERVRYFDVDPDGGSCVFEVNGVPVGLLICEESCGSPSRWPDTVRAGAQLVVVPNASTVRARQACPERCGAGYAHP

SEQ ID NO: 126397 - protein, 254 aa, Glycine max
  Coding DNA Sequence Number=SeqID_34712
  Gene Ontology: Mol. function=oxidoreductase activity; Cellular component=cytosol; Biological process=auxin mediated signaling pathway
  Homolog annotation: Hit_ID=A8G9G4; Match level="QueryCoverage=97%, HitCoverage=75%, E-value=1e-125, Identity=90%"; Hit description =Aldo/keto reductase
  Pfam annotation: Domain name=Aldo_ket_red; Domain location=13-253; Score=80.5; E_value=5.6e-21; Accession=PF00248.12; Description =Aldoketo reductase family
MHEGSTMQQRKLGSHGPLVSALGLGCMGMSDFYSTGADRQEAIATLHRALELGVTLLDTADMYGPHTNEELVGEAIKGKRQQVFLATKFGILRDPADPSARGVSSRPEYIRRSVEGSLRRLGVEEIDLYYQHRVDPQVPIEDVVGTMADLIREGKIRHIGLSEASVATLERAHKVHPITALQTEYSLWTRDAEQGVLAACERLGIGFVPYSPLGRGFLIGAIRRPEDLAEDDFRRGNPRFQGENFARNLALVEK

SEQ ID NO: 126398 - protein, 91 aa, Glycine max
  Coding DNA Sequence Number=SeqID_34713
  Gene Ontology: Mol. function=hydrolase activity; Biological process =lipid metabolic process
  Homolog annotation: Hit_ID=A8G9H2; Match level="QueryCoverage=87%, HitCoverage=32%, E-value=4e-22, Identity=51%"; Hit description =Patatin
  Pfam annotation: Domain name=Patatin; Domain location=3-89; Score= -31.5; E_value=0.0045; Accession=PF01734.13; Description=Patatin-like phospholipase
MALVCEGGGQRGMFTAGVLDEFQRAGFNPFDLLIGTSAGAQNLSAYICGQMPLAMDVAGTALYRRGASFCWCAFRNDDFQTDLSAGAARSA

SEQ ID NO: 126399 - protein, 116 aa, Glycine max
  Coding DNA Sequence Number=SeqID_34714
MWKIDNIYYFYTVQEKTYTQSFIIPHFPKLGLTHKNSSRWSRQLSQPTFWREGNAGLASVSSMKGKCAESPPTFIRGKRRKNQRKPVMKHIPDSGVIFTFEEGISTSHVCPKGQQP

SEQ ID NO: 126400 - protein, 79 aa, Glycine max
  Coding DNA Sequence Number=SeqID_34715
MEVRGKVELFPYRGLDELVQLCIRVEQQLKRKPSPKNSTSYSYTKKDQAPSVLGVPPSKPKDDKAQGWYPSGVSISFPT

SEQ ID NO: 126401 - protein, 103 aa, Glycine max
  Coding DNA Sequence Number=SeqID_34716
  Subcellular localization annotation: CTP_CleavageSite=35; ConfidenceScore=5.38e-01
MSPPPLETHNHSQTHLMLSRWPSLLAQFSASGLVCACALSATLACLARISEFRLSARLLTQQMDSSGALSGMSPHSANMHSSSFFQILPCTQPKECCAQQMAH

SEQ ID NO: 126402 - protein, 201 aa, Glycine max
  Coding DNA Sequence Number=SeqID_34717
MAPRKLASKRSRKDKAAEGTSSTPEYDSHRFRSAEHQQRFEAIKGWLFLWKRCIQLRDDEYTDFQEEIVRRRWASLVTPMAKFDPDIVLEFYANAWPTEEGVRDMRSWVRGQWIPFDADAIGQLLGYPLVLEEGHQCEYGQRRNRSDGFDEEAIPQLLCIPGQDFARTAVERRVRIMRTNMTTLTQIWMTLLLSNILPSDP

SEQ ID NO: 126403 - protein, 107 aa, Glycine max
  Coding DNA Sequence Number=SeqID_34718
MGAKHLTRTKERSHVIKQRSPDEIRAERHPPIGKSAEGAGECGLFLILKSNSDLHITRKTIKETVVRFTCLAFKHLVNEWQWKMVLFGYMVQPPIVDAILSNYSTPE

SEQ ID NO: 126404 - protein, 249 aa, Glycine max
  Coding DNA Sequence Number=SeqID_34719
  Pfam annotation: Domain name=Transposase_23; Domain location=51-114; Score=-11.5; E_value=0.021; Accession=PF03017.5; Description =TNP1ENSPM transposase
MSQRGSLIPTHIQPDIHGLVARVSTKGSNAESVVNPCLPNDVAPVEPPIGLYVPRQDSIELVALGKTYDGGSTIHNVAYADDVVRVSVEQVIDGDAEVPFPTSEIKCVRQALHTFIAWPTPLHEGSSPTKDTEAVEAVNDVVVDDPLHELIKSLVDIYEKPVELVWDATKFGIPNATASLFVTCADVNEIISGVQCLNIAILQLYMDPLSQSDDQGSVYGFLESQAILNANDKRGQCQEYIEKWLKESN

SEQ ID NO: 126405 - protein, 187 aa, Glycine max
  Coding DNA Sequence Number=SeqID_34720
  Gene Ontology: Mol. function=transporter activity; Cellular component= outer membrane-bounded periplasmic space; Biological process=transport
  Homolog annotation: Hit_ID=UPI00016501CF; Match level="QueryCoverage =98%, HitCoverage=20%, E-value=8e-10, Identity=26%"; Hit description =diguanylate cyclase
MYPNMQLRYVDIVDEAFEDLKNKRIDAYIGNELVVDYHAEFHRLSYAKKSSLTTFRSAVSMAVRNDQVLLLSIINKSLAKIGPNNPKILDYWKTPHSPISSLEKILLALLILAFVGSLVKLLSIRKKSKSEAIEHQKKIWHEANYDRNTKLPNRNFFERKIKEVVADAKQDKTAFAVMFIDLDDFKY

SEQ ID NO: 126406 - protein, 216 aa, Glycine max
  Coding DNA Sequence Number=SeqID_34721
MATMMEAMTSMKKILEANAVIVAATSTVAKANPMPPSGLKQMYHPTSDMVGKDLGSTDDPMMCKFKTSMPSRHMACLPMWRTLPMRMSITLLPYSLRANNPKTDHAHVSQPMGEAHEIPHHNLADFEPCLGYATEGQAVGGIPMPNTLKGPQFRPQPQPLHFAVVRAPPAMPEKGKVPDFDKYKGTTCSKNHLKMYFGPPPMGAYAKDEKLLIHFS

SEQ ID NO: 126407 - protein, 103 aa, Glycine max
  Coding DNA Sequence Number=SeqID_34722
MNLGIPQSCGSACHRTLGSRISFLNDHLEEALGSTKNRRKSLKVYQSHTWQGLTFSPWVKVYDKLGFWLKACRTAGHDICQGLASGSGIKGMSYIISMIHMQQ

SEQ ID NO: 126408 - protein, 126 aa, Glycine max
  Coding DNA Sequence Number=SeqID_34723
  Homolog annotation: Hit_ID=Q5XM22; Match level="QueryCoverage=66%, HitCoverage=47%, E-value=1e-35, Identity=86%"; Hit description =Resistance-like protein HAAS-2
TLTSLQVESTSRVYRTLTSLRKLSSLITLAETALTRGAYVRLGWVRGIYETRCQARRWIVAARAYLLHLVGCTLFANKSATYVHVVHLDVFRDLAQSGGYALGVVALVHMYDQLDEACRNTKRQLA

SEQ ID NO: 126409 - protein, 35 aa, Glycine max
  Coding DNA Sequence Number=SeqID_34724
MGPTLLFQKGSRIQSRCLPSPWHWLTSGEVLDSRS

SEQ ID NO: 126410 - protein, 149 aa, Glycine max
  Coding DNA Sequence Number=SeqID_34725
MARRDKIWSFCTLVSSRGGGPDDTRRYLTVIRTLLSSRGETKFGHSAPLCHPEAAGSMIRGDTLRLSAPFCHPEAAGPMTSRDKIWSFCTLVSSRGGGPDDMRRYLTVIRTLLSSRGGGPDDTRRYLTVIRTLVSPRGGGPDDMRKYPS

SEQ ID NO: 126411 - protein, 41 aa, Glycine max
  Coding DNA Sequence Number=SeqID_34726
MWHLPLNELVKKNVAFTWGEKQEEAFALLKEKHTKAPVLLQ

SEQ ID NO: 126412 - protein, 100 aa, Glycine max
  Coding DNA Sequence Number=SeqID_34727
MTAEWRRKRERRCHFNEKMSLEEAHHHRRPWIRAWRKNSSPILLEPLAHGSSDWSLPWEDCINNETSSRVFIFDDTLSLVVPTTTMFDIKRDDISRNLGS

SEQ ID NO: 126413 - protein, 73 aa, Glycine max
  Coding DNA Sequence Number=SeqID_34728
MVTVGDGEIAWNVENGLGRKKGEEMTFFQSYLDYKAQNAQVSNALGNGNFSHTLRIFSKIPTVASCSFLEKLH

SEQ ID NO: 126414 - protein, 170 aa, Glycine max
  Coding DNA Sequence Number=SeqID_34729
  Homolog annotation: Hit_ID=Q51617; Match level="QueryCoverage=24%, HitCoverage=59%, E-value=1e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPDGAVGDDGVGFDSAGGAVVVAFFGEKEEGYNMTLRLLYHHLTE

SEQ ID NO: 126415 - protein, 68 aa, Glycine max
  Coding DNA Sequence Number=SeqID_34730
  Homolog annotation: Hit_ID=A6FJQ2; Match level="QueryCoverage=55%, HitCoverage=84%, E-value=3e-11, Identity=92%"; Hit description=50S ribosomal protein L5
MQLPETVHSLSMRKEKIPHQAPFAIQAAQLLGRAIGAGLFAITPAGERGMCCKAIKLGNARVFPVTTL

SEQ ID NO: 126416 - protein, 147 aa, Glycine max
  Coding DNA Sequence Number=SeqID_34731
  Homolog annotation: Hit_ID=A5B3J2; Match level="QueryCoverage=92%, HitCoverage=24%, E-value=3e-09, Identity=31%"; Hit description =Putative uncharacterized protein
MRGKIPAGDLAPLDLEIEATCRRNNAEKRRKALQERTVRPSTERTLSSESSSLFPTNLREFEVVASEAHIMADNQPQRATLEDYSSSTVPQFFTSIARPKVQAHNITYPHSLIQLIQGNLFHGLPNEDPYAHLATYIEICNTVKIAE

SEQ ID NO: 126417 - protein, 244 aa, Glycine max
  Coding DNA Sequence Number=SeqID_34732
  Gene Ontology: Mol. function=transferase activity; Biological process= lipopolysaccharide biosynthetic process
  Homolog annotation: Hit_ID=A2Z3Z5; Match level="QueryCoverage=79%, HitCoverage=20%, E-value=1e-103, Identity=99%"; Hit description =Putative uncharacterized protein
  Pfam annotation: Domain name=Glycos_transf_1; Domain location=28-186; Score=-23.1; E_value=0.028; Accession=PF00534.11; Description =Glycosyl transferases group 1
MPFNSLYGAGRCQIINNGIDVATEAILAELTPVADTAGKPKIAIVAHDLRYDGKTNQQLVRDMMALGDKIELHTFGKFSPFEGANVVNHGFETDKRKLMSALNGMDALVFSSRVDNYPLILCEALSIGVPVIATHSDAAREVLEKSGGKTFSEGEVLSLVQMPKAQIAETVFGTDLESFRNRSRKAYSGQQMLEDFPITIVTFLPVLLLLYVDKINLKKLMIALGLGTGLTLFNYIFGQVAGCQ

SEQ ID NO: 126418 - protein, 88 aa, Glycine max
  Coding DNA Sequence Number=SeqID_34733
  Subcellular localization annotation: CTP_CleavageSite=59; ConfidenceScore=5.00e-01
MAYTNWHLGRGRSKLWSLSSSVIHIWVKVVMRVHMIRTRLPAAVRAKSCPGMHSSWVIASSSKSSTWFLLWLNSHCWFSSKISELPKN

SEQ ID NO: 126419 - protein, 106 aa, Glycine max
  Coding DNA Sequence Number=SeqID_34734
MSLVTLFGKLQEHEMELLRLNQHEENDKKKKGIALKASSSIQEESDEEDLIDLNEDDDLSLFVKRFNKFLRIRGNQRRPNFKPKRRTEDSSSTPKCFECNQLGHLR

SEQ ID NO: 126420 - protein, 122 aa, Glycine max
  Coding DNA Sequence Number=SeqID_34735
MTASKGKPIFEVVLSLGFPFKVALDWRYPAPHKQRGKDQNTQLPLQKVTTFEKILLVRDPACDLLVKEPGAPFGPANKSYPKPHELIVIHASSTIESGAPRIDCLALFIYPPASNLIRRPMN

SEQ ID NO: 126421 - protein, 94 aa, Glycine max
  Coding DNA Sequence Number=SeqID_34736
MQRSKHDVHLGAYLNGSDNYLKGIINSALKGLDDAPQPKSKAPARWIVVKCNRQKGNTECSYYVMHWMSTIILGSFRNNWEAYFNDPRPLEPER

SEQ ID NO: 126422 - protein, 57 aa, Glycine max
  Coding DNA Sequence Number=SeqID_34737
MWTTTGEKLAAQLAQASKVASSRSNSLLEESSGGPKWAWLLFAPPLFTKCNPLLFFW

SEQ ID NO: 126423 - protein, 46 aa, Glycine max
  Coding DNA Sequence Number=SeqID_34738
MTVGVGQERRPIEGLNRINMAGVGRYMAPTDIFQPTLRNFFYNAGR

SEQ ID NO: 126424 - protein, 92 aa, Glycine max
  Coding DNA Sequence Number=SeqID_34739
MFVGSSPLENYTVIYKTKVERKDIDLIDEEEAQIGAEALEHTKKRDTGHQSVSLDNETGDSTMLKMGDSAKVVIKQDMNGREHKYGFNNNER

SEQ ID NO: 126425 - protein, 223 aa, Glycine max
  Coding DNA Sequence Number=SeqID_34740
LLSLRTAKREEVEAPEEDEEVQALRAELEQAQTVKEKFKSTTLKIRKENAKLKDINIATTKALEQETKRARREEHGRNKFRGALWGSNNELKLRREERNQSRVHSMVLKEELAACSRTKKSLAQHLEATEQGMLAIIGQYKEELNQSLTHEQKLVEDFAQAYTEKEARGRVIDALHQEATMWMDRFALTLNGSQDLPRLLAKARAMTEVCSASEEIHGLINYC

SEQ ID NO: 126426 - protein, 96 aa, Glycine max
  Coding DNA Sequence Number=SeqID_34741
MKARDGMHQLALRQREVGVVAEQQSHPCLMRMICTRLPAAVRAKSCPGVHSSWVMASSSKPSALFLLWLNSHCWPSSKTSGSPRNWLRASASKGIH

SEQ ID NO: 126427 - protein, 144 aa, Glycine max
  Coding DNA Sequence Number=SeqID_34742
  Pfam annotation: Domain name=zf-CCHC; Domain location=72-89; Score =26.7; E_value=8.3e-05; Accession=PF00098.14; Description=Zinc knuckle
MKKLIRRRRESLLKPHLQSKKTVIKKIQLTWIMMKDISLFVKRFNKFLRVRGNQKLPNFKPKRRTETSSSTLKCFECNKPGHLRVDCPIFKKKMEKSEKKNINEKKLKKAYITWDENDMESSEDSENEEINLCLMAKSYESDEE

SEQ ID NO: 126428 - protein, 62 aa, Glycine max
  Coding DNA Sequence Number=SeqID_34743
  Gene Ontology: Mol. function=NADH dehydrogenase (ubiquinone) activity; Cellular component=mitochondrial respiratory chain; Biological process=mitochondrial electron transport, NADH to ubiquinone
  Homolog annotation: Hit_ID=Q04614; Match level="QueryCoverage=70%, HitCoverage=44%, E-value=4e-13, Identity=93%"; Hit description=NADH -ubiquinone oxidoreductase chain 4L
MGQSFASLVSTVAAAESAIGLAIFVITFRVRGTIAVEFINSIQGSGPFLAGRAHPIDSKVLS

SEQ ID NO: 126429 - protein, 101 aa, Glycine max
  Coding DNA Sequence Number=SeqID_34744
  Homolog annotation: Hit_ID=UPI0000ECBAF8; Match level="QueryCoverage =40%, HitCoverage=48%, E-value=1e-16, Identity=100%"; Hit description= UPI0000ECBAF8 related cluster
MKKGFQFAGYDKATIGTITLDCQSPYGEKRNRCALLPPNVPILAHSLERMQAWHWPSFYNVVTGKTLALPNLIALQHIPLSPAGVIAKRPAPIALPNSCAA

SEQ ID NO: 126430 - protein, 124 aa, Glycine max
  Coding DNA Sequence Number=SeqID_34745
MEAMKEQMAAMMEAMISVKKIMEANAVAIAATSVVAKVNPTSPSGLNQMNHPTLDMVGKDLGSRDGLHDVQNPNKHAFPPQGLPPNYTPPNVAYTLNEHVNNSTPIPIESRQPLTVHAHVSQPM

SEQ ID NO: 126431 - protein, 171 aa, Glycine max
  Coding DNA Sequence Number=SeqID_34746
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAGEKCCVSSSLAGMQAWHWPSFYNVVTGKTLALPNLIALQHIPLSPAGVIAKRPAPIALPNSCAA

SEQ ID NO: 126432 - protein, 143 aa, Glycine max
  Coding DNA Sequence Number=SeqID_34747
MTKLGLCLPTDTAVSEWQRGSDNRKVSPRIIMTKLGLCLPTDTTVSEWQRGADNRKVSPRIIMTKLGLCLPTDTTVSEWQRGADNRKVSPRIIMTKLGLCLPTDTTVSEWQRGADNRKGADNRKGANNHKVSPRIMGACHMTS

SEQ ID NO: 126433 - protein, 241 aa, Glycine max
  Coding DNA Sequence Number=SeqID_34748
NSLKTWDEVVEKFVKKYFPQSKIAEGKAAISSFHQFPDESLSEALERFCGGKIKLKTPEEAMDLIENMAASDIAILRDRAHIPTKKSLLELTSQDALLAQKKLLSKQLEALTETLRCTICGGAHESGCCIAIEEHPTRGPSTRPQQQGPSLYDRTTKLEETLAQFMQVSMSNQKSTQSAIKNFEVQVGQLAKQLADRSSSSFTPNTEKNPKEEFKAVMTRSRMAIQGDDSEAGKKMEEHKQ

SEQ ID NO: 126434 - protein, 129 aa, Glycine max
  Coding DNA Sequence Number=SeqID_34749
IYMRFSSNFSQPASIRSYALEPYNAQWNAPGLLRDKHTLRSNCILGEMEVDEPWPGLSRCKIHFLVGVLVYAKGMAFVDDWVVGNEKGCYRLSNDIVGPTSIISPMKTKSTKLEGATGVARFSTFGRIL

SEQ ID NO: 126435 - protein, 118 aa, Glycine max
  Coding DNA Sequence Number=SeqID_34750
  Subcellular localization annotation: CTP_CleavageSite=45; ConfidenceScore=5.09e-01
MSLSMQEPGLRSFFMPYSRPVQGRVCMARRFGPRPKQERHPQKLPAMEKKPTRMRRCLICLTSWEGVETRDWEIPRFMVNAVKFPGRPKWTRMNAQIDKRTYFGNIGLIKNRGNEPEP

SEQ ID NO: 126436 - protein, 101 aa, Glycine max
  Coding DNA Sequence Number=SeqID_34751
MVIRTFAIQRQASLMACGDHHDYYSLIYLPKTSESIGMRRRIMVIRFLRHPETSEYDGMRKPSRSSVFVVFLRLLQSPSPSRDKRVCWHAETFMVIRFHCF

SEQ ID NO: 126437 - protein, 255 aa, Glycine max
  Coding DNA Sequence Number=SeqID_34752
  Gene Ontology: Mol. function=RNA-directed DNA polymerase activity; Biological process=RNA-dependent DNA replication
  Homolog annotation: Hit_ID=Q0ZCD0; Match level="QueryCoverage=98%, HitCoverage=22%, E-value=6e-12, Identity=23%"; Hit description =Integrase
MERSMIDAASGGALGDMTPTEARNLIEKMAFNSQQFSARNDAIVLRGVHEVATDSSSSTKNKKLEGKLDALVNLVTQLAMNKKSTPVARVCGLCSSVDHHTNLCPSLQQSEVNEQLEAYAVNIYNRPPQQQNQQQQNNYDLSSNRYNPGWRNHPNLRWTSPPQQQQLVPPFQNVAGPSKPYVPPPIQQQQSQQRQQTIEAPPQPSLEELVRQMTIQNMQFQQETRAFIQSLTNQMGQMATQMNQAQSQNSDKLPS

SEQ ID NO: 126438 - protein, 88 aa, Glycine max
  Coding DNA Sequence Number=SeqID_34753
  Homolog annotation: Hit_ID=A6FJQ2; Match level="QueryCoverage=43%, HitCoverage=84%, E-value=3e-11, Identity=92%"; Hit description=50S ribosomal protein L5
MTVKPLTHAAPGDGHSLSVSGCREQTSPSGRMRKEKIPHQAPFAIQAAQLLGRAIGAGLFAITPAGERGMCCKAIKLGNARVFPVTTL

SEQ ID NO: 126439 - protein, 16 aa, Glycine max
  Coding DNA Sequence Number=SeqID_34754
EVSGLWKAKSSVGSSL

SEQ ID NO: 126440 - protein, 88 aa, Glycine max
  Coding DNA Sequence Number=SeqID_34755
MLLSSNVIHICVRVAMLVRMIRTRLFVAARVKSRPSMHSGSPLASLWLCSHSWHSSEIRGVTKGLIKGNYWPLTWECKSRLSIKGRGP

SEQ ID NO: 126441 - protein, 301 aa, Glycine max
  Coding DNA Sequence Number=SeqID_34756
  Gene Ontology: Mol. function=motor activity; Cellular component=cell projection
  Homolog annotation: Hit_ID=UPI00006A16D8; Match level="QueryCoverage =99%, HitCoverage=95%, E-value=3e-20, Identity=29%"; Hit description =UPI00006A16D8 related cluster
GLHVLAFRGLDVLIFRGLHVLVFIGLQALAFRGLHVLTFRGLHALTFHGQHFLTFRGLHVLTFVGLHVLAFIGLHVLAFGGLHTLAIRGLHVLTLRRLHALAFRGLHTLNFRGLHAFAFKGQHVLTFRELHVLAFRGLHALSFRGLHVLAIGGLSTTLVAFRGLHAVAFRGLHVLTFRGLHALTFKGLHVLGFRGLHVLAFTGLHVHAFRGLHALTFRGLHVLTLRGLHALVFRGLHAVTFRVLHAVTFRGLHVFAFRGLHVLAFKGLHALPIRGLHALTFRRLHVLAFRGLHVLAFRGLH

SEQ ID NO: 126442 - protein, 96 aa, Glycine max
  Coding DNA Sequence Number=SeqID_34757
  Subcellular localization annotation: CTP_CleavageSite=36; ConfidenceScore=5.25e-01
MTKDNDWTTRPRLERTTCPRHQRTTSPRHQRTSCPRHQRAARPHLQRTTLTLTVERTTRPRLERTTRPHHQRAARPYLQRTTCPRLERATRPHLGY

SEQ ID NO: 126443 - protein, 40 aa, Glycine max
  Coding DNA Sequence Number=SeqID_34758
MADMTVQVNNFRGLSPESLWGEALKIAAYILNRVLTKATA

SEQ ID NO: 126444 - protein, 127 aa, Glycine max
  Coding DNA Sequence Number=SeqID_34759
MARTGDNGGVYHQLDESQRLFLDAWTIQMQRLLNRNKEEPYRRIVKSSSFTLKPLSPREACDDQIRMREKREQEKENSEAPQRNMKKKSDTPEEKSDTQKRESDNSNQNLKMSFPRRFLMDCHLQEA

SEQ ID NO: 126445 - protein, 183 aa, Glycine max
  Coding DNA Sequence Number=SeqID_34760
  Subcellular localization annotation: CTP_CleavageSite=36; ConfidenceScore=5.23e-01
MEKSSKKRKGSSSTTTAAGHRRHGPSEAPITPIHPSLSSPRSSTLFFSDDQRLRYLSQFSSRIILDPKYLDIDFFNDETFDCYQVFQNSGLIDFMSLKLPYYPELVKVFYNNFKIQDGIISSEVHDISMIIDQSLFFSLTKLLSQCAPFEGIIVDDWKFDYSSHDAHRMIDWAHLVRYRMGIL

SEQ ID NO: 126446 - protein, 205 aa, Glycine max
  Coding DNA Sequence Number=SeqID_34761
  Gene Ontology: Mol. function=carboxylesterase activity; Cellular component=cytoplasmic membrane-bound vesicle; Biological process =biological_process
  Homolog annotation: Hit_ID=A8GC20; Match level="QueryCoverage=74%, HitCoverage=54%, E-value=8e-49, Identity=58%"; Hit description=S -formylglutathione hydrolase
  Pfam annotation: Domain name=Esterase; Domain location=1-153; Score =70.9; E_value=4.2e-18; Accession=PF00756.11; Description=Putative esterase
MFDYLSEELPALVADNFKLSDRQSVMGHSMGGHGALVLALRLGGRFASASAFAPIVNPTEVPWGQKAFTAYLGDDRQTWREWDSCLLMQNAEHRLPVLIDQGDSDQFLADQLRPERLEAVAREQNFPLELRIQPGYDHSYFFIASFVEDHLRDSATSPSIITCGMPCEQCSMRPRTPYTCASVSGVITCDGTPSASSCPCFSISA

SEQ ID NO: 126447 - protein, 149 aa, Glycine max
  Coding DNA Sequence Number=SeqID_34762
MFYKDIYCLKGSSEGPSPKQVRVRGHVVKIDVDNLNTFLETSVVLAEGETLPAYSKYCGLPADIREIKVALCIPSRGFVLNAEGQPGKILRKDLTTLAQVWSVLSYSNLAPTSHTSDLIVDRARLIFGLVSQMDMNVGALISGQIASMA

SEQ ID NO: 126448 - protein, 51 aa, Glycine max
  Coding DNA Sequence Number=SeqID_34763
MGHLSDQGVPMNPKRIKVIPEWPTPPSVEEKSLEFQEPRDLRSNPFQGGRE

SEQ ID NO: 126449 - protein, 150 aa, Glycine max
  Coding DNA Sequence Number=SeqID_34764
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q5SCV8; Match level="QueryCoverage=95%, HitCoverage=48%, E-value=1e-42, Identity=62%"; Hit description=ATP synthase subunit beta
  Pfam annotation: Domain name=ATP-synt_ab; Domain location=44-150; Score=-14.9; E_value=5.6e-07; Accession=PF00006.16; Description=ATP synthase alphabeta family, nucleotide-binding domain
  Pfam annotation: Domain name=ATP-synt_ab_N; Domain location=1-52; Score=14.1; E_value=0.0091; Accession=PF02874.14; Description=ATP synthase alphabeta family, beta-barrel domain
  Pfam module annotation: Pfam domain module=ATP-synt_ab::ATP-synt_ab _N; Domain location=44-150::1-52
MPNIYNALIVKGRDTVGQQINVTCEVQQLLGNNRIRAVAMSATEGIKVVDLLAPYRRGGKIGLFGGAGVGKTVLIMELINNIAKAHGGVSVFGGVESKVALVYGQMNEPAGARMRVGLTALTMAEYFRDVNEPDVLLFIDHILSLRPSRI

SEQ ID NO: 126450 - protein, 254 aa, Glycine max
  Coding DNA Sequence Number=SeqID_34765
MTSIFRVCISAICLLLILFLLRFGFCAVDAFGRRQLGDFHVAVFETRRALRVMERQRMLEEVDVVALGAAFVQALVSAARLFAVKRGVRHTFGDVQAVAQLDGVQQIGVEHAGVVGDVDALEALFQLRQLIDGFLHQLRRAVDAAALFHRQPHFVADLRPVFVAFLLHQVAQAGFDIAGLRIQRAAVGRRGFQRATRRVLTGDAAEHQQFCQRVGAETVGAVQADGGAFADREQPLDAGFAILIGFNADHGVVR

SEQ ID NO: 126451 - protein, 98 aa, Glycine max
  Coding DNA Sequence Number=SeqID_34766
MCASQRASKPVRRKEADWWDPPNWRCGMNRKLGYGAQLRANLDPTKGVGRLRQQDGGHGSRNPLRSVYTHLPNQLAPKMDGAKARDLYPAVGARTKPR

SEQ ID NO: 126452 - protein, 126 aa, Glycine max
  Coding DNA Sequence Number=SeqID_34767
  Homolog annotation: Hit_ID=Q5XM22; Match level="QueryCoverage=49%, HitCoverage=49%, E-value=3e-10, Identity=44%"; Hit description =Resistance-like protein HAAS-2
MACLLHLPITGALHRFEPLGVDEAVLLSTEILEVSDEEARAETSRSYAWRVATLVHMYDQLNVASQTPTRQMGGYLTLLQCWIYEYFPSVHQGVTDDGYAETTPCASRWLPTKAYMKGIKGAPYRA

SEQ ID NO: 126453 - protein, 223 aa, Glycine max
  Coding DNA Sequence Number=SeqID_34768
  Homolog annotation: Hit_ID=A7QKL3; Match level="QueryCoverage=25%, HitCoverage=9%, E-value=2e-08, Identity=55%"; Hit description =Chromosome chr2 scaffold_113, whole genome shotgun sequence
SEQESARGSFQGETPGIFIVLSGFATSDLSVDFCDARQGGGAYGKTPATRPFYADTARRSRTTERSESVSEEAEERPIRKPPLPAPDNNFTQETAMTMITNSSSVPELALPTAFAIIIYWMGGLKPHPVTFLLSLLVVLYSVLVSQSLGLAFGAILMEVKQARGSSRVDLQACKLGTGRRPHRSPFPRVAQPEWRMAPDAVFSPYASVRYFTPHMVHSQYNLL

SEQ ID NO: 126454 - protein, 86 aa, Glycine max
  Coding DNA Sequence Number=SeqID_34769
MAQECFPNEYMMWNCLSSVDRWHENSFSNKCKCVHDEMAPKKLSAKRSRRDAAAEGTSAAPEFDSHRFRSAEHQQRFEAIKGWSFH

SEQ ID NO: 126455 - protein, 92 aa, Glycine max
  Coding DNA Sequence Number=SeqID_34770
  Subcellular localization annotation: CTP_CleavageSite=59; ConfidenceScore=5.84e-01
MTSSRVSTSGSGSSSPFGKFKSIHSRLRRLTPLGPPQGLLQMMTPLSLGRAPLVDMDVRAGSSGCTNDSSRESNRATESAPRIAFEGLPNSL

SEQ ID NO: 126456 - protein, 140 aa, Glycine max
  Coding DNA Sequence Number=SeqID_34771
MKNDGKPSWICSRKRLGSITEAPRLGFSSRKQFFFTRTAEMHSQGDPGSLEQPPFAFFIGKGERRLLPSSPRRAGLLPLEATMLRKYSGRTLRSAQQCFLSTPDMSRNFTDCLTMSVKYLEAVKRRLHATKQWSPDKIRV

SEQ ID NO: 126457 - protein, 50 aa, Glycine max
  Coding DNA Sequence Number=SeqID_34772
MMQSYPARALDRRLQEDWARDAREGLRVLMSLRATEFGMTTLPVKEDKSG

SEQ ID NO: 126458 - protein, 87 aa, Glycine max
  Coding DNA Sequence Number=SeqID_34773
HEFEERHKYPRCGVSWCKVKDHDECSDDESTKKAPLAKKGEIAMECSVIRLIPPSGRRFIICILISRKSPLIEVLTKLWDEEVVVFD

SEQ ID NO: 126459 - protein, 156 aa, Glycine max
  Coding DNA Sequence Number=SeqID_34774
MRSNGVRGLNPIDNLKRGLLGGSMNPPVVGKFYMRKILIPGLMVAFQRALKRKWLRNLASLSDTMVLGTPWSLTTSLKKSFEIWEASSTLWHGIKCAILLNLSTTTKIESTPLWVLGSPRTKSILMSTQGADGMGKDKGLVYPKVAHEPTLMALLH

SEQ ID NO: 126460 - protein, 264 aa, Glycine max
  Coding DNA Sequence Number=SeqID_34775
MAKFDPEIVLEFYANAWPTEEGVRDMRSWVRGQWIPFDADAIGQLLGYPLVLEEGQECMAPTRHPLDPDKSNRPLGFPALITGLCQSFGVPVAPTKVIRPPITRAFIEKYCTQRQAQGDASQAAGAPPPPHQAGQAGAFDMELYLRHLVRQQAANHRAHVQTHDCLYQMSLSMQSQGFASFSCPTLDQFRQSCMSRRLARGPSRRGTPEAPGGGEEAHEDEEMVDLLDFLGGSGDTSLGDPQIHVFFHISFIIFMLCYCFDLRD

SEQ ID NO: 126461 - protein, 253 aa, Glycine max
  Coding DNA Sequence Number=SeqID_34776
  Homolog annotation: Hit_ID=Q84VI1; Match level="QueryCoverage=100%, HitCoverage=36%, E-value=6e-99, Identity=77%"; Hit description =Envelope-like protein
MATSPKRNCSSWVHPLYPSSPHQEQPEFNIQPIQIIPGQASVPEKLVPRRQQGVKIAVNPSLATSSREVDTEMDKKIRSMVSSILKEASVPEADEDVPTSSTLNVSMPDVEKDVPTSSGPNDEVLSSPSKERSTEEDDQAAKETPAPRAPEPAPGDLIDLEEVESDEEPIANRLAPGIAERLQSRKGKTPIKRSGRIKTMAQKKSTPVTPATSRRSKVAIPSKKRKEISSSDSDDDVELDVSTSKRAKKSGRK

SEQ ID NO: 126462 - protein, 588 aa, Glycine max
  Coding DNA Sequence Number=SeqID_34777
  Gene Ontology: Mol. function=magnesium ion binding; Cellular component=chloroplast; Biological process=metabolic process
  Homolog annotation: Hit_ID=Q5UB06; Match level="QueryCoverage=98%, HitCoverage=98%, E-value=0.0, Identity=65%"; Hit description=Wound -inducible putative chloroplast terpene synthase 3
  Pfam annotation: Domain name=Terpene_synth; Domain location=48-249; Score=103.0; E_value=9.4e-28; Accession=PF01397.12; Description =Terpene synthase, N-terminal domain
  Pfam annotation: Domain name=Terpene_synth_C; Domain location=252 -524; Score=278.1; E_value=1.8e-80; Accession=PF03936.7; Description =Terpene synthase family, metal binding domain
  Pfam module annotation: Pfam domain module=Terpene_synth::Terpene _synth_C; Domain location=48-249::252-524
MAFVHPIFASVNHPIFSPNKCSVFLGVKLIPEHAYSRCHSKKHFTIALNQNIHISKNGKGRDALQIRHAKALEEVKRELVSKTRQNADHGLSMVDSIQRLGIEYHFEEEIETILKKKLLMLRVHNHQGRAYQELSEVALQFRLLRQEGYYIHADIFDKFWGNEGKLKLTFCDDINGLIGLFEASQLSIEGEDYLHEAEECCRQYLNTWLSRFHEHPQVKVVADSLRYPIHRSLSRFTPTNSLQIESTEWIRSLQELSKIDTEMVSSLHLKEMFAVSKWWKELGLAKDLKLARDEPIKWYMWAMACLPDPRFSEERIELTKPLSLVYIIDDIFDFCGNIDELTLFTEAVKRWDMAATEQLPDYMKGCFKALYDITNEFAFKIQIKHGWNPISTLIKSWVRLLNAFLEEAKWFASGLVPKADDYLKNGIVSTGAHMILVHSFFFMGDAITQETITLMDEFPSIISATATILRLCDDLEGDQDVNVKGDDNDGSYIKCYMKEHPATSVEQAREHVAELISDAWKRLNQECLMTDANLFPSSFTKLCLNAARMVPLMYGYDTNSPSKLEEYVKSLLCGGAMQSIPEDQTIVS

SEQ ID NO: 126463 - protein, 669 aa, Glycine max
  Coding DNA Sequence Number=SeqID_34778
  Gene Ontology: Mol. function=microtubule motor activity; Cellular component=microtubule associated complex; Biological process =microtubule-based movement
  Homolog annotation: Hit_ID=A7R222; Match level="QueryCoverage=91%, HitCoverage=77%, E-value=0.0, Identity=60%"; Hit description =Chromosome undetermined scaffold_394, whole genome shotgun sequence
  Pfam annotation: Domain name=Kinesin; Domain location=434-662; Score =55.7; E_value=6.5e-19; Accession=PF00225.14; Description=Kinesin motor domain
MASRYHSSTNKKVGPEEASLDKRRRILGADKMDRQQGGRVRTPFSVVTNNAATSDAAEGAAVVVDFTKDEVETLLNEKKGNTYDNKKKIEQMTDLIKRLKLCVRWFKRIEEGYVQEKEKLRFELEAAEKKCTDTETEMKSKIEELEETVSDLRKTISSLEERIVKEESDKLEAINSYGKEKEARTEAEKVLDEKSAELEKVRDEKSVAVKKAISNEDLYKRSQEYNVSLQQYNSRLQSDLETANEAHKRLESEKATIVESLSNVRGHNKALQDQLVSLKVSQDEAIKQKEILGNELKCLREELKQIRDDRDHQLGQVNALTGEIAKYKEYTGKTCTQLDTLMIKTNALEETCSSQKEQIHIMQQQLFAEKEKLKNADLSASETRTMFEEQKIIIRELQDRLADKEFQVIEGERLRKKLHNTILELKGNIRVFCRVRPLLAEDSLGTDMTVSFPTSTEVLDRGIDLVQSGQKYNFTFDKVFNHEASQQDIFIEISQLVQSALDGYKVCIFAYGQTGSGKTYTMMGRPDAPDLKGLIPRSLEQIFQTSQSLKDQGWKYTMHVSIYEIYNETIRDLLSSNRSSGNDHTRTENSAPTPSKQHTIKHESDLATLEVCSAEEISSLLQQAAQSRQCALVIGLPSLCNIIVDKWCKKGFKNLTGTRLMHRRWLTVI

SEQ ID NO: 126464 - protein, 126 aa, Glycine max
  Coding DNA Sequence Number=SeqID_34779
  Gene Ontology: Mol. function=endopeptidase inhibitor activity; Cellular component=extracellular region; Biological process=response to biotic stimulus
  Homolog annotation: Hit_ID=Q04106; Match level="QueryCoverage=98%, HitCoverage=79%, E-value=5e-38, Identity=56%"; Hit description=Prb-1b
  Pfam annotation: Domain name=SCP; Domain location=15-114; Score=74.7; E_value=3.1e-19; Accession=PF00188.17; Description=SCP-like extracellular protein
  Subcellular localization annotation: CTP_CleavageSite=22; ConfidenceScore=5.14e-01
MGHSGHAHDSQANFFNVHNAARSQVGVPPLTWDNTLAAFAQSYANLRNVIANLSTHADHTVRAWVNEKANYDYNSNTCSSVCGHYTQVVWRNSLRVGCAKVRCDNGSTFIICCYDPRGNIRGQRPY

SEQ ID NO: 126465 - protein, 375 aa, Glycine max
  Coding DNA Sequence Number=SeqID_34780
  Gene Ontology: Mol. function=oxidoreductase activity, acting on the CH-OH group of donors, NAD or NADP as acceptor; Cellular component =glyoxysome; Biological process=tricarboxylic acid cycle intermediate metabolic process
  Homolog annotation: Hit_ID=Q5JC56; Match level="QueryCoverage=100%, HitCoverage=100%, E-value=0.0, Identity=87%"; Hit description=Malate dehydrogenase
  Pfam annotation: Domain name=Ldh_1_C; Domain location=190-373; Score =242.8; E_value=7.4e-70; Accession=PF02866.9; Description =lactatemalate dehydrogenase, alphab
  Pfam annotation: Domain name=Ldh_1_N; Domain location=45-188; Score =249.4; E_value=7.8e-72; Accession=PF00056.14; Description =lactatemalate dehydrogenase, NAD bind
  Pfam module annotation: Pfam domain module=Ldh_1_C::Ldh_1_N; Domain location=190-373::45-188
MEARAGANQRIARISAHLQPPNFQEGSDVLLKSAECRAKGGAPGFKVAILGAAGGIGQPLSLLMKMNPLVSVLHLYDVVNTPGVTADVSHMDTGAVVRGFLGQQQLESALTGMDLVIIPAGVPRKPGMTRDDLFKINAGIVRTLCEGIAKSCPNAIVNLISNPVNSTVAIAAEVFKKAGTYDPKRLLGVTTLDVVRANTFVAEVLGVDPREVDVPVVGGHAGVTILPLLSQVKPRSSFTAEETEYLTNRIQNGGTEVVENDAIACVWIAFKITIDDGEAKAGTGSATLSMAYAAAKFAGACLRGLKGEAGVVECAFVDSQVTELPFFATKVRLGRAGAEEVYQLGPLNEYERIGLEKAKRELAGSIQKGVEFIRK

SEQ ID NO: 126466 - protein, 514 aa, Glycine max
  Coding DNA Sequence Number=SeqID_34781
  Gene Ontology: Mol. function=squalene monooxygenase activity; Cellular component=integral to membrane; Biological process =metabolic process
  Homolog annotation: Hit_ID=A7QGY6; Match level="QueryCoverage=97%, HitCoverage=99%, E-value=0.0, Identity=80%"; Hit description =Chromosome chr3 scaffold_95, whole genome shotgun sequence
  Pfam annotation: Domain name=DAO; Domain location=40-277; Score= -21.7; E_value=0.0003; Accession=PF01266.15; Description=FAD dependent oxidoreductase
  Pfam annotation: Domain name=FAD_binding_3; Domain location=38-386; Score=-48.8; E_value=4.6e-09; Accession=PF01494.10; Description=FAD binding domain
  Pfam annotation: Domain name=SE; Domain location=189-462; Score =654.5; E_value=8.8e-194; Accession=PF08491.1; Description=Squalene epoxidase
  Pfam module annotation: Pfam domain module=DAO::FAD_binding_3::SE; Domain location=40-277::38-386::189-462
MDYQYILGGIMACSFAFFNECAKISSENGICSHEDAGSADIIIVGAGVAGSALACTLGKDGRRVHVIERDLSEPDRIVGELLQPGGYLKLIELGLEDCVDEIDAQQVFGYALYKDGKNTKLSYPLENFGSDISGRSFHNGRFIQRMREKASSLPNVKLEQGTVASLLEEKGTITGVHYKTKSGEEFTAKAPLTIVCDGCFSNLRRSLCNPKVEVPSHFVGLVLENCNLPYANHGHVILGDPSPILFYPISSTEIRCLVDVPGQKLPSLGSGEMARYLKTVVAPQVPPELYDSFIAAVDKGNIRTMPNRSMPASPYPTPGALLMGDAFNMRHPLTGGGMTVALSDIVVLRDLLKPLHDLHDASALCRYLESFYTLRKPVASTINTLAGALYKVFCASPDPARKEMRQACFDYLSLGGVFSDGPIALLSGLNPRPLSLVLHFFAVAIYGVGRLLIPFPSPKRMWIGARLISGASGIIFPIIKAEGVRQMFFPATVPAYYRTPPVHPLNTHEGNTWN

SEQ ID NO: 126467 - protein, 712 aa, Glycine max
  Coding DNA Sequence Number=SeqID_34782
  Gene Ontology: Mol. function=oligopeptide transporter activity; Cellular component=integral to membrane; Biological process =oligopeptide transport
  Homolog annotation: Hit_ID=A7UQT0; Match level="QueryCoverage=95%, HitCoverage=98%, E-value=0.0, Identity=79%"; Hit description =Peptidase aspartic, active site; Oligopeptide transporter OPT superfamily
  Pfam annotation: Domain name=OPT; Domain location=40-676; Score =721.3; E_value=6.8e-214; Accession=PF03169.6; Description=OPT oligopeptide transporter protein
MAEVKSEEPEKANTNVKEEEEEEEEEEEESPIEEVRLTVKNTDDPTQPPLVITQITVQVATLPLGHLMAVVLPTAMFRIPGFGTKRFSFNPGPFNMKEHVLITIFANAGSAFGSGSPYALGIVNIVKALYRRKISFISSWLLVLGYGWAGLLRKYVVEPAHMWWPSTLVQVSLFRALHEKDERRFSRAKFFFIALVCSFSWYVIPGYFFSTLTNISWVCWIFSKSVTAQQLGSGMNGLGFGALTLDWTAVASFLFSPLISPFFAIVNIFVGYTLVVYVVIPIAYWGLNVYSAHMFPIFSSNLFTSQGQEYNISAIVNEKFELDIAKYHQQGRIHLSVFFSLTYGFGFATVASTLTHVVCFYGREVMERYRASAKGKEDIHTKLMKKYKDIPTWWFYVMMGVTLVVSLVLCIFLNNQVQMPWWGLIFASALAFIFTLPISIITATTNQTPGLNIITEYLFGIIYPGRPIANVCFKTYGYISMAQAVSFLGDFKLGHYMKIPPRSMFLVQFIGTMLAGTINICVAWWLLNSINNICHKDLLPEGSPWTCPSDRVFFDASVIWGLVGPLRIFGSHGDYQALNWFFFGGAIGPILVWILHKSFPKQSWIPLINLPVLLGATGMMPPATPLNYNAWIIVGTIFNFFIFRYRKKWWQRYNYVLSAALDAGVAFMAVLLYFTLGLENTSLNWWGTAGEHCPLATCPTAKGIVVDGCPVY

SEQ ID NO: 126468 - protein, 149 aa, Glycine max
  Coding DNA Sequence Number=SeqID_34783
  Pfam annotation: Domain name=zf-CCHC; Domain location=77-94; Score =23.1; E_value=0.00048; Accession=PF00098.14; Description=Zinc knuckle
MELQQLNQNEETDKRKRSIALKVSSSMQEENEDEESGDKEDFSLFVKKFHKFIKNIIIERRQNFNHGKRFQEDSPTLRCYKCNQLGHIKANFPSNEQWPEKNEKKSHKERRSKKAYIAWDDNYSSDGSEKEINLLSKDYESDENISQED

SEQ ID NO: 126469 - protein, 610 aa, Glycine max
  Coding DNA Sequence Number=SeqID_34784
  Gene Ontology: Mol. function=solute:hydrogen antiporter activity; Cellular component=integral to membrane; Biological process =potassium ion transport
  Homolog annotation: Hit_ID=A7QSB4; Match level="QueryCoverage=85%, HitCoverage=82%, E-value=0.0, Identity=69%"; Hit description =Chromosome chr3 scaffold_157, whole genome shotgun sequence
  Pfam annotation: Domain name=Na_H_Exchanger; Domain location=2-307; Score=65.8; E_value=1.4e-16; Accession=PF00999.12; Description =Sodiumhydrogen exchanger family
  Pfam annotation: Domain name=Na_H_antiport_1; Domain location=141 -394; Score=-307.7; E_value=0.092; Accession=PF06965.3; Description =Na+H+ antiporter 1
  Pfam annotation: Domain name=TrkA_N; Domain location=340-465; Score =95.2; E_value=2e-25; Accession=PF02254.9; Description=TrkA-N domain
  Pfam module annotation: Pfam domain module=Na_H_Exchanger::Na_H _antiport_1::TrkA_N; Domain location=2-307::141-394::340-465
MGLELSLARLKALAKYAFGMGLAQVVLSTLAFTAFELPPNGAVGTKILEFLFHSRPDLVNIRSVDEAVVIGAALSLSSSAFVLQDLAVVPLLVILPILESQNITEGSIWPMLAQESLKALGGLGLLSLGAKYILRRVFEVVADTRSSEAFVALCLLTVAGTSLVTQNLGFSDTLGAFLAGAILAETNFRTQIEADIRPFRGLLLGLFFLTTGTSIDMQLLLREWPNVLSLLGGLIVIKTLIITAIGPRVGLTLKESVRIGLLLSQGGEFGFVVFSLANRLGVLPLELNKLLIIVVVLSMALTPFLNEAGRRAASFIEDKFDAENKQNASETVNFNVSEPVVILGFGQMGQVLANFLSNPLASGGDSDEVGWPYVAFDLDPSVVKAARKIGFPVLYGDGSRPDVLHSAGVSIPKAFMIMYTGKKKTIEAVQRLRLNFPAIPIYARARDLKHLLDLKKAGATDAILENAETSLHLGSKLLKGLGVMSDDVAFLSQLIRDSMELQAQEGIGQSEDRGLDIMKPLQVKVADVREAHVLTATTSPETELSEMNQKHQASSIRNQREVDSEEQDYELNEAVNLEGNGVLVSKQSSEESSMVVDPSNPSSHTATEEP

SEQ ID NO: 126470 - protein, 153 aa, Glycine max
  Coding DNA Sequence Number=SeqID_34785
  Gene Ontology: Mol. function=protein serine/threonine kinase activity; Biological process=protein amino acid phosphorylation
  Homolog annotation: Hit_ID=A7QXX4; Match level="QueryCoverage=74%, HitCoverage=16%, E-value=4e-19, Identity=44%"; Hit description =Chromosome undetermined scaffold_234, whole genome shotgun sequence
  Pfam annotation: Domain name=Lectin_legB; Domain location=32-152; Score=-61.6; E_value=3.3e-06; Accession=PF00139.10; Description =Legume lectin domain
MAASRYCKKSYVHASFHAITLTLLLLAIPHAASLSFNYQQLGDTGIALNFSGKARRDNDVINLTRSEPDSYGRVTYYELLHLWDKNSEKVTDFTTHFSFTINTPNKTHHGDGITFFLAHPDFPQSDIDGSGIGLASREQLKNLNFAKDYPFVA

SEQ ID NO: 126471 - protein, 210 aa, Glycine max
  Coding DNA Sequence Number=SeqID_34786
  Subcellular localization annotation: CTP_CleavageSite=70; ConfidenceScore=5.59e-01
MGKNKGRQSHSAAKQIMVKGTTSGSSKSQTSATSGLDNLLGKVLVKKAGTSFAKTDDVAHQVFDNLSECSAESESCPEVSCTLGDNDSTTDDDSSHSCGSKSSPQLHDNKALTPWVNLFKDNRNLSKGFGMKFSPPPSDDEVLLEETDLQPLEEAWGHSLIGYVAGRFPGKKALLDCCQKWGVKFSYSTHESGWVMFKFESEDELNQVPL

SEQ ID NO: 126472 - protein, 442 aa, Glycine max
  Coding DNA Sequence Number=SeqID_34787
  Gene Ontology: Mol. function=transferase activity, transferring glycosyl groups; Cellular component=cytoplasm; Biological process =metabolic process
  Homolog annotation: Hit_ID=A4F1R4; Match level="QueryCoverage=98%, HitCoverage=97%, E-value=1e-167, Identity=66%"; Hit description=UDP -glucose:anthocyanidin 3-O-glucosyltransferase
  Pfam annotation: Domain name=UDPGT; Domain location=10-442; Score =10.1; E_value=4.1e-11; Accession=PF00201.9; Description=UDP -glucoronosyl and UDP-glucosyl transferase
  Subcellular localization annotation: CTP_CleavageSite=32; ConfidenceScore=5.00e-01
MSNSTENKHVAVFAFPFGTHTVPLLNLVLKLSQAAPNCSFSFIGTEKSNAIHFPKPHIPINIKPYCISDGIPEGHPLANHPIEKLNFFLRTGHENLHKGIQMAEEETKQKVTCVISDAFVSSSLVVAQKLNVPWIAFWPPMSCTLSLYFYIDLIREQFLNSAGNAAFDFLPGLPNMRVEDMPQDLLFFGEKETIFSKTLVSLGKVLPQAKVVVMNFFEELDPPLFVQDMRSKLQSLLYIVPVRFPILSVADSTGCLSWLDMQGSRSVAYVSFGTVVTPPPHEIVAVAEALEESELPFLWSLKENVLGFLPTGFLERTSMSGRIVYWAPQTQVLAHDSVGVFVTHCGSNSVTESLSSGVPMICRPFFGDQGVAARVIQDLWEIGVIIEGRVFTKDGLLKSLKMIMVQEEGKKIRDNALKLKKTVEDAARPAGKSAHDLKTLLE

SEQ ID NO: 126473 - protein, 403 aa, Glycine max
  Coding DNA Sequence Number=SeqID_34788
  Gene Ontology: Mol. function=nucleotide binding; Cellular component =mitochondrion; Biological process=cell division
  Homolog annotation: Hit_ID=A2Q1P1; Match level="QueryCoverage=55%, HitCoverage=67%, E-value=5e-74, Identity=54%"; Hit description =Dynamin central region; Dynamin GTPase effector
  Pfam annotation: Domain name=GED; Domain location=109-172; Score= -6.1; E_value=0.0093; Accession=PF02212.9; Description=Dynamin GTPase effector domain
  Subcellular localization annotation: CTP_CleavageSite=47; ConfidenceScore=5.02e-01
MDYINTSHPNFIGGSKAIEAAVQQTRSSRIALPVSRVKDALESDKGSASERSGKSRSILARHANGVVADQEMTASKPHTEPVHTVQSFSTIHLREPPPVLRPLESNSETEAVEITVTKLLLKSYYDIVRKNVEDLVPKAIMHFLDLNELPLEAETVERGYSLPETTTGLPKIRGLPTSSMYSTGSLGDYYEASPKNTKSRKSSHSGELQSPFHDSNGNGGPYTSGRSARPAPRAAPRPAPVHHAPPPAPAQSGGGSMLGGIGSTIAQGMAFGTGSAVAHRAVDAVMGPRTIQHEAVVTEAAAAAPAPTANTFGGDACNVHTKAFQDPTGKVFGLVGFGLVGWAVDGGGPAGVGKDDADDELIGGVWCTIRKKGERKKGLKGKKEILDNVKGEMPSHLSSLAEC

SEQ ID NO: 126474 - protein, 131 aa, Glycine max
  Coding DNA Sequence Number=SeqID_34789
  Homolog annotation: Hit_ID=Q8GXK1; Match level="QueryCoverage=88%, HitCoverage=57%, E-value=1e-30, Identity=56%"; Hit description =Putative uncharacterized protein
  Subcellular localization annotation: CTP_CleavageSite=58; ConfidenceScore=5.60e-01
MSRNGDVVEQNAAPSTTSSSSTIRNRTDPFLVACRCFSFFTSLAAILCIAVNFLSAVRSFKHASDIFDGIFRCYAVLVAAFVVLAETEWSFILKFSKVLEYWAARGMLQILYAFLSIYSKLYDAYFHYALI

SEQ ID NO: 126475 - protein, 82 aa, Glycine max
  Coding DNA Sequence Number=SeqID_34790
MGELALDFRLVLKLQTVCRRSSSTLHLLPLEVFCTAKLLLVVLDLDKASCQVVKKDGNGRFGILIGGVLGRMAVAELLGMQI

SEQ ID NO: 126476 - protein, 103 aa, Glycine max
  Coding DNA Sequence Number=SeqID_34791
MPAPAIPIPILIAAAAAAAIVVGVPEGLPEGIDAFRDLGEVVQHGLPAAFGAAATAVVGGGGGEAAAGGLQREREERGRPRRRERNGELLRREGDWEYAICVD

SEQ ID NO: 126477 - protein, 543 aa, Glycine max
  Coding DNA Sequence Number=SeqID_34792
  Gene Ontology: Mol. function=transcription regulator activity; Cellular component=nucleus; Biological process=regulation of transcription
  Homolog annotation: Hit_ID=A5C8Z8; Match level="QueryCoverage=77%, HitCoverage=99%, E-value=5e-37, Identity=31%"; Hit description =Putative uncharacterized protein
MVCQAASQTRFRALKHEYGIDGAATIIVRVIACFQPLHFCQAEYFRHLLKPVTKFPKISYKSTITSTGHLFCWMVKADESLPRPHHVAWQSPSSNHFSILPKPSLLSLPAYLNSSTSILPAVSTFHGLAAPSIPSLKSMLKNEVQGFLQYCNADTSLKETHFGGALQNANPSLQKRLLIFDRSDNKTRLFYGPVLPLVQSPTVTATKFAQSYGINGEGQASNVGQKHLTRYSLLKESVKDHAITEESENHEDTEEINALLYSDDESPEGDDDDSCDEVTSTDHSPLATNKTYVIQEQFEDTKEEVASSDWPNKRLKLFDGDYNRSSTPADRYSLLRPNETCDCVSDAESKNSCGWAYSVDKTKVDNSVACDIKFKKDKISESLKVLENLIPGAKGKGPLLVIDGTIEYLKILMSQTGALGDMLGAPSIIAGAPSNLLKGQHSLPPQATASPAATSFAWTPLPFEGKGADDEASGRPVMGSSGTSGRTFSGNFPEEVFFRKKPNVFRKNSSSRNFPEEGFFRKRLGFPEEVFFRNNSGRTLLPE

SEQ ID NO: 126478 - protein, 205 aa, Glycine max
  Coding DNA Sequence Number=SeqID_34793
  Gene Ontology: Mol. function=oxidoreductase activity; Cellular component=cytoplasm; Biological process=flavonoid biosynthetic process
  Homolog annotation: Hit_ID=A7Q651; Match level="QueryCoverage=90%, HitCoverage=91%, E-value=1e-59, Identity=61%"; Hit description =Chromosome undetermined scaffold_55, whole genome shotgun sequence
  Pfam annotation: Domain name=2OG-FeII_Oxy; Domain location=56-155; Score=126.3; E_value=8.9e-35; Accession=PF03171.11; Description=2OG -Fe(II) oxygenase superfamily
METTNKGHLINNPNKDTSAEYCRRTWKVGKELLKGISESLGLEANYIEDTMNLDSGWQMIAANMYPPCPQPELAMGIPPHSDHGLLNLLMQNGVSGLQVLHNGKWINVSSTVNCLLVFVSDHLEVVSNGKYKSVLHRAVVSNKATRMSLAVVIAPSLDTVVEPANELLDNQRNPAAYVGMKHTDYMQLQRSNRLNGKAVLDKVKI

SEQ ID NO: 126479 - protein, 122 aa, Glycine max
  Coding DNA Sequence Number=SeqID_34794
  Pfam annotation: Domain name=Transposase_23; Domain location=11-71; Score=-9.6; E_value=0.013; Accession=PF03017.5; Description =TNP1ENSPM transposase
MGDSDMCGLYIKANPTCLGALGRVYEGSTVVHNTLLLPGQVKVGVEEVKDPDAPVPIPTDEVSLVGQAIHTFLSWPTHLVKSLSQQTVVSPAKPPQKSDPEVDDPLYLMTLTIPKLFLRPYQ

SEQ ID NO: 126480 - protein, 154 aa, Glycine max
  Coding DNA Sequence Number=SeqID_34795
MGQKLDPRELDNTAAQVHVHLHHQAIYQPCPINIKIKSVRGRRKVKVVKYTPCLSECSEVCVHVLKACQIFLSFSKDDWGVEEVIDVGAEFLDQSIVNLLLLEFGEYPAALPPLELSVKFTEHPCGELYVPLRSEARGIPGGFPSLCRNCSAFS

SEQ ID NO: 126481 - protein, 116 aa, Glycine max
  Coding DNA Sequence Number=SeqID_34796
MLDDEPFVQVKRSFAIGAGAVTSFGYRKDRNGQWLKKDALPPQDECTPSPPPRREDSALLNEVLTKLRGLRCYVGERFDSLDTRFAGMDIRLTQVEEDVSFIRTCFDPPPPPPSSS

SEQ ID NO: 126482 - protein, 147 aa, Glycine max
  Coding DNA Sequence Number=SeqID_34797
MKNIPDSGIIFTFKEENDLNDRLKLVKNGRKETEIERNKDESQKTRNELKSLGFGNLPVEERRTEENLHGFAYGNISEALRKHLGLDFLHENNFFSPKTAEMHSQGDQGKKGGGGGRLPPSSPRQAGLIPPEAIQLRKTVWKAYIKI

SEQ ID NO: 126483 - protein, 56 aa, Glycine max
  Coding DNA Sequence Number=SeqID_34798
MAKNNADEGGCWQQQRVPPSVVHKERSGMRVEGEIFQSVDLMGAAIQQFYRIKMCP

SEQ ID NO: 126484 - protein, 41 aa, Glycine max
  Coding DNA Sequence Number=SeqID_34799
MLRTTGFQDEFGVEIGTDISNPIPVPTLGYQGKPNPDPKCG

SEQ ID NO: 126485 - protein, 197 aa, Glycine max
  Coding DNA Sequence Number=SeqID_34800
VAKEKPIGDVDSGMKDAAAGELCVYLEDGGLAAAGGERVGLAGVGFCCKSARRGGGIGMEASSVGDCTGEEDGKCGLFGGHGVYDSGKFELTRGEFCDGWFDAIYSRPFGGVDSGMKVREEVAGELQADPEDDDPTVVGGECVGLAVSGEVESTWGHLVSVTMQGRKMESVEWYREGSFTEEGHPVWWPWRLWKHRV

SEQ ID NO: 126486 - protein, 119 aa, Glycine max
  Coding DNA Sequence Number=SeqID_34801
MTLPFAAIETFVLACLLKDQSKNEFKIFKIESRTLQDSRGKLISRIKNQDSRDQDFKNQDSRDQDSRLKIQESREGLIKISMKRFSQKLSSIWIFLKTCLPKSFYSLVIDYQIAVIDYQ

SEQ ID NO: 126487 - protein, 51 aa, Glycine max
  Coding DNA Sequence Number=SeqID_34802
IEEAKEHHLDEDAMIPHNVAPCRACRPWIFFINGVLCFLKINGSGMEKVER

SEQ ID NO: 126488 - protein, 149 aa, Glycine max
  Coding DNA Sequence Number=SeqID_34803
MYYIIVCILLPRSTNLAQASKEDLILLWALQTGRQIDWARLVWYRMHKALRANAPLPYPHLVILFLHHFKVLLDDEPFVKVKRFFSIGAGVVTSFGYQKDMGGQWVRKQDLPPPIPDERTPSPPPQRDASSSLLIEVLIELHDLQAFVG

SEQ ID NO: 126489 - protein, 80 aa, Glycine max
  Coding DNA Sequence Number=SeqID_34804
MGKRWLRWHLPKDPFQVLPELPEERVPEDFQKKGSSGSNETSFGKLPEHLFQKKVLPDDLSVLPKALSRRPLLPESFRKN

SEQ ID NO: 126490 - protein, 72 aa, Glycine max
  Coding DNA Sequence Number=SeqID_34805
  Homolog annotation: Hit_ID=A5AEQ1; Match level="QueryCoverage=79%, HitCoverage=13%, E-value=4e-08, Identity=54%"; Hit description =Putative uncharacterized protein
MADNNSFIPNPHESSKPLACITFTNVTKLLPNNYPNWKQQVEALLDGYDLLQNPDGSFPAPSETTPTTASLP

SEQ ID NO: 126491 - protein, 253 aa, Glycine max
  Coding DNA Sequence Number=SeqID_34806
MAERTVVLTSTVDADDAPSTVDGGLWFVAPLHGGSWFVAARASSFVAEEEEEESNGEEEKGSARKKKNGSGEESNALWEKKNQKLELLGAPSNIADSSSLPEHRFFFSPGTQILLLSRNTASSSLPEQLLLLPEPASSSLLREASSPRGAPRLSSSSPRTDPLGVLPEVPEEHFPESFWKNCSSGSNQTSSGRTLLPEDSRKTSSGNFPEEVVHPEEFRKTHSSGRTFKFPEDLSGRTPSSGMFPEEPLLPEV

SEQ ID NO: 126492 - protein, 164 aa, Glycine max
  Coding DNA Sequence Number=SeqID_34807
MAMRESVWFLGFSPVSKRKKDVPRGKGEEKEENKDRGGMKGWAPPPPEEALDVASFLASFGSSRFLLPLLRQRHREPSAKLLLLLRERGFETRIEDAGKNGKKGLTAAASGRFVRGSSGTSKRSCSGNIPTLLPEFSRNTSSGKFPEEVVLPEEFRKKCSTDDL

SEQ ID NO: 126493 - protein, 55 aa, Glycine max
  Coding DNA Sequence Number=SeqID_34808
MSSRDLFLGLRQSAIPEPNVFFVCPNLYRRADGATVGVLHHHDEASETYLLLDGD

SEQ ID NO: 126494 - protein, 335 aa, Glycine max
  Coding DNA Sequence Number=SeqID_34809
  Homolog annotation: Hit_ID=A2Q6B4; Match level="QueryCoverage=40%, HitCoverage=55%, E-value=3e-15, Identity=33%"; Hit description =Ribosomal protein L33; Nucleic acid-binding, OB-fold
  Pfam annotation: Domain name=DUF223; Domain location=40-135; Score= -9.4; E_value=0.023; Accession=PF02721.5; Description=Domain of unknown function DUF223
MARAPDNIKSINRSKETLKLAVRIIDLWFVGTPNRSEQAEMVIIDSHGDAIHVVCKQDQLKSWKADLMENCTYVMHNFKVMKNDGQFKICDHQYKLVFTGVTVVRQSDLEDLPFKKYKFAYFTNVIAGLFQPKLLVGSYAPSVSNSLRASKLLINEAVFEIQEFRERLSDLGIQVSGSSQLSSKDAFLSKAEAKTISKINNISEEGDVDLNVSPQALDKLLGYVLTFKVKVQPKFNNVVVLRYSNDLDLINVVVAMLPDIEACSKVHAPIPDSDDPSQLEFQSVSVTANHDPLLGLPLTPTKQITSDDCDDEPKSSQISPIQLSSNKLARHDQIE

SEQ ID NO: 126495 - protein, 143 aa, Glycine max
  Coding DNA Sequence Number=SeqID_34810
MKGKKSWIIHDAILPRKGPITRTISKRLQEDWARAAEEGPKVLMNLRTHLLLEVASPLSLPFSIPLPFIFQEAKESIDEEDPRPTSSNGACINPDQRNNFTIYNKDTPESSTSILKRATKVKSKQTPNWYNRYKKMKPQIYRA

SEQ ID NO: 126496 - protein, 44 aa, Glycine max
  Coding DNA Sequence Number=SeqID_34811
MKRKNTLPVTLRDDLTIEILLRLPLRHPPTNFFRDAMTFIKLSP

SEQ ID NO: 126497 - protein, 346 aa, Glycine max
  Coding DNA Sequence Number=SeqID_34812
  Pfam annotation: Domain name=AT_hook; Domain location=166-178; Score =14.5; E_value=0.076; Accession=PF02178.10; Description=AT hook motif
  Pfam annotation: Domain name=AT_hook; Domain location=198-210; Score =7.6; E_value=1.2; Accession=PF02178.10; Description=AT hook motif
  Pfam annotation: Domain name=AT_hook; Domain location=233-245; Score =8.0; E_value=1; Accession=PF02178.10; Description=AT hook motif
  Pfam annotation: Domain name=AT_hook; Domain location=94-106; Score =10.8; E_value=0.33; Accession=PF02178.10; Description=AT hook motif
  Pfam module annotation: Pfam domain module=AT_hook::AT_hook::AT _hook::AT_hook; Domain location=166-178::198-210::233-245::94-106
  Subcellular localization annotation: CTP_CleavageSite=38; ConfidenceScore=5.18e-01
MVCSSHSNQKETSSSSQPAAPNSPVNPTHDIGKQLVVPTSEGSPECIVSKGIELPPTQLQQVSSDDMGPALQSRPKGDLDENLLSRGSEQKPPKHPRGRPPKLETEANYPGKSLLPSYDDIHDEQRPNINKMEKQHQSGRGRGRGRGRGGVKLGRVRGRVKGRGRGRGRGRPPKLKEDPIQYEEQLQEEDQPQQGRQGRGQGRPRKLIQDTNICEAQLPEEVQAKQQGVRVPGRGRGRPPKPKENTNQWTNDSKGLEWKKLKVQRGEASKIRVKRSKVTSGVKVGIRIKIWVKRGFPILMLKQNRALAASASSKFKVEMDFIRMKSLATSITSMSMLGEGLLIKPD

SEQ ID NO: 126498 - protein, 128 aa, Glycine max
  Coding DNA Sequence Number=SeqID_34813
MDNKMRNKELKVMPSRHRDCARRTPSGPKEVQQGPGVSSSDYGPLSVLRSARHPQQGHQASYYPSFHQEVLRPHAGRGRDTTTAWGWPATGNKCTTATSRAPQLIHKKVRVLPMTHGRPIGSQVQGQR

SEQ ID NO: 126499 - protein, 99 aa, Glycine max
  Coding DNA Sequence Number=SeqID_34814
MNWRSRLLSCCFLLSKWISFKDKWLRRNSLILYIWHRLICWHRLLGYGGLTPSRRRRLDSWPSHSCKELLHTHGRLLAKALQPLNDDDLTSVQALEHGK

SEQ ID NO: 126500 - protein, 95 aa, Glycine max
  Coding DNA Sequence Number=SeqID_34815
MSLHVLYLYAFSRFPPRDFRSVVSLGQDHLGLPSGVKTKHERQKPIKVLKDECKRGWGHDRPIVALLCAKQAGNVAARQPRILCILQLSFTTCLF

SEQ ID NO: 126501 - protein, 111 aa, Glycine max
  Coding DNA Sequence Number=SeqID_34816
MWSPASIDQLQEYRIALCQAPDGARTHALQLATEAQTPEHTVFMTKVVPTELLLRGNLRAISKAVTLTNGQRYWVDPHGVWLTLEELDALESDDDSEVPWINGLPALFAPK

SEQ ID NO: 126502 - protein, 131 aa, Glycine max
  Coding DNA Sequence Number=SeqID_34817
MDKSLKVGEYEWRERERRSMKFCASNEVQIESVEPNCRAKISLINISEFLLWFSPLIQDQVLDSPLSVLRCHEASHGPEIYLSYPNFVRGLLFDGMQPLVERFEVLGALCCTIREVPRHARNQKEALLRNP

SEQ ID NO: 126503 - protein, 98 aa, Glycine max
  Coding DNA Sequence Number=SeqID_34818
MLHSMLQSLHRGQSIIMQSLQGLGLPSVMSMDEFDAQVAWPGAQPSPFGGGGASAAQEPEPEEPAVAATEGEDELTPPEPFYFDAGVHMAQEEETSID

SEQ ID NO: 126504 - protein, 188 aa, Glycine max
  Coding DNA Sequence Number=SeqID_34819
  Gene Ontology: Mol. function=cation:chloride symporter activity; Cellular component=integral to membrane; Biological process=sodium ion transport
  Homolog annotation: Hit_ID=A4VCJ8; Match level="QueryCoverage=56%, HitCoverage=10%, E-value=3e-37, Identity=77%"; Hit description =Cation chloride cotransporter
DAGSRQARQGASAGVGGCRGWLNYAASEQIVLRVHHMRAIGAGLFAITPAGERGMCCKAIKLGNARVFPVTTLIPFVITMKWDAQMDGGGGSPAQDESMDAFTSAQQRIDNYLTQMKATAEREGTPLMADGKPVVVNEKQVEKFLYTTLKLNSTILRYSRMAAVVLVSLPPPPVSHPAYFYMVPSSNS

SEQ ID NO: 126505 - protein, 43 aa, Glycine max
  Coding DNA Sequence Number=SeqID_34820
MSKRLQEDWARVAEEGSRVLMNLRVGYPRNIGFFSPCILGHLD

SEQ ID NO: 126506 - protein, 310 aa, Glycine max
  Coding DNA Sequence Number=SeqID_34821
TETNMLAIIAKYQEELGLATAHEHRIADEYAQVYAEKEARGRVIDSLHQEATMWMDRFALTLNGSQELPRLLAKAKAMADTYSTPEEIHGLLGYYAGTDESRHVGSERTNGLHDGGHVRYEQLMEKNAGTAAAVSSAAEADPTLLATTHHSPSNIVGRGRDTLGHDGSPHLGYNRAAYPYGLPPNYSPPMLQEEAGHIASPVHEKEPPQQPDEAHKDPQDYARRDVEFYPPIPEGPAPGTLSQPNIAASPIVLSMEGPPPATEERRKLDLLEERLRAVEGFGDYPFADMTDLCLVPDVVIPPKFKVPDFD

SEQ ID NO: 126507 - protein, 121 aa, Glycine max
  Coding DNA Sequence Number=SeqID_34822
MSVSACYQAFCLTDSKRKCYTDNHSGISARQRDSNVSMTDLVSAEDDVNLRVSTGLSAAIDEGCRRRRIKNVYTDNHSGFSARQRDSNVSMTDLVSAEDDVNLRMSTGLLAATDEGCRRRR

SEQ ID NO: 126508 - protein, 159 aa, Glycine max
  Coding DNA Sequence Number=SeqID_34823
MASNSHQFSARSDDAIVIRGVHEVATNSSSSAKTKKLEGKLDALVNLVTQLAMNKKSAPVTRLCGLCSSSDHHTDLCPSMQQLGAIEQPEAYAANIYNRPPQPQQQNQPQQNDYDLSSNRYNPGWRNHPNLRWSSPQQQQQQPAPSFQMWKQSFMMNQQ

SEQ ID NO: 126509 - protein, 135 aa, Glycine max
  Coding DNA Sequence Number=SeqID_34824
EWSSGNTEEVLGGEGGNSGKPRRMVIDAFLAYHHSKESLVITVLAYAYDTFDLRCHRMCLRKNKANWEELLAGMTEVSISWFPRRKEEGARVLCLSQPILRREGDAGLTGASSMGGKCAESPPTFIRGKRRKNRK

SEQ ID NO: 126510 - protein, 132 aa, Glycine max
  Coding DNA Sequence Number=SeqID_34825
MYNYHEKGRASDLESVLVDFMTYQASSKGNCYSSQQQRTQFGKDYSFEEYQWESEWQPCYQNEAEGLSNLDDLLMQFKGRKEEYGEIETHQESILQVNTIHHQLINKEEKDEVFIIPEYSCMATTVYVVGKD

SEQ ID NO: 126511 - protein, 240 aa, Glycine max
  Coding DNA Sequence Number=SeqID_34826
  Homolog annotation: Hit_ID=UPI000065F7CF; Match level="QueryCoverage =50%, HitCoverage=16%, E-value=9e-07, Identity=34%"; Hit description =Homolog of Homo sapiens "Leucine-rich repeats and IQ motif containing 1
  Subcellular localization annotation: CTP_CleavageSite=73; ConfidenceScore=5.04e-01
RAVHPRLHRGACPRPQRTTRPHLKRTTPPHLKRTTHPHLSGLHDPRLQRTKRPHLQRTTCPCLQRTMTSSPLEGSTPSPSKGYMPSPLEDYTSSAFRGLHALAFRGLHVLSIRGLHVLTFGGLHTLAFRGLHVLTFRGLHALAFRRLHVVTFIGLHALAFSDYMSSPIEDYMPSPSEDYTSSPSEGYTPSPSEDYTSSSSEDYTCSPSEDYTSSPSEGCTPSPSKVALVLNFRGIHVLTF

SEQ ID NO: 126512 - protein, 139 aa, Glycine max
  Coding DNA Sequence Number=SeqID_34827
MTTLAQIWMTLLLSNIPPGDRNADLPLRKYQLRSRPQDTPVDLKKFNRVLGFPALITGLCQFYGVPVTPSKGSRLQDTQWTRRSPTGSTVCPSPPASSSGPLLTRLSSRSTAPPGRRMARHHGSLRMAGSGQQTHCHHL

SEQ ID NO: 126513 - protein, 207 aa, Glycine max
  Coding DNA Sequence Number=SeqID_34828
MGSSQMPSLKRRFYQVKVKSLGTTSLKELGQLMGQLQRCFTFGDFQLSPMVEEFEEILGCPLGGRKPYLFSGFYPSLARISKIVQISAQEASRKWGGWNTEKIFGGKSKNLGSFAPFSQRDEACLLARKPPFMHKERRGKLGPTLSKQRRSICQLVPSMEGRKNRSSYFMRRISKCSLDGDEGLHQLQSRSCYKTTWLPYHTGAARG

SEQ ID NO: 126514 - protein, 69 aa, Glycine max
  Coding DNA Sequence Number=SeqID_34829
  Subcellular localization annotation: CTP_CleavageSite=42; ConfidenceScore=5.48e-01
MKDCKNTSGEDVSFTSRSSQSLTNSFQALKLAPVSSSGGLVRARALSALMCRLVHVCDFWLSTPFSLNG

SEQ ID NO: 126515 - protein, 94 aa, Glycine max
  Coding DNA Sequence Number=SeqID_34830
MNWTSSLPIKSSWLVQANRQKRDWSMTIVIRNTSEIKNERRRGLCTVYIVLPMRTTRRRKWWKESEYPEPWSAVGFYSKNPCASSMVPPFERVI

SEQ ID NO: 126516 - protein, 101 aa, Glycine max
  Coding DNA Sequence Number=SeqID_34831
IAPARHPVDPKKSNRVLGFPALIMGLCQFYGVPVAPSKVIRPPTNRAFIKKYCAPRQAQGETPQQPGDGQQQATNVPPPPPEPLSSSTKRLEYCLRHMADQ

SEQ ID NO: 126517 - protein, 165 aa, Glycine max
  Coding DNA Sequence Number=SeqID_34832
MTQKLVTCGDTLRLSAPRHSVTPSVIDEQRPIWSSAPFPEMSASSGGDFFKSHKLSRTTSKSIAFIGHPTRSVILTLRSCDMRRQNLVIPHPFAIQTQSCPMARRDKNWSFCTLCHPEAAGPMTCGDKIWSFRTPFPFRHSRVRWYAETKFGHSAPFVIQRRRAR

SEQ ID NO: 126518 - protein, 116 aa, Glycine max
  Coding DNA Sequence Number=SeqID_34833
MVGYIPSSFADLVFIGERIEAGLKEAKFDHPALMNEKTGANEEDENEEGTHVVAAIPTWSNFPPAQQCHYSANISPSHYPSPSHPQRPSLNQPQSLPAAHPVPKHQPKRNFVAKSL

SEQ ID NO: 126519 - protein, 211 aa, Glycine max
  Coding DNA Sequence Number=SeqID_34834
KVRKAWEVLQKKDKELRGSNNGPIGGYRKWLKAHVQGLDWLPSLRTAKREEVEAPEEDEELQALRAELEQAQTVKERFKSEALKILKENAELGNVNIATTKALEQETKRARREEHGQNKFRGALWGSNSELKLRREERDQSRAHSMVLKEELAACSRSKRNLSQHLCETKTNMLAIVSKYQEELNLATAHEHKVAGEYARVYAEKEARGRG

SEQ ID NO: 126520 - protein, 15 aa, Glycine max
  Coding DNA Sequence Number=SeqID_34835
VNAVKIFPDAQNGLG

SEQ ID NO: 126521 - protein, 94 aa, Glycine max
  Coding DNA Sequence Number=SeqID_34836
MKALNLVEARDTLPPPWASCQSDLPGPQSPTRDILTQISNLRHYLSHQTSLGSVAVPMMIDGDEHVSYPNFVRGPLLDDVRPFFGPREVLGTHH

SEQ ID NO: 126522 - protein, 93 aa, Glycine max
  Coding DNA Sequence Number=SeqID_34837
MREQRLTINSWRSGLDGGGYMNDDQFMGFRIRFDDGGCTNSGRQSIRGTPNSMVEDVNDDQFMGLRIRLDGGGCTNSARQSIRGAPDSIVEDA

SEQ ID NO: 126523 - protein, 83 aa, Glycine max
  Coding DNA Sequence Number=SeqID_34838
  Subcellular localization annotation: CTP_CleavageSite=21; ConfidenceScore=5.27e-01
MRGYLVVTHTFLQPRANEPVDAQRLTSSSAPSVVLTREVRPVDTQRLTSSYAPFVVLTREVRCHAGLPYGYPYLSSTSGKRAR

SEQ ID NO: 126524 - protein, 152 aa, Glycine max
  Coding DNA Sequence Number=SeqID_34839
MDTSEPYIGAMKGTMCEPQANLGAGQKFSPINVFKQKKRSDKPWDFNQLIKRLHCRHSKIVKFPTSNVQSFAFGMIDPLDESISCFLIRVDPWVLVPIAFRGLHALAFRGLDALSFRGLHALDFRGLHVLDFRGLYALAFRGLQVLAFRRLQ

SEQ ID NO: 126525 - protein, 35 aa, Glycine max
  Coding DNA Sequence Number=SeqID_34840
MGLSGHSHYHRLKGALKPGDPQGLHSEESVRASPS

SEQ ID NO: 126526 - protein, 281 aa, Glycine max
  Coding DNA Sequence Number=SeqID_34841
  Homolog annotation: Hit_ID=A7UQU7; Match level="QueryCoverage=58%, HitCoverage=27%, E-value=2e-21, Identity=35%"; Hit description=IMP dehydrogenase/GMP reductase, putative
MRPDVRPGGGLSQLALICCTLSVALFLLIRVQHTCMWSILTLSGTSLIVVVTLGGLPRLVHMYDQLDEACRTTTRQLAGYLTLFQCWIYEHFPSVHQCVTDDTYQETSPRASRWLTSKAHMKGITGAPYRARCDGLTVTDVSWLPYTEHRGVRAFQEISSFQGQLRWGPMIVAVRPERVVRQFGYIQSIPPPPVSARLSQDQIDDRWMEFADHLLPAGQPCLVPGQVSADYIEWFFRISHPFMTPTQAADQQRDAPAADPEDYIQPPSPQVPVAFDPPPYV

SEQ ID NO: 126527 - protein, 71 aa, Glycine max
  Coding DNA Sequence Number=SeqID_34842
MAFFLSYTKAKTETLKLEMLSGTEASSTLQTSSQRSQWSDHGQTASECGLQRMKKQSKEPISQLLEILGSF

SEQ ID NO: 126528 - protein, 208 aa, Glycine max
  Coding DNA Sequence Number=SeqID_34843
MGEVEKVQEQMKVDMEAMKEQMATMMEAIISMKKIREVDMVAVAATNAVAKVNPMPPFGLKQMNHPTSNMVGKDLGSTDDTMMCKFKTSTPSRHMACLPNYTPPNVAYIPNEDANTSTPILIKIQQPQSDHAHVSRPMEETHGMPHHNLADFEPCLGYATEEKAVGGIPLQNTLEGPQCHPQPQPSHSTAVKTLMLWQKWERGKAQGH

SEQ ID NO: 126529 - protein, 304 aa, Glycine max
  Coding DNA Sequence Number=SeqID_34844
  Homolog annotation: Hit_ID=Q6WAY6; Match level="QueryCoverage=96%, HitCoverage=49%, E-value=1e-36, Identity=32%"; Hit description =Putative uncharacterized protein
MGQLQRQAFCKAYGKIWDLAMVEVSTEAIASLAQYYDQPLRCFTFGDFQVSPLVEEFEEILGCPLGGRRPYLFSGFYPSLARISKIVQISAQELDHRKQVENGVVGIPRKCLEAKARILAGKGKWASFIDILALLIFGGVLFPNVDGLVDLAVIDAFLAYHNHKESSVVAMLADLYNTFDGRCEKSSTRIVCCTPALYVWLVSHLFHQEVRHACPLEGHRSCTERGGANWDRLLANKEGASVNWFPRWKEGRTRILISCGGFLNVPKMGTRGCISYNPVLTIRQLGYPMRRTPLEEGLAPVLSR

SEQ ID NO: 126530 - protein, 373 aa, Glycine max
  Coding DNA Sequence Number=SeqID_34845
  Homolog annotation: Hit_ID=Q2HW90; Match level="QueryCoverage=43%, HitCoverage=32%, E-value=1e-17, Identity=36%"; Hit description =Putative uncharacterized protein
MFGDFQLVPTIEEFEEILGCPLGGRKPYLSSGCLPSLSRIAIVVKDSARGLDRMKQTRKGIAGLPRKYLEDKARGMASQGDWVSFMDVLALLIFGVVLFPNVDGLVDLAAIDGFLAYHHSKESPVVAVLADLFDTFDRRCEKSSARIICCLPALCVWLVSHLFQQDTKHPCPLQSHRSCTEKRRIDWDQLLAGIGVHTRGLDWLAKLKVVSEESFEAPEEDEEVQALKNELGKARLAKEKFKLAATDIRKECVGLREENATTARALEQETKRARKEEYGRNKFRGALWGSNSELKLRREERDQSRAHGMVLKEELVACSRSRRNLSQRLCKTETNMLAIIAKYQEELSLATAHEHRVADEYAQVYAEKEARGR

SEQ ID NO: 126531 - protein, 180 aa, Glycine max
  Coding DNA Sequence Number=SeqID_34846
  Gene Ontology: Mol. function=cysteine-type endopeptidase activity; Cellular component=integral to endoplasmic reticulum membrane; Biological process=proteolysis
  Homolog annotation: Hit_ID=A7QMR1; Match level="QueryCoverage=50%, HitCoverage=25%, E-value=5e-28, Identity=61%"; Hit description =Chromosome undetermined scaffold_127, whole genome shotgun sequence
DAGSRQARQGASAGVGGCRGWLNYAASEQIVLRVHHMRAIGAGLFAITPAGERGMCCKAIKLGNARVFPVTTLIPYRHMANTLSLYRTVKRLGIPDERIILMLADDMACNARNKYPAQVFNNENHRLNLYGDNVGTELEFVIMVIAVSFGKPVVPAALMNRPTRGERRFAYWALFRFLAH

SEQ ID NO: 126532 - protein, 194 aa, Glycine max
  Coding DNA Sequence Number=SeqID_34847
  Subcellular localization annotation: CTP_CleavageSite=28; ConfidenceScore=5.36e-01
MASVKVKSPMVQRTVKVSGSLHFYGKVDGAMVATVLFCISVETFLPIFTGLFSFSFFSRVNKSFKNLAYFGICLMASKRGMLTSTLLKVSRRSKSSSTFFARMDLDGTGDPQEKEIDHHGGLLVTMLVNKDKHYDNIVIPPFSNKVVEFKPTLLSLIGSHPFAGMDHEDPYTHLSTFMELCSTMGASEKNVEAV

SEQ ID NO: 126533 - protein, 73 aa, Glycine max
  Coding DNA Sequence Number=SeqID_34848
MSNHKSSESALKNLENEDKSRSDKAVNEGKEVPYPVVPSKKEKEIGNNHALRRSFTTDATLLQVLEGYVNKET

SEQ ID NO: 126534 - protein, 132 aa, Glycine max
  Coding DNA Sequence Number=SeqID_34849
MARAGDNGGVYHQLDESQRLFLDAWTTQMQRLLTKSSLFTLKPLSPREVCDDQIRMREKREQEKENSEAPQRNMKKSDTPEEKSDTHERKFNYFAEASEVRKVLPAHEPLNLQNLKMSFLRRFLMDYHLQEA

SEQ ID NO: 126535 - protein, 131 aa, Glycine max
  Coding DNA Sequence Number=SeqID_34850
  Homolog annotation: Hit_ID=Q51617; Match level="QueryCoverage=46%, HitCoverage=88%, E-value=1e-16, Identity=75%"; Hit description =Putative uncharacterized protein
  Subcellular localization annotation: CTP_CleavageSite=35; ConfidenceScore=5.70e-01
MASFSSGSQRSRRVTGSPMLCKKAVSSFGPPIVVRSKLAAVLSLMVMAALHNSLTVMPSVRCFSVTGVSRGPFVSRVSVMTVKTSDTCSSRRRSQLVCKRMPGADKPVRARQRVLAGVGAGLTMRHQSRLY

SEQ ID NO: 126536 - protein, 59 aa, Glycine max
  Coding DNA Sequence Number=SeqID_34851
MAPKKLSTKRSRRDAAAKGSSAAPEFDSHRFQSVEHQQRFEAIKGWSFHRERHVQLRED

SEQ ID NO: 126537 - protein, 192 aa, Glycine max
  Coding DNA Sequence Number=SeqID_34852
  Homolog annotation: Hit_ID=A0ST23; Match level="QueryCoverage=24%, HitCoverage=95%, E-value=4e-20, Identity=97%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLIPSTSSMVDSIMEALEPTVPGLLAVPIASNLRSHLLSLSRKLALLDLDTRKLVLKLTHINCVALTARFPVGKPVVPAALMNRPTRGERRFAYWALFRFLAH

SEQ ID NO: 126538 - protein, 63 aa, Glycine max
  Coding DNA Sequence Number=SeqID_34853
MEHISKLENGGHMNSPKQSFMWFRKMMIMEDCLDAPNSEDGGHMNDNAIILVAPKQDDNGGLP

SEQ ID NO: 126539 - protein, 216 aa, Glycine max
  Coding DNA Sequence Number=SeqID_34854
  Gene Ontology: Mol. function=protein kinase activity; Cellular component=chromatin; Biological process=protein amino acid phosphorylation
  Homolog annotation: Hit_ID=A2Q378; Match level="QueryCoverage=100%, HitCoverage=17%, E-value=6e-38, Identity=34%"; Hit description =Putative uncharacterized protein
  Pfam annotation: Domain name=DUF889; Domain location=99-216; Score= -88.9; E_value=1.9e-05; Accession=PF05970.5; Description=Eukaryotic protein of unknown function (DUF889)
MFFLYAYGGTGKTFIWKTLVASLRADNKIIIMVVSSSIASLLLPGGKIAHSKLKIHVPIFEDSTCNIHQGTHLTELLNEASLIIWDEAPMAHKFYFEALDRSLRDVIKVKSSSDKIFDEANTDATDREETAAFAEWILNIGDGIVGQQNDGYCSIEIPTDLLITEYDDPLYAIVNSTFPNLSHHHTNPEYFQTRAILASTNETIQQINDYILSLIP

SEQ ID NO: 126540 - protein, 184 aa, Glycine max
  Coding DNA Sequence Number=SeqID_34855
  Gene Ontology: Mol. function=nucleic acid binding; Biological process= RNA-dependent DNA replication
  Homolog annotation: Hit_ID=Q2AA09; Match level="QueryCoverage=91%, HitCoverage=59%, E-value=5e-11, Identity=30%"; Hit description =Retrotransposon gag protein
MERSMIDAASGGALGDMTPAEARNLIEEMASNSQQFSARNDAIVIRGVHEVVTNSSSSAETKKLEGKLDALVNLVTQLAMNQKSTPVARPCGLCSSADHHTDLCPSVQQSEVIKQPEAYAANIYNRPPQPQHNRYNPGWRNHPNLRWLSPSQQQQQQQPYFQNAAGPSRPYVPPPIQQQQQQQP

SEQ ID NO: 126541 - protein, 166 aa, Glycine max
  Coding DNA Sequence Number=SeqID_34856
SKKVYTDNHSGISASQRDSKVSMTDLVSAEDDVNLRIQQKVYTDNHSDISARQRDSKVSITDLVSAEDDAFRLTEPAKVYTDNHSGISARQRDSKVSMTDLVGAEDDQKVYTDNHSGISARQRDSKVSMTDLVSAEDDGAEDDISLYVLSGFSSYRQQKFYTDNHS

SEQ ID NO: 126542 - protein, 224 aa, Glycine max
  Coding DNA Sequence Number=SeqID_34857
MEVDLSVPYKVIAWTRGCIIYNPVLAIRQFGYPMRGASSEETIMPFITRGFNKANMKILQKIRKAWNKVGKKDKELRRRSNSVIGDYHKWLKSRTQGIAWHKKLKGLNGEEAGVPEESEEVQDLKAELGKTKVEKEKLKVVVTRVRKECDKLKDVNMSTTEALEQKMKKARKEEWSRNKFRGALLGSSNELKVSKAEKDKSRMENMMLKDKLRNFQRSKGSLKE

SEQ ID NO: 126543 - protein, 125 aa, Glycine max
  Coding DNA Sequence Number=SeqID_34858
QARQGASAVVAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPWVRVFWETVI

SEQ ID NO: 126544 - protein, 163 aa, Glycine max
  Coding DNA Sequence Number=SeqID_34859
  Homolog annotation: Hit_ID=A5BY33; Match level="QueryCoverage=100%, HitCoverage=9%, E-value=7e-08, Identity=25%"; Hit description =Putative uncharacterized protein
MDFFSNESFECIQAFENSNLIPFISLKLPVYTELVEAFYSNIEIQEGTLISEVYGIKMVIDKSLFYDLTQLSSEGVPFEGTLNDDWKFDFSVHDAHRLVCTNQADMTGRLLPSSLAFESCILHYLIVRILLPRSSNLAQVSKDDLIVMWAFHTGRQIDWAHLV

SEQ ID NO: 126545 - protein, 444 aa, Glycine max
  Coding DNA Sequence Number=SeqID_34860
  Homolog annotation: Hit_ID=Q6WAY6; Match level="QueryCoverage=64%, HitCoverage=54%, E-value=1e-33, Identity=30%"; Hit description =Putative uncharacterized protein
AIASLTQYYDQPLRCFTFGDFQLEPTIEVFEEILGCPLGERKPYLFSGCLPSLSRIATVVEDSARGLDRVKQTRNGIAGLPRKYLEDKARDMANQEDWVPFMDVLALLIFGVVLFPNVDGLVDLAAINAFLAYRHSKESPVVAVLADLFDTFDRRCKKKKNRLGQLLAGIGGRTINWFPRWKEGNEGVLFSCGGYPNIPLIGTRGCINYNPVLAIRQLGYPMRGAPMEESMSPFLVRDFSAQNFKAIQRIHKAWETALRKDQELRGIRNGIIGGYHEWLKVHIRGLDWLAKLKVVSEESFKAPEEDEEVQALKNELGKAKLAKEKFKLATTHIRKECAELREENATTARAPEQETKRACKEEYGRNKFRGALWGSNSELKLRREERDQSRAHSMVLKEELVAYSRSKRSLSQRLCETETNMLAIIAKYQEELSLATAHEHRVAD

SEQ ID NO: 126546 - protein, 298 aa, Glycine max
  Coding DNA Sequence Number=SeqID_34861
  Gene Ontology: Mol. function=tetraacyldisaccharide 4'-kinase activity; Biological process=lipid A biosynthetic process
  Homolog annotation: Hit_ID=Q6D438; Match level="QueryCoverage=90%, HitCoverage=81%, E-value=1e-109, Identity=71%"; Hit description =Tetraacyldisaccharide 4'-kinase
  Pfam annotation: Domain name=LpxK; Domain location=2-290; Score =399.9; E_value=4e-117; Accession=PF02606.5; Description =Tetraacyldisaccharide-1-P 4'-kinase
RGWRTRWRAPCPVIVVGNLTAGGNGKTPLVIWLVQALQQQGLRPGVVSRGYGGKAERYPLLVNQDSATEQAGDEPVLIAQRTQVPVAVAPQRRQAIEALLAAHLLDVIVTDDGLQHYALERDREIVVVDGVRRFGNGWWLPAGPMRERASRLEQVDAVVVNGGSAQAGEIAMTLQPGLAVNLLTGEQAALTQLPPVVAMAGIGHPPRFFTTLQQQGVQPVAEIAFADHHAYSEEELRSLTQDAQCLLMTEKDAVKCRHFARANWWYLPVDAHLAGAPLAALLADLTQLCTAARDARSR

SEQ ID NO: 126547 - protein, 173 aa, Glycine max
  Coding DNA Sequence Number=SeqID_34862
  Gene Ontology: Mol. function=helicase activity; Biological process =viral genome replication
  Homolog annotation: Hit_ID=Q9LW42; Match level="QueryCoverage=93%, HitCoverage=10%, E-value=2e-35, Identity=49%"; Hit description =Helicase-like protein
MLDENNAHAKSFRMARDRLTDTQVHNVRLKLIDGRTYNIPSVPEVAALIAGDIDANSNIDIIVDTQNGQLQRIHELHCSYLALQYPLLFPYGEDEYRTDILHRDTLSGKKRKRNRLTMRKWFAYRLQCRPNEGQTLLHSRKLVQQFVAEGYTMIESERLSYPFKRVAGSHSPF

SEQ ID NO: 126548 - protein, 112 aa, Glycine max
  Coding DNA Sequence Number=SeqID_34863
MVKEECKEVSVSSKRLAKKESHFEIKTNIKETSPLGQPPYILLCKKTLVSTVTPLGLDVIPQVKELLDEGLVRVDGRSPKYEEPQDLRSNPFQGGGNDAIVPHKGHWIEDSK

SEQ ID NO: 126549 - protein, 223 aa, Glycine max
  Coding DNA Sequence Number=SeqID_34864
  Homolog annotation: Hit_ID=Q2HW90; Match level="QueryCoverage=76%, HitCoverage=36%, E-value=3e-20, Identity=32%"; Hit description =Putative uncharacterized protein
MVEVSTEAIASLAQYYDQPLRCFTFGDFQLSPMVEEFEEILGCPLGGKRPYLFTGFYPSLARISKIVKILAQELDHRKQVGWLEYRESKGEWAPFIDILALLIFGGVLFPNVDGLVDLAAINAFLAYHDHKESPVVAMLADLYDTFDQRCEKSSTRIVCCTLALYVWLVSHLFRQEVRHACPLESHHSCTEKGRANWDQLLSNKEGASFNWSPRWKEGEPGIL

SEQ ID NO: 126550 - protein, 98 aa, Glycine max
  Coding DNA Sequence Number=SeqID_34865
MAPRKLPAKRSRKDKAAEGTSAEHQQRFEAIKGWSFHRERRVQLRDDEYTDFQEEIARRRWTLLVTPMAKFDPDIVLEFYVNAWPTQEGVRDMRSWVR

SEQ ID NO: 126551 - protein, 176 aa, Glycine max
  Coding DNA Sequence Number=SeqID_34866
  Subcellular localization annotation: CTP_CleavageSite=70; ConfidenceScore=5.57e-01
MPPSGPSSQAGRKASSMISDIRPMDQTPVRYSACWRSTQGQAAVAAGCSTRASMAQAPVSASRNSPRAVRVFMASASILDTAAQHRAGLRVHPQLHALALRVVGLDVVAAVMLQFDLGDVAIARGGQRVIDLAHGQDLRGGGGLDRRGCGGRRSGLGRGLRQRGGAGEGGGADGQG

SEQ ID NO: 126552 - protein, 235 aa, Glycine max
  Coding DNA Sequence Number=SeqID_34867
MTTLAQTWSVLSYSNLVPTSHTSDITLDRAKLIYEMIMKMDRNLGYLISHQISIIAQNDSSRLGFLALITTLCKARGVTSDSRTLKSLSPTIYLAYIKKNCWNLDDPIVTFRGPKKTRGKRLEAPTTSAAPETAAPSSSTPPAPSSSTPSTQIPLPAHSSFGPSNFLFTSEMLHSMLQSLHRGHVIIMQSLQSSGLPFIMSTDEFLTQVASLGVQPSPSGGGGTSAAQELEVVEE

SEQ ID NO: 126553 - protein, 111 aa, Glycine max
  Coding DNA Sequence Number=SeqID_34868
ALGFSALITGLCPSYGVPVIPSKVIRPSITRTFIEKYYTPRQAQGDAHQAAGALPPPRQADPFGAEVAWPRDWPDAQAGEEPAGSPGGADESHRDEDMTDLLGFLGGSGAT

SEQ ID NO: 126554 - protein, 25 aa, Glycine max
  Coding DNA Sequence Number=SeqID_34869
MHENEWHGACLLRAPILGTYRTISR

SEQ ID NO: 126555 - protein, 208 aa, Glycine max
  Coding DNA Sequence Number=SeqID_34870
  Pfam annotation: Domain name=zf-CCHC; Domain location=95-112; Score =23.6; E_value=0.00041; Accession=PF00098.14; Description=Zinc knuckle
MPPIVVITLARALVKNFVTITKEGIGHILDLTPIEEKRKESLKRLTLTSHTSMGRTKDQGQGILGVTPSKPKDDKGETIEKQAPKASMQEKTSSIKCFKCRGKGHITSQCPTTKTMITRGQDIYSSQDEATTSPSSSESEEAKGKESSEEIYPQEEGQPLVVKEKCKETLASIATPLGLEFIPQVKKLLDEGLVRKSLNPCALLVPKI

SEQ ID NO: 126556 - protein, 164 aa, Glycine max
  Coding DNA Sequence Number=SeqID_34871
MLFQFLALGACCCLLSTGEGRAAVGYTQTIPAPPVDSWVSYDDIHDRWMHYEDHIVPASEVCVVPRVCSSDYIDWFFRISHPFMTPGHPRVVPEAPQTDIPHVSEPGASSTSAEEPRHAVEVCDDIVERLERHLSLGVVTPGSSTHEVIEECLRLARSVTHDHL

SEQ ID NO: 126557 - protein, 39 aa, Glycine max
  Coding DNA Sequence Number=SeqID_34872
MMHAPDLNSQMQCVFVEATQSCTITPPSVINLGPQGVPY

SEQ ID NO: 126558 - protein, 106 aa, Glycine max
  Coding DNA Sequence Number=SeqID_34873
MGELLQVWEKMDLPLENVDQLALVQPAQLARQIPPIEVPELQTFHQFSQPRVELQARPPTQGTTQLTEWILEELPSLWASGPADADGGAGEDGEGMVRFCRIKAAK

SEQ ID NO: 126559 - protein, 30 aa, Glycine max
  Coding DNA Sequence Number=SeqID_34874
MPSTSQGPKKGRMSSSKGPRTKLGYDNEYQ

SEQ ID NO: 126560 - protein, 183 aa, Glycine max
  Coding DNA Sequence Number=SeqID_34875
METLQKVRKAWEVVQKKDKELRGSNYGPIGGYRKWLKAHVQGLDWLPSLRTAKREEVEAPEEDKEVQALRTELEQAQTVKERARREEHGRNKFRGALWGSNNELKLRREERDQSRVDSLILKDELKACSSSKRNLSQRLCETETNMLTIISKYQEELNLATTHEHRVADEYAQVYAEKEARGR

SEQ ID NO: 126561 - protein, 115 aa, Glycine max
  Coding DNA Sequence Number=SeqID_34876
MEWFFRISHPFVTRTEETAAPRHPPPPHHEEFVEPPIPEVSVATDLPTHSVVHCEGCQGMAQDLGAIAEDLERVINLRMVTEGINLHDIMTRCLRRARGDTADGSLRPRQRCRID

SEQ ID NO: 126562 - protein, 28 aa, Glycine max
  Coding DNA Sequence Number=SeqID_34877
MKRCIRRARKPDMGLSVTMHQRKEENSR

SEQ ID NO: 126563 - protein, 314 aa, Glycine max
  Coding DNA Sequence Number=SeqID_34878
  Gene Ontology: Mol. function=metal ion binding
  Homolog annotation: Hit_ID=A4WDT6; Match level="QueryCoverage=100%, HitCoverage=84%, E-value=1e-159, Identity=87%"; Hit description =Hydrogenase expression/formation protein HypD
  Pfam annotation: Domain name=HypD; Domain location=9-314; Score =600.4; E_value=1.8e-177; Accession=PF01924.7; Description =Hydrogenase formation hypA family
MRYVDEYRAPEQLLQLIGHLRTRSALLDYTAENPLRIMEVFGGHTHAIFKFGLDQLLPENIEFIHGPGCPVCVLPMGRIDSCIEIASRPDVIFCTFGDAMRVPGKNGSLLQAKARGADIRIVYSPMDALTLAADNPTRKIVFFGLGFETTMPATAITLQQAKARSVDNFFFFCQHITLIPTLRSLLEAPGNGIDAFLAPGHVSMVIGTDTYGFIAEQYNRPLVVAGFEPLDLLQGVTMLVEQKIAALSAVENQYRRVVPDAGNERAQQAIADVFCVEGDSEWRGLGLIAESGVRLTPAYRAFDAEAHFRPQPQQ

SEQ ID NO: 126564 - protein, 111 aa, Glycine max
  Coding DNA Sequence Number=SeqID_34879
  Homolog annotation: Hit_ID=Q51617; Match level="QueryCoverage=31%, HitCoverage=50%, E-value=4e-11, Identity=91%"; Hit description =Putative uncharacterized protein
MTVKTSDTCSSRRRSQLVCKRMPGADKPVRARQRMRKEKIPHQAPFAIQPAQLLGRAIGAGLFAITPAGERGMCCKAIKLGNARVFPVTTLIPMGADMPAAGAGPKIEEVD

SEQ ID NO: 126565 - protein, 107 aa, Glycine max
  Coding DNA Sequence Number=SeqID_34880
MEQFLERVQDASFETTIPEPFTLHPEAGEEQARPETATTPERSLEGTSEPPTPVADLSSSQPAADPSTPLLDIPEDQTTPVLVLNTSPPATLVLHLTDEEEAQSQDT

SEQ ID NO: 126566 - protein, 106 aa, Glycine max
  Coding DNA Sequence Number=SeqID_34881
  Subcellular localization annotation: CTP_CleavageSite=39; ConfidenceScore=5.15e-01
MKSGDMRGYLMVIRTFRQPGAYQPVDARRLTSSSAPFVVLTRESSDMRGYVMVTHTVRQPWANEPNDPETNIIFCTFCRPDPKSADMRGYIMVTRTFRQPGRKRAH

SEQ ID NO: 126567 - protein, 47 aa, Glycine max
  Coding DNA Sequence Number=SeqID_34882
MGEMLATQLAQASKNLMNCATMLPFEFWHVTELHKLPDDGRQVPQNG

SEQ ID NO: 126568 - protein, 39 aa, Glycine max
  Coding DNA Sequence Number=SeqID_34883
MKEECGCASPLDFVSIYRGGRDVIDYKAVVIDYRLSVLV

SEQ ID NO: 126569 - protein, 192 aa, Glycine max
  Coding DNA Sequence Number=SeqID_34884
  Homolog annotation: Hit_ID=A5CA85; Match level="QueryCoverage=52%, HitCoverage=18%, E-value=2e-12, Identity=38%"; Hit description =Putative uncharacterized protein
MTRDNPGDLQPFDPEIDRTFHRLFRHSVHPDHFVHSKHFVAGDSEHSDFEHSVANFHIENMAQSPPRERTLREMAAPNFTYESLCIQYPDEDVPYVLKTGLIHLLPKFHGLAGEDPHKHLKEFYIEDHIFLKAFPHSLEGVAKDWLYYLAPRFITSWDDPNRVFLENSSLHLGPLPSKKTFQASVNLVEELV

SEQ ID NO: 126570 - protein, 204 aa, Glycine max
  Coding DNA Sequence Number=SeqID_34885
MEEATQSRSIDIVIDSLSPIRRHVKWKMARTKKTGQMTPHRGSFVVHGRQDVLTATIRQLEHPGSVHATGAGVTIKQYFGATPRTSRTSSSMAPEDLDQMQSQFQSQMQSQGLALPPKPEVGPLATCVSIKKSCVNPSGNDLDTGDSDKCGLYIEENPPRLVALRRLYEGSTTIHHIPLLHDQVKVGVEEVRDADAPILVPNEE

SEQ ID NO: 126571 - protein, 117 aa, Glycine max
  Coding DNA Sequence Number=SeqID_34886
  Gene Ontology: Cellular component=mitochondrion
  Homolog annotation: Hit_ID=A5ALV3; Match level="QueryCoverage=49%, HitCoverage=40%, E-value=6e-14, Identity=71%"; Hit description =Putative uncharacterized protein
  Subcellular localization annotation: CTP_CleavageSite=83; ConfidenceScore=5.02e-01
MTSKELNEEPYEVKISCTNRNRTVQRFSYRYPFNKHRSSKGSRRPTNARKPGLSFRKWIPIRRVHNRMDKLTLPVFGIQFGSLGGTRKDRMECNNIDFQYRYRRKGFSIDSNALPTR

SEQ ID NO: 126572 - protein, 77 aa, Glycine max
  Coding DNA Sequence Number=SeqID_34887
MTSLTQIWMTLLLSNILPSDHNADLPLRKYQLGSRPQDTQWTRRSPTGPWGFQLWLRASISPTGCLSDAILPRKGIG

SEQ ID NO: 126573 - protein, 146 aa, Glycine max
  Coding DNA Sequence Number=SeqID_34888
  Homolog annotation: Hit_ID=Q2HW90; Match level="QueryCoverage=74%, HitCoverage=21%, E-value=4e-10, Identity=32%"; Hit description =Putative uncharacterized protein
MERIEKVVKISEQELDRVKQNRNEVAGIPRKHLEEKVEALASQGEWATFIDVLALLVFGTVLFPNVDGLVDLAAIDAFLAYHPNKASPVIAVLADAHDTFDLRCKKSSARIVCCTPVLYVWLASHVAYHEGRSVCPLQGYRMCFKK

SEQ ID NO: 126574 - protein, 178 aa, Glycine max
  Coding DNA Sequence Number=SeqID_34889
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
IRKAAGSEQESARGSFQGETPGIFIVLSGFATSDLSVDFCDARQGGGAYGKTPATRPFYADTARRSRTTERSESVSEEAEERPIRKPPLPARNSYDHDYEFELGTQEVFDVVVSSVKSEENALPKGMQAWHWPSFYNVVTGKTLALPNLIALQHIPLSPAGVIAKRPAPIALPNSCAA

SEQ ID NO: 126575 - protein, 41 aa, Glycine max
  Coding DNA Sequence Number=SeqID_34890
MGSRNGSGYEAEMLLASSLPNKEFLMLLRDATYVIKKVMRN

SEQ ID NO: 126576 - protein, 63 aa, Glycine max
  Coding DNA Sequence Number=SeqID_34891
MRGTMHEPRENLGVDQKFSPRLGSSSSMDSFASWKMNGSGMKKEEREETPLQGEDESRRSSPP

SEQ ID NO: 126577 - protein, 54 aa, Glycine max
  Coding DNA Sequence Number=SeqID_34892
  Subcellular localization annotation: CTP_CleavageSite=45; ConfidenceScore=5.11e-01
GFVGACALSATLARLARISEFRLSARLLAKQMDSSSVFSGMSPRSANMHSSSFF

SEQ ID NO: 126578 - protein, 182 aa, Glycine max
  Coding DNA Sequence Number=SeqID_34893
TKFGHSAPLYHPDASDPMIPGDTLRLSAPFCHPESAGPMTSRDQVWSFCTHDTRRYLTVIRTLLSSRGGGPDDKQRPKTKFGHSAPMIRGDTLLVIRTFLSSRGGGPDDKQRPKTKFGHSAPMIRGDTLRLSAPFCHPEAAGPMTSRDQVWSFCTHDTWRYLMVIRTLLSSRGGGPDDKQRP

SEQ ID NO: 126579 - protein, 94 aa, Glycine max
  Coding DNA Sequence Number=SeqID_34894
MAGHSSFKQQNSLTRLRKKEIVTGVFRMRKAVILLGRIDGDPVLRETRIWATWEYVSSVGGGQQGMIVMAAQLIHDRVEMECLEGAWENLEGNT

SEQ ID NO: 126580 - protein, 81 aa, Glycine max
  Coding DNA Sequence Number=SeqID_34895
MVRQQTANHRGQGQGSPPFVCPTREQFRVEVAWPGDWPTEEGTGPARSPGEAEGAHMDEDMTDLLGYLGQGGATRPRSLHL

SEQ ID NO: 126581 - protein, 82 aa, Glycine max
  Coding DNA Sequence Number=SeqID_34896
MLTKLSCPRTNPSQEGENDEDMTKSKGKDPLEGLGGPMTRARARKAKEALQQVLSILFEYKLKFQGEKSKVVSCIMAQMEED

SEQ ID NO: 126582 - protein, 110 aa, Glycine max
  Coding DNA Sequence Number=SeqID_34897
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=65%, E-value=2e-33, Identity=100%"; Hit description=LacZ protein
MLSNRDDHIDNYFIGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 126583 - protein, 115 aa, Glycine max
  Coding DNA Sequence Number=SeqID_34898
  Subcellular localization annotation: CTP_CleavageSite=48; ConfidenceScore=5.15e-01
MPISPCGSISWSVPSRHRGRPHKTPSGPGEVQQGPGVSNFGYEPLSVLQGARSPQQGIAPARHPVDPEKSNRVLGFPALIMSLCQFYGVPVTPNKVIRPRTNRAFIKKYCAPRQA

SEQ ID NO: 126584 - protein, 90 aa, Glycine max
  Coding DNA Sequence Number=SeqID_34899
  Homolog annotation: Hit_ID=A5BP71; Match level="QueryCoverage=56%, HitCoverage=13%, E-value=3e-09, Identity=52%"; Hit description =Putative uncharacterized protein
  Pfam annotation: Domain name=zf-CCHC; Domain location=63-80; Score =8.2; E_value=0.087; Accession=PF00098.14; Description=Zinc knuckle
MAIIVNAEACGYWWPLGNEAAIPPSDEAWTLIPDPTTIRAKGRPKSTRIRNEMDWVEPFDRRQKCSRCGAEGHNRCRCPMQSDRGSNSFN

SEQ ID NO: 126585 - protein, 42 aa, Glycine max
  Coding DNA Sequence Number=SeqID_34900
MLLKNGGGKRQIPIRGPALKGHKTDLPQICACVVIDLEVLSM

SEQ ID NO: 126586 - protein, 176 aa, Glycine max
  Coding DNA Sequence Number=SeqID_34901
MTRRLLAGSLAFESRILHYLIVRILLPRSSNLAQALRLNAHLPYPHLVTLFLQHFNIPLDFEPYVPIKRSFLICATVIASFGYRKEHDGSWVKKGAQPIDDEGHLPIGEDSSLLQRILDRFDGLQTYVGERFDALELQVDMRFDKMDSAITKVEGDVTYIRTCFDLPPPPPPPPSS

SEQ ID NO: 126587 - protein, 66 aa, Glycine max
  Coding DNA Sequence Number=SeqID_34902
MPSVAKEYPKLVNINTEGSMHLTLSFLASHNQFFQNNYSHMAALDYFGVRQRYFSSHIRWKNGLSG

SEQ ID NO: 126588 - protein, 80 aa, Glycine max
  Coding DNA Sequence Number=SeqID_34903
  Subcellular localization annotation: CTP_CleavageSite=34; ConfidenceScore=5.43e-01
DSESRWQAKIPYGHPFLLSSSGNIQAQRRARFFSAGQGRSSPMAKGSVVGCAIAIRPTWAFQDVPKKACLLCSTQLAWPS

SEQ ID NO: 126589 - protein, 128 aa, Glycine max
  Coding DNA Sequence Number=SeqID_34904
MRGASSEESITPFIAWGFSDPNAIIDQYKEKLSLAVTHEQRLEDEYAKVSVLQAKREAREKVIDSLHREAMMWMDRFAFTLNGSQELPRLLPKAKAMADVYLAPEEVHGLLNYCQHMIDLMAHIIRSH

SEQ ID NO: 126590 - protein, 28 aa, Glycine max
  Coding DNA Sequence Number=SeqID_34905
MEKNEETTMEEKLACGASMEAGSLSFNE

SEQ ID NO: 126591 - protein, 76 aa, Glycine max
  Coding DNA Sequence Number=SeqID_34906
  Homolog annotation: Hit_ID=A0PAV3; Match level="QueryCoverage=50%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGGGGVTAKSTPRTSALAKCSGPPCA

SEQ ID NO: 126592 - protein, 124 aa, Glycine max
  Coding DNA Sequence Number=SeqID_34907
  Homolog annotation: Hit_ID=A6FJQ2; Match level="QueryCoverage=30%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNAREELQRGGIGMMFQGNGTEAVVQVVVHSQHYLAKTEIENTI

SEQ ID NO: 126593 - protein, 241 aa, Glycine max
  Coding DNA Sequence Number=SeqID_34908
  Pfam annotation: Domain name=zf-CCHC; Domain location=47-64; Score =21.5; E_value=0.00084; Accession=PF00098.14; Description=Zinc knuckle
MAFTLIQRKTKVKESYRVRPSKPKDDKGKTIEKQPLKASMQEKTSSMKCFKCLGRGHITSQCPTKKTMIMRGQDIYSSQDEATTSPSSSKSEEAKGEESSEEIYPQEEGQPLMVKEECKEVSVSSKRLAKKERHFEIKTNIKEIPLLRQPPHFLLCKKTLVSIATSLRLEFIPQVKELLDEGLVRKRLNPCALLVPKIGIIRHQIPKIGGVMNALGGATLFCKITRAPNIFMICVHRDSLG

SEQ ID NO: 126594 - protein, 98 aa, Glycine max
  Coding DNA Sequence Number=SeqID_34909
MDLKLSINSKRKEEKGMSERQNKTLDFRIVIIKKGEIVEAMSSKVILMMPKNQELSKVSSKDSRIKFQDSRFKIQEKSRSRFKTQDSRIMRRLNQDKY

SEQ ID NO: 126595 - protein, 248 aa, Glycine max
  Coding DNA Sequence Number=SeqID_34910
  Gene Ontology: Mol. function=nucleoside-triphosphatase activity; Cellular component=plasma membrane; Biological process=peptide transport
  Homolog annotation: Hit_ID=A9CG34; Match level="QueryCoverage=100%, HitCoverage=91%, E-value=9e-63, Identity=67%"; Hit description=ABC transporter, nucleotide binding/ATPase protein
  Pfam annotation: Domain name=ABC_tran; Domain location=1-77; Score= -8.7; E_value=3.9e-06; Accession=PF00005.18; Description=ABC transporter
  Pfam annotation: Domain name=oligo_HPY; Domain location=80-130; Score= 18.3; E_value=9.5e-06; Accession=PF08352.3; Description =Oligopeptidedipeptide transporter, C-ter
  Pfam module annotation: Pfam domain module=ABC_tran::oligo_HPY; Domain location=1-77::80-130
MSGGQCQRVMIAIAIASKPRLLIADEPTTALDVTIQKQILDLLMKLQEEYGMALILITHDMGVVAETADRVVVQYKGRKMEEADVLSLFEAPQHPYTKALLSALPENATGDRLPTVSDFFGKEGALKGIDFAVERGKTLAIVGESGSGKSTLARIIALIDPASGGELKIDGQPVDIARRRPGTEMRSKVQMVFQNPYGSLNPRQKVGDVLMEPLIINTKIPASERRERAEAMLVKVGLGPEHFNRYPH

SEQ ID NO: 126596 - protein, 69 aa, Glycine max
  Coding DNA Sequence Number=SeqID_34911
MDVPSTRTDPQEMYPLLLSVKPKRLVGLGSSSSMDSFASWKINGSGMEKEEREETPLQGEDESRRSSPP

SEQ ID NO: 126597 - protein, 127 aa, Glycine max
  Coding DNA Sequence Number=SeqID_34912
MGIAPTRHPVDPEKSNRALGFPALVTGLYQSYRVPVPPRQGHVIIGIAPVRHPVDPKKSNRVLELSSSNYGSLSVLQSVCRPQQSHQTPLLIELSSRSIAPPGRRRAKHHSSIGMVGSGKQTHRHHL

SEQ ID NO: 126598 - protein, 86 aa, Glycine max
  Coding DNA Sequence Number=SeqID_34913
MENCTKQSLRMAPNSWVEDDMNENAIHGAPNKGLRMENRTKQFTTHGSQTRGWRTHATKTHFLGSNQRLRWKISLGNHYAWLLDSR

SEQ ID NO: 126599 - protein, 229 aa, Glycine max
  Coding DNA Sequence Number=SeqID_34914
METFQKVREAWEVLQKKDKELRGSNNGPIDGYRKWLKAHVQGLDWLPSLRTVKREEVEAPEEDEEVQALRAELEQAQTVKERFKSTALKIRKENAELRDIKAATTKALEQETKRARKEEHGRDKFCGALWGSNSELKLQREERGQSRAHSMVLKEELAACSRSKRNSSQHLCETETNMLAIVSKYQEELNLAMAHEHRVADEYAQVYVEKEARGRVINSLHQEATMWMD

SEQ ID NO: 126600 - protein, 143 aa, Glycine max
  Coding DNA Sequence Number=SeqID_34915
MDNEEGMQEQMKADLSALKDQMASISEVMLKLQKAIEDKATTTASSTVREAESVLQPALNSGRDRNTTVFGRRYSPQAYPYGLPPDFTPRATPKDLSQAPTFEGQLPPYDDYPGQDDEEGDTHLGPLIHLKDPSPHELPQANI

SEQ ID NO: 126601 - protein, 42 aa, Glycine max
  Coding DNA Sequence Number=SeqID_34916
MDTRITQLEEDELSCHQEDHALLKFNSRQESKKFKIYDQDNL

SEQ ID NO: 126602 - protein, 181 aa, Glycine max
  Coding DNA Sequence Number=SeqID_34917
  Gene Ontology: Mol. function=guanylate kinase activity; Cellular component=cytoplasm; Biological process=purine nucleotide metabolic process
  Homolog annotation: Hit_ID=Q1GXB9; Match level="QueryCoverage=44%, HitCoverage=40%, E-value=8e-23, Identity=66%"; Hit description =Guanylate kinase
  Pfam annotation: Domain name=Guanylate_kin; Domain location=1-77; Score=42.3; E_value=1.8e-09; Accession=PF00625.12; Description =Guanylate kinase
  Pfam annotation: Domain name=RNA_pol_Rpb6; Domain location=122-176; Score=58.8; E_value=1.9e-14; Accession=PF01192.13; Description=RNA polymerase Rpb6
  Pfam module annotation: Pfam domain module=Guanylate_kin::RNA_pol _Rpb6; Domain location=1-77::122-176
GGFLESAHVHSARYGTAQSEVENALAAGRDVILEIDWQGAQQIRTLFPQVTSIFILPPSIEALSHRLNSRGQDSEAVITQRSDGDCSRPALAVKPPAPNGTDPGSNLEVFMARITVDDCLDNIPNRFQLTLVAAYRARQLANGSDPLVSGYSQKDKATVLALREIAAGKIGVELLEKKGQA

SEQ ID NO: 126603 - protein, 146 aa, Glycine max
  Coding DNA Sequence Number=SeqID_34918
MGEVEEVQEKMKADMEAMKEQMATMMVAMMILKKIMEANAVAVAATSTVNKENPMPPSGLNQMNHPTSAMVGKDLGSTDGPMMCKFKTSTPSRHMACLLTIHHPMWRTLPMRMSITPLPCSLRANNLIIYMSLNPWGRRMKFPTTI

SEQ ID NO: 126604 - protein, 68 aa, Glycine max
  Coding DNA Sequence Number=SeqID_34919
GLLDLELTLLRVDFLPGLEPPDVGEVAPNWGRFFEDPNNEGLTIDFDRDISQTINEEEEEDVLSPELE

SEQ ID NO: 126605 - protein, 150 aa, Glycine max
  Coding DNA Sequence Number=SeqID_34920
MGAIIGCVGSLWKLGGNFCLSPECVIAFQVNTHQYAGAPPPPPRQADSAGPLSMERYLQHLVRQQAANHRGQVQIHECLYRFSLSQQGQGSAPFVCPTLEQFRAEVAWPGDWPDAQTGEEPVESPGETDEPHMDEDMTDLLGFLGGSGAT

SEQ ID NO: 126606 - protein, 57 aa, Glycine max
  Coding DNA Sequence Number=SeqID_34921
MVTRSVKFRNVAETKRKNCYAIPIRPTWAFPFLPPEGGCFWRKQPGSPGRAELAWVS

SEQ ID NO: 126607 - protein, 144 aa, Glycine max
  Coding DNA Sequence Number=SeqID_34922
  Homolog annotation: Hit_ID=Q2HVN2; Match level="QueryCoverage=80%, HitCoverage=34%, E-value=3e-10, Identity=30%"; Hit description =Putative uncharacterized protein
MWWKDLKQTVNSAQLGDIVHSKMRWKIVRGDKVRLWEDKWNHQQQPLVERYPRLYQISTQQNQTIRQMGQHLQSGWEWQLLWRRPLFENEIESAINFLKDIEGIHIQQQGSDEWEWLGDQTRNYSTRSAYNLVLEASTGGQQEE

SEQ ID NO: 126608 - protein, 65 aa, Glycine max
  Coding DNA Sequence Number=SeqID_34923
MGTRKIHITFLNCTHGHCTPECARKTARKPHYKRNLKESWASSSKANNTRKSSLPWIQTENANET

SEQ ID NO: 126609 - protein, 217 aa, Glycine max
  Coding DNA Sequence Number=SeqID_34924
DEVVEKFLKKYFPESKTAEGKAAISSFHQFPDESLSEALERFCDGKIKLKTPEEAIDLIENMAASDIDILRDRAHIPTKKSLLELTSQDALLAQNKLLSKQLEALTETDVPSVGELMNLDVKQGPSLYDRTTKLEETLAQFMQVSMSNQKSTESAIKNLEVQVGQLAKQLMDRSLSSFIANTEKNPKEECKAVMTRSRMTIHVDESEAKKKMEEHKQ

SEQ ID NO: 126610 - protein, 176 aa, Glycine max
  Coding DNA Sequence Number=SeqID_34925
  Homolog annotation: Hit_ID=Q5NRP4; Match level="QueryCoverage=35%, HitCoverage=4%, E-value=6e-07, Identity=42%"; Hit description =Putative gag-pol polyprotein, identical
  Pfam annotation: Domain name=zf-CCHC; Domain location=53-70; Score =22.6; E_value=0.00058; Accession=PF00098.14; Description=Zinc knuckle
MATSKSFCPHSYLKKDQGQGIFGAVPSKPKDDMGKTIEKQPPKASMQEKTSSIKCFKCLGRGHITSQCPTKKTLIMRGQDIYSSQDEATTSPSSSESEEAKGEESSEEIYPQEEGQPLMVKEKCKEVLIWDSLGVEGRSPEYEEPRDLRSNPFQGAGADAILPPKGIGWQTPRGLG

SEQ ID NO: 126611 - protein, 209 aa, Glycine max
  Coding DNA Sequence Number=SeqID_34926
MSLHSSSSVNGEGSTPKDPLYKILDELRSLMLWKEKQERKEKGKKRVEEISQDEREKIREEERRKIRKEMKREKHASFSSHNSCKSLSEALCGYYEGRHRSHLRPHSHRRENERKPQEVNIKLPYFHGKDNVEAYLDWEIRVEQKLKRKPTLKSYGYHSYPKKDQGLGILGVASSKPNDDKGKTIEKQPPKASMQEKTSSIKCFKCLGR

SEQ ID NO: 126612 - protein, 71 aa, Glycine max
  Coding DNA Sequence Number=SeqID_34927
MERYLQHLGQGFTPFACPTPEQFRAEVAWPGDWPEAQAGEAPAGSPGDAEEARMDEEMTDLLGFLGGSGAT

SEQ ID NO: 126613 - protein, 95 aa, Glycine max
  Coding DNA Sequence Number=SeqID_34928
MNALGGATLICKITRAPNIFMICVHRDSLGRNNQHENTEKGVPMNPKRIKVIPEWPAPLSVLREKCPEFQEPRDLRSNPFQGGGNDAILPRKGIG

SEQ ID NO: 126614 - protein, 331 aa, Glycine max
  Coding DNA Sequence Number=SeqID_34929
  Gene Ontology: Mol. function=protein transporter activity; Cellular component=membrane; Biological process=protein secretion
  Homolog annotation: Hit_ID=A8GEN8; Match level="QueryCoverage=87%, HitCoverage=59%, E-value=4e-99, Identity=63%"; Hit description=RND efflux system, outer membrane lipoprotein, NodT family
  Pfam annotation: Domain name=OEP; Domain location=95-281; Score =183.0; E_value=7.3e-52; Accession=PF02321.9; Description=Outer membrane efflux protein
LATDRSNLAIAKETAESARQSLDVTKKRMQNGVDSMVDVASADTTYQSALADVASYTTSVAQDKNALDLVVGKSVPDNLLPQSIESIGQALREVPAGVSSEALNNRPDVLQAEHNLKAANASIGAARANFFPSISLTTSGGVGSADLSSLFKNGTGVWSFAPSISLPIFNGGYNVSYLNYTKAQKEYYVAVYEKSVQTAFQEVADALARRGTITDQMASQRNNVAASQTYYRLAELRYQQGIDTYLNTLTAQRTLYTARTSLVSVEQAYYQNLNTFYKVMGGGTALQESELKIRAGIGQVSTVTREPGLSDKVLSVRRSDDFVSGLMTMVA

SEQ ID NO: 126615 - protein, 183 aa, Glycine max
  Coding DNA Sequence Number=SeqID_34930
  Subcellular localization annotation: CTP_CleavageSite=45; ConfidenceScore=5.54e-01
MATPPASPPPSPPPPADASASPSTFKRTRKATRPPGAERPVAHVNLAIGKADGPHKKKLRTYLGIIVRDKVDVTYENWKEVPAAQKDLIWEDIQTVSEQWRQFKSNLPRKWELAAGNDGVDDTVHEKYDISKEKWAQFCLTHRDPSWENKSSWLRRQRKDWRKLPSPEALRASLTLHLPSDAM

SEQ ID NO: 126616 - protein, 77 aa, Glycine max
  Coding DNA Sequence Number=SeqID_34931
MASANSLFPEGNSINSLFHFIWRGLPLGKPEMELLRLHQNEDKYLGTRKRKELLLKHHPTIQERHSVSGYIENPRDR

SEQ ID NO: 126617 - protein, 158 aa, Glycine max
  Coding DNA Sequence Number=SeqID_34932
MGMIMTLSSQSERPTGHYERKSSPWVKTRELQVHQGATEHSGGGRGKGQHVTGSSQLNPYQRYILGARYGWGLSSTDTPQASPELQQVAEATQIGEPASSSAEVRQLVDHLSEQAREVASEASMERTPRALAMWMAGLTLAFAISIALAQKVRGYTGY

SEQ ID NO: 126618 - protein, 192 aa, Glycine max
  Coding DNA Sequence Number=SeqID_34933
MIMRSQDIYSSQDEATTSPCSSESEEAKGEKSSEEIYPQEEGKPFMVKEECKEISVSSKRLAKKERDFEIKTNIKEISPLKQPPHFLLCKKTLVSIATPLRLEFIPQVKELLDEGLVCKSLNPCALLVPKIGVPMNPKRIKVILEWPTPPSVLRKKAKSFKNLGILGQILFKGEGMMQSYPARALDRRLQED

SEQ ID NO: 126619 - protein, 60 aa, Glycine max
  Coding DNA Sequence Number=SeqID_34934
GEADLRTNPFEEGKSDEEKARNKGKKPLEGLGGPMTKTRTKKAKEALQRVLTMLFEFRPT

SEQ ID NO: 126620 - protein, 69 aa, Glycine max
  Coding DNA Sequence Number=SeqID_34935
MEEKVKLKTNGALRSTYLKLLCSDTTCWKLTYEASMEAGSLSFNKVHENPMVFFSSSSPTLLEPLAHGS

SEQ ID NO: 126621 - protein, 136 aa, Glycine max
  Coding DNA Sequence Number=SeqID_34936
MSLPSAVHVSSIIKREASRDWEICSSVVFRIAKKEGVETRIVITERAGWTKSVSYLCFPLISDERFFLQKAVASGGSNLARLGELGGKLLPYFAINRGRSEGKRGSTFLALLILSKLLRKIISVKKIQAEALPLQR

SEQ ID NO: 126622 - protein, 130 aa, Glycine max
  Coding DNA Sequence Number=SeqID_34937
MTPIEVQGDAPQAADAPPPHQAGPAGLFDTEQYLRHLVRQQAANHRAYVQTHDCLYHMSLSLQSQGFTSFPCSTPDQFKAEVAWPGDWPEAQAGESPAGAPAEAPDEADEAREGEEMTDLLDFLGGSDAT

SEQ ID NO: 126623 - protein, 64 aa, Glycine max
  Coding DNA Sequence Number=SeqID_34938
MFSRPGNSRSLEISEKNCFREENPSRGASVTFRNISVGDSRRFSTVLRRSSVFNRHIGNQKEVK

SEQ ID NO: 126624 - protein, 80 aa, Glycine max
  Coding DNA Sequence Number=SeqID_34939
MSPQVMQDGGSSQYCIIIVILQRILLGERAVYAMMLTPIEPLMEALEEDYKDGNEINESRQFIGGVLDLEKRINRLDTLT

SEQ ID NO: 126625 - protein, 75 aa, Glycine max
  Coding DNA Sequence Number=SeqID_34940
MTKARQKGQNRGGACHPARPGEQGCFLQKQQPSGGRIWKAQLSKKLRKLTDCAKYLFSISVTLRNFHESRKPASF

SEQ ID NO: 126626 - protein, 131 aa, Glycine max
  Coding DNA Sequence Number=SeqID_34941
  Homolog annotation: Hit_ID=A7MRQ1; Match level="QueryCoverage=73%, HitCoverage=100%, E-value=8e-08, Identity=33%"; Hit description =Putative uncharacterized protein
MATLLGNCTLTVEVLSGKNFAQQAMLNATRILRAFMYRSEDEKLADIVMGDAVLQLLKQAGPVTTLALLEKLRAMAASETDPARQRAFRYAIAEVQNSKSAPLGEAVALKGSDNVTHIFRNRDNTGKNTRH

SEQ ID NO: 126627 - protein, 344 aa, Glycine max
  Coding DNA Sequence Number=SeqID_34942
  Gene Ontology: Mol. function=catalytic activity; Cellular component =integral to membrane; Biological process=cellular metabolic process
  Homolog annotation: Hit_ID=Q1MMK8; Match level="QueryCoverage=99%, HitCoverage=98%, E-value=1e-118, Identity=63%"; Hit description =Putative CoA reductase
  Pfam annotation: Domain name=3Beta_HSD; Domain location=7-280; Score=- 54.0; E_value=1.3e-06; Accession=PF01073.10; Description=3-beta hydroxysteroid dehydrogenaseisomerase family
  Pfam annotation: Domain name=Epimerase; Domain location=6-250; Score =38.2; E_value=5.3e-10; Accession=PF01370.12; Description=NAD dependent epimerasedehydratase family
  Pfam annotation: Domain name=NAD_binding_4; Domain location=8-229; Score=-53.7; E_value=2.6e-05; Accession=PF07993.3; Description=Male sterility protein
  Pfam module annotation: Pfam domain module=3Beta_HSD::Epimerase::NAD _binding_4; Domain location=7-280::6-250::8-229
MSNEKVLVTGGSGFIAQYCIIALLQQGYQVRTTLRDAEREAEVRAHLLQAGVDAGEALQFVVADLTADAGWEDAVAGCRFVLHGASPTPTGNQVSEADWVNPAIEGNLRVLRAARDAGVKRVVLTSAFGAVGIGHPADYPRPFTERDWSDVSGDVWPYQKSKTLAERAAWQFITEQGNGLELATVNPVSVLGPVLGADYSHSIRIVKELLEGQPGCPDINSCFVDVRDVASLHVLAMPHAAAQGQRFLASSGHSLPLIEVARTLKTHLVAEAEKVSLQPMSDAMVRAAAAQNPLMTGMVKLLGVDMNVSAAKAGWLLNWHPRSPQEAILATARSLIALGLVANH

SEQ ID NO: 126628 - protein, 690 aa, Glycine max
  Coding DNA Sequence Number=SeqID_34943
  Gene Ontology: Cellular component=integral to membrane
  Homolog annotation: Hit_ID=A7MRR1; Match level="QueryCoverage=31%, HitCoverage=85%, E-value=7e-77, Identity=60%"; Hit description =Putative uncharacterized protein
  Pfam annotation: Domain name=MipA; Domain location=346-576; Score =133.5; E_value=5.9e-37; Accession=PF06629.3; Description=MltA -interacting protein MipA
MRRTQLFVVTRQLARHRVEVVRELRQFGGRCRKRARVAQPEIGNKRNGHQHQDADGDPVRGGNGRVGVAYAPPAIDDLVKARGIAFRMRTQGEKFTQNRRRHMVRDPQVLHREAQPHAQSNQHYGTDSQRQNAQTKPAPERLLYYVGINHPLQRVAVRHTLLQQKRAAQRAHRCAHQRDQQREFGWRGINAKHVARGLCDGNRHRAAVHLQPLPAQDLFLRRFYRAAPQHCLHACHYFAGMIRLDHIIIRAVAQGTDAIGRIAHGRDHNHRHLAAAPEFCQHLGAVQAGQHHIKQNQIGLPAQGQLKSAQAIRGNTHRIIFPPGILRLRAAAARARGGKRTDKETSLTLGAGAQFAPRYSGSNKTRVQPVPIFQARDGAFFADAQKGIGYDLQSDSGFYLEHTLGYGLGRSDKDSTWRDGASRLQGMGNISATVNTALALGWQLTPWLSAEGKAVLPLSDDQGVNYQASVTLVPLQRDSDTVALQTAALFGDARYMNTWYGVSDVQSSRSRFSRYDAGGGFYGVATTLTWSHQFDAHWGTLVSAGYSWLGDRAADSPIVSRRDQPLRGHAAINHQFAAGNIDTFVRCEEQGSRRNFARMAEAFGRYLRAECLSYLVADLVKHRRVRRARTKRVDANAARCQFAAPGAGIGAHRGFAGRISAIAGIGHAARNRSHQHDGTALPSCASPHAV

SEQ ID NO: 126629 - protein, 95 aa, Glycine max
  Coding DNA Sequence Number=SeqID_34944
MYNYHEKGRALDLESVLANFMTYQASSKEGLSNLDDLLMQFKDTVDSMQQAFKRTETQIGKLVDDMTKVVVKREEEYAEIEAHQESILQVTTIHH

SEQ ID NO: 126630 - protein, 43 aa, Glycine max
  Coding DNA Sequence Number=SeqID_34945
MEAQSLLILYRLGPYQSNQRNLRNLLEMSLSLSEDTVLVPKLW

SEQ ID NO: 126631 - protein, 241 aa, Glycine max
  Coding DNA Sequence Number=SeqID_34946
  Homolog annotation: Hit_ID=Q2HRM6; Match level="QueryCoverage=14%, HitCoverage=9%, E-value=3e-07, Identity=61%"; Hit description=RNA -directed DNA polymerase
PHGLPPSRSIDHQVDLLPEASLPNKPTYNSKPQETQHKDAHAKVEYVKRLYDQVKVQIAKKNESYTKQANKKRKEVVLEPSDDLGHLRANVFQEGGNDENPKTGQIQAKGSSGEGRRPNFSLGSLLNQSQTYQGNPCGVYSDLSSFTESGVYPDLSSFTGSGVIQKTLQPVSSDLLLVRFTSACSFKSYDLRIPIHSIHTIDHSGQSTNTQFQHQHQTTAYNQFTVQSCFRTSYQTTTTTN

SEQ ID NO: 126632 - protein, 187 aa, Glycine max
  Coding DNA Sequence Number=SeqID_34947
SDSLTGALGFPALITGLCQSFGVPVTPSKVIRPPITRAFIEKYCTPRQAQGNAPQAADAPPPPHQADPAGSLGTKRYYGTWFASRRPTTGGRCRYMTVSTSSASVSRARVSLLLHALLQISLGLRSHGPEIGLRTRRRRHLQELLDNAEDARMDEEMTDLLGFLEEAEPRDREIFGVMALSYFVTIL

SEQ ID NO: 126633 - protein, 86 aa, Glycine max
  Coding DNA Sequence Number=SeqID_34948
MDPVPSGVANCRNLPLCGRARRGLTGALSKGGKMHGVATNVYLWKKRRKNRRKPVIKNIPSSGVVLRLRKVLAPLTFCLKGQQPNF

SEQ ID NO: 126634 - protein, 198 aa, Glycine max
  Coding DNA Sequence Number=SeqID_34949
  Gene Ontology: Mol. function=5-formyltetrahydrofolate cyclo-ligase activity; Biological process=folic acid and derivative biosynthetic process
  Homolog annotation: Hit_ID=A4WE63; Match level="QueryCoverage=100%, HitCoverage=100%, E-value=5e-86, Identity=78%"; Hit description=5 -formyltetrahydrofolate cyclo-ligase
  Pfam annotation: Domain name=5-FTHF_cyc-lig; Domain location=11-192; Score=169.2; E_value=1.1e-47; Accession=PF01812.11; Description=5 -formyltetrahydrofolate cyclo-ligase family
MTQFPEVSASRQDIRQLIRQRRRALTPVQQAHFAQQAAARMMAYPPVVMARTVALFLSFDGELDTQPLIEQLWRAGKKVYLPVLHPFSEGNLLFLHYHPHSELVVNRLKITEPKLDVRDVLPLSQLDVLITPLVAFDEQGQRLGMGGGFYDRTLQNWQQYGLQPVGYAHDCQGVEALPVEKWDVPLPAVVTPSKIWVW

SEQ ID NO: 126635 - protein, 164 aa, Glycine max
  Coding DNA Sequence Number=SeqID_34950
IVGEISKEYFPESKTVKGKVTISSVHQFVDESLSEALERFQGGKIKLKTPEEAIELIENMSASDHAILQDRVVPFVVNLHCIPIEEHTQEVHYMGNQQRQGYNQEGFSGFQQVALGANTEKNPKEKCKAVMTRSRKLMAAEDEDVVALKEQVALKDTTDKKKNK

SEQ ID NO: 126636 - protein, 46 aa, Glycine max
  Coding DNA Sequence Number=SeqID_34951
MDVKTTFLNGNLEEVNVKHPEGFSSSSGAHLMIFYLQPMTGVYYMR

SEQ ID NO: 126637 - protein, 203 aa, Glycine max
  Coding DNA Sequence Number=SeqID_34952
MDNEEGVQEQMKADLSALKDQMASISEVMLKLQKTIEDKATATASSTVREAEPVLQPALNPGLDRNTAVFCRRYSPQAYPYGLPPDFTPCATPEDLSQALTFEGQLPPYEDYPRQDDGEGDTHLGPLLHLKDPSPHELPQPNIVRHIPASPTPVKESVPFAEDKGKIEALEERLRAVEGLGNYPFSNLADLCLVANIVIPPKS

SEQ ID NO: 126638 - protein, 54 aa, Glycine max
  Coding DNA Sequence Number=SeqID_34953
MFAHSIKGCRPLGRTCGVLIPSPCSEKAQSSRTSGLSQSFKGEGMMQSTCKGIG

SEQ ID NO: 126639 - protein, 138 aa, Glycine max
  Coding DNA Sequence Number=SeqID_34954
  Homolog annotation: Hit_ID=Q6WAY3; Match level="QueryCoverage=42%, HitCoverage=2%, E-value=2e-08, Identity=44%"; Hit description =Gag/pol polyprotein
MQPMFLSMGGPPPTAEGKGKLDLIEEILRAIEGFGDYPFADMTDLCLVSDIVIPRKCGFKTRRSDDESRKGTNIGDPTVDFEQEASRTENEEDEDVGLPPELERIIAQEDREMRPHQEETKLVDLGTDSGTNDVTIGT

SEQ ID NO: 126640 - protein, 60 aa, Glycine max
  Coding DNA Sequence Number=SeqID_34955
MGFWETVTLGKVLGFCEKFSDVIVREDMLRLNLIKEGRIITGIKMRLMSDVMSVKNIVRL

SEQ ID NO: 126641 - protein, 160 aa, Glycine max
  Coding DNA Sequence Number=SeqID_34956
MVPHQSVNFPAQQFHMLQSSIETQGIDRRRDTIEAEEYSQQMAERGHGMYYTPQTFAEYPTQMYQYPFQGHHTDTSASQQSFGGVAETQAHFSWPTMTPSQQYHAPLGTQWNVPGQIPNTGDLFGVDLRHAFSAEADEEEAGRHRGRRNPDRQARRWERP

SEQ ID NO: 126642 - protein, 79 aa, Glycine max
  Coding DNA Sequence Number=SeqID_34957
MMMTFSAGFAYLEGECVNNVVWALERFHIDKNVKEKCKSLIGQKNALEYVMDAWGSLIDCRSEHQFDDCLKKFEIACSP

SEQ ID NO: 126643 - protein, 198 aa, Glycine max
  Coding DNA Sequence Number=SeqID_34958
  Gene Ontology: Mol. function=oxidoreductase activity; Biological process=electron transport
  Homolog annotation: Hit_ID=A8GIX2; Match level="QueryCoverage=100%, HitCoverage=57%, E-value=1e-116, Identity=96%"; Hit description =Rieske (2Fe-2S) domain protein
MGWNLGDRIACWYHGVEVGGDGTVKDVPAVDRCPLVGQKCLRSYPAKEAYGAVFLYFGVTADEAPAELTFPQELADEASYSNFLCTASWNCNYQYALENVMDPMHGTYLHSSSHSMAEGDRKADMGLEPTDSGFIFKKNGQIGVNFDWVEFGNSGAYWMRLSIPYKKRFGPGGHFWIIGMVVPEDKDHCRVFFWRIRK

SEQ ID NO: 126644 - protein, 107 aa, Glycine max
  Coding DNA Sequence Number=SeqID_34959
MTLLSRTPWNQSSVGHYLERRTGDGVNRKLGLGAQLRVYYPSETTAKGTGLAELNSGGMEVKTLGASPGGAVVGADLGGTGEARLIALCARTPKGNRVKIPEPGRGG

SEQ ID NO: 126645 - protein, 55 aa, Glycine max
  Coding DNA Sequence Number=SeqID_34960
MACPEGQKVDFGTYTLVEEAEYWWENTRQCIEAEDKGGIFRKIVHIPRRSRMVGA

SEQ ID NO: 126646 - protein, 341 aa, Glycine max
  Coding DNA Sequence Number=SeqID_34961
  Gene Ontology: Mol. function=RNA-directed DNA polymerase activity; Biological process=RNA-dependent DNA replication
  Homolog annotation: Hit_ID=Q5NRP4; Match level="QueryCoverage=35%, HitCoverage=7%, E-value=1e-08, Identity=32%"; Hit description =Putative gag-pol polyprotein, identical
  Pfam annotation: Domain name=zf-CCHC; Domain location=88-105; Score =16.6; E_value=0.0047; Accession=PF00098.14; Description=Zinc knuckle
KKPQEANINLPYFYEKDNVEANLDCEIRVEQQLKEKSTSKSYGSHSYPKKDQGQGILGVIPSKPKDDKGKIIEKQAPKASMQEKTSSIKCFKCLGRRHITSQCPTTKTMIMRGQDIYSSQDEATTSPSSNENEEAIGEESRKEIYPQEEGQPLMVKEECKEVSVSSKRLVKKESHFEIKTNIKETSPLRQPPHLLLCKKTLVSTATPLGLEVIPQVKELLDEGLVRIIRHQIPKISDMMNVLSGATLFCKITRTPNIFMVCVHRDPLGSDQGVPMNPRRIKVIPKWPTPPSIRKIWGFHDLTNFYKRFEGRSPEYEEPQDLRSNPFQGGGNDAILPCKGIG

SEQ ID NO: 126647 - protein, 187 aa, Glycine max
  Coding DNA Sequence Number=SeqID_34962
VLCQPYNSEDPSPKQVKVRGHLVRIDADNLNIFLEMLVILVEGETLPTYSGYCRLPTDYKEIEAALYIPGQGFVLNSEDHPRKILRKDLMTLTQMDMNVGALISGQITSIAQSNPSRLGFPALITALRARTRLAEPPSTSIAPIPARTSTTPFVPASADFQRLEAMLQSIHQGEDEGPKTKVPQHVE

SEQ ID NO: 126648 - protein, 219 aa, Glycine max
  Coding DNA Sequence Number=SeqID_34963
MWGAPTEESLSPFLVRDLGAQGLKVIQRIHKAWRSLLRKDKELRGIRNGVIGGYHGWLRIHTRGLDWLSKLKVIDEENFEAPEEDEEVRALKLELGKARLAKEKFKSAATHIRKECTELQEENAATARALEQETKRARKEEHGREKFRGALWGSNNELKLRREERDRSRAHGMILKEELVACARSKRSLAQHLEAMEQSMLAIIGQYKEELNQSMAHEH

SEQ ID NO: 126649 - protein, 172 aa, Glycine max
  Coding DNA Sequence Number=SeqID_34964
  Homolog annotation: Hit_ID=Q84VI1; Match level="QueryCoverage=99%, HitCoverage=25%, E-value=2e-61, Identity=74%"; Hit description =Envelope-like protein
MATSPNEISASGSPSVPSSPHQEQPEFNIQPIQIIPGQASVPEKLVPRRQQGVKIAENPSLATSPREVDTEMDKKIRSIVSSILKDASVPEADEDVPTSSTPNVSVPDVNKDVPTSSGPNAEVLPSPSEEESTDEEDQSTEETPAPRAPEHAPGDLIDLEEVESDEEPIANS

SEQ ID NO: 126650 - protein, 45 aa, Glycine max
  Coding DNA Sequence Number=SeqID_34965
MGTTIGEELATQLAQASQVASSRSNRLLEEESVRQVASDILRRGG

SEQ ID NO: 126651 - protein, 15 aa, Glycine max
  Coding DNA Sequence Number=SeqID_34966
MASMDTSAMVNSKIF

SEQ ID NO: 126652 - protein, 87 aa, Glycine max
  Coding DNA Sequence Number=SeqID_34967
MTLATLFGKKKKGIALKASSSIRRKDKEIDLDEAQKRWRQSEKKNFSEKKLKKHTSHGMTYDMESSEDSENEEINLCLMAKVMKVMR

SEQ ID NO: 126653 - protein, 224 aa, Glycine max
  Coding DNA Sequence Number=SeqID_34968
  Gene Ontology: Biological process=transposition, DNA-mediated
  Homolog annotation: Hit_ID=Q6UUU1; Match level="QueryCoverage=31%, HitCoverage=46%, E-value=1e-18, Identity=71%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGALPRGRHGSKMADMNYATIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCKEDT

SEQ ID NO: 126654 - protein, 184 aa, Glycine max
  Coding DNA Sequence Number=SeqID_34969
  Homolog annotation: Hit_ID=A5BSR3; Match level="QueryCoverage=66%, HitCoverage=39%, E-value=3e-12, Identity=37%"; Hit description =Putative uncharacterized protein
PIRTVSRDTVCDKYGISKEKWAQFCQTHRDPSWEDVRMKAQAIQKQNTVPHEAAQSGSVDGVINPPSPVRRHMKWKMACTKKSGEMTTEAAKEIAEKIDSFKEQATQGSFVPHGRQNVLAAAIGRPEHPGRVHAAGAGVTIKQYFGSAPWTSRSASSLPPDELQQLTQQIRDQLEESITEKVTR

SEQ ID NO: 126655 - protein, 141 aa, Glycine max
  Coding DNA Sequence Number=SeqID_34970
ETSLSTAIPLELEVIPQVKELLDEGLFRKSLNPCALLVPKIGIIRHQIPMIGGMMKVLSGATLFCKITHAPNIFMICVHRDSLGSDQGLPMDPKRIKVIPEWPTPPSVEKRINEFQEPRDLRSNPFQGGGNDAILPPKGIG

SEQ ID NO: 126656 - protein, 39 aa, Glycine max
  Coding DNA Sequence Number=SeqID_34971
MDSFASWKMNGSGHGEGRERGAHATSREDESSKKLDTTI

SEQ ID NO: 126657 - protein, 202 aa, Glycine max
  Coding DNA Sequence Number=SeqID_34972
  Homolog annotation: Hit_ID=Q6CQE3; Match level="QueryCoverage=30%, HitCoverage=51%, E-value=1e-13, Identity=66%"; Hit description =Kluyveromyces lactis strain NRRL Y-1140 chromosome D of strain NRRL Y- 1140 of Kluyveromyces lactis
  Subcellular localization annotation: CTP_CleavageSite=53; ConfidenceScore=5.55e-01
MLSQLFVFHKSKNCHPLPPDGRNKRSSGSNLIVRHRHDPSAGSAVIYSSQRTRAANRSRRRNPNTYRTSSIGRSDRAGVQKGEADRSHTRAGLDRLPNPRNYRGCGTRLALHRTSLKDYSDCSGLPNLPGLNEPDWVIAAIVPLRSWPWRVPPHSYLAGSLRSPLTELTRQIAPPTKNGHAPPPIESRKSSQSVNPYYVWTW

SEQ ID NO: 126658 - protein, 90 aa, Glycine max
  Coding DNA Sequence Number=SeqID_34973
MEDCLEGSHLGNHETQLQTRKWRTHERKRNSWGSEKSSKLESGGHMNSAKAITFMGLRKRVRMEDCLEGPHLGNHETQLQTRKWRTHEQP

SEQ ID NO: 126659 - protein, 68 aa, Glycine max
  Coding DNA Sequence Number=SeqID_34974
MFLQKAIASRGSNLARLGELGGKLLPYFPINRGRSEGEKGSTLLVSEIHLKLVKKIVFVKKIQVEALP

SEQ ID NO: 126660 - protein, 87 aa, Glycine max
  Coding DNA Sequence Number=SeqID_34975
  Homolog annotation: Hit_ID=A2Q186; Match level="QueryCoverage=68%, HitCoverage=15%, E-value=3e-08, Identity=41%"; Hit description =Reverse transcriptase-beet retrotransposon, putative
MDHGSKPFKVYDAWLMNKDYQKVVRDCWSENQPRGWGGYALKCKLQNLKQRLKTWSRDNIGDLGNKVKQIQQKLNDLENSLTAQPSN

SEQ ID NO: 126661 - protein, 124 aa, Glycine max
  Coding DNA Sequence Number=SeqID_34976
MTEKKMMIVDTLPVFYYEEMVGYTPSSFADLVFTGKRIEVGLKRGKFGHPALMKTGASEEGENEGETHAVTAIPIWPSFPPTQQCHYSANNNPSPYPPPNYPQSSSLNQTTKPTYHTTNAKHHF

SEQ ID NO: 126662 - protein, 285 aa, Glycine max
  Coding DNA Sequence Number=SeqID_34977
  Homolog annotation: Hit_ID=Q84VI1; Match level="QueryCoverage=100%, HitCoverage=41%, E-value=1e-118, Identity=78%"; Hit description =Envelope-like protein
MATSPKETAAPGSPAVPSSPHQEQPEFNIQPIQIIPGRASVPEKLVPRRQQGVKIAVNPSLATSSREVDTEMDKKIRSMVSSILKEASVPEADEDVPTSSTLNVSMPDVEKDVPTSSGPNDEVLSSPSKERSTEEDDQAAKETPAPRAPEPAPGDLIDLEEVESDEEPIANRLAPGIAERLQSRKGKTPIKRSGRIKTMAQKKSTPVTPATSRRSKVAIPSKKRKEISSSDSDDDVELDVSTSKRAKKSGRKVPGNVPDAPLDNISFHSIGNVEKWKYVYQRKLA

SEQ ID NO: 126663 - protein, 258 aa, Glycine max
  Coding DNA Sequence Number=SeqID_34978
VVAELQAVIQGQLGDEHDGFGIVAIDVEHRRFDHLGHVGAIQRRARVARIRRGEADLVVDDDVHRAARAVAAGLGQVQGFHHHALAGEGRVAVHQHRQHLLAFGVAAAFLAGARAAFDHGVDDFQVGRVERQRQVHRTATGRQVAREAVVVLHVAVGQAFGVLAFELGEQVAGHLAHDVHEQVQAAAVGHADHDFLDAVFTGVVHHFVHRGDEAFAAFQREALLADVLGVQEALEAFGFGQLLQDVALFLGRVLAPQR

SEQ ID NO: 126664 - protein, 98 aa, Glycine max
  Coding DNA Sequence Number=SeqID_34979
MGVQIAPRPTWALRNIPPEGGCFWRKQPCSPGRAELAWASWAATTSPIFAINRGGSEEGRAEALPKRFRNVFCEEFRKDFNRSSTFFIRSSSFFDLQR

SEQ ID NO: 126665 - protein, 138 aa, Glycine max
  Coding DNA Sequence Number=SeqID_34980
EPSRTHSPRCNTGLKQAIGPINRGPDGDPQQAPSATTSGKSLSLFNHTNRGCHICDGTHEPRQCITQEDSSREVNYMGAQNRHRFLGYNQGGLSGFKQGRNFTQGLSWRNHLRNQFKKEQRSQLVQNSNQGVDLYEKT

SEQ ID NO: 126666 - protein, 72 aa, Glycine max
  Coding DNA Sequence Number=SeqID_34981
  Homolog annotation: Hit_ID=UPI0000ECAFAB; Match level="QueryCoverage =45%, HitCoverage=40%, E-value=4e-12, Identity=100%"; Hit description= UPI0000ECAFAB related cluster
VDGIDKLDSDTWWMSCSELSSQSGRHRGGAPIRPIVSRITIHWPSFYNVVTGKTLALPNLIALQHIPLSPAG

SEQ ID NO: 126667 - protein, 82 aa, Glycine max
  Coding DNA Sequence Number=SeqID_34982
MESPSVATYHSTGVQGEKPKERLLERKMCGSRHQRLFEENIRKTKTRSVNFENKGLRVVYAWGRVLPLLIRILRCDEKFRPT

SEQ ID NO: 126668 - protein, 73 aa, Glycine max
  Coding DNA Sequence Number=SeqID_34983
  Homolog annotation: Hit_ID=Q6WAY3; Match level="QueryCoverage=45%, HitCoverage=1%, E-value=6e-08, Identity=87%"; Hit description =Gag/pol polyprotein
MPEPRTEKQVRGFLGRLNYIARFISEQLTPTCEKPSYQIEETQLVNLGTGEAKERSKSSLGTRCMTAPESAKA

SEQ ID NO: 126669 - protein, 279 aa, Glycine max
  Coding DNA Sequence Number=SeqID_34984
  Homolog annotation: Hit_ID=Q2HW90; Match level="QueryCoverage=56%, HitCoverage=34%, E-value=7e-12, Identity=30%"; Hit description =Putative uncharacterized protein
MGLSQMPSLKKRFYQVKVKSLGITSLKELGQLMGQLQRQAFRKAYAVEMLHFWDFQLSPMVEEFEEILGCPLGGRDHTSKIVQISAQELDHRKQVENGVVGIPRKCLEEKARTLAGRGEWAPFIDILVLLIFGGVLFPNVDGLVDLAVIDAFLAYHDRKESPVVAILADLYDTFDRRCEKSSTRIVCCTSALYVLLVSHLFHQENERLSTGSLDGKKEESGFLFRAEGAPLEEELAPIIARGFNKTNVEALQKVRKAWDMVQKKDKELRGSNNGSIGGY

SEQ ID NO: 126670 - protein, 115 aa, Glycine max
  Coding DNA Sequence Number=SeqID_34985
MARTKKTGQMTFEAAKEIADKIDFLEDQTSQGSFVAHGCQDVLIAAIGRPEHPGCVRAARVGVTIKQYFGPAPRTFRTSSSMAPEDLEQLMQKIRDQLEESITEKVTQQLMLSFS

SEQ ID NO: 126671 - protein, 61 aa, Glycine max
  Coding DNA Sequence Number=SeqID_34986
  Subcellular localization annotation: CTP_CleavageSite=31; ConfidenceScore=5.53e-01
MKLASTTSSSKLLSMASYGVASPLSLPSPVRYHSSSKKQRNPLMKYILGLQAPMELTSEGT

SEQ ID NO: 126672 - protein, 91 aa, Glycine max
  Coding DNA Sequence Number=SeqID_34987
MTRGNPSDLQPFDPEIDMTLHRLVRHHLVPFEHLEHSVIGDFEHYSFEHSDFEYSENMAHPPPRERTLRELAAPDFTYESLCIQYPDEDVP

SEQ ID NO: 126673 - protein, 260 aa, Glycine max
  Coding DNA Sequence Number=SeqID_34988
  Homolog annotation: Hit_ID=UPI00016621D1; Match level="QueryCoverage =65%, HitCoverage=39%, E-value=1e-09, Identity=30%"; Hit description =UPI00016621D1 related cluster
LHALTIRGLHVLTFVGLHALTFRGLHVLANRGLHALTFRGLHILAFRGLHVLTLRGLHVLALRGLHVLALRGLHVLTIKGLHALTSRGLHVLALRGLPAFALGLHALTFRGLHILAFRGLHVLTLRGLNVLPLRGLHVLTIRGLHALTSRGLHVLALRGLHVLTIRGLHALTSRGLHVLALRGLLALALGLHALTFRGLHVLANRGLHAFTFRGLHVLANRGLHALTLRGLHALTSRGLYILALRGLHALTFRGLRVLIF

SEQ ID NO: 126674 - protein, 99 aa, Glycine max
  Coding DNA Sequence Number=SeqID_34989
MEIKCTVESKRVGKKETNTKEFLYWFGNNPCLPPVPKRPAVLEISFNLVKIFLQAKIHKGLDVPSTKTDPQEMYPLLFSVKPKKMYPLLVPQRMYPPMC

SEQ ID NO: 126675 - protein, 139 aa, Glycine max
  Coding DNA Sequence Number=SeqID_34990
MLYGALTVTRARARVMGEVEEVQEQIKANMEAMKEQMATVMEAMMSMKKIMEVNAVAVAATSTVAKVNPTPPSGLNQMNHPTSDMVRKDLGSTGGPHDVQIQNEHAFPPYGLPLNYTLPNVVYTPGEDVNNSAPILIES

SEQ ID NO: 126676 - protein, 153 aa, Glycine max
  Coding DNA Sequence Number=SeqID_34991
  Gene Ontology: Mol. function=sequence-specific DNA binding; Biological process=signal transduction
  Homolog annotation: Hit_ID=A7MJI5; Match level="QueryCoverage=98%, HitCoverage=54%, E-value=7e-70, Identity=87%"; Hit description =Putative uncharacterized protein
TWDVVAWNHPATVVLKDYGQLPPARRNILRLLFTDQEARGMQDDWEGVARLIVNAFRADAARLGASEEIDRLVEELSAQSADFARLWRNNDVAGHGEGFKVLHHPQMGTIALEFSTFSVEGRPDLTMMLFNPATDESRAKTERWISQNPAQRV

SEQ ID NO: 126677 - protein, 184 aa, Glycine max
  Coding DNA Sequence Number=SeqID_34992
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MKHFTDTLISATYWHDRFPDWKAGSERNAINETAMTMITPSSKLTLTKGNKSWYRAPPRGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 126678 - protein, 222 aa, Glycine max
  Coding DNA Sequence Number=SeqID_34993
MGDQEETQEQMKADMSALKEQMASMMEAMLGMRQLMEKNVATAAAVSSAAEADPTLLATAHHPPSNIVGRGRDTLGHDGNPHLGYNRAVYPYGLPPNYSPPVLQDDAGHIASPVLEREPPQQPDEVHKDPQDYARRDVEFYPPIPEGPAPSTLPQPNITTQPIVFSMEGPPPATEERRKLDLLEERLRAVEGFGDYPFADMMDLCLVPDVVIPPKFKVPDFD

SEQ ID NO: 126679 - protein, 76 aa, Glycine max
  Coding DNA Sequence Number=SeqID_34994
MVTIMVFHLRLVFAELQQQNQGNKAKMGFKGINSEAFCTPGQNETKNKIQGYQRETNKNIHIFLNEHQGMKGMGNI

SEQ ID NO: 126680 - protein, 28 aa, Glycine max
  Coding DNA Sequence Number=SeqID_34995
MSQATVKSQDKSMAEINPRYLGMEANEG

SEQ ID NO: 126681 - protein, 137 aa, Glycine max
  Coding DNA Sequence Number=SeqID_34996
MVGLEGKELGGTGGPHLVQKTSLPSHHMACLPTIHHPMWHTLPVRMSITPLPYSLKANNLKLIMHMSLKPWGRHMKFPTTFKLTSSLASDMPLKGKQLVVYLCKTLWRGLNFSLNHNTSMENGGLHTFKLCGFGLRR

SEQ ID NO: 126682 - protein, 126 aa, Glycine max
  Coding DNA Sequence Number=SeqID_34997
MGSSGFDPIPFRSVLLIEFCKRFRSFFGESRGLSDGCAQPNVIYVDPSQTSLQRVTIPSYMGFRLKEGFLAKRRKALVYAHPAERRLSGRTRRQLPMPSRQNEKAMEGPKGTIFIVKKLSFLASSA

SEQ ID NO: 126683 - protein, 86 aa, Glycine max
  Coding DNA Sequence Number=SeqID_34998
MSMDCYEGDCEVHIYSDLRWGPIAVRNRPERIMRQFGYVQSIPIEAVNSWVSFEEIDDRWVHYSYHLAPAGEICLMPGQCAPEYMD

SEQ ID NO: 126684 - protein, 55 aa, Glycine max
  Coding DNA Sequence Number=SeqID_34999
MDDSSTIEETEVNSKFEEVLEAFTEMHEEAQRLAVSNNKLRSDLKLHTTKLASTQ

SEQ ID NO: 126685 - protein, 133 aa, Glycine max
  Coding DNA Sequence Number=SeqID_35000
MCEDQWTYDYAMSQEVHMDYDYDDEEECGVNESHVNCSNAFNTSQVFGTRDDVLQWARTVAHENGFVAVIMRSDTDTGIKNSLEKTLGVGNVVVPSGFVGTSAWRGRLMVKLICGIHNHELAKSLVGHPHRWH

SEQ ID NO: 126686 - protein, 345 aa, Glycine max
  Coding DNA Sequence Number=SeqID_35001
  Gene Ontology: Mol. function=RNA binding
  Homolog annotation: Hit_ID=Q2HS79; Match level="QueryCoverage=68%, HitCoverage=46%, E-value=7e-37, Identity=42%"; Hit description =Cyclin-like F-box; Agenet
  Pfam annotation: Domain name=F-box; Domain location=115-162; Score =22.4; E_value=0.0017; Accession=PF00646.24; Description=F-box domain
MEWITHQLQERRMRRRMRIRKTRQAYGKNEDNEDWISEREVDGETEDDGDMISERKRNIREVDAENEDNGDRIGKRKRNIREVDAENEHNGDRISERKKNIAREVDGENEDHRPDRISALPDSLLFHMINFMDTKSAVQTCVLSKRWNDLSKCLTNLTFNSDLPSEGLDRSFKKFESWVLSSRDDSYPLLNLTIESWIDADVQDRVIKYALLHNVQKLKMNINSTTYRPNFKSLPLIFRSQSLTSLELSNKLSPSRLKLPKSLCLPALKSLHLAYVTFTASDKDRVEPFSNCHVLNTLVLRNFSLSAQVLSISNSTLSSLTIFEGQACSIVLSTPNLSSFSITGS

SEQ ID NO: 126687 - protein, 665 aa, Glycine max
  Coding DNA Sequence Number=SeqID_35002
  Gene Ontology: Mol. function=nucleotide binding; Cellular component =cytoplasm; Biological process=response to virus
  Homolog annotation: Hit_ID=Q10NS9; Match level="QueryCoverage=95%, HitCoverage=94%, E-value=0.0, Identity=59%"; Hit description=Dynamin family protein, putative, expressed
  Pfam annotation: Domain name=Dynamin_M; Domain location=248-535; Score=-71.2; E_value=9.3e-07; Accession=PF01031.11; Description =Dynamin central region
  Pfam annotation: Domain name=Dynamin_N; Domain location=61-235; Score= 224.9; E_value=1.9e-64; Accession=PF00350.14; Description=Dynamin family
  Pfam annotation: Domain name=GED; Domain location=560-656; Score =30.8; E_value=5.1e-06; Accession=PF02212.9; Description=Dynamin GTPase effector domain
  Pfam annotation: Domain name=MMR_HSR1; Domain location=59-236; Score=- 18.1; E_value=0.049; Accession=PF01926.14; Description=GTPase of unknown function
  Pfam module annotation: Pfam domain module=Dynamin_M::Dynamin _N::GED::MMR_HSR1; Domain location=248-535::61-235::560-656::59-236
MGEGTFRFGLDHATPKPEPNEAKHVAPIVSSYNERIRPVLDAVENLRRLNITKEGIQLPTIVVVGDQSSGKSSVLESLAGISLPRGQGICTRVPLIMRLQNHSLPKPELVLEYNAKIVSTDEAQVSDAIRVATDELAGGGKGISNTPLTLVVKKDGVPDLTMVDLPGITRVPVHGQPEDIYDQIKDIIMEYIRPEESIILNVLSATVDFSTCESIRMSQGVDKTGERTLAVVTKADKAPEGLHEKVTADDVNIGLGYVCVRNRIGDESYEDARAEEVNLFRTHTLLSKIDKSIVGVPVLAQKLVQLQAASISKILPEIVKKINDKLGSQLSELDKFPRKLTSVPNAMSAFMHIIGLAKESLRKILLRGEFDEYPDDKHMHCTARLVDMLDQYSNDLYKGPESDAGEKFLMEEIKVLEEAKWIGLPNFMPRSAFLTLLQNKVRAISSMPIEFTVKVWDYLEEVVVAVLKRHSEHYHQLQTSTKRAGKNLIAKMKENSMKYVMEVVEMEKLTDYTSNPEYMSEYNELMANQDEFVEKVNTGNYHEVALDGFEQAIKVGHLSQYSTLLPQAFDLKMRLRAYWKIVLRRLIDGTALHLQLSIFNLVDKDLGDEIVKDMMSPYAGGIEKLLEEAPSVSMKRDKLNRSIKVLRESKEVVANIMDKISSYDD

SEQ ID NO: 126688 - protein, 72 aa, Glycine max
  Coding DNA Sequence Number=SeqID_35003
MADIISLFAIKKVNFYDNQSPPNQSQKNDDLEPVHRWIVVKFEYHVRNTIPSILTVGNFDIMSELRETPFAL

SEQ ID NO: 126689 - protein, 412 aa, Glycine max
  Coding DNA Sequence Number=SeqID_35004
  Gene Ontology: Mol. function=transporter activity; Cellular component= integral to membrane; Biological process=transport
  Homolog annotation: Hit_ID=A5B4A0; Match level="QueryCoverage=99%, HitCoverage=56%, E-value=1e-125, Identity=53%"; Hit description =Putative uncharacterized protein
  Pfam annotation: Domain name=Ponericin; Domain location=237-266; Score=15.4; E_value=0.063; Accession=PF07442.2; Description=Ponericin
MDELLKRASMYEYDDDGNKPLQNLGDKDQQTDPYSFDGGGSVTLADITEEQQHLTIKGEPKHQKIGGKKDENPLGSSLNLYCCHCTSKKDEKNEKISTKEKKVLETPILIAAKNGVTEMVAKIMDSFPVAVHDMDAKKKNIVLLAVENRQTYLYNFLLSKKNLKESNIFEKVDNEGNSALHLAAKLGDYKPWLIPGEALQMHWEIKWYLFVKGSMQPHFFSHYNNENKTPRDIFSETHKDLVRSGGEWLKKTAESCSLVAALIAAVAFSTSTNVPGDFKDDTGSPTLEERPEFKAFAIASLIALCCSVTSLVLFLSILTSRYQERDFGKNLPRKLILGLTSLFMSITSMMVCFCAGHFFVLKDKLKSVAFPVYAVTCLPVTLFALAQFPLYIDLTWATFKKVPQRGYKTSLT

SEQ ID NO: 126690 - protein, 158 aa, Glycine max
  Coding DNA Sequence Number=SeqID_35005
  Homolog annotation: Hit_ID=A5C5C3; Match level="QueryCoverage=68%, HitCoverage=23%, E-value=3e-09, Identity=30%"; Hit description =Putative uncharacterized protein
MKLEHNTREGQHLKSGGKTGRNEPPTTPRKLSEWEEIDKLWRKKEMHNLAKELVNLLAPKDYSWRNTAIARDRTVSMGRSQQEGKSKEIKGEQEGARKPTYTPLLMAACNGITEIVEVIIHFHPHSIEHVSDDEQNILYMAVKHRQKKIYQILKKLKM

SEQ ID NO: 126691 - protein, 147 aa, Glycine max
  Coding DNA Sequence Number=SeqID_35006
MATGAVNASVTGTVYTDNKLAIYQVDKVLLPLDLVLPSEAPAPAPGKAKGASPKTDKTKSGADDGAAGGDSDNGDNKDLPAEASSAGSVQWLYPNKCVNPSAVRHNLNQAAAGKGCRKGQGVTALGREWSGEKTLPRGIIIYLGSLF

SEQ ID NO: 126692 - protein, 522 aa, Glycine max
  Coding DNA Sequence Number=SeqID_35007
  Gene Ontology: Cellular component=anchored to membrane
  Homolog annotation: Hit_ID=A7P2Q7; Match level="QueryCoverage=40%, HitCoverage=58%, E-value=2e-23, Identity=31%"; Hit description =Chromosome chr1 scaffold_5, whole genome shotgun sequence
  Pfam annotation: Domain name=Fasciclin; Domain location=328-451; Score=63.3; E_value=8.4e-16; Accession=PF02469.13; Description =Fasciclin domain
MVALCKETIGHQDIVSSLFKGMQKEKKTINSVELSKAMFDAAQSGNVTILEFLFNNHPDLLFEVDSTKQRSLLHIAILYRQEYVYRLILSKGAFKNVMIQLIDSDGNNVLHLAAEFDSKERLGLPSLPVLMCSEEKWFQEVEKIVPPAMKRMKNNDGLTPKEVYYRSHKDLHTEAASIVKNLANTLLVVAILIVTLGITGAITVPIKDLDSTSSPFFPKKTWYTFFFLSIAFGTWLCASSMFCYASVILPQIMYTAAISGAIVVFDFLSNWSIYLICGFGAPKPPAKPAPATPTPAPAKSLVPSLPQSPFSDSSSNQYNFKILRKTKSFSTLIRLLKTTQIINQVNAQLVTTKSGGGLTILAPDDGAFSHLQAGYFNSLGDRQQKALIQFHVLPVSVSSSNFDSLSNPVMTLATYGNSVNISTGVVNATLTGIMYSDKTLAIHHVDTVLIPLYFSKPKPPAPAPTLAKAPKADKDNSSAQDDDQGESNKATSAANAINLISIHGTMLVSLGVALVAAVTFSI

SEQ ID NO: 126693 - protein, 1358 aa, Glycine max
  Coding DNA Sequence Number=SeqID_35008
  Gene Ontology: Mol. function=DNA-directed DNA polymerase activity; Cellular component=DNA polymerase III complex; Biological process =DNA replication
  Homolog annotation: Hit_ID=A7QDG1; Match level="QueryCoverage=81%, HitCoverage=94%, E-value=0.0, Identity=56%"; Hit description =Chromosome chr10 scaffold_81, whole genome shotgun sequence
  Pfam annotation: Domain name=AAA; Domain location=493-698; Score= -21.2; E_value=0.0014; Accession=PF00004.20; Description=ATPase family associated with various cellular activities (AAA)
  Pfam annotation: Domain name=DNA_pol3_delta; Domain location=539-775; Score=-90.8; E_value=0.027; Accession=PF06144.4; Description=DNA polymerase III, delta subunit
  Pfam module annotation: Pfam domain module=AAA::DNA_pol3_delta; Domain location=493-698::539-775
VGVLIMTRAVRSRVLKDANGDISDHLRNHIHLTNCIHLKNHMHKNSPILADRSIMRDLVVLQRSRSLRDPSASPPSWHSPSVVDLLFKRVENDAVSQGGRMSVGAERRKEGRRLSGTSPPLVSIGSSRVAPGEIGRGNDGITAPSERSSRSGLGDGRRVGREESGRKNDRPDFLDVNPEEPLYQGGKSLAEDVISRHSESKARKSKQRGKNVRDAQVKTLSEQLNDVPLDSDDLASSNIHFRGRFPRQEKVIEEVESRMRSHGSGMNKGKRRKFRSVRRTRVATTSRDIGAENEISVASNSLAHHKYHLEEADEFADENVTRAPKNGCGIPWNWSRIHHRGKTFLDLAGRSLSCGLSDSRLKKGTFTANGRNISEMPVASERSSSCTKSDAEALPLLVEASGSHASTENACWDHDYSGELGLFGDNLFKHDVDSDLASEARSGDQRKLRGNRHSRHQSLTQKYMPQTFRDMIGQNLVAQALSNAVMKRKVGLLYVFYGPHGTGKTSCARIFARALNCNSSEHPKPCGFCNYCVAHDMGKSRNIREVGPVSNFDFEGIMDLLDNMTLSQLPSHYRVFIFDDCDTLSTDCWNAISKVIDRVPRRVVFILVSSSLDWIATKEGLEIDKDALKLIASRSDGSLRDAEMTLEQLSLLGQRISVPLIQELVGLISDEKLVDLLDLALSADTVNTVKNLRVIMETGVEPLALMSQLATVITDILAGTYDFTKERRRRKFFRRQPLSKEDMEKLRQALKTLSEAEKQLRMSNDKLTWLTAALLQLAPDQQYVLPTSSDNSFNHSPFALKDADAREAARLTGNPVDIPNKGRRLSMDARIENFHAGSSADGMTRGLGSEKKRHSVSGFTPQHAHSQTTDKIRMSERQILGKNHKEIEEIWLEVLERIQVTGLKEFLFKEGKLISVSFGAAPTVQLMFSSQLTKSTAEKFRGHILQAFESVLGSSITIEIRCELNKDAASAVQQPLTLPATNDSSSQIRDFNGVGTLAHPSVTDSVEKRRGEIVEEAASQVEHMNSEQQVDAHGTSYKSLEGTSIGQSSASQKMPIVKSHLDERKLMEQGQSRSLVRSKVSLAHVIQQAEGQRSGWSKRKAVSIAEKLEQENLYETGTKIKELDMLESIKSNPAKAVTLENSKPKATCTAESCLMWEMSVYKISKGMEEEKEPLNSEQLSKVVFDAAKSGNIMILECLLKYHPDLLFEVDSREQRSLLHIAILYRQESVYQLILSKGDSKNVMIQLVDSKGNNVLHLAAGELAPEERFGLPNHVLMAREENWFQEVEKIGDPLESTCRHASLALAVVLQRRDWENPGVTQLNRLAAHPPFASWRNSEEARTDRPSQQLRSLNGEWRLM

SEQ ID NO: 126694 - protein, 81 aa, Glycine max
  Coding DNA Sequence Number=SeqID_35009
MAGTGARNRSQKNLFSAYEVTRNELLIDHGGVSFSAGCGSWDDEAFWLLDTNKGKQREPRIEQGESQSVPWKVETETREKE

SEQ ID NO: 126695 - protein, 90 aa, Glycine max
  Coding DNA Sequence Number=SeqID_35010
MAFVLLSGPHKGVHTNFKDLCLAKEDGFNPSINETINLIQAEMMDYITIKITTCPSSFTVQNYPCHVMRLLPEDHRNYLCLDYLYYEYEI

SEQ ID NO: 126696 - protein, 71 aa, Glycine max
  Coding DNA Sequence Number=SeqID_35011
MILVAIVAEVLEEYTALLARVVEQVFRSAPVPRRWIHRSSVSFNLSLLPLCLPCITLETSFTSLLYYYVKL

SEQ ID NO: 126697 - protein, 95 aa, Glycine max
  Coding DNA Sequence Number=SeqID_35012
MWRPLAVRDLEGGFVEVCLDLDGTVVGVIVVEGGGKGEEPGFGVLGGKGGGGEDEEESEEGDKKGEVEPEEEGIVVGFGGWDLFFRISSHLISGD

SEQ ID NO: 126698 - protein, 422 aa, Glycine max
  Coding DNA Sequence Number=SeqID_35013
  Gene Ontology: Mol. function=binding; Cellular component=nucleus; Biological process=regulation of transcription
  Homolog annotation: Hit_ID=A7QDH6; Match level="QueryCoverage=87%, HitCoverage=90%, E-value=4e-99, Identity=34%"; Hit description =Chromosome chr10 scaffold_81, whole genome shotgun sequence
  Pfam annotation: Domain name=PPR; Domain location=142-176; Score=9.8; E_value=0.53; Accession=PF01535.11; Description=PPR repeat
  Pfam annotation: Domain name=PPR; Domain location=208-242; Score =41.6; E_value=2.7e-09; Accession=PF01535.11; Description=PPR repeat
  Pfam annotation: Domain name=PPR; Domain location=41-75; Score=24.1; E_value=0.00053; Accession=PF01535.11; Description=PPR repeat
  Pfam annotation: Domain name=PPR; Domain location=76-110; Score=9.0; E_value=0.66; Accession=PF01535.11; Description=PPR repeat
  Pfam module annotation: Pfam domain module=PPR::PPR::PPR::PPR; Domain location=142-176::208-242::41-75::76-110
MEKPTVWMDFAGKPTAGEVELSHVTGDMVAGVLELKQGKAVMGEPKIAAYVREGLYDDAIKLFYEMESKGVSPDVYSMNSVLHACACSNSLDKGRDVHNYIRKDNMTLRFPVSNGLMDMYAKCGSMEKAYLVFSQIPVKDIVSWNTMIGACGSLAALEIGRGIHGRILRNGYSSELHVANALIDMYVKCGSLVHARLLFDMIPEKDLITWTVMIAGYGMHGFGNEAIATFQMMRIAGIKPDAITFPSIFMLAVILDYSIRDLLARTGNLLKAHSFIETMPIKPDATIWGALFCGCRIHHDVELAEKVAEHVFELEPDNTGYYKLAMAFGILNFPSGRTISVTKNLRVCDDCHEMAKFMSKTTRREIIVRGSNRFHHFKDGFCSCRDFWGSLIGVEKQYAYMENRLSEYCNWGRQRGEALSLP

SEQ ID NO: 126699 - protein, 373 aa, Glycine max
  Coding DNA Sequence Number=SeqID_35014
  Gene Ontology: Mol. function=DNA binding; Cellular component=nucleus; Biological process=regulation of transcription
  Homolog annotation: Hit_ID=Q6DXR2; Match level="QueryCoverage=98%, HitCoverage=99%, E-value=2e-48, Identity=38%"; Hit description =Putative MYB transcription factor
  Pfam annotation: Domain name=Myb_DNA-binding; Domain location=88-139; Score=41.3; E_value=3.5e-09; Accession=PF00249.22; Description=Myb -like DNA-binding domain
MSEGYEIHNNEETSSGCSQKCSSFDLNEELACSTEDNTDTKECYELTTTNEKAKDEGTSANGSSISSREGNERRGTTVRQYVRSKMPRLRWTPELHHSFAHAVERLGGQERATPKLVLQLMNVRGLSIAHVKSHLQMYRSKKLDEAGQVLSQTYRSNQEVVRRPLILHQSISPQQHLKMGNGGIILASNFNKHSHFPSLLQPSFSLSRSLTNDTDSRHQHWYINHQAFRIPIASGQIQPKDTRGRIAPMRPSQLLEEKRWPPLEILNNHQSKFQKLPSIDSPKIGSQAIQPAEWSSFMNNTSIIDYLSNNSNEPRNNSNSLKLEFGPPFRIKKDEQQFLDLQLGLSHTCTVGTDGKMDHYRETPEISTKLSLS

SEQ ID NO: 126700 - protein, 254 aa, Glycine max
  Coding DNA Sequence Number=SeqID_35015
  Gene Ontology: Mol. function=protein binding
  Homolog annotation: Hit_ID=A7QDI9; Match level="QueryCoverage=93%, HitCoverage=97%, E-value=5e-55, Identity=47%"; Hit description =Chromosome chr10 scaffold_81, whole genome shotgun sequence
MKNPVAESFTDFYDKWVWKLEEILHQLLEVSKQRTEVVKTEQELQVLVSKVTSHLKEYYTIKWASAHEEVLVFFSPAWLSPLENAYLWITGWKPSMVFKLLETLKKQASGGDFVMTEEQVRKIEELRKRTRMEEEKVEREMERQQVAMADRKMVELVKLTGRARNNGSGGGGDAVDAVVEVALKGVLAGLERVMKASDCVRLKTLKGVLDVLSPMQCVDFLAANIAMQLRLRQWGKKKRDIAAAGSTLNVNQDN

SEQ ID NO: 126701 - protein, 167 aa, Glycine max
  Coding DNA Sequence Number=SeqID_35016
MDEEAESVPHPQSPKLGFPLPSSAAADGNLITGLSTIMAASIQDAKNRISQIERAKRNAAFSKLESCEGEKATLLARIDELDEKLRLKTREIEEADGKLLERVEALTCELRDEKLKRNRVTEAYKRLKSQHVYLRRKVGLGEENVVQENKLECASELEMLQSPIVKP

SEQ ID NO: 126702 - protein, 203 aa, Glycine max
  Coding DNA Sequence Number=SeqID_35017
MCNDMIICACGASHLCIIKLEVTKSLSPPLTSIRFNMKKATLDLGASTEGAGGPSNAGASAGAVCFLLFFVFFFDLGAGTSALGGTTGAGVVGSSAGGELTGTGVGGELIGTGVGGELTGVTVGGVVVGGVAARGVATGGVVVGAGAATLDGGDAAMGDEMAGGVAVGALGDEAGGYEVREVTGAVDFGLEEAMVGDAINTFF

SEQ ID NO: 126703 - protein, 94 aa, Glycine max
  Coding DNA Sequence Number=SeqID_35018
MDNLLMQYKEVIESTQPTFKSLEIQVGKLAKEVTKFMAKREENFVEVEAHEESLVKEHDSKEKDEEKKYMTFMASLAKRRKCKEDVFYVTLMPP

SEQ ID NO: 126704 - protein, 169 aa, Glycine max
  Coding DNA Sequence Number=SeqID_35019
  Gene Ontology: Mol. function=intramolecular transferase activity, phosphotransferases; Cellular component=extracellular region; Biological process=metabolic process
  Homolog annotation: Hit_ID=O49813; Match level="QueryCoverage=98%, HitCoverage=99%, E-value=3e-45, Identity=53%"; Hit description=Olee1- like protein precursor
  Pfam annotation: Domain name=Pollen_Ole_e_I; Domain location=30-154; Score=187.0; E_value=4.6e-53; Accession=PF01190.8; Description =Pollen proteins Ole e I family
MAKTTIIILASTLCFLSFLGSAYARDRFMVEGTVYCDTCRVQFLTKLSEFLEGATVRVVCSQVDNAKNVTFSKEAVTDASGSYKVEVDGDHEEDTCEVTLLKSPRADCSEVDQESHLQQAARISITKNNGIVSPIRQANPLGFLKKDRLPGCLDLLKELGINEDGTLIA

SEQ ID NO: 126705 - protein, 104 aa, Glycine max
  Coding DNA Sequence Number=SeqID_35020
  Homolog annotation: Hit_ID=A7QDL9; Match level="QueryCoverage=86%, HitCoverage=15%, E-value=6e-15, Identity=50%"; Hit description =Chromosome chr10 scaffold_81, whole genome shotgun sequence
MNSVMKPSHYINTLLVPRNGEIPVDVDCLAAQGIFDVISDLTRDHIHDGYEYSYFRTGSMIVVDSLRDPKVGIIYDPRSLIRSLVDLIDRYMKSQVNGLIDTRR

SEQ ID NO: 126706 - protein, 365 aa, Glycine max
  Coding DNA Sequence Number=SeqID_35021
  Gene Ontology: Mol. function=hydrolase activity, acting on ester bonds; Cellular component=cellular_component; Biological process =lipid metabolic process
  Homolog annotation: Hit_ID=A7QDN1; Match level="QueryCoverage=92%, HitCoverage=90%, E-value=1e-104, Identity=55%"; Hit description =Chromosome chr10 scaffold_81, whole genome shotgun sequence
  Pfam annotation: Domain name=Lipase_GDSL; Domain location=22-340; Score=172.9; E_value=8.6e-49; Accession=PF00657.13; Description=GDSL- like LipaseAcylhydrolase
MVAFVAVSSSASLLVACPYRSMFSFGDSLADTGNLYLSSHPPTDHCFFPPYGQTFFHHVSGRCSDGRLIIDFIAESLGLPLVKPYFGGWNVEEGANFAVIGATALDYSFFQDRGISIPTNYSLTIQLNWFKELLTALCNSSTNCHEIVENSLFLMGEIGGNDFNYLFFQQKSIAEIKSYVPYVINAIASAINELIGLGARTLMVPGNLPIGCSVIYLTIYETIDKTQYDQFGCLKWLNEFGEYYNHKLQSELDKLRVFHPRANIIYADYYNAALPLYRDPTKFGFTDLKICCGMGGPYNFNKLTNCGNPSVIACDDPSKHIGWDGVHLTEAAYRFIAKGLIKGPYSLPQFSTLCFRNVSFGYFNS

SEQ ID NO: 126707 - protein, 50 aa, Glycine max
  Coding DNA Sequence Number=SeqID_35022
MYFAIPRGGVGGAMVVGVGWRWWCVGCWSWVEVTTRVVQEYWKQKGEYVK

SEQ ID NO: 126708 - protein, 263 aa, Glycine max
  Coding DNA Sequence Number=SeqID_35023
  Gene Ontology: Mol. function=molecular_function; Cellular component =cytoplasm; Biological process=cell proliferation
  Homolog annotation: Hit_ID=A9PJ71; Match level="QueryCoverage=74%, HitCoverage=81%, E-value=2e-79, Identity=76%"; Hit description =Putative uncharacterized protein
  Pfam annotation: Domain name=THOC7; Domain location=47-187; Score =175.1; E_value=1.9e-49; Accession=PF05615.4; Description=Tho complex subunit 7
MEGLGRERMSKEFWGQNAVIEMLGKTRKVSARGESVAANYAFGPSEDDVIIKHRLLTRTTTTRGDPPLKKLQKKFTSFVSEVDKDEDNNYNECDKLARAFLQELTTFEIPLLKSKAIVEANIREKENFNELKEEMNRQILQAQDDIEDLKKQLEESKVERRHKEECEAIRKLIAMQPPRSETMKVISELENEIAALDAENTAGSRLLELRKKQFALLLHVVLSGKGWPDTNFGSVVTGFGMDGWGKTNELLVETDSWQHGVEK

SEQ ID NO: 126709 - protein, 201 aa, Glycine max
  Coding DNA Sequence Number=SeqID_35024
  Gene Ontology: Mol. function=ATP-dependent helicase activity; Cellular component=nucleus; Biological process=RNA-mediated posttranscriptional gene silencing
  Homolog annotation: Hit_ID=Q5QNI3; Match level="QueryCoverage=83%, HitCoverage=23%, E-value=8e-65, Identity=71%"; Hit description =Putative DEAH (Asp-Glu-Ala-His) box polypeptide 35
MSQFWKPGTERPQGRVVDDEEGGVLFLSGSHHSSSSSRYGYASIDKQRQRLPVFKYRTAILYLVETRATTIIVGETGSGKTTQIPQYLKEAGWAAGGRLIACTQPRRLAVQAVASRVAEEMGVKLGEEVGYTIRFEDVTKPDVTVLKFLTDGVLLREMMDDPLLTKYRNCELDVKVPGRAFEHELEKLRQLYFILSTNFNC

SEQ ID NO: 126710 - protein, 939 aa, Glycine max
  Coding DNA Sequence Number=SeqID_35025
  Gene Ontology: Mol. function=extracellular-glutamate-gated ion channel activity; Cellular component=integral to membrane; Biological process=ion transport
  Homolog annotation: Hit_ID=A5B195; Match level="QueryCoverage=83%, HitCoverage=36%, E-value=0.0, Identity=50%"; Hit description =Putative uncharacterized protein
  Pfam annotation: Domain name=ANF_receptor; Domain location=56-398; Score=122.5; E_value=1.2e-33; Accession=PF01094.19; Description =Receptor family ligand binding region
  Pfam annotation: Domain name=Lig_chan; Domain location=571-834; Score= 156.3; E_value=8.6e-44; Accession=PF00060.17; Description=Ligand -gated ion channel
  Pfam annotation: Domain name=SBP_bac_3; Domain location=458-792; Score=-20.0; E_value=1.2e-06; Accession=PF00497.11; Description =Bacterial extracellular solute-binding proteins, family 3
  Pfam module annotation: Pfam domain module=ANF_receptor::Lig _chan::SBP_bac_3; Domain location=56-398::571-834::458-792
MHFLSTIPQTLAMIWLFYLLISLGLISGYQNEATNANNKVISIGAIIDVNSRIGKEQQVALDIAAQSYNSTSRTYKLALYFRNSTKDPLRAITLVEEMIYKQKVQVIIGMHKWSEAALVAEIGSQAQVPIIAFAEPTITPPLMTERWPFLVRLANSSTTYIKCIADIVQTYNWQRVVAIYEDDAYGGDYGMLALLSEALQDVGSMIEYHLVLPPISSLHDPGGLVREELLKLWQTQSRVFIVLQSSFEMAIHLFKEASKMGLVDKESVWIHPESITNLLDSVNKSSISYMEGALGIKTYYSENSTEYQDFEAQFRKKFWPKNAEEDNRYPGFYALQAYDSIKIVTQAVDRMAGRNTSSPKNLLREILSSNFLGLSGQIQFEDGQLLQNPILRIVNVAGRSYKEVCFWSQQHGFTTNLPIGQGGYNVAGNTKCFNGVRWPGDLKHDPKGWKMPTKQNPLRIAVRNRTSFSKFVNYDQNKKIYSGFCIDIFQSVLPLLGYDLPYQYYPIDGTYNDLVQLVYNKTYDAVVGDMTILEERMQYVDFTVPYAESGLSMIVPSKSEESAWMFTKPFTWELWMVTGAILIYTMLAVWYLERESNPEFHGNWKSQISTALWFTFSSLFFAHREKMSCNLTRMVMVSWLLLVLILTSCYTASLSSMLTVKQLQPNVTDIQWLKRNNMKIGCDGDSFVRSFLEKVENFKPENIINVTDEYNYDGAFKNNSIAAAFLELPYEKVFISECCNRYIGFTPRTRFGGLGFMFQKGSPLARDVSKAILHLSEKKAELKRLEEKWLITSPASCSNVTSDDTDSLKLRSLWILYVISGATSTICVLLSAIQSLVKSCHQCQAVAPEGNDTPSDHKVWEKVITHAKQIFNKKINNSSEAQEQVVTDCSLRWDRVNMTVSPEHQQEMASPLPGILMLPSPPPEVQMTTHDLGITNTSK

SEQ ID NO: 126711 - protein, 532 aa, Glycine max
  Coding DNA Sequence Number=SeqID_35026
  Gene Ontology: Mol. function=catalytic activity; Cellular component =integral to membrane; Biological process=metabolic process
  Homolog annotation: Hit_ID=A7QDM6; Match level="QueryCoverage=99%, HitCoverage=98%, E-value=0.0, Identity=66%"; Hit description =Chromosome chr10 scaffold_81, whole genome shotgun sequence
  Subcellular localization annotation: CTP_CleavageSite=52; ConfidenceScore=5.28e-01
METPTRFSSCRGVAFEVKPHADPFAIVTTPTSQSLSNSKRIWPLDTSRVFPSSSQRSFSSVSSHFCDLDDDDEEEDAPESIFEKTYDVEKQNQLAAVHNNGIVGSTSKSEQPSKPSRKNESRLSVILLDQGLFTVYKRLFMLCLTFNVTGLVLAATGNFPYARNRAALFSIGNILALTLCRSEAFLRLVFWLAVKTLGRSWVPLFLKTATTSLLQSLGGIHSGCGVSSIAWLVYALVLTLKDRDNTSPEIIGVSSAILGLLCLSSLAAFPLVRHLHHNVFERTHRFAGWMALCLLWAFIMLTISYDPKSKSYSKELGSRLVRSQEYWFTVTITVQIILPWLTVRRVAVKVSSASGHASMIKLEGGIKAGILGRISPSPLSEWHAFGIISDGKKEHMMLAGAVGDFTKSLVSNPPSHLWVRQVHFAGLPYLVNMYDRVLLVATGSGICVFLSFLLQPSKADVYLLWVAKGVEQNFGEEIKEMGRPNVSQLSVTAAKKWNVEVVIVTSNPEGSRDVVNSCKADGIPAFGPIWDS

SEQ ID NO: 126712 - protein, 60 aa, Glycine max
  Coding DNA Sequence Number=SeqID_35027
MFIVVVVDSSTATYEEMAEKLQKEMKGSGLRLKGMTRGLIRAVKEMDKEVVEAESIVVVV

SEQ ID NO: 126713 - protein, 216 aa, Glycine max
  Coding DNA Sequence Number=SeqID_35028
  Gene Ontology: Mol. function=4-alpha-hydroxytetrahydrobiopterin dehydratase activity
  Homolog annotation: Hit_ID=Q6QJ72; Match level="QueryCoverage=75%, HitCoverage=70%, E-value=1e-39, Identity=51%"; Hit description =PCD/DCoH-like protein 2
  Pfam annotation: Domain name=Pterin_4a; Domain location=74-171; Score= 23.8; E_value=1.8e-05; Accession=PF01329.10; Description=Pterin 4 alpha carbinolamine dehydratase
MNRLLLVRHPLLALSKPPLSPFSQTYYYSYTPARINSELYKIKDPPGVSSVHTSSTFCTTNKDLSTENCVPCNTKDLQPMTEDAARTMLQQWNLVNEDGVLKLRRSWKVKTFTKGLEFFRIIAGLAEAEGHHPDLHLVGWNNVTIEIWTHSVETQSNYICELHQRANMAISNPLPTPMVPGLKLSALGGLTQNDFILAAKINELNLHDLLRRKTSN

SEQ ID NO: 126714 - protein, 265 aa, Glycine max
  Coding DNA Sequence Number=SeqID_35029
  Homolog annotation: Hit_ID=Q8LEQ7; Match level="QueryCoverage=23%, HitCoverage=62%, E-value=3e-15, Identity=67%"; Hit description =Putative uncharacterized protein
  Subcellular localization annotation: CTP_CleavageSite=54; ConfidenceScore=5.30e-01
MKVSSIANFSVISSQNDDMPIGWPFGLGFLNMMRLRVGESLPAASMAPYQLHVPSTSFSSFSSSNLDTESTASFFQDNSVSLAQLIGIRPGDRGRLYFPNSLRFEERKKKLAKSSGSDGSKVQGMDMSRPNEEALDVTRPKEVQCSSNPKRESKPIALERKCLLRSAVSRAAGAANLAAGARTKPARSPFRLPKQTSISNRVFRLPVEASFCVESMLPYHSATASALLNSMLSVSRHSYGWTPEGIPSLFSLLPFSEMRHDSYKS

SEQ ID NO: 126715 - protein, 346 aa, Glycine max
  Coding DNA Sequence Number=SeqID_35030
  Gene Ontology: Mol. function=transferase activity, transferring glycosyl groups; Cellular component=cytoplasm; Biological process =carbohydrate metabolic process
  Homolog annotation: Hit_ID=A7QPS2; Match level="QueryCoverage=82%, HitCoverage=32%, E-value=1e-127, Identity=77%"; Hit description =Phosphorylase
  Pfam annotation: Domain name=Phosphorylase; Domain location=91-342; Score=-253.8; E_value=3.5e-17; Accession=PF00343.11; Description =Carbohydrate phosphorylase
MRGDKALSHSVRDRLIERWHDTHVYVKRTKPKRLYFLSLEFLMGRSLSNSVINLGIQDQYAEALSQLGFEFEVVAEQIYYLRVSLQWCYFYPLNIHVCDIHDKEGDAALGNGGLARLSACQMDSLATLDYPAWGYGLRYEYGLFRQIIVDGFQHEQPDYWLNYGNPWEIERIHVTYEVKFYGTVEEVEMNGEKHQVWVPGETVEAVAYDNPIPGYGTRNTINLRLWAAKPSNKFDLEAYNTGDYINSVVNRQRAETISNVLYPDDRNHQGKELRLKQQYFFVSASLQDIIRSDSVPLGFMEFSGYPRLDMGYSEFLGREKRKMEKECFGSVQCLQNYEESKERILF

SEQ ID NO: 126716 - protein, 517 aa, Glycine max
  Coding DNA Sequence Number=SeqID_35031
  Gene Ontology: Mol. function=transferase activity, transferring glycosyl groups; Cellular component=cytoplasm; Biological process =carbohydrate metabolic process
  Homolog annotation: Hit_ID=A7QPS2; Match level="QueryCoverage=81%, HitCoverage=48%, E-value=1e-180, Identity=74%"; Hit description =Phosphorylase
  Pfam annotation: Domain name=Phosphorylase; Domain location=1-512; Score=309.5; E_value=6.4e-90; Accession=PF00343.11; Description =Carbohydrate phosphorylase
MEELKKKIGLDYNRLSRMSIVEEGAVKMPIYHVFPWISGGFNTTAGSLSSACCRTGLKHIELGPEMQKSTSRRERLGESQPVDPEQGCAELTVSIRMANLSIVGSHAVNGVSKLHLDTLKMNTFKDFYELWPEKFQYKTNGVTQRRWIVVSNPSLCALISKWLGTEAWIRNADLLTGLRDLVDNTDFHQEWKMVKKVNKMRLAEYIETMSGVKVSLDAMFDVQVKRIHEYKRQLLNILGIIHRYDCIKNMDKNDRRKVVPRVCIIGGKAAPGYEIAKKIIKLSHAVAEKINNDTDIGDLLKLASFKSQLFICVFIPDYNVSVAELVIPGADLSQHLSRGGAGGCAGYELNMSPLGTAGHEASGTGSMKFMMNGCLLLATADGSTIEIIEEIGSDNLFLFGAKVQEVAELREKGSTLKVPLQFARVLRMVRDGYFGHKDYFESLCDTVEIGNDFYLLGPDFGSYLEAQAAADKAFVEPEKWIKMSILSVAGSGRFSSDRTIQDYAERTWKIDPCRCPL

SEQ ID NO: 126717 - protein, 521 aa, Glycine max
  Coding DNA Sequence Number=SeqID_35032
  Gene Ontology: Mol. function=calmodulin binding; Cellular component =integral to membrane; Biological process=response to biotic stimulus
  Homolog annotation: Hit_ID=A7QPR0; Match level="QueryCoverage=98%, HitCoverage=96%, E-value=1e-174, Identity=59%"; Hit description =Chromosome chr10 scaffold_138, whole genome shotgun sequence
  Pfam annotation: Domain name=Mlo; Domain location=4-483; Score=696.1; E_value=2.7e-206; Accession=PF03094.6; Description=Mlo family
MANVSETTLENTPTWAVATVCFIMIVISIFIEHLLHILARYFKRKRRKSLTEALEKIKTELMLLGFTSLLLTVSEKSIANICIPKGVGETLIPCASIAFDDAEEETKCAEQGKVSLLSREGVRELQYFIFHLAVCHVVSCILTFGLGMAKMRRWESWEGETKTLEYQFAYGNFINFITCFGSVDPRRFQLTRQTPFGKRHLNYWSNNSVMYWPVCLVRQFYRSVPKVDYFTLRHGFIMAHFSEESNFDFQKYIERALENDFGVVVGLSWWIWIFSVLYIFFNANAFYSHFWLPFIPLMVLLLVGTKLQSIITDMCLDSHDKSHMIKGTLLVRPSDHFFWFGWPKLLLHLISFILFQNSFQLAFFTWTSIRFGIRSCFHEEIENIIIRVAMVVSVQILCGYVTLPLYALVTQMGTSMRKVVFTENVIRGIQIWQDKAKKNMALRNPYSQGTSLDTSLSLETSLEASPSFRLGASLSNFMDRPLDVNKHMNVNITQGEIVSEQQESENQASNLSSFQGFNLQL

SEQ ID NO: 126718 - protein, 722 aa, Glycine max
  Coding DNA Sequence Number=SeqID_35033
  Gene Ontology: Mol. function=hydrolase activity; Cellular component =peroxisome; Biological process=proteolysis
  Homolog annotation: Hit_ID=Q0PY37; Match level="QueryCoverage=100%, HitCoverage=100%, E-value=1e-166, Identity=45%"; Hit description =Putative protease/hydrolase
MVLSDAVNFARNFAVMVRVRGPDPKGLKMRNHAFHQYRMCSSGETTLSASGVLVPDTLCDSQVATRLNGDNCEDRVLVVTVASVVEPFLSPQQRDNIPQGRPDLIAGVQIDVMTEETNEKSNRGTPCWLLAQLLSLVGILNLLDPYYAVDIPASSNCLQSLIEASLGLPEHEWEDLLDSKVSAMNKRGDFLLAVGSPFGVLSPMHFFNSISVGCIANCYPPHSSDGSLLMADIRCLPGMEGSPVFSEHACLIGVLIRPFRQKAYGAEIQLVIPWDAIVTASSGLLHKRPQNTQKGLCNQEGNLYAAGSVPFSDTDKLDVCSRNKHEHLYFGSSSPLPIEKAMTSVCLVTIGDGVWASGVLLNSQGLILTNAHLLEPWRFGKEHVNGGGYGTNSEKISSMLEGTAYVVNRVESNQVSQTSPLKMPILYPFAANEQGGYKSSPTYDNHRNIRVRLDHIKSWVWCDAKVVYVCKGPWDVALLQLESVPDDLLPITMNFSRPSTGSQAFVIGHGLFGPKHGFFPSVCSGVVAKVVEAKTPQSYLSVQPEHLHNHEHFPAMLETTAAIHPGASGGAIINSDGHMIGLVTSMMLSFLDPNLLIGAQPALSGPIVYLNARHSGGAIIPQLNFSIPSAALAPIVNFSKAMEDLSLLRILDEPNEYLSSVWALMRPSYPNPHPMHDPPQSVTDNKSKEKGSRFAKFIAERKDIFNAGKSGVISKEVIASKL

SEQ ID NO: 126719 - protein, 56 aa, Glycine max
  Coding DNA Sequence Number=SeqID_35034
MKQKVKALRERNMEAEKGRSKKSWTTCWGFSCETDKVKSLLYSLAIAHLRKSFSEK

SEQ ID NO: 126720 - protein, 627 aa, Glycine max
  Coding DNA Sequence Number=SeqID_35035
  Homolog annotation: Hit_ID=Q2HTS7; Match level="QueryCoverage=100%, HitCoverage=65%, E-value=0.0, Identity=64%"; Hit description=Cig3, related
MELEDTELKTMLESYSQMDLARRGPFRAIQVVSVLIFSLTNLIDKLGKDESENKNDGQLMQLALTAAFSLMGRFIERCLKASSLIHCPLLPSVLVFVEWCSSIHEDDKKETEKHLDRTPLWEDYELRGFVPIACSYLSLDFCGNWEHIDNFESGIELRTERIREAAIKIASSSNNWQKWITCDKLGNKFYLARSDQDHDKKETKNVESNSHSTKLEEPNQQTNKDTGEQGKWMVKDNLSSSSTNGKSSVVEEEEVILFRPLTRYNSAPSHCSISTDDKMTPKDKDNQSLLSDDCLHRASSLLMAQNPAQTQSDPWEFSILDFRSDKSFKQQESSTRESNAHTFSEAPISAGPPSLNAWVLDRGSLSHNRNNGTNGLSEHRLQPIEEIASSSLASISINKAENSVTSSMVESSNFHYSSSATYSLPVPSAPLLPDNAAWFTDAQSSLSSPLFPDNSVPKSGYPDWSSTYGPHGYDPRFPVLSSGYTPPGRMTSSEWLRWYRENYKPERTNNYMQPTHLNSPGPGNHVNVPYHDTYRFGQFDRWSNPLPSNQYTYMESPGPPPLQPGFLSAFGEHKGSVYNNFQRPTPYACGVVTDPRNEPQSLLECLKEKEWRLQPDPNVRGPTFMGN

SEQ ID NO: 126721 - protein, 106 aa, Glycine max
  Coding DNA Sequence Number=SeqID_35036
MGVATCTQHYCWGTQQTVKWRNCPSAIILPEEERHPECFRKKLLPEEFQCLPEEASSGSLPEEASSGSCVVFYCAFFLSSSVCFVSSSVCFVSSSVCCCFGGGPFS

SEQ ID NO: 126722 - protein, 900 aa, Glycine max
  Coding DNA Sequence Number=SeqID_35037
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=A7R2J6; Match level="QueryCoverage=91%, HitCoverage=89%, E-value=0.0, Identity=60%"; Hit description =Lipoxygenase
  Pfam annotation: Domain name=Lipoxygenase; Domain location=228-894; Score=962.4; E_value=1.8e-286; Accession=PF00305.10; Description =Lipoxygenase
  Pfam annotation: Domain name=PLAT; Domain location=120-216; Score =39.8; E_value=9.7e-09; Accession=PF01477.14; Description=PLATLH2 domain
  Pfam module annotation: Pfam domain module=Lipoxygenase::PLAT; Domain location=228-894::120-216
MAMVKEIMGQRMVEAFCSDVSRCSSQPNRFCIKRQKTVSILPTFSELKTMLQLPAPYSQPPFIKLDESSKRDLALNPMSVTITGTITIKNSDITDHKEMMAMMLQHFGTFKNALHERGIIVLQLVSTEIDPRTMEPKLSNPVELEWLKCYKVGAERSTYKVEFEIDSDFGFPVAITVTNKYDKEIFLEGFSIEGVVDIACNSWIQPEKVHPEERVFFSNKAYLPCHTPAGLKKLRKEELKQLRGNGKGVRRGCERVYDYDVYNDLGNPDKGQEHVRPILGTRDYPCPRRCRTGRPHATTDEKYESPINSSVESYVPRDEAFEGVRKEALDVEKLKGATRNLIPFIRTCITKCGNFKQLSDVQQIYKRKHVDKMKPENVTTTKWPLPMNMMSKIQNDVEEYFKFDTPRIINGGNCCCIKDEELGRQALAGINPLSIKRLETFPPVSDLDPSIYGAQKSALKEEHIISHLDGMPVQQAMAEKKLFMLDYHDAYLPFLNGINAREDRKAYATRTILYLTRLGTLKPIAIELSLPESKQVLTPPLDATSHWLWQIAKAHVCSNDAGVHQLVHHWLRTHACMEPFIIAAHRQLSAMHPVFKLLKPHLKHTLQINALAREALINEGGIIETDFSSGKYSTEIISAAYKDWWRFDMEALPADLIRRGLAEPDPTHPHGLRLLIEDYPYANDGLLIWFALENLVRTYVNYYYSDRIMVRSDSELQSWYSEVTNVGHADHANASWWPTLSTPSDLTSILTTLIWVASVQHSAVNFGQYPLGGYVPMRSPHMKKLLPKEDDLEYKEFLEDPEGYLLSCLPNMFETTKFLAVVNILSQHSPDEEYMGQRKDLSDWTGDPEIIKAFYEFSMDIKRIEKEIDKRNKDTTRRNRCGAGIPPYELLVASSAPGVT

SEQ ID NO: 126723 - protein, 1186 aa, Glycine max
  Coding DNA Sequence Number=SeqID_35038
  Gene Ontology: Mol. function=transferase activity, transferring glycosyl groups; Cellular component=chloroplast; Biological process =glucan biosynthetic process
  Homolog annotation: Hit_ID=A4F2M4; Match level="QueryCoverage=100%, HitCoverage=100%, E-value=0.0, Identity=76%"; Hit description=Starch synthase III
  Pfam annotation: Domain name=Glyco_transf_5; Domain location=700-923; Score=245.3; E_value=1.3e-70; Accession=PF08323.2; Description=Starch synthase catalytic domain
  Pfam annotation: Domain name=Glycos_transf_1; Domain location=966 -1164; Score=-22.3; E_value=0.025; Accession=PF00534.11; Description =Glycosyl transferases group 1
  Pfam annotation: Domain name=SSIII; Domain location=204-348; Score =245.8; E_value=9.5e-71; Accession=PF07036.2; Description=Starch synthase III
  Pfam annotation: Domain name=SSIII; Domain location=374-529; Score =285.9; E_value=7.8e-83; Accession=PF07036.2; Description=Starch synthase III
  Pfam annotation: Domain name=SSIII; Domain location=542-689; Score =275.1; E_value=1.4e-79; Accession=PF07036.2; Description=Starch synthase III
  Pfam module annotation: Pfam domain module=Glyco_transf_5::Glycos _transf_1::SSIII::SSIII::SSIII; Domain location=700-923::966 -1164::204-348::374-529::542-689
  Subcellular localization annotation: CTP_CleavageSite=79; ConfidenceScore=5.11e-01
MEMSMQLNCKTVFPYRGGYICSPCKAGWGVSFVRASADFSRKRQQKKVSVARTKGTSGKGFVPSKKNTRMKKGDTLTSVVSEVSGGDKKQTVEVNVDDTDKEGELEFSQEEKFEAVDRIDENVGDVGDLSLLDETVGELSLLDESNQATISVFDEDVEVLESWKEEFPYNGGVGIVEDSSEEGLLESAEIDENVKDTDTDGDITEEAVEESSSADDDRINEEAAGLLKLELEANQRRQEIERIAEEKLSQGIKLFVYPPVVKPDQDIELFLNKNLSTLSEEPDILIMGAFNDWKWKSFSIRLNKLHLKGDWWSCQLYVPKEAYKVDFVFFNGQNVYDNNDQKDFCIPVDGGMDALAFEDFLLEEKRKELEELARAQAERERQAEEQRRIEADRAAKEEDRARAKAEIGKMRETLPQLLKNAVKSVDNVWHIEPSEFKGKDLIRLYYNRSSGPLANANEIWIHGGHNNWKYGLSIVERLVKSVLKGGEWWYADVVVPDQALVLDWVFADGPPKKAVVYDNNRKQDFHAIVPGAIPDEQYWVEEEQLIYRKFQEERRLREDAIRAKAEKTAQMKAETKERTLKGFLLSQKHIVFTDPLDVQAGSTVTIFYNPSNTNLNGKPEVWFRCSFNRWSHRNGPLPPQRMLPAENGTHVKASFKVPLDAYMMDFVFSESEHGGVFDNKFGMDYHIPVFGSIAKEPPLHIIHIAVEMAPIAKTSFIAKAGKLLEIRIKNFYYLSCVVQKKVGGLGDVVTSLSRAVQDLNHNVDIILPKYDCLNLSNVKDFDYHKSYSWGGTEIKVWHGKVEGLSVYFLEPQNGFFQVGCVYGRGNDGERFGFFCHAALEFLLQNGFHPDIIHCHDWSSAPVAWLFKDNYAHYGLSKARVVFTIHNLEFGAHSIGKAMAYADKATTVSPTYSREIAGNPVIAPHLHKFHGIINGIDPDIWDPYNDKFIPVSYSSENVVEGKRASKETLQQRLSLKKADLPLVGIITRLTHQKGIHLIKHAIWRTLERGGQVVLLGSAPDPRIQNDFVNLANELHSAHHDRARLCLAYDEPLSHLVTYETEKPLIYAGADFILVPSIFEPCGLTQLTAMRYGSIPVVRKTGGLYDTVFDVDHDKDRAQAQGLEPNGFSFDGADTGGVDYALNRAISAWYEGRDWFNSLCKRVMEQDWSWNRPALDYLELYHAARKAE

SEQ ID NO: 126724 - protein, 291 aa, Glycine max
  Coding DNA Sequence Number=SeqID_35039
  Homolog annotation: Hit_ID=A7QZN7; Match level="QueryCoverage=93%, HitCoverage=36%, E-value=5e-42, Identity=39%"; Hit description =Chromosome chr10 scaffold_282, whole genome shotgun sequence
MEQDSTFQSMFFVAFVFQLESSMPHLNGSKEMATEWSPTLNEASNEFIMIHSRKLLEDKKLVGDHNSVVSTLLEELLQAQRSINKLKAEQKTIQKNVEHFLQNLKDDKIFLKSKEHHKIKATIGELKGKLERERRSRERMELLNTKLVHELAEANLLRKQFMTNCEKEKKERELMEEMCEELAMQIGEDKAKLTVILSESKRICEEVEEERNMMQMAELWREERVQMKLVDAQFVLEDKYNRLVQLAASLERFLISRGAELDTTELEDAELIKQEVESLNIQRVMELSFDV

SEQ ID NO: 126725 - protein, 44 aa, Glycine max
  Coding DNA Sequence Number=SeqID_35040
MNNTIHISKRNIFPVPKVLIFFSPWRLRFQSSAEEEGSETDSER

SEQ ID NO: 126726 - protein, 72 aa, Glycine max
  Coding DNA Sequence Number=SeqID_35041
MELNLRGKREIGISEFTMEKRLTIVLRNGEEGWWENVKLETVFLGEEEMLDLDIIYKTRMTCFVTPNRVDFN

SEQ ID NO: 126727 - protein, 37 aa, Glycine max
  Coding DNA Sequence Number=SeqID_35042
MVDELRFKFSQEKCPYSVFGHISLSQCLQMRIPVLNP

SEQ ID NO: 126728 - protein, 223 aa, Glycine max
  Coding DNA Sequence Number=SeqID_35043
  Gene Ontology: Mol. function=sequence-specific DNA binding; Cellular component=intracellular; Biological process=regulation of transcription, DNA-dependent
  Homolog annotation: Hit_ID=Q2VY17; Match level="QueryCoverage=99%, HitCoverage=95%, E-value=6e-44, Identity=48%"; Hit description =CONSTANS interacting protein 2b
  Pfam annotation: Domain name=CBFD_NFYB_HMF; Domain location=62-126; Score=68.7; E_value=2e-17; Accession=PF00808.14; Description=Histone- like transcription factor (CBFNF-Y) and archaeal histone
  Pfam annotation: Domain name=Histone; Domain location=56-129; Score =33.2; E_value=9.2e-07; Accession=PF00125.15; Description=Core histone H2AH2BH3H4
  Pfam module annotation: Pfam domain module=CBFD_NFYB_HMF::Histone; Domain location=62-126::56-129
MAPTILPTQTYGHSLSSSYPRLHPYDPQAMYQLRQEPLQQQLTNFWAKKRQEIEETTSFKTHSLPLARIKKIMKGEEGVRMVSAEASVVFAKACEMFMMELTIRASGSAEENQRKIIKKCDVASAISRTDVFDFLVDIVSGHNKIMEQQGFVGIPRIGTALTPTENVPYYQMPPHQSLVPGPPYGSSGMVVGMPVHYQNHPGLQTPTMGPTPNPQNSSRDSDS

SEQ ID NO: 126729 - protein, 756 aa, Glycine max
  Coding DNA Sequence Number=SeqID_35044
  Gene Ontology: Mol. function=aspartic-type endopeptidase activity; Cellular component=extracellular region; Biological process =proteolysis
  Homolog annotation: Hit_ID=Q9FSZ9; Match level="QueryCoverage=91%, HitCoverage=100%, E-value=1e-152, Identity=56%"; Hit description =Putative extracellular dermal glycoprotein
MSSSFSIHFFLLLSIALFSVCCLAASQAPTTKSHPYILPIKKDPATNLYYTSVGIGTPRHNFDLVIDLSGENLWYDCDTHYNSSSYRPIACGSKQCPEIGCVGCNGPFKPGCTNNTCPANVINQLAKFIYSGGLGEDFIFIRQNKVSGLLSSCIDTDAFPSFSDDELPLFGLPNNTKGIIGLSKSQLALPIQLASANKVPSKFSLCLPSLNNQGFTNLLVRAGEEHPQGISKFLKTTPLIVNNVSTGAISVEGVPSKEYFIDVKAVQIDGNVVNLKPSLLAIDNKGNGGTKLSTMSPFTELQTTVYKTFIRDFIKKASDRRLKRVASVAPFEACYDSTSIRNSSTGLVVPTIDLVLRGGVQWTIYGANSMVMAKKNVACLAIVDGGTEPRMSFVKASIVIGGYQLEDNLLEFDVASSKLSFSSSLLLHNATCSLGIGNPRHNIDVAIDLTGESLWYDCAINYNTLSYIPVSCDSHSCPTKSTIPCVTCHGPFKPGCTNNTCGTYNYNPLAQVTFPGDLAQDFIFISQIQVSGIRSGCTNAHKFTSNLVGGLPKGSKGMLGLARSELAVPTQLALLKKLPLKFSLCLPSSNNIGFTNLLIGPEGHEQSQDVSKYIQTTPLVVNHFDTGPLFEEGFLKKAADRRLKRVASVAPFEACFDSRSIGNSFTGFVVPTIDLVLQGGVQWTIHGANSMVMVKKNVACLAFVDGGTMATMSFFKASIVLGAHQLEENLLAFDVASSKLSFSSSLLLHNVTCSHL

SEQ ID NO: 126730 - protein, 53 aa, Glycine max
  Coding DNA Sequence Number=SeqID_35045
MDKIELFPYQGSQRLEKKASLQLGVSLVLASHTQEEALCVRRSRDEGLENGIV

SEQ ID NO: 126731 - protein, 54 aa, Glycine max
  Coding DNA Sequence Number=SeqID_35046
MKMRLLLDAEILTTGDKKSELSSLNYTKTKVALAYSPNPTKLRACEFDLDDARQ

SEQ ID NO: 126732 - protein, 369 aa, Glycine max
  Coding DNA Sequence Number=SeqID_35047
  Gene Ontology: Mol. function=transporter activity; Cellular component= mitochondrial inner membrane; Biological process=transport
  Homolog annotation: Hit_ID=O49875; Match level="QueryCoverage=100%, HitCoverage=100%, E-value=1e-171, Identity=79%"; Hit description =Adenine nucleotide translocator
  Pfam annotation: Domain name=Mito_carr; Domain location=173-269; Score=100.1; E_value=6.9e-27; Accession=PF00153.18; Description =Mitochondrial carrier protein
  Pfam annotation: Domain name=Mito_carr; Domain location=273-363; Score=83.9; E_value=5e-22; Accession=PF00153.18; Description =Mitochondrial carrier protein
  Pfam annotation: Domain name=Mito_carr; Domain location=68-165; Score= 132.6; E_value=1.1e-36; Accession=PF00153.18; Description =Mitochondrial carrier protein
  Pfam module annotation: Pfam domain module=Mito_carr::Mito_carr::Mito_ carr; Domain location=173-269::273-363::68-165
MVDQVQHPRIIEKVAGQQHLRTGLPLYHQWRSFANYSNGALQYPVMPACRAATAASHVFVAAPSEKGHFLIDFLMGGVSAAVSKTAAAPIERVKLLIQNQDEMIKAGRLSEPYKGIGDCFKRTMQEEGVVSLWRGNTANVIRYFPTQALNFAFKDYFKRLFNFRKDRDGYWKWFAGNLGSGGAAGASSLLFVYSLDYARTRLANDAKAAKKGGERQFNGLVDVYKKTLASDGVAGLYRGFNISCVGIIVYRGLYFGMYDSLKPVLLTGSLQDSFFASFGLGWLITNGAGLASYPIDTVRRRMMMTSGEAVKYKSSMDAFTQILKNEGAKSLFKGAGANILRAVAGAGVLAGYDKLQVIVFGKKYGSGGA

SEQ ID NO: 126733 - protein, 440 aa, Glycine max
  Coding DNA Sequence Number=SeqID_35048
  Gene Ontology: Mol. function=nucleotide binding; Cellular component =intracellular; Biological process=small GTPase mediated signal transduction
  Homolog annotation: Hit_ID=A9PIP7; Match level="QueryCoverage=43%, HitCoverage=94%, E-value=5e-96, Identity=88%"; Hit description =Putative uncharacterized protein
  Pfam annotation: Domain name=Arf; Domain location=240-420; Score =188.8; E_value=1.4e-53; Accession=PF00025.12; Description=ADP -ribosylation factor family
  Pfam annotation: Domain name=MMR_HSR1; Domain location=254-372; Score= 20.1; E_value=1.5e-05; Accession=PF01926.14; Description=GTPase of unknown function
  Pfam annotation: Domain name=Miro; Domain location=255-372; Score =31.0; E_value=4.3e-06; Accession=PF08477.4; Description=Miro-like protein
  Pfam annotation: Domain name=Ras; Domain location=255-422; Score= -57.7; E_value=5.2e-05; Accession=PF00071.13; Description=Ras family
  Pfam annotation: Domain name=SRPRB; Domain location=251-395; Score= -67.3; E_value=0.012; Accession=PF09439.1; Description=Signal recognition particle receptor beta su
  Pfam module annotation: Pfam domain module=Arf::MMR_HSR1::Miro::Ras::S RPRB; Domain location=240-420::254-372::255-372::255-422::251-395
MKIGVMVVDLEAQGVFVDIDVVPYLLGGLVVDDEGRATRRAGAGAGGGSNAAGSESEGREWECRRNWGWSCNRKKLSGFVVVAAAAWEGEGRKGLLKGESNLAAAVVVQGGILYGSSKKGVEVVVGFGVLLLLRETELSEAESLTIDPIPPSSDLSAATVYRTSLPSLAPVNLFNHSSFPSSISGSVTTELILSIAVVPMDCDFHSLASLSQFSGNSSLIYVSNLMVHVDSLNNTRMFSLFYGLWKYLFSKMELHVLILGIDKAGKTTLLEKMKSVYSNIEGIPPDRIIPTVGLNIGRIEVANSKLVFWDLGGQPGLRSIWEKYYEEAHAVIFVVDASCPSRFEDAKSALEKVLRHEDLQGAPLLILANKQDIPEAVSADELPQYLDLKKLDERVFMFEAVSAYDGMGIRESAEWLVEVMERSKRTEMLRARAGAMGAGP

SEQ ID NO: 126734 - protein, 64 aa, Glycine max
  Coding DNA Sequence Number=SeqID_35049
  Gene Ontology: Mol. function=tRNA isopentenyltransferase activity; Biological process=tRNA processing
  Homolog annotation: Hit_ID=Q5GFS0; Match level="QueryCoverage=100%, HitCoverage=20%, E-value=5e-23, Identity=83%"; Hit description =Isopentenyl transferase
MNISISACACKQELPLVSFQKGSLSMESLFHNRNKEKVVVIMGATGTGKTKLAIDVAKHFQPAE

SEQ ID NO: 126735 - protein, 292 aa, Glycine max
  Coding DNA Sequence Number=SeqID_35050
  Homolog annotation: Hit_ID=A7NWF1; Match level="QueryCoverage=67%, HitCoverage=86%, E-value=2e-27, Identity=49%"; Hit description =Chromosome chr5 scaffold_2, whole genome shotgun sequence
  Pfam annotation: Domain name=DUF21; Domain location=29-191; Score= -61.0; E_value=0.033; Accession=PF01595.11; Description=Domain of unknown function DUF21
MNVVSALMVTRNQLGAPEGIPFGSVWLFVYAGISFSLVIFAGIMSGLTLGLMSLGLVDLEILQSSSVILPVVQKQHQLLVTLLLCNAAAMEIVPSDMPLYDILNEFQKGSSHMAAVVRARKQNEMSENVVANIDKFSRPPSINKSTGLQRSDSRTNGSFSDNIEDEVIGVITLEDVFEELLQEEIVDETDEYVDVHKSTGSINPKIDCPKGSWVWVRAINRGQSGPQSGKEWGAMRHKKEDQKRVGGARGEAKCSQQLVAATLQEDHGGSPERCTSNLENHLNKPYNCSLEN

SEQ ID NO: 126736 - protein, 145 aa, Glycine max
  Coding DNA Sequence Number=SeqID_35051
MAFALFGTGGLEFGDGAATGRPEEQKRTAVRGSHLPELGPEAVVIGVGLSAALPGELIDFGGGGAEALNLQIELHGLLEALASLALAAAGSGAAEEGGEGEGEEEEEGEEVGEGEGGEEEGEGVEDVAEVGGEEEGAGEEDQEED

SEQ ID NO: 126737 - protein, 46 aa, Glycine max
  Coding DNA Sequence Number=SeqID_35052
MIGKWTIYKEGCDTSKLIIPENRGSTSSKGAKRRRDQEKSGEASIP

SEQ ID NO: 126738 - protein, 241 aa, Glycine max
  Coding DNA Sequence Number=SeqID_35053
  Gene Ontology: Mol. function=kinase activity; Cellular component =cytoplasm; Biological process=purine nucleotide metabolic process
  Homolog annotation: Hit_ID=A7NWE1; Match level="QueryCoverage=100%, HitCoverage=81%, E-value=5e-84, Identity=66%"; Hit description =Chromosome chr5 scaffold_2, whole genome shotgun sequence
  Pfam annotation: Domain name=Guanylate_kin; Domain location=82-187; Score=93.3; E_value=7.6e-25; Accession=PF00625.12; Description =Guanylate kinase
MGDAPRPLSVPIPTLEKAERSDLLRALEASMGSPFSSEPLSPNPNSLIIVISGPSGVGKDALIARLRDNSRLALHFVVTVTTRPRRPAEVDGKDYIFVSKEEFLGMVEREELLEYALVYGDYKGVPKQQIRECLAKGCDVVLRVDIQGAATLKKVLGKSAVFVFVAAESEMALVERLVDRKTETVESLLVRIGTAREEMKHVKNFDYVVVNAKGKLDNAVKLMESIIDAEKARVSQRTPLL

SEQ ID NO: 126739 - protein, 612 aa, Glycine max
  Coding DNA Sequence Number=SeqID_35054
  Gene Ontology: Mol. function=calcium ion binding
  Homolog annotation: Hit_ID=A7NWD9; Match level="QueryCoverage=97%, HitCoverage=93%, E-value=1e-134, Identity=60%"; Hit description =Chromosome chr5 scaffold_2, whole genome shotgun sequence
  Pfam annotation: Domain name=Abhydrolase_1; Domain location=68-370; Score=-15.6; E_value=0.096; Accession=PF00561.11; Description =alphabeta hydrolase fold
MVSTEGRGGIVKILLIKNSRGDVLQCSHYMPIVSPDGKPLPCVIYCHGNSGCRVDASEAALILLPSNITVFTLDFSGSGISGGEHVTLGWNECFIIVKVAYWTLKQQEEPKKKKSIAGIEVDECSDIQKWEFLKVRVAPIKKKLTKAYPGWFDHKDDLRAVVNYLRADGNVSLIGLWGRSMGAVTSLMYGAEDPSIAGMVLDSPFSDLVDLMMELVDTYRVRLPKFTVKFAIQYMRKTIQKKAKFDITDLNTVKVAKSCFVPALVGHAIDDDFIRPHHSDRILEAYMGDKNIIKFEGDHNSSRPQYYFDSVNIFFHNVLQPPEDELGESFFDIMNDYFETSTSSTVEDIKHVRSKKPMSRMEVPSHISSKDAHLDCEAQKCDDLSSSSSTMISFELSNGRLYSPLVPTDLDDDHFVEFQLDDFTGCPSSAKKEQKMFTEAVIDSLKDREIRIPEVEQPPVRSASSTMSIEPSDKNDSHASNSHEISKPVETESSLLNHSDKTISTSSDALEPLKTESNSISVIPSPVTSLSSSKIPSSPLPPLDTSSVTESGDTESASTGNDSSASLQSSSDTDISHNTKATLTVIKNPTGHVLNGLLRRWDFKFFRNSQNR

SEQ ID NO: 126740 - protein, 688 aa, Glycine max
  Coding DNA Sequence Number=SeqID_35055
  Gene Ontology: Mol. function=glutamate-ammonia ligase activity; Cellular component=chloroplast; Biological process=nitrogen compound metabolic process
  Homolog annotation: Hit_ID=P08281; Match level="QueryCoverage=60%, HitCoverage=96%, E-value=0.0, Identity=87%"; Hit description =Glutamine synthetase leaf isozyme, chloroplast precursor
  Pfam annotation: Domain name=Gln-synt_C; Domain location=163-412; Score=283.0; E_value=6e-82; Accession=PF00120.15; Description =Glutamine synthetase, catalytic domain
  Pfam annotation: Domain name=Gln-synt_N; Domain location=77-157; Score=146.7; E_value=6.2e-41; Accession=PF03951.10; Description =Glutamine synthetase, beta-Grasp domain
  Pfam module annotation: Pfam domain module=Gln-synt_C::Gln-synt_N; Domain location=163-412::77-157
  Subcellular localization annotation: CTP_CleavageSite=44; ConfidenceScore=5.64e-01
MAQILAPSTQWQMRISKSSPNATPITSNMWSSLLWKQNKKVSPTSSAKFRVLAIKSDNSTINRLEGLLNLDITPFTDKIIAEYIWIGGTGIDVRSKSRTISKPVEDPSELPKWNYDGSSTGQAPGDDSEVILYPQAIFKDPFRGGNNILVICDSYTPQGEPIPTNKRHRAAEIFSNPKVQAEVPWYGIEQEYTLLQTNVKWPLGWPVGGYPGPQGPYYCSAGADKSFGRDISDAHYKACLYAGINISGTNGEVMPGQWEYQVGPSVGIEAGDHIWASRYILERITEQAGVVLSLDPKPIEGDWNGAGCHTNYSMREDGGFEVIKKAILNLSLRHKDHISAYGEGNERRLTGKHETASINTFSWGVANRGCSIRVGRDTEKNGKGYLEDRRPASNMDPYVVTSLLAETTLLWEPTLEAEALAAQKLALKDPTHLMNCNHAATTFLSLALPPPPSSALFPKRPSAILRPYQTLLSSNTRLGLRVRASNGDSNVQPANWSQWIPAGSFAADKVFRLIPGATASPIGQFVPSPATFLHSIDPRVKLDQLGRVYLLSELLFITSGLGSDGVPAIVQLRTPPPAMMGLPNLPVSLTGYAYTIMKLGPLTFTRKGLSVASTVACLTFTVFQSASPCLTATSPEQLAFALRWFMLPLKYIGVSVSEIVLTLLLSLRFISLVFDEGGDVVLIDMADH

SEQ ID NO: 126741 - protein, 67 aa, Glycine max
  Coding DNA Sequence Number=SeqID_35056
MNDVNRILVGASESLNEQCESSPSLQWHESSCIFQFEGWTAISSTTLFSYSGIEKLQCGGACYCNSR

SEQ ID NO: 126742 - protein, 171 aa, Glycine max
  Coding DNA Sequence Number=SeqID_35057
  Homolog annotation: Hit_ID=Q000R3; Match level="QueryCoverage=60%, HitCoverage=19%, E-value=3e-09, Identity=33%"; Hit description=RING -7 protein
  Pfam annotation: Domain name=PHD; Domain location=118-165; Score=0.2; E_value=0.013; Accession=PF00628.20; Description=PHD-finger
  Pfam annotation: Domain name=zf-C3HC4; Domain location=119-162; Score= 39.6; E_value=1.1e-08; Accession=PF00097.16; Description=Zinc finger, C3HC4 type (RING finger)
  Pfam module annotation: Pfam domain module=PHD::zf-C3HC4; Domain location=118-165::119-162
MGRQCRAEALWPLLFLTFMFIIVLITIDHASTGIFIFLGSILGLFLWYWLGSLVLDRDNWDNSHDVDDERTREFQNIESSNASDPQNSLPLTRTRIVIASVRARREPWQDGDDESQRDCPICMEDFKNGELIQPFGVCVHEFHLSCVNSWLLGGGKTTCPVCRKDLSISVD

SEQ ID NO: 126743 - protein, 1443 aa, Glycine max
  Coding DNA Sequence Number=SeqID_35058
  Gene Ontology: Mol. function=DNA binding; Cellular component =cytoplasm; Biological process=protein import into nucleus
  Homolog annotation: Hit_ID=A7NWC6; Match level="QueryCoverage=88%, HitCoverage=99%, E-value=0.0, Identity=52%"; Hit description =Chromosome chr5 scaffold_2, whole genome shotgun sequence
  Pfam annotation: Domain name=SAC3_GANP; Domain location=333-583; Score=20.8; E_value=2.4e-05; Accession=PF03399.7; Description =SAC3GANP family
MVKCLSRISRFPNPERTRSPPISYSDLDTDTPERPSPVTTFIASRDSATGVTARISRFPNPEKTRSPPISYADLDIDTPERPSPVTTFIASRDTATGVTTRISRFPNPERTRSPPISYADVEALRNSDQTVLRNKPSLSPPRLGSTSNVPRTVPHSQIHQKSFPSNVSEATVSKPISSTAPKRSRSPPPSFAANVTLEGNSISSEDNSEREMLAKAKRLARFKVELSKSEQNNDDIPNQTAFANRHEQSVLEQKYVRGNLMDSARNFTNGLAVSDNEGLETSNLIIGLCPDMCPESERGERERKGDLDQYERADGDRNVTSRLLAVKKYTRTAEREAILIRPMPILQKTIDYLLTLLDQPYDERFLGVYNFLWDRMRAIRMDLRMQHIFNQRAITMLEQMIKLHIIAMHELCEYTKGEGFSEGFDAHLNIEQMNKTSVDLFQMYDDHRKKGINIPTEKEFRGYYALLKLDKHPGYKVEPAELSLEIAKMTPEIRQTPEVLFSRSVARACRTAVKLCLGDLLVMSSNPETASLHMQGLHLIRNPNLYVLCYFYKLRTQALASLHSGLQNSQGLPVAHVANWLAMEDEGIEGLLEYHGFLLKTFEEPYMVKEGPFLNVDVDFSTKCSKLVLKKRSGRILEDVSPSIQAESPRVETVKEIQMRKVYKHEPQVVSAVENDTSVQILDEEIPDAEAIFSPKDSKSGKAFKDVQDNRKDHNMSTTSPSLLSFPFPNIIPEPQLPRIDVLKDTNSDLIARGSPKRNLPSNVDGRPLEIVPKAAPPESSLGNSFFVPPPVARGISKDESLIIHQEHHDEIDEVRENCQDEEIAEAKLKLFLRLWRRRASKLRRLREERQLASNAALNSMPLGPPIQHYINRPGNFNKFDIDIAMRERYENQEKSWSRLNVSNIVADTLGRRNPDAKCLCWKIILCSQMNSGYEMGAAGTWLTSKFMPSSDEDAVISSPGLVIWRKWISSQSGINPTCYLSVVRDTAFGSLDEAVSGAGAVMFLVSESISWELQRSHLHNLLMSIPSGACLPLLILCSSYDERFSSAIINELGLQSIDKLKISSFLLVFLSENQQQMEHLGGFFSDTRLREGLQWLAGESPLQPNLGCVKIRELVHAHLNSFSEMLDIAINSNVGPNDYVSLFNEALDRSTKEIIATANSNPTGWPCPEIGLLDKFCDEDRVVKMCLPTLGWSSSVKTEPTICALQNCKLPNFPDDISWLARGSKVGHEIESHRIQLENCLIQYLAHTSKTMGISLATKEARVTMQSCARLELRGSSYHVVPHWGMIFRRIFNWRLMGLSSREVSTAYIAECHHVALPNVSSETWLSYYPDASLDEIISVSCNSPLPVNDQLRPDALQSPPHRDSNDVFHETVNVMYTESNLPIDKLPSMDTTGTYGLYSANSNSGALTNGKPTKEADKLSKLLEQCNLLQDGIDKKLFLYF

SEQ ID NO: 126744 - protein, 111 aa, Glycine max
  Coding DNA Sequence Number=SeqID_35059
MEKKGATVVVEALRRRFYGGQSWDSLKKESLFTMDFVTHCPEALHYGKVKISLSSTLQNFPPATLFGTYSAAWCQIGGDEGCDGDAEGLEGDGLGFELVEEERVQEIAHRI

SEQ ID NO: 126745 - protein, 137 aa, Glycine max
  Coding DNA Sequence Number=SeqID_35060
  Subcellular localization annotation: CTP_CleavageSite=74; ConfidenceScore=5.20e-01
MGTEVLRPQDCFTQRIGVPPPGFSRRRTYGTHHNNKNNNVNNYFRGNRKPTTRPEQRKRVVDKRPSLDDSRFSSLEMEKARTRPGYGPEADPDRGFQVRARDLRRIRVRGVAVAERAALAVFFEEAAGGGGCRLCDP

SEQ ID NO: 126746 - protein, 495 aa, Glycine max
  Coding DNA Sequence Number=SeqID_35061
  Gene Ontology: Mol. function=hydrolase activity, acting on glycosyl bonds; Biological process=metabolic process
  Homolog annotation: Hit_ID=A7NWB1; Match level="QueryCoverage=100%, HitCoverage=87%, E-value=0.0, Identity=52%"; Hit description =Chromosome chr5 scaffold_2, whole genome shotgun sequence
  Pfam annotation: Domain name=IU_nuc_hydro; Domain location=23-378; Score=-36.6; E_value=3.3e-07; Accession=PF01156.10; Description =Inosine-uridine preferring nucleoside hydrolase
MFPMRVWVAVVFIMLVTTVAAKPRRILLDTDVDLDDVFALLYLLKLNRSEFQLEGVTINANAWTNVGHAVNQVYDILYMMGRDDIAVGMGGEGGILPDGTILPNVGGYLSIIEQGMTTTGGCRYRQAIPIGHRGILDIDTIYGIRKAFLPQGIRKYTPLGQPTAQQVLIDKISAGPITLIVIGVQTNIAIFLMNNPHLKKNVQHIYIMGGAVRSTDPTSCCPKNASFSCIPGQCGDRGNVFTNYEANPYAEFNIFGDPFAAYQVIHSGIPVTLVPLDATNTIPINEEFFNEFEKSQDTYEAQYCFKSLKMAKMARDKLDNQFYTSYFMWDSFASGVAVSSMRNSNKKNKRENEFAHMEYMNITVITSNKPYGISDGSNPFFDGLKVPKFNLKKGGVHSGHVQQGLRDKFCFVKNGKGRCQDGYTAEVDGPDSVKVLVATKAKPNRDVRSKLDKEYFKSFLNVLKQPQHAGRFNFTTQFPYYEEVTYMPDFQNKTL

SEQ ID NO: 126747 - protein, 471 aa, Glycine max
  Coding DNA Sequence Number=SeqID_35062
  Gene Ontology: Mol. function=sugar:hydrogen symporter activity; Cellular component=integral to membrane; Biological process =carbohydrate transport
  Homolog annotation: Hit_ID=A7NWA9; Match level="QueryCoverage=90%, HitCoverage=99%, E-value=1e-174, Identity=68%"; Hit description =Chromosome chr5 scaffold_2, whole genome shotgun sequence
  Pfam annotation: Domain name=MFS_1; Domain location=50-421; Score =49.5; E_value=1.1e-11; Accession=PF07690.7; Description=Major Facilitator Superfamily
  Pfam annotation: Domain name=Sugar_tr; Domain location=45-469; Score =251.2; E_value=2.2e-72; Accession=PF00083.15; Description=Sugar (and other) transporter
  Pfam module annotation: Pfam domain module=MFS_1::Sugar_tr; Domain location=50-421::45-469
MAIEQHKDVESGYLQEPFIQPEEVACKEVGSDKSVENGSIGMVLLSTLVAVCGSFTFGNCVGYSSPTQAAIREDLSLSLAEFSMFGSLVTIGAMLGAITSGRITDFIGRKGAMRISTGFCITGWLAVFFSKGSYSLDLGRFFTGYGIGLISYVVPVYIAEIAPKNLRGGLATTNQLLIVTGASVSFLLGSVIHWRKLALAERYNCWLGLNFEGLVPCICLLIGLCFIPESPRWLAKVGREKEFQLALRRLRGKDVDISDEAAEILDSIETLRSLPKIKLLDLFQSKHVRSVVIGVGLMVCQQFVGINGIGFYTAETFIAAGLSSGKAGTIAYACLQVPFTVLGAILMDKSGRRPLMMDQSLMLECAPIFAVAGVLIYIAAYSIGVGPVPWVIMSEIFPIHVKGIAGSLVVLANWLGAWIVSYTFNSLMSWSSPGTLFLYAGSSLLTILFVTKLVPETKGKTLEEIQAWISP

SEQ ID NO: 126748 - protein, 411 aa, Glycine max
  Coding DNA Sequence Number=SeqID_35063
  Gene Ontology: Mol. function=metal ion binding; Cellular component =nucleus; Biological process=regulation of transcription, DNA -dependent
  Homolog annotation: Hit_ID=A7NWA8; Match level="QueryCoverage=87%, HitCoverage=48%, E-value=1e-121, Identity=59%"; Hit description =Chromosome chr5 scaffold_2, whole genome shotgun sequence
  Pfam annotation: Domain name=SBP; Domain location=113-191; Score =157.9; E_value=2.8e-44; Accession=PF03110.5; Description=SBP domain
  Pfam annotation: Domain name=zf-NADH-PPase; Domain location=131-163; Score=14.7; E_value=0.0049; Accession=PF09297.2; Description=NADH pyrophosphatase zinc ribbon doma
  Pfam module annotation: Pfam domain module=SBP::zf-NADH-PPase; Domain location=113-191::131-163
MEPLSLPPLPVMDDAEDPSSIWDFSYLLDFDLDDQDIIINNNNSLPLPLNDHPAPSEIPQNDRVRKRDPRLTCSNFLAGRVPCACPELDAILEDEGLPGKKRARTARASASARCQVPACEVDISELKGYHRRHRVCLRCANAATVMLNGEAKRYCQQCGKFHVLSDFDEGKRSCRRKLERHNTRRRRKPTADSGGATHSELLQPVAENEENNYDVEAGKDCSNLSTDINDVGVSLDLEDEPAPIPSSAPEAQNINSDSVVSLAVSGETRVNSGNTSNSPSYCDNKSAYSSMIFQWLASMPVELEGYIRPGCTILTIFIAMPNIMWINLLKDPLEYVHDIVAPGKMLSGRGTALVHLNDMIFRVMKDGTSVTNVKVNMHAPKLHYVHPTYFEAGKPMEFVACGSNLLQPKFR

SEQ ID NO: 126749 - protein, 693 aa, Glycine max
  Coding DNA Sequence Number=SeqID_35064
  Homolog annotation: Hit_ID=A7PUF8; Match level="QueryCoverage=98%, HitCoverage=97%, E-value=1e-155, Identity=42%"; Hit description =Chromosome chr7 scaffold_31, whole genome shotgun sequence
  Pfam annotation: Domain name=Ank; Domain location=112-145; Score=4.7; E_value=6.9; Accession=PF00023.21; Description=Ankyrin repeat
  Pfam annotation: Domain name=Ank; Domain location=385-421; Score=5.3; E_value=5.6; Accession=PF00023.21; Description=Ankyrin repeat
  Pfam annotation: Domain name=Ank; Domain location=39-74; Score=1.4; E_ value=21; Accession=PF00023.21; Description=Ankyrin repeat
  Pfam annotation: Domain name=Ank; Domain location=78-108; Score=10.3; E_value=1.1; Accession=PF00023.21; Description=Ankyrin repeat
  Pfam module annotation: Pfam domain module=Ank::Ank::Ank::Ank; Domain location=112-145::385-421::39-74::78-108
MAEIDVESLFNYAVKGQWREALDAYNKNPETLEAKITKVEDTVLHVAVHVGQTCFVKSVLDNIDKEVSLNILCMQNSKGNTPLHLSAQLGNVELCHNMAKRDPKLVCFRNVEGETPLFLAAVHGKREAFFCLHENQQRRRDDEEDGSLLVRKSNGDTILHSTVVSEYFGLALQIIELYPNLVNSVNQDGLSPLQILAAKPNCFKSSTRMELLQSIIYKCSIVDEIEETYDIRCNEADTTHHYPMNYETCATFLSLLKSTSIGKDDNAASNDEENNVSRKSEEEQAKKLEKKRYLFPPNWGATIRFLTHMMKILLIICGFGASWIGKIQRKKVKHILAKQVMNELIQRTCSSSLYKHDHTGTSNINSSTSSNNQSKEKGGFQKIRRTDSPILIAAKMGVAEMVEKILETDPVAIHDVDADNKNVVLLAIENRQPHVYSLLNERSMIKETAFRQVDNQGNSALHLAATYRSYKPWRVPGAALQMQWEYKWYKLVKNSMPPNFYERYNENGQTAKQVFISTHERLTKEGGKWLSKTSESCSLVAALVATVAFTTSTAVPGGPNQNTGYPLFQGRLAFNIFAVASLVALCSSVTALVLFLSILTSRFQEKDFAMDLPRKLLLGLTTLFTSIASVLVSFCAGHFFIVEDELKFAVYPIYVATCLPVSFFAFVQLPLYFDLSLAMIRKVPQRSYKSHHH

SEQ ID NO: 126750 - protein, 303 aa, Glycine max
  Coding DNA Sequence Number=SeqID_35065
  Gene Ontology: Mol. function=catalytic activity; Biological process =metabolic process
  Homolog annotation: Hit_ID=A7NW86; Match level="QueryCoverage=92%, HitCoverage=97%, E-value=1e-105, Identity=67%"; Hit description =Chromosome chr5 scaffold_2, whole genome shotgun sequence
MATHLQVSEGAPTEAFDPSPSLAIGEYDLLIVGPGILGRLVAHNWRQEYPGCKVFGQTATTNHHQELTEIGINPSLKWTKASSFKFPYVIFCAPPYQSPDYLGDLRLAASCWNGEGALLFTSSSAPYDCNDNGLCHEDNPVVPMGRSPRTDVLLKAEKIVLEFGGSVLRLSGLYISSSEFSLLGFQLFIHLGGAHAYWLDKGIVESRPDHILNLIHYEDAASLSVAILKKQFHGRIFLGCDNHPLSRQEVMDLVYKSGKFSKKFEKFTGTDDPLGKRLNNSRTCQEVGWQPKYSSFAHFLETI

SEQ ID NO: 126751 - protein, 341 aa, Glycine max
  Coding DNA Sequence Number=SeqID_35066
  Gene Ontology: Mol. function=triacylglycerol lipase activity; Cellular component=extracellular region; Biological process=lipid metabolic process
  Homolog annotation: Hit_ID=A9P9L1; Match level="QueryCoverage=93%, HitCoverage=92%, E-value=1e-127, Identity=66%"; Hit description =Putative uncharacterized protein
  Pfam annotation: Domain name=Lipase_3; Domain location=85-225; Score =153.7; E_value=5e-43; Accession=PF01764.16; Description=Lipase (class 3)
MGKTRWLIILVTCLCLLSFSDGRELKVRHKKQHYQYNHTVATILVEYASAVYLSDLTELFTWTCSRCNGLTKAFVGVADDPHAIIIAFRGTNEHSLQNWIEDLYWKQHDINYPGMDDAMVHRGFYTAYHNTTIRPAILDAVERAKKFYGDIEIIATGHSMGGAMASFCGLDLTVNQNEKNVQVMTFGQPRIGNAAFASLYTKLVPNTIRVTNDHDIVPHLPPYYYYLPQKTYRHFPREVWLYNIGLGSLVYSVEKICDESGEDPNCSRSVTGNSIADHLVYYGVDMGSDEPSSCRIVMDSYVQNTNIKDSRGNLILSRDPATPLIKLSGEGDNQENPINVD

SEQ ID NO: 126752 - protein, 227 aa, Glycine max
  Coding DNA Sequence Number=SeqID_35067
  Gene Ontology: Mol. function=nucleotide binding; Cellular component =mitochondrion; Biological process=response to cold
  Homolog annotation: Hit_ID=A7NW61; Match level="QueryCoverage=63%, HitCoverage=79%, E-value=4e-21, Identity=39%"; Hit description =Chromosome chr5 scaffold_2, whole genome shotgun sequence
MAPLACLRLPTRIRLRTSHDPDSILSLFKSHGFSDSQIRRIIQTYPYFLSYNSRKIILPKLNFLLSKGASTPDLIRIITKNPKILRLSLYNSITPRYDFIKRFMLSDDSTLRSVKVCPCIMLSKNPLLNIEFLLHNGVPESKVVMLLRYWPPLSLPMPPLSRTRSRRLWNWASRPAKRCLVKDVNWASAFLVSDKIFLQKFVVSFEKEADRLLKLYEEKMMFLDNTH

SEQ ID NO: 126753 - protein, 198 aa, Glycine max
  Coding DNA Sequence Number=SeqID_35068
  Gene Ontology: Mol. function=structural constituent of ribosome; Cellular component=ribonucleoprotein complex; Biological process =translation
  Homolog annotation: Hit_ID=P51418; Match level="QueryCoverage=90%, HitCoverage=98%, E-value=7e-85, Identity=86%"; Hit description=60S ribosomal protein L18a-2
  Pfam annotation: Domain name=Ribosomal_L18ae; Domain location=23-198; Score=400.0; E_value=3.6e-117; Accession=PF01775.8; Description =Ribosomal L18ae protein family
MVTFRVRKIHAILCLISSSFDYDFYEVVVGRALPTEADQHPKIYRMKLWATNEVRAKSKFWYFLRKLKKVKKSNGQVLAINELITIFEKNPTKIKNYGIWLRYQSRTGYHNMYKEYRDTTLNGSVEAMYNEMASRHRVRSPCIQIIKTATIPAKLCKRESTKQFHNSKIKFPLVFQKVRPPTRKLKTTYKAKKPNLFM

SEQ ID NO: 126754 - protein, 39 aa, Glycine max
  Coding DNA Sequence Number=SeqID_35069
MVVALIGGSRDNGNGWLIWFMTRGAGRRWLRNVMVHNCT

SEQ ID NO: 126755 - protein, 257 aa, Glycine max
  Coding DNA Sequence Number=SeqID_35070
  Gene Ontology: Mol. function=phospho-N-acetylmuramoyl-pentapeptide -transferase activity; Cellular component=integral to membrane; Biological process=peptidoglycan biosynthetic process
  Homolog annotation: Hit_ID=O49730; Match level="QueryCoverage=31%, HitCoverage=25%, E-value=1e-12, Identity=51%"; Hit description =Phospho-N-acetylmuramoyl-pentapeptide-transferase homolog
  Subcellular localization annotation: CTP_CleavageSite=29; ConfidenceScore=5.10e-01
MPSHSCILNHHRHRSLPLPLPLHLSRRKRLSLPPTPSLIYSPSSRFDCATLELHPSIIPQNECCFPRNVAPTRAFDDFHCGVTLTVRNSTRYSVEVLDALKDSFDIPMLDYWDADDNSSAYMLSSSDGEDSDGEIFLTPVNDLDLPSVSASNNDALTVAAHRFANLGRGRKKSRQTTPTLGGLLFIPVGVVVAHVFAGSSSIEVSGAAGATIGFAAVGLLSDILSLTKNHWRGLPALTEVLLEGLFGRKEVGEKLGG

SEQ ID NO: 126756 - protein, 757 aa, Glycine max
  Coding DNA Sequence Number=SeqID_35071
  Gene Ontology: Mol. function=voltage-gated potassium channel activity; Cellular component=integral to membrane; Biological process=potassium ion transport
  Homolog annotation: Hit_ID=Q93YI7; Match level="QueryCoverage=99%, HitCoverage=98%, E-value=0.0, Identity=60%"; Hit description=Inward rectifying potassium channel
  Pfam annotation: Domain name=Ion_trans; Domain location=95-275; Score= 82.3; E_value=1.6e-21; Accession=PF00520.22; Description=Ion transport protein
  Pfam annotation: Domain name=Ion_trans_2; Domain location=184-281; Score=50.1; E_value=7.8e-12; Accession=PF07885.7; Description=Ion channel
  Pfam annotation: Domain name=cNMP_binding; Domain location=375-464; Score=55.6; E_value=1.7e-13; Accession=PF00027.20; Description =Cyclic nucleotide-binding domain
  Pfam module annotation: Pfam domain module=Ion_trans::Ion_trans _2::cNMP_binding; Domain location=95-275::184-281::375-464
MSVSCVKNFFQRFWQDEFQTGNIPHGSFLANDDLLPSLGARINQETRLRRYIISPFHPRYRAWELVLVVLVIYSAWICPFEFAFLPYKENALFIADNIVNGFFAIDIVLTFFVAYLDRHSYLLVDDPKKIAISFLFNHSSELGFKVLNMFRLWRLRRVSSLFARLEKDIRFNYFWTRCTKLIAVTLFTVHCAGCFNYLIADRYPDSKRTWIGAVYPNFKEESLWDRYVTAIYWSIVTLTTTGYGDLHAENTREMLFDIAYMLFNLGLTSYIIGNMTNLVVHWTSRTRNFRDTVKAASEFASRNHLPHRIQDQMLSHICLRFKTEGLKQQETLNDLPKAIRSSIAHHLFFPVVQKVYLFQGVSHDFLFQLVSDMEAEYFPPKEDVILQNESSTELYVLVSGVVDLVRYIDGHDHVHGKAAAVDAFGEIGVLYHIPQPFTVRTTELSQILRINKTSLMNVLHANPGDAQIIMDNLLMRLKGREGFGFEYPCTDSGRFPHEVLQGGNTRGGPSHECTNNSLEHSLMHEGECIYIGNSETSLHKGTNDDHLVSKHNMIPEHGRRDIHAPANKGNLDIVEILLERDAYPIPNSLGMTQKAQVKRPKNKSICAQKMSCENEKLDEFRIQIAEPKILDLDRNGSTRNRRQDGIRSIKFPLEKTNTNSNSRNSNCPSDRESARLTKKRVTIHLLHSGSTSRGQHGKLIILPDSLEELLQIAGDKFGGFNPTKVINTENAEIDDINVIRDGDHLFLQCSNNEDLSS

SEQ ID NO: 126757 - protein, 59 aa, Glycine max
  Coding DNA Sequence Number=SeqID_35072
MGSGDGKREFWDGEVSASVSLKTVGLAEGTSSSHGKSVTLGDGVGSVYERVQDLVTLGG

SEQ ID NO: 126758 - protein, 190 aa, Glycine max
  Coding DNA Sequence Number=SeqID_35073
  Homolog annotation: Hit_ID=A7Q150; Match level="QueryCoverage=66%, HitCoverage=40%, E-value=2e-52, Identity=74%"; Hit description =Chromosome chr10 scaffold_43, whole genome shotgun sequence
  Pfam annotation: Domain name=DUF1365; Domain location=50-189; Score =77.5; E_value=4.5e-20; Accession=PF07103.2; Description=Protein of unknown function (DUF1365)
MEIFYLLCSIVSTSLTSLLLSLVLPFHTLLQRWNSSRAASSFSDDEAEPISLYEGTVWHQRRHPVNHSFQYQVRYALIDLDRAPHAPHDHLSLDEARQITDTNGPILLLTIPPSVGYEQNPLSVYYCYAVEGSTKRLKKCIAEVTNTPWGERVSFVFNPHSDLVAKALHVSPFMLEMMLPVEVWEVPEKD

SEQ ID NO: 126759 - protein, 195 aa, Glycine max
  Coding DNA Sequence Number=SeqID_35074
  Homolog annotation: Hit_ID=A7PQM0; Match level="QueryCoverage=72%, HitCoverage=51%, E-value=4e-46, Identity=63%"; Hit description =Chromosome chr6 scaffold_25, whole genome shotgun sequence
  Pfam annotation: Domain name=ATP-synt_10; Domain location=21-194; Score=-31.8; E_value=4.9e-05; Accession=PF05176.5; Description=ATP10 protein
MEAVKMVGLRRLIRQRSSLRDSLAEKVHSPVPSQHLARLTPKRFFDLHQLGNKEAIEKERARLADEMTRGYFADMAEFKKHAGKIAVANKLIIPAMVATKFPDFEVSFTDGKTMKLPIRVSDRAVDSDKSSVPKASLVCLSFRASSQEMINSWSVPFTEAFRKSNDVHLYQHIAVISLPKCLASCFGISEEKDDE

SEQ ID NO: 126760 - protein, 69 aa, Glycine max
  Coding DNA Sequence Number=SeqID_35075
MELGIGSLQALKVCKLEGHISKFKDREVAMMTLTLDLYPLPTPPQVSSVGKLRAENLLIRARKWFRSSN

SEQ ID NO: 126761 - protein, 156 aa, Glycine max
  Coding DNA Sequence Number=SeqID_35076
  Gene Ontology: Mol. function=molecular_function; Cellular component =cytoplasm; Biological process=protein modification process
  Homolog annotation: Hit_ID=A3A993; Match level="QueryCoverage=45%, HitCoverage=28%, E-value=3e-25, Identity=81%"; Hit description =Putative uncharacterized protein
MIQALPWEAQWFTMWEAASAENGDGVKNAMVKGLRSSMVKTEESKQGVIRVAKMIEVVLNDRLGKKVRVKCNDDDTIGDLKKLVAAQTGTRADKIRIQKWYTIYKDHITLRITRSMTAWVSNSTTTKHNKVCFMRNILCAGNGISAKCNSDLRKFP

SEQ ID NO: 126762 - protein, 191 aa, Glycine max
  Coding DNA Sequence Number=SeqID_35077
  Gene Ontology: Mol. function=protein binding; Biological process =protein modification process
  Homolog annotation: Hit_ID=A7Q1A1; Match level="QueryCoverage=61%, HitCoverage=45%, E-value=3e-38, Identity=67%"; Hit description =Chromosome chr10 scaffold_43, whole genome shotgun sequence
  Pfam annotation: Domain name=ubiquitin; Domain location=55-123; Score= 16.1; E_value=0.0064; Accession=PF00240.14; Description=Ubiquitin family
MMKKKPSARENSSSSSSTAAREEESEWEMRPGGMLVQKRTANTDAAVTRNLRLRIAYGALRYEICVSSIATFGEVKKVLCGETGLEVDEQKLVYRGRERENGEYLDVCGVKDRSKVVLIQDPSSIERRFIQMRINSKIQTAHRAINNVAVQLDQLADQLAKALFTRYCFKTDKETLLKVSNCLILNHDRNI

SEQ ID NO: 126763 - protein, 874 aa, Glycine max
  Coding DNA Sequence Number=SeqID_35078
  Gene Ontology: Mol. function=protein dimerization activity; Cellular component=nucleus; Biological process=regulation of transcription, DNA-dependent
  Homolog annotation: Hit_ID=Q6L8U1; Match level="QueryCoverage=100%, HitCoverage=100%, E-value=0.0, Identity=64%"; Hit description=Auxin response factor 3
  Pfam annotation: Domain name=AUX_IAA; Domain location=667-833; Score=- 107.7; E_value=0.093; Accession=PF02309.7; Description=AUXIAA family
  Pfam annotation: Domain name=Auxin_resp; Domain location=232-315; Score=195.0; E_value=1.9e-55; Accession=PF06507.4; Description=Auxin response factor
  Pfam annotation: Domain name=B3; Domain location=105-210; Score=63.0; E_value=1e-15; Accession=PF02362.12; Description=B3 DNA binding domain
  Pfam module annotation: Pfam domain module=AUX_IAA::Auxin_resp::B3; Domain location=667-833::232-315::105-210
MRLSSAGFSPPPQEGENRVLDSELWHACAGPLVSLPAVGSRVVYFPQGHSEQVAVSTNKEVDAHIPNYPSLPPQLICQLHNMTMHADAETDEVYAQMTLQPLNPVLTKAVFAARAKGGIPASGAGHPKAAEKVFPPLDFSQQPPAQELIARDLHGNEWKFRHIFRGQPKRHLLTTGWSVFVSAKRLVAGDSVLFIWQNQLLLGIRRANRPQTVMPSSVLSSDSMHLGLLAAAAHAAATNSRFTIFYNPRASPSEFVIPLAKYVKAVYHTRVSVGMRFRMLFETEESSVRRYMGTITGISDLDPVRWQNSHWRSVKVGWDESTAGDRQPRVSLWEIEPLTTFPMYPSPFPLRLKRPWPPGLPSFHGMKDDDFGPNSPLLWLRDPDRGLPSLNFQGIGINPWMQPRFDPTMLNMQTDMYQAAAVQDMRSLDPSKQHSASLLPFQQPQNFPNRTAALMQAQMLQQSQPQQIFGNTQENQHSPQSQAHLQQHLQHQHSFNSQHHHHHQQQQQRQQHQVVDNQQISSAVSTMSQFVSAPQPQSPPMQVISSMCQQQNFSDSNGNTVTTIVSPLHSILGSFPQDETSHLLNLPRTSSWIPVQNSSGWPSKRVAVDPLLSSGASQCVLPQVEQLGQPQSTMSQNAISLPPFPGRECSIDQEGSNDPQNHLLFGVNIEPSSLLMPNGMSSLKGVCGNNGSSTLPYQSSNYLNTTTRTDSSLNHGMTPNIGDSGFLQCLEEAGQGNPLNKTFVKVYKSGSFGRSLDITKFSSYHELRGELARMFGLEGELEDPVRSGWQLVFVDRENDVLLLGDGPWPEFVNSVWCIKILSPQEVQQMGNNGLELLNSFPIQRLSNGICDDYVSRQDPRNLGTGITTVGSLDY

SEQ ID NO: 126764 - protein, 117 aa, Glycine max
  Coding DNA Sequence Number=SeqID_35079
MALAMVMHSFCPHDNCVPLSPIAIARAMLKDLKSFCLMRKLVHLMLSQSAYTIQEALDKVSVDITTIFLSTNVSLLESHRLTTVTVRDADIVARVQGVWKATKDRIPSKMNMVRRKM

SEQ ID NO: 126765 - protein, 257 aa, Glycine max
  Coding DNA Sequence Number=SeqID_35080
  Homolog annotation: Hit_ID=A7QV72; Match level="QueryCoverage=63%, HitCoverage=86%, E-value=1e-58, Identity=60%"; Hit description =Chromosome undetermined scaffold_186, whole genome shotgun sequence
  Subcellular localization annotation: CTP_CleavageSite=41; ConfidenceScore=5.20e-01
MAMTCESSIVSPLFLSRICQAKTDPTRAFLLENKFSTITVTASPRQVVSAARLCNPNLATKVVVPWRRSRKGKKTTGKKEHHLWKSRDSAQSGQKALALVRTIMEVQMNVEKLVYKLPNEKEAVYGALDKWTAWETEFPVIAVSKALKILRKRGHWVRAIQVAKWMISKGQGATMGTYDTLLLAFDMDKRVFADMEELRVKPDEDTVRRVARAFRELGEEEKWKLVIKRYGLKWKYIHFNGERGYSLHWVNLMSLTN

SEQ ID NO: 126766 - protein, 760 aa, Glycine max
  Coding DNA Sequence Number=SeqID_35081
  Gene Ontology: Mol. function=identical protein binding; Cellular component=extracellular region; Biological process=negative regulation of catalytic activity
  Homolog annotation: Hit_ID=A5BS96; Match level="QueryCoverage=95%, HitCoverage=90%, E-value=0.0, Identity=56%"; Hit description =Putative uncharacterized protein
  Pfam annotation: Domain name=PA; Domain location=388-466; Score=16.1; E_value=0.0074; Accession=PF02225.13; Description=PA domain
  Pfam annotation: Domain name=Peptidase_S8; Domain location=129-607; Score=33.2; E_value=1.5e-08; Accession=PF00082.13; Description =Subtilase family
  Pfam annotation: Domain name=Subtilisin_N; Domain location=30-111; Score=45.8; E_value=1.5e-10; Accession=PF05922.7; Description =Subtilisin N-terminal Region
  Pfam module annotation: Pfam domain module=PA::Peptidase _S8::Subtilisin_N; Domain location=388-466::129-607::30-111
MAIKSIIPATYFLLFLHLLLPLASCIKTKQVYVVELFGDHTSDDKTLHEVENSHHSYLLSVKETEEEARASLLYSYKHSINGFAALLTPKEASKLSVVFVHKNQPKIYSLHTTRSWNFVGLDGPLNPWEEESDHTDGNLLARAQYGKDIIVGMIDSGVWPDSKSFSDEGMEPVPTKWKGVCQNGTAFDSSQCNRKIIGARYYLHGYQSAFGPLNEKEDYKSARDKDGHGSHTASIVAGRVVPNASAIGGFAKGTALGGAPLARLAIYKACWPIKGKSKHEGNICTNIDMLKAIDDAIGDGVDVLSISIGFSAPISYEEDVIARGALHAVRKNIVVVCSAGNSGPLPQTLSNPAPWIITVAASTVDRSFHAPIKLSNGTIIEGRSITPLHMGNSFYPLVLARDVEHPGLPSNNSGFCLDNTLQPNKARGKIVLCMRGQGERLKKGLEVQRAATGVSYENSLKLIQYVHSTPNPMAQILPGTTVLETKPAPSMASFSSRGPNIVDPNILKPDITAPGVDILAAWTAEDGPTRMTFNDKRVVKYNIFSGTSMSCPHVAAAAVLLKAIHPTWSTAAIRSALMTTAMTTDNTGHPLTDETGNPATPFAMGSGHFNPKRAADPGLVYDASYMGYLLYTCNLGVTQNFNITYNCPKSFLEPFELNYPSIQIHRLYYTKTIKRTVTNVGRGRSVYKFSAVSPKEYSITATPNILKFNHVGQKINFAITVTANWSQIPTKHGPDKYYFGWYAWTHQHHIVRSPVAVSFP

SEQ ID NO: 126767 - protein, 278 aa, Glycine max
  Coding DNA Sequence Number=SeqID_35082
  Homolog annotation: Hit_ID=A7QDC9; Match level="QueryCoverage=81%, HitCoverage=100%, E-value=5e-76, Identity=60%"; Hit description =Chromosome chr10 scaffold_81, whole genome shotgun sequence
  Pfam annotation: Domain name=DUF1264; Domain location=71-245; Score =274.8; E_value=1.8e-79; Accession=PF06884.2; Description=Protein of unknown function (DUF1264)
MTTQSLYNQPRKHPCMSTWNQNLNPRSPSSAYIYDSHASEKITESILQRLTMASTDKSPDPTPAKGPDPTPGKPMSVGQHVIDKSAMMVQSLDPIKQMSQHVCSFAIYSHDMSRQIETHHYCSRLHQNFIQCAVYDSDESKARLLGVEYIVPADVFEAFPPEEQKLWHSHAYEVDRELHVFSRGKVFVKNGNAGDRLPMGAPALMMSPQAASPGLVRAELVLERDAKYNFSSKSLKSSRLEIPEPEMINPLADYWKQHGKGFVIDIEETEMKLRPPFP

SEQ ID NO: 126768 - protein, 573 aa, Glycine max
  Coding DNA Sequence Number=SeqID_35083
  Homolog annotation: Hit_ID=A7QFM8; Match level="QueryCoverage=97%, HitCoverage=97%, E-value=0.0, Identity=60%"; Hit description =Chromosome chr8 scaffold_88, whole genome shotgun sequence
  Pfam annotation: Domain name=MACPF; Domain location=125-294; Score =123.0; E_value=8.5e-34; Accession=PF01823.10; Description =MACPerforin domain
MENPTSDSLSATLGNSIQALGRGFDVTSDIRLLYCKGAPGSRLVHVDEDHTKNLLLSHDLVIPNVSMDVDWSPGKDGIETTPVYSFHEMAKYFNERSGITGHIPLGSFNSMFNFTGCWMADAAATKSLAMVGYFIPLVEVKLNKLNLVLTDEVKHAVPYSWDPTSLASFIENYGTHIVTSATVGGRDVVYIRQHQSSSLSASDIETYVKDIGDDRFHNVKHFSGPGPLKYKEKDVTVIFRRRGGDDLEQSHTKWVETVKLAPDVINMNFTPIVSLLEGVPGIKHLARAIDLYLQCSMNQKTEGKSWRNDKPPIEDLQYFLDFQITQVWAPEQNNLQRKEPVCQSLQFSLMGPKLFVSPDQVTVGRKPVTGLRLSLEGSKQNRLAIHLQHLVSLPKNLQPHWDTHMAIGAPKWHGPEEQDSRWFEPIKWKNFSHVSTAPIEYTETSIGDLSGVHIVTGAQLGVWDFGAKNVLHLKLLFSKVPGCTIRRSVWDHNPSAPVAQRPDGASSSLMKKTSEDKKEDSSIHIGKLAKIVDMTEMSKGPQDIPGHWLVTGAKLGVEKGKIVLRIKYSLLNY

SEQ ID NO: 126769 - protein, 87 aa, Glycine max
  Coding DNA Sequence Number=SeqID_35084
MEIPKNRKWMYQRLDGHVSNARRTNKVSLQEMQCKVFKFVDDVMRDLYKEGFMPIYYWWTNHGEKLPQFPPIVLQGSYYESGRQGNN

SEQ ID NO: 126770 - protein, 140 aa, Glycine max
  Coding DNA Sequence Number=SeqID_35085
TIKGSTLADYLAQQPINDYQPMHPKFADEDIMTLFEEEVKDEDKDKWIVWFDAIDFRVKLLKVYGDSALVIHQLKENRVNDRGEEKEGLGGIGGSPDVSWRRCPAAVVVEDESFLCFDGSALYLALDILALGSFVLALDT

SEQ ID NO: 126771 - protein, 67 aa, Glycine max
  Coding DNA Sequence Number=SeqID_35086
MTRSVRQIRSASGIHEVRHTARLVGWETLDEDQSEMCSLNAQPARPARSLSLLTLSTPSLAEQAFES

SEQ ID NO: 126772 - protein, 318 aa, Glycine max
  Coding DNA Sequence Number=SeqID_35087
  Homolog annotation: Hit_ID=A7UQU7; Match level="QueryCoverage=32%, HitCoverage=18%, E-value=5e-17, Identity=43%"; Hit description=IMP dehydrogenase/GMP reductase, putative
  Pfam annotation: Domain name=DUF1723; Domain location=108-157; Score =56.2; E_value=1.1e-13; Accession=PF08330.1; Description=Protein of unknown function (DUF1723)
MPTTSTHRQQEVAPVAEDDLVLTKDVHAHAEEAIDDAEGFPGGPRDLSVLTDYGDHVAVIVWNDEERPELKLSSHGRKVLKFGRPAPEIEGLVAITGLSPLIACSVDTGDRGLISTFVERWHKETSSFHLPVGELTITLDDVSLERKLELRQHNVMGHTYAYRGYEIFIRVDTFFETLVRVELCIESFRPSAYVIYDGVPLSSDTDQRGWCGNLDMFRPSSINYGFHDDTYVEPHIPEVLVAPAAAPAYAPSDVEQPRHVVACQTIAERLERLVNLRIVTAGTKIHEVMEDNIRIARGVTPDGNVYVRSRQRRRTDQP

SEQ ID NO: 126773 - protein, 73 aa, Glycine max
  Coding DNA Sequence Number=SeqID_35088
MKIICSNFQGKDNAPPPPPQWIEAKVSVQHLPSWVLHSAATFLLALWQVYQIARSNNLSVSQMSYHRDFVALM

SEQ ID NO: 126774 - protein, 867 aa, Glycine max
  Coding DNA Sequence Number=SeqID_35089
  Gene Ontology: Mol. function=voltage-gated potassium channel activity; Cellular component=integral to membrane; Biological process=potassium ion transport
  Homolog annotation: Hit_ID=O24538; Match level="QueryCoverage=96%, HitCoverage=98%, E-value=0.0, Identity=77%"; Hit description =Potassium channel
  Pfam annotation: Domain name=Ank; Domain location=578-610; Score=2.5; E_value=14; Accession=PF00023.21; Description=Ankyrin repeat
  Pfam annotation: Domain name=Ank; Domain location=611-643; Score =39.0; E_value=1.7e-08; Accession=PF00023.21; Description=Ankyrin repeat
  Pfam annotation: Domain name=Ank; Domain location=644-678; Score=8.3; E_value=2.1; Accession=PF00023.21; Description=Ankyrin repeat
  Pfam annotation: Domain name=Ank; Domain location=679-707; Score=2.8; E_value=13; Accession=PF00023.21; Description=Ankyrin repeat
  Pfam annotation: Domain name=Ank; Domain location=708-740; Score =20.6; E_value=0.0058; Accession=PF00023.21; Description=Ankyrin repeat
  Pfam annotation: Domain name=Ion_trans; Domain location=117-319; Score=111.3; E_value=3e-30; Accession=PF00520.22; Description=Ion transport protein
  Pfam annotation: Domain name=Ion_trans_2; Domain location=228-325; Score=68.4; E_value=2.4e-17; Accession=PF07885.7; Description=Ion channel
  Pfam annotation: Domain name=cNMP_binding; Domain location=455-544; Score=67.5; E_value=4.3e-17; Accession=PF00027.20; Description =Cyclic nucleotide-binding domain
  Pfam module annotation: Pfam domain module=Ank::Ank::Ank::Ank::Ank::Io n_trans::Ion_trans_2::cNMP_binding; Domain location=578-610::611 -643::644-678::679-707::708-740::117-319::228-325::455-544
MEGMNFSSLYNPQLASSSKKSYSKQEYNHSGEHHHLNEEGYMSPSFNLRNISKLILPPLGVSSQNPVNSKGWIISPMDSRYRCWESFMVLLVAYSAWVYPFEVAFMHKSSNMKIYIADSVVDLFFGIDIVLTFFVAYIDRTTHLLVRDKKKIVVRYLSTWFVMDLASTIPYEAIGYLFTGKRKLGLPYFLLGLFRFWRIRRVKQYFTRLEKDIRFSYFWVRCARLLSVTLFSIHCAGCLYYMLADRYPHQGKTWIGAVNPNFRETSLRIRYISAMYWSITTMTTVGYGDLHAVNTLEMIFIIFYMLFNLGLTAYLIGNMTNLVVEGTRRTMEFFRFLTTWNPSRFLGMLPELYVIVTNVPCNFMSLSVQRNSIEAASNFVSRNRLPPRLKEQILAYMCLRFKAENLNQHQLIEQLPKSICKSICQHLFFATVEKVYLFKDVSKEILLSLVAKMKAEYIPPREDVIMQNEAPDDIYIIVSGEVEIIHTEMERERILGTLHTGDMFGEVGALISRPQSFTYRTKTLTQLLRLKTNTLMEAMQIKREDRQILKNFLQHIKQLKDLSIKDLMVENVEEEDPNMAVNLLTVASTGNAAFLEELLRAGLDPDIGDSKGKTPLHIAASKGHEECVKVLLKHACNMHIKDMNGNTAIWDAIASKHYSIFRILFQLSAVSDPNTAGDLLCTAAKRNELTVLTDLLKQGLNVDSKDHHDTTAIQIAMAENHVDMVHLLVMNGADVSDVHNHEFCSSTLDEMLQKREIGHLINVTEVMRSGVVLKGKHQEQELNGGRSNGLKFPRVSIYRGHPVVRREKGSVEAGKLIRLPDSLEELKTIAGEKFGFDAKDAMVTNEEGAEIDSIDVIRDNDKLFFVE

SEQ ID NO: 126775 - protein, 220 aa, Glycine max
  Coding DNA Sequence Number=SeqID_35090
  Homolog annotation: Hit_ID=A5APL5; Match level="QueryCoverage=24%, HitCoverage=12%, E-value=4e-09, Identity=58%"; Hit description =Putative uncharacterized protein
MRAVTLDGKSIDEYLRKIKGYVDELAGVGVLVRHEEYIDTLLEELPSDYAPIIFVIESKKHTSSIAEIEALLYVILVALKARMVVAMVVVNLNAKSTVPGPSQPNAKLTNSSSHGNGASGSTWIPDFGANFHVTGSLVFVSPNDTAITFQLNKLLHVPSISKNLLSVSQFAKDNSIFFEFHPHLCLVNLRRPIKFSYKEWLVLMDSILFTTSSFKAILLY

SEQ ID NO: 126776 - protein, 772 aa, Glycine max
  Coding DNA Sequence Number=SeqID_35091
  Gene Ontology: Mol. function=ATP-dependent helicase activity; Cellular component=intracellular; Biological process=double-strand break repair via homologous recombination
  Homolog annotation: Hit_ID=Q8L840; Match level="QueryCoverage=79%, HitCoverage=57%, E-value=1e-162, Identity=48%"; Hit description=DNA helicase isolog
  Pfam annotation: Domain name=DEAD; Domain location=404-547; Score =51.5; E_value=3e-12; Accession=PF00270.20; Description=DEADDEAH box helicase
  Pfam annotation: Domain name=ResIII; Domain location=400-541; Score= -27.8; E_value=0.01; Accession=PF04851.6; Description=Type III restriction enzyme, res subunit
  Pfam module annotation: Pfam domain module=DEAD::ResIII; Domain location=404-547::400-541
  Subcellular localization annotation: CTP_CleavageSite=5; ConfidenceScore=5.20e-01
MRHGEANSGQGPKVNLLQHANALENFSSQAKFLSSTFLFSVPPKKPHHEQPNPGFVFRRSETIQGSQRVQVEKALAAHSSLQNSSRNYVQPGKTQVTPQLHEDRRTTSFHGGYENGNHRCPDVAATPIVNNHNSRGLDGSVNNHTNYTGQINKSSNCMAVDIDDDDSLFKNIDVDQIVEDYCTPKPSISKLPPITPTADKDNFARQGDDVLPPELCLDCVHGYMLGFCPEAASHLQDMKDNLIAIFNELLDNGENLNSTQIAKLRHDRSQLNKQIQQLEKYIHSGNLNEERQKSHFSASTAPPTSFVYETPQQTVLCNGSKRYDTEAYMGNGTYGSSFQSLPPFSVDNCSMPSGSVGREVFIPKIIEVNYIEGSGDKRWSSYDFSWTKELEVNNKKVFGNHSFRPNQREIINASMSGCDVFVLMPTGGGKSLTYQANIPAAYLSANMEWTEQQDILRELNSDYCKYKLLYVTPEKVARSDNLLRHLDNLHFRELLARIVIDEAHCVSQWGHDFRPDYQGLGILKQKFPNTPVLALTATATASVKEDVVQALGLVNCIIFRQSFNRPNLRYSVIPKTKKCLEDIDKFIRENHFDECGIVYCLSRMDCEKVAEKLQGSFAILSRSQARIKGEGCVRLSTANVKLCRISMTWINYVIITVSKEQGPLHRRPDVVKSKQGFPHFRERVWVKKLVHDRRIRFGTWNIGTLTGKSMEIVDVMVRRKINFMCLQETKWTGEKAKELDNSGFKLWYTGKIRSRNGVGIIVDKEWKKDVVD

SEQ ID NO: 126777 - protein, 111 aa, Glycine max
  Coding DNA Sequence Number=SeqID_35092
TSSGKFPEDVFRKSSGRSVLPEDVWLLPEEHFFRKLSGKGSSGTSGRTPNGFHAESILDSKSNGELGRLTSKAVRGEDGEEEEAWLVVSGRRRKLGSRCHGGSTGMEEEKK

SEQ ID NO: 126778 - protein, 183 aa, Glycine max
  Coding DNA Sequence Number=SeqID_35093
EKYQHRRNEILQHSTEEDTSTQDFPNTATSVNDNEIYLNVVGGPNYKGNVYGLGTLSKKFSCSKSTPSTFIALVEDQIEEMRETINKLNAELLAKANKEKTLEEKILQLMENHDHQSQEMRQQMQEQNEQIRQQNEQMQRILQHLHIQSIMPTPSLSATIADGTEHHVNDAQVDRPHDMGNDR

SEQ ID NO: 126779 - protein, 155 aa, Glycine max
  Coding DNA Sequence Number=SeqID_35094
MIDGLMLSGKLGIGKTLVFGRMLGVGEESLNHVFARMFLNSEQKHEVVGDLGAWENEIWKWKFSWRRPWFDWERDRVIEFERLLEGVECHDPLLGHDRRTNYNFFSLLHYTRVTTKISIRHNGDLPKKDNQVPGCVSKSQEIGYSTTGYLRKEVK

SEQ ID NO: 126780 - protein, 49 aa, Glycine max
  Coding DNA Sequence Number=SeqID_35095
MGAPNHLTSEQPPNEGNSLQSLRSKTNRKLHGYSVVDTHHQAETGRQRM

SEQ ID NO: 126781 - protein, 144 aa, Glycine max
  Coding DNA Sequence Number=SeqID_35096
MYVLVVSARDQVWVTKGEPEEGADLKWAKVVAYTIVKGCEAWTSCRISGAKVKTKQLNKKVGGRPTIRLARDSNSERYSMTMPFCVSLNRVPSRSFHIKRSNRKMVTFRCVVVSEKLVDLEDPTKGIGTVKPRYFQLHTKRGRG

SEQ ID NO: 126782 - protein, 72 aa, Glycine max
  Coding DNA Sequence Number=SeqID_35097
MVSRLAAGVSLSEACALSENHAISEALNPLSKLGESEKHLRAQRVISSLNETFVSSCAKCAQLAQRIFTNSR

SEQ ID NO: 126783 - protein, 119 aa, Glycine max
  Coding DNA Sequence Number=SeqID_35098
  Homolog annotation: Hit_ID=A5B3J2; Match level="QueryCoverage=100%, HitCoverage=26%, E-value=3e-12, Identity=36%"; Hit description =Putative uncharacterized protein
DLVDLDMEIEATCRRNNTESFPETRESKTAVPEADIMDEEQPRRVTLKDYSSSIVPQFFTSIVRPEVQAHNITYPHSLIQLIQGNLFHGLPNEDPYAHLATYIEICNTVRIVGVLEDAV

SEQ ID NO: 126784 - protein, 161 aa, Glycine max
  Coding DNA Sequence Number=SeqID_35099
MDALQHRNWAGAGEGVGAEDAGAGEAAEDGPSDPRACALRVPGNLIMGSSRFQQFFFMYAKLMAGMRDSKVKEYETTPRATQSEEMRVGKPRLEEVIQVRVKLLDQGHINVLVHELGQGLMSVLPDQLTAEFVIFCDEKINIPLRKDVPGVNILSNVPRPL

SEQ ID NO: 126785 - protein, 434 aa, Glycine max
  Coding DNA Sequence Number=SeqID_35100
  Gene Ontology: Mol. function=catalytic activity; Cellular component =nucleus; Biological process=regulation of transcription
  Homolog annotation: Hit_ID=A5AHA6; Match level="QueryCoverage=86%, HitCoverage=73%, E-value=5e-97, Identity=52%"; Hit description =Putative uncharacterized protein
  Pfam annotation: Domain name=TCP; Domain location=61-247; Score =158.7; E_value=1.5e-44; Accession=PF03634.4; Description=TCP family transcription factor
  Subcellular localization annotation: CTP_CleavageSite=70; ConfidenceScore=5.61e-01
MELSDLQNKKQSSSSSSTGATHQQQQQQQQSSSTHLVVPSPSNSSASLIDASLAIATRSDDSTKKTQQPSTNTKRSTKDRHTKVDGRGRRIRMPATCAARVFQLTRELGHKSDGETIEWLLQQAEPAIIAATGTGTIPANFSTLNVSLRSSGSTLSAPPSKSAPHTFHGALALAHHPYDEAFQHPALLGFHPHHHQQQLLSADQIAEALPSAGGGDSGGNYLRKRYREDLFKDDNINNTQSQNDSGDADGDADGDGSSPKLPKEAGSGLLRPTNLLPATAMWASGPPGSTIWMLPVTAAAASSSSSSSSASSAASSESQMWAFPQSVSGFMPRFNLPVPGALEFQGARAGSLQLGPSMLMPPPPLPPQQQQQPSQHLGLAMSDSNLGMLAALNAYARAGLNINSDHHHHHHHHHHHQHQSQPSESGEDAPNSSQ

SEQ ID NO: 126786 - protein, 440 aa, Glycine max
  Coding DNA Sequence Number=SeqID_35101
  Homolog annotation: Hit_ID=A5BUS6; Match level="QueryCoverage=47%, HitCoverage=14%, E-value=1e-17, Identity=31%"; Hit description =Putative uncharacterized protein
MEARNTYVSHEMQRVYDYSSRQLLGVRPQEGELQGSVVKLSWLAHHFSQINIHDGNVEQLQRFTRAWILRFIGGVLFVDKSSSKVSLRYLQFLRDFEQCSTWLQRGNQHIGNDDLIVFRRKLDIMKRHEFLWEPYTTIVMSTLPPICLVDSVPIPKCPSQPLNIHGLMLKGKQDENWFQLLASMISQWNNRAGFRVDIYPRQEDLLSFNSDYMVWYRRKTKMFVDPKNANTATLYMVSPQGRNTWTVDDLVPYVEKITILSEEQERITESVAQQFHMLQSSVETRGFDRRMEVVEAEDFSQQMEQRGHGMYYTAPTFSQYPSQMYQYPFEGHDTDMSASEHSFGGVAETHPHFSWPTMTPSQQHDAPMATPNAPLAPQWNVPGAIHDMGDLLGVDLHHKFSAEADQEGRRQRARRNADRQARRWDRPCGTSSRHHGHHNE

SEQ ID NO: 126787 - protein, 43 aa, Glycine max
  Coding DNA Sequence Number=SeqID_35102
MLTLQLIFFLSYFYGDSSSDAPESLVKKITLAFVSAMECRGAC

SEQ ID NO: 126788 - protein, 134 aa, Glycine max
  Coding DNA Sequence Number=SeqID_35103
MCLFGLFSSSKGLQMLLSNHKTILYVCRCNLFEDTPFFSSFVDHSSSLQEVLPIPCPLGNSDQNVNEVPSSLPNSIEVVSPPLLTYHHRARPADSTIPEVSPRDSHPSPTSPPTMDPASSPVSHHSESAWPIAI

SEQ ID NO: 126789 - protein, 331 aa, Glycine max
  Coding DNA Sequence Number=SeqID_35104
  Gene Ontology: Mol. function=protein binding; Cellular component =endoplasmic reticulum membrane
  Homolog annotation: Hit_ID=A7QCI0; Match level="QueryCoverage=74%, HitCoverage=51%, E-value=9e-71, Identity=57%"; Hit description =Chromosome chr12 scaffold_78, whole genome shotgun sequence
  Pfam annotation: Domain name=DUF1682; Domain location=119-325; Score =74.2; E_value=4.3e-19; Accession=PF07946.5; Description=Protein of unknown function (DUF1682)
MANPILSFLLLALLCILALAHADSHFEGFEAEDDDDLEDSSIDPASLRSPPLSDPTPLTTDPTPQPPASDLPKSPPATTFDFWDDEEFEGVPVEHPAPEPPSDPKSPENSTTTQTPPTLTPPRSFTVEIVCGSFLIMFAINYFTGKRENENIALSWAAQFAAKDSIFEKNFSLLGIGDGGEEAPLLLKEGQTTFKFYASGRRYCQGLLATLELKSRHDLIARIYNMIVPCRDEIAFEVYMNDDAMDHVVFAMAKKKAAKAMHKDVRDLQRFATLLSPPTATASARKWVADDLAVISESKEVANDFITDAVIDQDQDSLGLTWGQMIPLGPQ

SEQ ID NO: 126790 - protein, 173 aa, Glycine max
  Coding DNA Sequence Number=SeqID_35105
MDDFSEPRDQELFHHNNDQSDGEGVVVPTSTPSPLLQYHQPRCPVELNLEHLPQYIDQHYFVQQQQDRVQPPIGALDVGIIRAEMYFKTAKLVAIRGRQTKAMINFGSQYSIIVNKFDRHNHTFIVTETQAPLQTPKPPGRFRVCYNPKIVIMVNMRLNTFTVTTLNLSMLIP

SEQ ID NO: 126791 - protein, 313 aa, Glycine max
  Coding DNA Sequence Number=SeqID_35106
MEGSVNIGIRKKGLLDGDEVASWSGFEKWSHSDIVAMRGGSTHLNDFQKLGKGLGYLHFTKEKQTRPPIWLRTIHQSTKQDVPVGVDRMEEEDGLWKKDCLCKTWERVDSMDSHSSMVGEREGPTTSQFEEDKRKNALSDGHSFGPATQKIACPVGEYGETHGVVVNKKKGKAIETLTQTWCSRCHSLPKAYNLGYGTRKLVGNGSFELGLYYHVENNMGQPPFGECFAYKEEQVQLENTSQGRIYDFGPEPITDLQLQAKVDDISHEHGSTLQSSNKTTSGEHKHNKGSALLQVSWNWIEGILRQWKDQAGS

SEQ ID NO: 126792 - protein, 291 aa, Glycine max
  Coding DNA Sequence Number=SeqID_35107
  Homolog annotation: Hit_ID=A2Q6B4; Match level="QueryCoverage=38%, HitCoverage=59%, E-value=2e-14, Identity=33%"; Hit description =Ribosomal protein L33; Nucleic acid-binding, OB-fold
MDLKENFTYAMHNFRVIKNDGQYKVCDHAYKLAFTGAIVARQCELDDIIGVVDEVVFCHVSSRSSRVVFKLRDLSDQLLSCTLWDDYCLQFLEYLDEHESESPIIVLLTNARIKEGQGSYPPSVSNSLKASKLAINELVVQIQEFNQRLSKLGIEVQSVLARCGQGSSQLSGSTQLSSKETFISKYRVEVMVNHKDESTRFLIWDRECIELIGQSADEVNCLKIADGDLDLNASLEALDKLLGNVLAFKIKQSISIKSYHDPLIGLPLTPTKRQPSHECDDEARSSQISPA

SEQ ID NO: 126793 - protein, 328 aa, Glycine max
  Coding DNA Sequence Number=SeqID_35108
  Homolog annotation: Hit_ID=Q1SN17; Match level="QueryCoverage=26%, HitCoverage=17%, E-value=3e-09, Identity=37%"; Hit description =Transposase, putative
MDEDQWVYDNIMYEEVDMDDQNEQECGVNEQHVDCSDAFKTSQMMFCSGLDQLLMKMDLLQSGQYGCRKKDFVRRDTESRKCGCPFKLCGKSVIGGQGWMVKLMCKTHNHELAKSLVGHAYAGRLTKDEKTIIADMTKFHIDKNVKAKCKSLIGQKNAWEYVMDAWGSLVDCPFEQQFHECLKKFEIACSPWPINSKVREIAYPDQNSMCPPPAKVNTKGAPKKPMNRNQRSTKYDLSYWDASSSDQPNPRRIMSMLDQFQPFIHDFIDNIVDVKVDGNCGYQSIAIFLSMGEDSWSLVCNHLLKELAKWSDDYIKLFGDTDGFEEGP

SEQ ID NO: 126794 - protein, 380 aa, Glycine max
  Coding DNA Sequence Number=SeqID_35109
  Homolog annotation: Hit_ID=A5C6C9; Match level="QueryCoverage=73%, HitCoverage=26%, E-value=1e-20, Identity=27%"; Hit description =Serine/threonine protein phosphatase
  Pfam annotation: Domain name=DUF1723; Domain location=150-199; Score =49.4; E_value=1.3e-11; Accession=PF08330.1; Description=Protein of unknown function (DUF1723)
MVRTRGLGRALGRVIGRALGREDHHDSDDVPQRRRPTASARRQWEAAPIVEDVLDMTEDVLAHGVEAVDGAEGFAVDNAKGFPGGSRDPSVLTEYGDHVGVSIWNGEERPELKLSSHGRKVDKFGRPAPEIEGLVTATGLSPLIACSVDTGDQGVISAFMERWHKETSSFHLPVGELTITLDDVASLLHLPIIGTFHSFEPLHVDEAVLMLVELLEVSGEEARAEKNVMGHTYTYRGYEIFIRGDSGSYAWGAAALVHMYDHLNNACKSDGRQLAGYITLLQIYEHFSSIADCVTDLDYDEMSPHACRWLTTKAYSKGFPALTYWTRIDGLTIPDLRWGPVVVTHRPEKVVRQFGYVQTIPPQPMGVSLSFDDLDDTCRT

SEQ ID NO: 126795 - protein, 110 aa, Glycine max
  Coding DNA Sequence Number=SeqID_35110
MKSVQFQVKKRLSHEVLKVTVELSSSVGPNAHPPLSAASAGLARQKNLAEHQYQGCALSARSREGGAKRNIAGQQSRESPSYIEVRAHHSAYFGKRALEAARGAVFAEIP

SEQ ID NO: 126796 - protein, 99 aa, Glycine max
  Coding DNA Sequence Number=SeqID_35111
  Homolog annotation: Hit_ID=A5B108; Match level="QueryCoverage=93%, HitCoverage=13%, E-value=1e-08, Identity=35%"; Hit description =Putative uncharacterized protein
MAAKRILRYVKGTTDYRVLLPFGQNESNQNLLGYTNSDWRRDKDDRKSIATYVFMDKVNKGKIKLIYYKLEDNLVDLLTKPLKKAKFKELRSKLMIKAD

SEQ ID NO: 126797 - protein, 337 aa, Glycine max
  Coding DNA Sequence Number=SeqID_35112
  Gene Ontology: Mol. function=calmodulin binding; Cellular component =integral to membrane; Biological process=cell death
  Homolog annotation: Hit_ID=Q2HSW1; Match level="QueryCoverage=88%, HitCoverage=50%, E-value=1e-124, Identity=75%"; Hit description=Mlo -related protein
  Pfam annotation: Domain name=Mlo; Domain location=1-335; Score=392.4; E_value=7e-115; Accession=PF03094.6; Description=Mlo family
MGGKTLQETPTWAVAVVCFVLLSISILIEHILHLIGKWLKKKHKRALCEALEKIKSELMLLGFISLLLTVGQGLISRICISEKVAGTFHPCPKKYYKKKEESEHRTNNGRRLLAAFLDSDNQNHRRILAAGGGDNCPPGKVPFVSSEGIHQLHIFIFVLAVFHVLYCILTLALGRAKMRRWKRWEEETKTAQYQFSHDPERFRFARETSFGRRHLSFWAQNPVLLWIVCFFRQFVRSVPKVDYLTLRHGFMMAHLGPHSHPKFDFRQYIKRSLEEDFKVVVEISTPIWFITVLFLLVHTDDCSISWSQVASDNNKDGSKNSTTRRGCKGSATGATWG

SEQ ID NO: 126798 - protein, 239 aa, Glycine max
  Coding DNA Sequence Number=SeqID_35113
  Gene Ontology: Mol. function=calmodulin binding; Cellular component =integral to membrane; Biological process=cell death
  Homolog annotation: Hit_ID=Q2HSW1; Match level="QueryCoverage=98%, HitCoverage=41%, E-value=9e-78, Identity=61%"; Hit description=Mlo -related protein
  Pfam annotation: Domain name=Mlo; Domain location=1-165; Score= -197.8; E_value=1.6e-09; Accession=PF03094.6; Description=Mlo family
MGQRIQQRGEVVKGVPLVQPGDDLFWFNKPRLILYLINFVLFQNAFQLAFFSWAALQFMMKSCFHSQKQGVVIRISMGIFVQFLCSYVTLPLYALVTQMGSTMKPTIFNKRVATALRKWHHTAKKNVKQNRGLRLQTPSSTRPTTPNHPKSQVNFLRRYHSEMAPYPSSPIRFDFEANLSYEVNATSSSIHHHEMEMGHQAYDHAEKVDEPSSTLVGLSLPQREIDIEHGKEFSFDNKE

SEQ ID NO: 126799 - protein, 434 aa, Glycine max
  Coding DNA Sequence Number=SeqID_35114
  Gene Ontology: Mol. function=protein serine/threonine kinase activity; Cellular component=beta-catenin destruction complex; Biological process=protein amino acid phosphorylation
  Homolog annotation: Hit_ID=Q8H6X8; Match level="QueryCoverage=93%, HitCoverage=92%, E-value=0.0, Identity=91%"; Hit description=GSK-3 -like protein MsK4
  Pfam annotation: Domain name=Pkinase; Domain location=82-380; Score =314.8; E_value=1.6e-91; Accession=PF00069.16; Description=Protein kinase domain
  Pfam annotation: Domain name=Pkinase_Tyr; Domain location=82-380; Score=5.6; E_value=9.6e-13; Accession=PF07714.8; Description=Protein tyrosine kinase
  Pfam module annotation: Pfam domain module=Pkinase::Pkinase_Tyr; Domain location=82-380::82-380
MASASLGSGGVGSSRSVNGGFRGSSSSVDWLGREMLEMRLRDHEDDRDSEPDIIDGVGAETGHVIRTSIGGRNGQSKQNVSYIAEHVVGTGSFGVVFQAKCRETGEIVAIKKVLQDKRYKNRELQIMQMLDHPNIVALRHCFFSTTDKEEVYLNLVLEYVPETVNRIARSYSRINQRMPLIYVKLYTYQICRALAYIHNCIGICHRDIKPQNLLVNPHTHQLKLCDFGSAKVLVKGEPNVSYICSRYYRAPELIFGATEYTTAIDIWSTGCVMAELLLGQPLFPGESGVDQLVEIIKVLGTPTREEIKCMNPNYTEFKFPQIKPHPWHKIVPYISETFHREKKVFQKRLPPEAVDLVCRFFQYSPNLRCTALEACIHPFFDELRDPNTRLPNARPLPPLFNFKPQELSGVPPDVINRLIPEHARKQNLFMALHT

SEQ ID NO: 126800 - protein, 164 aa, Glycine max
  Coding DNA Sequence Number=SeqID_35115
MAEKFISHTVSHFSFFRKIVKEGMILSQFRALSQYTHHLRAALTQLTLFVTHPSMPARPVIEHIWPPFNYYRHHPRFVVYTYYVPTTLLVFSSDHCNPNILAKPKSEILGFISSSSNILLAFKSSNVLLDISLCSAVGSHTIINGKEVVNFLCSAAGTIGRTQS

SEQ ID NO: 126801 - protein, 332 aa, Glycine max
  Coding DNA Sequence Number=SeqID_35116
MDGVGYLAGPPKLGLIAGSATLVTLKGQLCEWSVADKGNPNKAIEVSSYVRSSVEASCSDNASIIAKITIGDFKEVSVNYSPKDNKPIHLCCYRMDAYERSDWVFLENESSINMPTTRDFFYVYDCIFRNLNIELPFDDFTMSILYILNMAISQLHLNGQKKKISSTLEEIDEKYGRKSIEEGLDSLLDVQSRLDFGRDILQGVDASFALAINEVEEGVGGDEQGNKSSPSCKYRREKDLMVALKCEVDAFKESLIKAQEEIKQGKEQYQFLMRGSREKVIMEHNVSFNKALRQVDHKFMIPHDAEFDILMDIHEGTLMSIQNIPRNTPRTS

SEQ ID NO: 126802 - protein, 726 aa, Glycine max
  Coding DNA Sequence Number=SeqID_35117
  Gene Ontology: Mol. function=protein dimerization activity; Cellular component=nucleus; Biological process=regulation of transcription, DNA-dependent
  Homolog annotation: Hit_ID=A4PSF1; Match level="QueryCoverage=99%, HitCoverage=98%, E-value=0.0, Identity=75%"; Hit description=AUX/IAA protein; Transcriptional factor B3; Auxin response factor
  Pfam annotation: Domain name=AUX_IAA; Domain location=479-694; Score=- 87.7; E_value=0.0036; Accession=PF02309.7; Description=AUXIAA family
  Pfam annotation: Domain name=Auxin_resp; Domain location=277-359; Score=176.9; E_value=5.1e-50; Accession=PF06507.4; Description=Auxin response factor
  Pfam module annotation: Pfam domain module=AUX_IAA::Auxin_resp; Domain location=479-694::277-359
MASAAPGATNDALYKELWHACAGPLVTLPREGERVYYFPQGHMEQMLPRFTLQFYLENICSFLTCLAFWWEMSLFMLEASMNQGLEQQMPSFNLPSKILCKVVNVHLRAEPETDEVYAQITLLPEADQSEVTSPDDPLPESPRCTVHSFCKTLTASDTSTHGGFSVLRRHADDCLPPLVTCQAPTPNLWTVLSCEPVKECDHWIFLQIEYAKVICRATQAPLTDHWVECLCQFQKISGWGENGELRVGVRRLMRQQSNMPSSVISSHSMHLGVLATASHAIATGTLFSVFYKPRTSRSEFIVSVNKYLEARSHKLSVGMRFKMRFEGDEVPERRFSGTIVGVGDNKSSVWADSEWRSLKVQWDEPSSILRPDRVSPWELEPLVSTPPTNPQPSQRNKRSRPPILPSTMPDSSLQGGSDIHNFSIKFCYSCCFYSNFLFLCASGVWKSPVESAPFSYCDHQHGRDVYPSTNFNSTATGFLGFGGNCYASNKSIYWSSRMENSTESFSPVALKEFGEKRQGTANGCRLFRIQLHDNSNSNEESLPMVTLSGRMGDDGPLPSLDAESDQHSEPSNVNRSDIPSVSCDAEKSCLRSPQESQSRQIRSCTKVHMQGMAVGRAVDLTRFDGYEDLLRKLEEMFDITGELCGSTKKWQVVYTDNEDDMMMVGDDPWLEFCSIVRKIFIYTAEEVRKLSPKIGLPISEEVKPSKMDSEAVANPEDQSSIVGPGC

SEQ ID NO: 126803 - protein, 52 aa, Glycine max
  Coding DNA Sequence Number=SeqID_35118
MNESKELLIRIGMPTLKGNPEAELLILMLTGNETGMTIAEAMKKVLMWIGIG

SEQ ID NO: 126804 - protein, 148 aa, Glycine max
  Coding DNA Sequence Number=SeqID_35119
MAAGRHGGEEGAEEEKKEAKKGEEKDEEKGLMEDEKCMCRVEKRKAMKKMKCLNDPEDERMQREKAWMEMIMIIQKQQQQQQEEEEEYEYLARKRDHLKEGTIQSVIQVLAYGAMLQTNGHDLQREGGRIIPINVFVSCLDLLMSINL

SEQ ID NO: 126805 - protein, 99 aa, Glycine max
  Coding DNA Sequence Number=SeqID_35120
MEDANTCGGEEGNQISKRGRRSLLSDTQKTKEEYEPFWKEKNESAEEEACGEVAGCTGEEGKRGRKRYFWKFIQLLGAPSILLGAPSNTLSVLTWFKTS

SEQ ID NO: 126806 - protein, 205 aa, Glycine max
  Coding DNA Sequence Number=SeqID_35121
MQLNIFIDGLRTQSKQLLDAFVGGKIKLKTPMEAMELIENMAASDRAILRDRAYTPTKRSLLELTVQDATLGQNKLLARQIEALTETLSKLPQQLQAVSPSHSSIMRIGGCHIYDGADEPRQCIAQEDSSREVNYMGSQNRHGFQCYNQGGPSGFNQGRNFTQGSSWKNHPRNQFNKEKRSQPIHNSNQEVDLYEKTSKLEETLN

SEQ ID NO: 126807 - protein, 386 aa, Glycine max
  Coding DNA Sequence Number=SeqID_35122
  Gene Ontology: Mol. function=protein dimerization activity; Cellular component=nucleus; Biological process=regulation of transcription, DNA-dependent
  Homolog annotation: Hit_ID=Q2HSV9; Match level="QueryCoverage=98%, HitCoverage=46%, E-value=1e-171, Identity=77%"; Hit description =Transcriptional factor B3; Auxin response factor; Aux/IAA_ARF _dimerisation
  Pfam annotation: Domain name=Auxin_resp; Domain location=296-379; Score=168.8; E_value=1.5e-47; Accession=PF06507.4; Description=Auxin response factor
  Pfam annotation: Domain name=B3; Domain location=161-274; Score=92.3; E_value=1.5e-24; Accession=PF02362.12; Description=B3 DNA binding domain
  Pfam module annotation: Pfam domain module=Auxin_resp::B3; Domain location=296-379::161-274
MEIDLNDAVTSEAEKSASCNGECEKGAALSSPTCSSSGSSSTRVSSSYIELWHACAGPLTSLPKKGNVVVYFPQGHLEQAASFSPFSPMEMPTYDLQPQIFCRVVNIQLLANKENDEVYTQVTLLPQAELAGMYMEGKELEKLGADEEGNETTPTKSTPHMFCKTLTASDTSTHGGFSVPRRAAEDCFPPLDYKKQRPSQELVAKDLHGVEWKFRHIYREVPVVILSGQPRRHLLTTGWSIFVSQKNLVSGDAVLFLRGENGELRLGIRRAARPRNGLPESIVGSQSYYPNFLSSVANAISAKSMFHVFYSPRASHADFAVPYQKYIKSIKNPVTIGTRFKMKFEMDESPERRCTSGIVTGMSDLDPYKWPKSKWRCLMLQFIKKC

SEQ ID NO: 126808 - protein, 558 aa, Glycine max
  Coding DNA Sequence Number=SeqID_35123
  Homolog annotation: Hit_ID=Q6WAY6; Match level="QueryCoverage=42%, HitCoverage=50%, E-value=2e-14, Identity=26%"; Hit description =Putative uncharacterized protein
MGSDQALSFKKRFYHLKVKNLELASLRELGQQMDQLAPTIEEFEGILGCPLGGRKPYLFFEFYHSLTRIVRVVKILEQELDRVKQNRNGVVGIPRKRLEEKAEAWANQGEWTSFIDILALLVFGTILFLNVDGLVREEHCENYLLYACSLCMVGIPHFFIMKLAPTVKEGGAGVLCSCEGFPNVPLIGTRGCINYNLVLAIRQFGYPMRGAPSEEVIMPFIARGFNEANARILQKIRKAWNRVGRKDKELRGSNNGVIGGSHKWLKSRTQGITWLPKLKSLSGKEAEIPEKSEELKTLKAELEKTRVVKEKLKTIVTKGKSVSALQIEREAKERVIELLHGEAMKWMNRFALTLNESQELPRLLTRAKAVADTHCHHQKVAIVTKKNERALRYPYRTRAKAKIMSEIEEVQEQIKADMEAMKDQMSTMMEAIMSMRKTMEVNMTIVATTREGLGSTGGLHFAQVLSKHPFPPYDLPPNYTPPNAIQLSVRSALDSFYWGGSVNIAQEIEVSGGRTAGYSVRGRRYTSELSILYALCGRCGGIIGNIFSNAKNCEQCLC

SEQ ID NO: 126809 - protein, 92 aa, Glycine max
  Coding DNA Sequence Number=SeqID_35124
MTEDIVIFEKGQMTIICLCVPSDLHARTLSLMNDKVRTLNPMKDKVRTLSPMKDKVRTSSPMKDKVRTLSPMKDQVRTLSPNKGEDFEPYER

SEQ ID NO: 126810 - protein, 32 aa, Glycine max
  Coding DNA Sequence Number=SeqID_35125
MGHLSDQGVPMNPKRIKVLRDGAQEYEEPRDL

SEQ ID NO: 126811 - protein, 152 aa, Glycine max
  Coding DNA Sequence Number=SeqID_35126
  Homolog annotation: Hit_ID=Q6WAY4; Match level="QueryCoverage=80%, HitCoverage=22%, E-value=1e-11, Identity=33%"; Hit description =Putative uncharacterized protein
MGSSQTPSLKKRFYQVKVKSLGITSLKELRQLMGQLQRQAFRKAYGKIWDLAMVNVSTEAIASLAQYYDQPLRCFTFGDFQLSPMVEEFEEILGCPLGGRRPYLFSEFYPSLTRISKIVQISTQELYHRKQVENGVVGIPRKYLEAKAKILA

SEQ ID NO: 126812 - protein, 48 aa, Glycine max
  Coding DNA Sequence Number=SeqID_35127
MACTHIPVEAKMTYTRFSSNFSQPASIRPCTLCFRALQCLMECPGAPP

SEQ ID NO: 126813 - protein, 275 aa, Glycine max
  Coding DNA Sequence Number=SeqID_35128
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLESDDQHHPDTIDSFALVDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 126814 - protein, 341 aa, Glycine max
  Coding DNA Sequence Number=SeqID_35129
VLEIPRCARVQFLVPQNALSMHEWPRGSLPQRGPGRTRRPKELVPLRSTTVTALGALYTSSASKPSRDGGNRAPAVGTTGYSHGQVDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITRLCQSFGVPVAPTKVIRPPITRAFIEKYCTQRQGQGDAPQAAGAPPLPHQAGQAGAFDIEQYLRHLVRQQAANHRAH

SEQ ID NO: 126815 - protein, 115 aa, Glycine max
  Coding DNA Sequence Number=SeqID_35130
MARAGGGGDEYHQLDGAQRLLLDAMNAQMQHLLSRTNEEVYGRLEVLENQANQNARRNIDGNKGNNGGNDGPRQNRVEGVKLNVPPFKGRSDPDAYLDWEMKIEHVFACNVYTDE

SEQ ID NO: 126816 - protein, 38 aa, Glycine max
  Coding DNA Sequence Number=SeqID_35131
MCRLAPRSEFNLRQIPMWGKLKHGCQGGQCIGHLVLFP

SEQ ID NO: 126817 - protein, 162 aa, Glycine max
  Coding DNA Sequence Number=SeqID_35132
  Gene Ontology: Mol. function=metal ion binding; Cellular component =nucleus; Biological process=histone H3-K9 demethylation
  Homolog annotation: Hit_ID=A7Q7J4; Match level="QueryCoverage=67%, HitCoverage=10%, E-value=3e-44, Identity=77%"; Hit description =Chromosome undetermined scaffold_60, whole genome shotgun sequence
MFGCFLSLPHFAVFALPAQTFLVALASFGIGEMQGEININQLFTGYTNGRRDWLAWPQILKLKDWPPSNLFEEQLPRHCAEFISSLPFKEYTDPHKGSLNLAVKLPNGSLKPDLGPKTYIAYGFPQELGRGDSVTKLHCDMSDAVCSICLFLSWAVIFKDFF

SEQ ID NO: 126818 - protein, 36 aa, Glycine max
  Coding DNA Sequence Number=SeqID_35133
MQLARPGFPDWKAGKITIYSGNSYDHDYAKLEINPH

SEQ ID NO: 126819 - protein, 23 aa, Glycine max
  Coding DNA Sequence Number=SeqID_35134
KNDASSVSNTPLGARGSSGASNP

SEQ ID NO: 126820 - protein, 23 aa, Glycine max
  Coding DNA Sequence Number=SeqID_35135
FHEGFNRSSTFFIRSSSFFDLQR

SEQ ID NO: 126821 - protein, 66 aa, Glycine max
  Coding DNA Sequence Number=SeqID_35136
MSPHGGDMDGGEKRKERDGVSLAFGIAGPGGRPARRAISSVVERAPDNCVVVPGLDQEIGSSHKEE

SEQ ID NO: 126822 - protein, 108 aa, Glycine max
  Coding DNA Sequence Number=SeqID_35137
MKADMEAMKDQMAAMMEAMLSIKKIMESNAATVATTSIATEVDPTHPSSLNQFRTSMPSNYTPPNVVHTSDKNVKTPLPYSLRANNLNLIMCMSLNPWGRHMNYPTTI

SEQ ID NO: 126823 - protein, 203 aa, Glycine max
  Coding DNA Sequence Number=SeqID_35138
  Homolog annotation: Hit_ID=Q6WAY6; Match level="QueryCoverage=90%, HitCoverage=32%, E-value=7e-21, Identity=33%"; Hit description =Putative uncharacterized protein
MGSSRIPSLKRRFYQVKVKSLGITSLKELGQLMGQLQRKAFRKAYGKIWDIAMVEVSIEAIASLAQYYDQPLRCFTFGDFQLSPMVEEFEEILGCPQGGRKPYLFSGFYPLLARISKIVQISAQELDHRKQVENGVVGIPRKYLEAKARILAGKGEWAPFIDILTLLIFGGVLFPNVDGLVDLAAIDAFFAYHDHKEAPVVTS

SEQ ID NO: 126824 - protein, 46 aa, Glycine max
  Coding DNA Sequence Number=SeqID_35139
MASYGEAKGSIDEEDPRPTSSTWSYITLEVTDRILELHGGLAEGGW

SEQ ID NO: 126825 - protein, 118 aa, Glycine max
  Coding DNA Sequence Number=SeqID_35140
MQVLCIPGQDFTRAAANGRVWIMRTNMTTLTQIWMTLLLSNIPSSDRNTDLPLQKDRAHKAPSGPGEVQQGPGVFSSGYGPLDHARKTPSEPGEVQQGPGVSSSDYEPLSVLRSACHP

SEQ ID NO: 126826 - protein, 94 aa, Glycine max
  Coding DNA Sequence Number=SeqID_35141
MTTLLANRGLHALTLRGLCVLTFRGLHVLTFRGLHVLAIRGLRVLTFRGLHALAIRGLHVLALRGLLALALGTSYPHLQRTTCPHLRRATRPHL

SEQ ID NO: 126827 - protein, 81 aa, Glycine max
  Coding DNA Sequence Number=SeqID_35142
MDSGRFQVSVPGNNYPSVVVGDTEGPPKGFVGVYHQLLALQWHIRAKARSRLDCDGEFHVSPPRFKRHVHDQFGVAGSQWV

SEQ ID NO: 126828 - protein, 92 aa, Glycine max
  Coding DNA Sequence Number=SeqID_35143
LQVIPSVVRLMKQANVFPLKKILRKFIIWEINSDKGILKEDFQAFSRVPIINKDSGGHTLATSSTKTRMGLQTGQSNKDLTYSKELLSWRRP

SEQ ID NO: 126829 - protein, 104 aa, Glycine max
  Coding DNA Sequence Number=SeqID_35144
APVASVSISCPLPVQLLTGWCVTAKAPPDISAGKCSGPAARNPPHPAALNAPLQGASPFAIQAAQLLGRAIGAGLFAITPAGERGMCCKAIKLGNASVFPVTTL

SEQ ID NO: 126830 - protein, 111 aa, Glycine max
  Coding DNA Sequence Number=SeqID_35145
  Subcellular localization annotation: CTP_CleavageSite=40; ConfidenceScore=5.85e-01
MGSPPASTPPPPPPPPPSPHSPPPPSDASTSPSAMKWTRKASRLRSLSTRPPGAERPVVHVDLAIGVGNGPHKKKLRTYLGIVVRDKVDVTYENWKEVPTAQKDLIWEDIH

SEQ ID NO: 126831 - protein, 157 aa, Glycine max
  Coding DNA Sequence Number=SeqID_35146
  Gene Ontology: Mol. function=transcription factor activity; Cellular component=intracellular; Biological process=regulation of transcription, DNA-dependent
  Homolog annotation: Hit_ID=P03023; Match level="QueryCoverage=28%, HitCoverage=11%, E-value=5e-09, Identity=77%"; Hit description =Lactose operon repressor
  Subcellular localization annotation: CTP_CleavageSite=46; ConfidenceScore=5.28e-01
MKHFTDTLISANIVSQYTLPLAPNTQTASPRALADSLMQLARQVSRLESGQEQKLVPGPPSRSTVSISLIGPGRGGHPVRGPSRRGRQGLRRRDQEGRASAHPHRAGPHRRPWPDGHPQADRRGRGPAARARIEFLQPGGSTSSRAAATAVELQFAL

SEQ ID NO: 126832 - protein, 303 aa, Glycine max
  Coding DNA Sequence Number=SeqID_35147
HALRRLYQTRARARVMGEVEEVQEQMKADMEAMKEQMATMMEAMISMKKIMEANAVAVAATSVVAKVNPMPPSGLNQMNHPTSAMVGKDLGSIGDPYYVQIQNKYAFPPYGLPPNYTPPNVAYTLGEDVNNSAPILIESRQPHHAHVSQPMGDTHEMPYHNLADFEPCLGYATEGQAVGGIPCKHFGRALSITHNHNPHIPQRAIEGGKDYAFPNLEELFLVPNIITPPKFKVLDFDKYKGTTCPKNHPKIVSTILIWLRIGCNCKKCAKRGHKSFKEYAQKVEGSGGPGGTPNDGKGDDDRD

SEQ ID NO: 126833 - protein, 84 aa, Glycine max
  Coding DNA Sequence Number=SeqID_35148
VREEWLKSMSIDLEALACSELQNKERETQGSVNPGYQRNSIHCPALDPIRRIKPRLLCSPNGAQRASSSHGTNDFPGLAHNSHK

SEQ ID NO: 126834 - protein, 86 aa, Glycine max
  Coding DNA Sequence Number=SeqID_35149
MSKFFSFVAEYEVKSMEKEKFQQLSFLPPRCFFSSSPPPLLPPLKLQIPLHFYPKLQGKAIFGVLEPISTSWGFKFQKTGREDEES

SEQ ID NO: 126835 - protein, 238 aa, Glycine max
  Coding DNA Sequence Number=SeqID_35150
WLSELKIINEENFEAPEEDEEVRALKTELGKARLAKEKFKLVATDVRKECAELREENAATARALEQETKRARKEEHGRDKFRGALWGNNSELKLRREERDQSRAHSMVLKEELAVCSRSKRSLSRRLCETETNMLAIVSKYQEELNLATAHEHKVEDEYARVYTEKEAKGRVINSLHQEATMWMDRFALTMNGSQELPRLLAKAKAMADTYSAPEEIHGLLSYCQHMIDLMAHIIRNR

SEQ ID NO: 126836 - protein, 87 aa, Glycine max
  Coding DNA Sequence Number=SeqID_35151
QILAYGVVGSVLLRRPDCETAPNTRDRPADEDAADVPERRRPTASARRLRDVADMTDDVLEQAMEAPEMRRTHRVLIVVRGQMVMMC

SEQ ID NO: 126837 - protein, 295 aa, Glycine max
  Coding DNA Sequence Number=SeqID_35152
  Homolog annotation: Hit_ID=Q6WAY6; Match level="QueryCoverage=97%, HitCoverage=48%, E-value=8e-38, Identity=35%"; Hit description =Putative uncharacterized protein
MGPLQMQAFRKAYGKILDLSIAEISTEVVVSLTQYYDQPLRCFTFGDFQLVPIVEEFEEILRCPLGGRKPVSFLRVSSLLSKIAVVVRDSTRELDRVKQTQNGVVGLPQKYLEGKGRDMANQEEWVPFMGVLAVLIFGVVLFPNMDGLVDLASINAFLAYHHSKESPVVAILADLFDTFDRRCEKSSAQIICCLPALCVWLVSHLFQQDIRHPCPLRSHRSCVEKRRVDWHQHLARIEDRTINWFPRWKEGKEGVLFSCGGYLNILLIGTRGCINYNPALSIRQLGYPMRGAPTE

SEQ ID NO: 126838 - protein, 113 aa, Glycine max
  Coding DNA Sequence Number=SeqID_35153
GPSNWMARTRFTTTFRVDKNIIEVPLTYHRQWRPYYQTYVLLDYNGSKHFVRLRKYGTRYFFADGMKEFRRAHDINDSVIIRFFAASKDTSFDVDVMGPIHRQTRRRFFQQQL

SEQ ID NO: 126839 - protein, 20 aa, Glycine max
  Coding DNA Sequence Number=SeqID_35154
VESERENGNLVTHERLWSVN

SEQ ID NO: 126840 - protein, 157 aa, Glycine max
  Coding DNA Sequence Number=SeqID_35155
MTQELVARGDTLRLSAPRHSVTPSVIDEQRPIWSSAPFPEMSSFSDGDFSSLTNYPELRRSEFLIGGYAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 126841 - protein, 180 aa, Glycine max
  Coding DNA Sequence Number=SeqID_35156
MTQELVARGDTLRLSAPRHSVTPSVIDEQRPMWSSAPFPEMSASSDHSRVRWAAQRQNWVILHPCVIPRGRRGPMTRGDTLQLSAPFGHPEAAGPMTRGDTLRLSAPFCHPEAAGPMTRRDKIWSFCTLVSFRGGGPDDTRRYLTVIRTLLSSRGGGPDDTQRQNLVILHPCVIQRRRAR

SEQ ID NO: 126842 - protein, 91 aa, Glycine max
  Coding DNA Sequence Number=SeqID_35157
HLVRQQAANHWGQVQIHECLYQLSLSQQGQGFSPFACPTLDQFRTDVAWSGDWPEAQAEEAPAGAPGNAEEARMDEEMTDLLSFLGGSGAT

SEQ ID NO: 126843 - protein, 80 aa, Glycine max
  Coding DNA Sequence Number=SeqID_35158
MANNIINNRDSGELTLRTPHAKRHLLHALSELLFALSALTPDHWLYGPAKRSGLAKHVDALSAILLCLINFENGAKRVLS

SEQ ID NO: 126844 - protein, 63 aa, Glycine max
  Coding DNA Sequence Number=SeqID_35159
MEPEQPIQDSSATPALDLNEDQPQDEQDPLEQNEHVIGSMTKNVSQFVRLIVKECIDRIPVRV

SEQ ID NO: 126845 - protein, 73 aa, Glycine max
  Coding DNA Sequence Number=SeqID_35160
  Subcellular localization annotation: CTP_CleavageSite=67; ConfidenceScore=5.04e-01
MFLQKAVASGGSNLPRLGELGGKLLPYFPINRGRSEENPSLGASVTFPWVISRRFSTVLRRSSFALRRSSVFN

SEQ ID NO: 126846 - protein, 165 aa, Glycine max
  Coding DNA Sequence Number=SeqID_35161
MSALKDQMASMMEAMLKIQKSIEDNAREAEPVLQPAMNSGWDRSATDFTPRTAPDDLSQAPTFEGQLPPHADYHLEEDDEGDAHLGPLLPPRESTPHELPQPNIIRHAPSQSAPVKEPIPISKDKGKIDLLEERLRAVEGLGNYPFSDLVDMCLVPDIIIPPKFK

SEQ ID NO: 126847 - protein, 163 aa, Glycine max
  Coding DNA Sequence Number=SeqID_35162
MDNEEGVQEQMKADLSALKDQMASISEVMLKLQKTIEDKATATASSTVREAEPVLQPALNPGLDRNTAVFGRRYSPQAYPYGLPPDFTPRATPEDLSQAPTFEGQLPPYEDYPGQDDGEGDTHLGPLLHLKDPSPHELPQPNIVRHIPASPTPVKRICSLCGR

SEQ ID NO: 126848 - protein, 69 aa, Glycine max
  Coding DNA Sequence Number=SeqID_35163
MGFPLLAVTYLAENLSGLKAKVQKSLRLCLNGGFDRGSPILISGAKQIGVSRCRSRAKLPYYSTRHAQQ

SEQ ID NO: 126849 - protein, 252 aa, Glycine max
  Coding DNA Sequence Number=SeqID_35164
  Homolog annotation: Hit_ID=UPI000065F7CF; Match level="QueryCoverage =55%, HitCoverage=17%, E-value=2e-07, Identity=31%"; Hit description =Homolog of Homo sapiens "Leucine-rich repeats and IQ motif containing 1
RTTRRHLQRTTHPRLQRATRPCLQSARGYALTFRGLHILPFRRLHVLAFRGLHALAFRGLHVLPFRGLHVLTFRGHTCPRFHRTTCPPLQWSTRPHLQGLHILAFIRGLHVPHLHRGLHPRLQRATHPPLQRTTRPHQRATRLPFRGLHVLAIRGLHVLAFRGLHALTFRRLQVLAFKGLHTLAFRGVHALAFRGLHVLTFRGLQRTTCPLLQWSTRPHLSRTTHPRLQRTTHPRLQRATHRHLQRTTRPHL

SEQ ID NO: 126850 - protein, 150 aa, Glycine max
  Coding DNA Sequence Number=SeqID_35165
  Subcellular localization annotation: CTP_CleavageSite=48; ConfidenceScore=5.12e-01
AKCALCAKLRVILAKRESAALSPRMASKKRKSLASSSTQARFDRSRFHSQEAWERYTDIIVPRKLLLESNVEFYANLYDPEDKSLKQVRVRGHLIKFDEDTLNTFLKPPVILEEGENLYAYSRFALLRPDPQELAAKLCIPGRGFELNAD

SEQ ID NO: 126851 - protein, 74 aa, Glycine max
  Coding DNA Sequence Number=SeqID_35166
MALEWWSQMKHPVPVGVPRLIRMAVEWRRKRERRCHFKEKMSLEEAHHHRRPWIRAWRKKEMNEGRGREEHKIL

SEQ ID NO: 126852 - protein, 173 aa, Glycine max
  Coding DNA Sequence Number=SeqID_35167
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=73%, E-value=9e-25, Identity=68%"; Hit description=LacZ protein
  Pfam annotation: Domain name=RuvB_C; Domain location=1-55; Score =71.3; E_value=3.1e-18; Accession=PF05491.4; Description=Holliday junction DNA helicase ruvB C-terminus
MDNKILTTIIDKFKGGPVGLSTLATAVSESSETIEEVYEPFLIQEGFIMRTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 126853 - protein, 106 aa, Glycine max
  Coding DNA Sequence Number=SeqID_35168
  Homolog annotation: Hit_ID=A6ZKI8; Match level="QueryCoverage=93%, HitCoverage=82%, E-value=3e-07, Identity=28%"; Hit description =Conserved protein
  Subcellular localization annotation: CTP_CleavageSite=26; ConfidenceScore=5.36e-01
TYQGNPCGVYPDLSSFTGSGVYPDLSSFTGSGVYLNLSSFTGSGVYLDLSSFTGSGVYPDLSSFTGSGVYPDLSSFTGSGVYPDLSSFTGSGVIQTFVACIKRSAP

SEQ ID NO: 126854 - protein, 57 aa, Glycine max
  Coding DNA Sequence Number=SeqID_35169
MLQEPPPTPELKPLQATLKYAYLEDKEKFPVIISASFAAEQEEKLLLVLKKHKKAIG

SEQ ID NO: 126855 - protein, 176 aa, Glycine max
  Coding DNA Sequence Number=SeqID_35170
LRVRYHAETNIVICTLCQPGASEPVDTQRLTSSFAALSSRDGESGDMRRYPSGASKPVDMQTLTSSSAPLSSRDGESGDMRTYPSGYPYKMISVNPDPRSQVAGGDTQVVIRTKRFLLILTREVRWQAEIPKCEPVDMQRLTSSSAPLSSRDGESDDMRRYPSGFPYKPTSVNLDP

SEQ ID NO: 126856 - protein, 104 aa, Glycine max
  Coding DNA Sequence Number=SeqID_35171
MDNEEGVQEQMKADLSALKDQMASITDAMLKLQKTIEDNATATASNAVREAEPVLQPAINLGRDRNTTVFGRRTCRKTKKNVDAQSVSFRDTSEIKWKHRCIIK

SEQ ID NO: 126857 - protein, 178 aa, Glycine max
  Coding DNA Sequence Number=SeqID_35172
  Homolog annotation: Hit_ID=Q2HTA0; Match level="QueryCoverage=89%, HitCoverage=23%, E-value=5e-21, Identity=38%"; Hit description=IMP dehydrogenase/GMP reductase, related
ALLTELLEVTPDEATVETRQAARAYLLHLVGCTLFANKSATHVHVVHLQAFRDLAQAGTFSWGAVALVHSYDQLNEASQAPTRQMAGYISLLRVTIAASLSISPQMTGIKGAPYRARIDALTVTDVCWMPYAEHRGVRGYDLISSYMGQVRWGPIIVYLRLERVVRKMGYIQTVPPPP

SEQ ID NO: 126858 - protein, 76 aa, Glycine max
  Coding DNA Sequence Number=SeqID_35173
MGSQLQGHNEDNNCTSKPYAGAMRDIVHERQVNIGADQKLIKRQTAPLSSLQNGQVTKSNRTYTLREFPERFAKIG

SEQ ID NO: 126859 - protein, 279 aa, Glycine max
  Coding DNA Sequence Number=SeqID_35174
  Homolog annotation: Hit_ID=Q6UUU1; Match level="QueryCoverage=25%, HitCoverage=46%, E-value=2e-18, Identity=71%"; Hit description =Putative uncharacterized protein
LPGINRDTRIYLFCEVISVTGIYSAQSASAVPPVQLLTGWCVTAKAPPDISAGKCSGHAARRVPFAIQAAQLLGRAIGAGLFAITPAGERGMCCKAIKLGNARVFPEFDVQWLMPVMPALWESQLPGRLRQENGVNLGAEVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGARFPGRCQEDT

SEQ ID NO: 126860 - protein, 285 aa, Glycine max
  Coding DNA Sequence Number=SeqID_35175
MALALAPVRRLTSEMRIGSVPHQPAIDHQILAGHRTRPRAGEEQRGIGELGRRCDAAQRRVGGDVVEHRFGRGGAGIGGAQQATGQHVHGDAMRAEVAGQGAGQRQQCGLGGGVVVVGHDRVLEQVGADVDHPAEATGLHAGQGRLHGVQRAAHAALELCLEGGPTDGGGTVAGITIERERCECVVDHRGDALAEVGQGVLQHRIDLAAISDVGRQCDRLSAQLGGQRPSGAFAVVVVDDDARTLCSERAGDVLAKSASATGDQHQLFADLHEGAAIHCMKGHAA

SEQ ID NO: 126861 - protein, 99 aa, Glycine max
  Coding DNA Sequence Number=SeqID_35176
MVVTARPERVVRQFGYIQSIPPPPWFFRISHPFMIPIQVGDQPRDALAADPEEYIQPSSPQVPVTFDPPRHAVDCLTIARGGASADGSVRARQRRRREY

SEQ ID NO: 126862 - protein, 202 aa, Glycine max
  Coding DNA Sequence Number=SeqID_35177
  Gene Ontology: Mol. function=nucleotide binding; Biological process =defense response
  Homolog annotation: Hit_ID=A7QXA5; Match level="QueryCoverage=52%, HitCoverage=52%, E-value=9e-11, Identity=36%"; Hit description =Chromosome undetermined scaffold_217, whole genome shotgun sequence
  Subcellular localization annotation: CTP_CleavageSite=40; ConfidenceScore=5.46e-01
MTTPPPSPTQSEIPSDGTSRKTRQATRLRRLTARTLEQARATVSVNPATGRGSGPHKDQFHSYLGVVARDKIPIVHASWNDVPETLKNMIWDDILAKFDIPEGDNAKKKVMSTVATRWRQFKSALTTKYVYGNTDGQAKDDPLVKYGINEKDWAEFEKMRQTPTWQLTNAHFLISRGYGKRHKKFKSTMTLRTCCLGEAMSC

SEQ ID NO: 126863 - protein, 203 aa, Glycine max
  Coding DNA Sequence Number=SeqID_35178
  Homolog annotation: Hit_ID=Q6WAY6; Match level="QueryCoverage=42%, HitCoverage=15%, E-value=1e-14, Identity=46%"; Hit description =Putative uncharacterized protein
INAFLAYHDHKESPVVAMLADLYDTFDRRCEKSNQLLANKEGASVNWFPQWKEGRVGVLISCGGFQNVPLMGTRGCISYNPVLAIRQFGYPMRGAPLEDELAPVISQGFNKTNVETLQKVRKAWEVLQKKDKELRGSNNGPIGGYRKTAKREEVEAPEEDEEVQALRAELEQARTVKERARREEHGRNKFRGALWGSNSELKL

SEQ ID NO: 126864 - protein, 290 aa, Glycine max
  Coding DNA Sequence Number=SeqID_35179
  Gene Ontology: Mol. function=helicase activity; Biological process =protein amino acid phosphorylation
  Homolog annotation: Hit_ID=Q7XD08; Match level="QueryCoverage=99%, HitCoverage=26%, E-value=6e-53, Identity=40%"; Hit description =Putative uncharacterized protein
  Pfam annotation: Domain name=DUF889; Domain location=34-204; Score =147.8; E_value=3e-41; Accession=PF05970.5; Description=Eukaryotic protein of unknown function (DUF889)
MAHKFCFEALDQSLRDIITNKSNSNQIFGGKVIVFGGDFRQILPVIPRGTCSNIVNAAINSSYLWDLCEILTLTKNMRLHSNLESIDEQETATFAKWILDIADGIIGDENDGYDTIQVPAHLLITRYDDPISAIVKSTFPDLDQHHNNPEFFKSKAILASTNETVEQINHYVLSFIPAEIISGKNIGLAVYIPRMSMSPSQSPWLFKLLRRQFPIMLSYAMTINKSQGQSLSMVGLYFPKPVFTHGQLYVALSRVNSAKGLKILIHDDEQKSMNSTTNVVFKEVFRNIKR

SEQ ID NO: 126865 - protein, 223 aa, Glycine max
  Coding DNA Sequence Number=SeqID_35180
  Gene Ontology: Mol. function=UDP-N-acetylmuramoylalanine-D-glutamate ligase activity; Cellular component=cytoplasm; Biological process =peptidoglycan-based cell wall biogenesis
  Homolog annotation: Hit_ID=A8UJY0; Match level="QueryCoverage=60%, HitCoverage=30%, E-value=8e-41, Identity=63%"; Hit description=UDP-N- acetylmuramoylalanine--D-glutamate ligase
MVGAVIGFFWYNTYPAQVFMGDTGSLMLGGVIAVLAIILRKELMIPVLCGIFLVENISVMLQDDYHRSNVGYSMSDYIKNEIKLYKRGGESGCGAAYLAKKKGLEVFLSDKGTIKDNYKAFLTENNIEFEEGNHDEERILNADWIVKSPGIPKKADIIYKIHLKGIRLSSEIEFASEFTNAKIIAITGSNGKTTTTSLIYYILKNDGLKVGLGGNIGYSFAKQ

SEQ ID NO: 126866 - protein, 138 aa, Glycine max
  Coding DNA Sequence Number=SeqID_35181
MGEVEEVQEQMKADMKALKEQMATMMEAMMSLKEIMEVNVAAIAATSTIAEVDLTSPIWLQPNKSSNLRYGRSRRQRVGRYRRPSFSAKNKHVFPPYGLLPNYAPPNVAYTPSEDVDNSVSHTLLKPNNLNLIMHMSL

SEQ ID NO: 126867 - protein, 48 aa, Glycine max
  Coding DNA Sequence Number=SeqID_35182
MKMLLIPHDMNGNRMEKEEREEMPLQGQDESRRSSPPYEAIDKSLEEE

SEQ ID NO: 126868 - protein, 240 aa, Glycine max
  Coding DNA Sequence Number=SeqID_35183
  Homolog annotation: Hit_ID=A5B939; Match level="QueryCoverage=20%, HitCoverage=42%, E-value=2e-12, Identity=58%"; Hit description =Putative uncharacterized protein
RCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNQARVNGGSNYDSLK

SEQ ID NO: 126869 - protein, 182 aa, Glycine max
  Coding DNA Sequence Number=SeqID_35184
MRERDRRKSLAFFLRDLGTQVSVIQRVHKAWRSPLRKNKKLRGIRNGVIGGYHGWLRVHTRGLDWLSKLKVINEENFEALEEDEEVQALKLELGKATLAKEKFKSAATHIRKECTELQEENAATARALEQETKRARKEEHGRNNSEDSMLGSNNELNTWKHGAKHASYHRAIQGRVEPVCGP

SEQ ID NO: 126870 - protein, 100 aa, Glycine max
  Coding DNA Sequence Number=SeqID_35185
MKREKHASYSSHNSCKSLSEQLRDYYEGRHRSHLRPHSHRRVKERKPHEANIKLAYFHGKDNVEANLDWEIRVEQQLKKKTHYFSMSHHKNHDYEGPRHL

SEQ ID NO: 126871 - protein, 73 aa, Glycine max
  Coding DNA Sequence Number=SeqID_35186
MVAKPKGIEEQWGISGKNGNIGSKGLSKELIQGRLIWLEACKNKMPKSSPNMHLKQEVSIRVKPRLLCKQSMG

SEQ ID NO: 126872 - protein, 190 aa, Glycine max
  Coding DNA Sequence Number=SeqID_35187
MTQELLAREDTLRLSAPRHSVTPSLIDEQRPIWSSAPFPEMSAFSDGDFSSLTSYLELQAAGPMIRGDTLRLSAPLCHPEAAGPMIRGDTLRLSAPFCHPEAAGPMTSRDKIWSFCTLVSSRGGGPDDTRRYLTVIRTLVSSRGGGPDDTRRYLTVIRTLVSSRGGGPDDKQRQNLVILHPCVIQRRRAR

SEQ ID NO: 126873 - protein, 70 aa, Glycine max
  Coding DNA Sequence Number=SeqID_35188
MELQRLNQNEEIDKKKRSIAFKAYSSTQEENEEEESENEEDFSLFVKKFKKFVKKRRIERSQNFNNGKKI

SEQ ID NO: 126874 - protein, 66 aa, Glycine max
  Coding DNA Sequence Number=SeqID_35189
  Subcellular localization annotation: CTP_CleavageSite=59; ConfidenceScore=5.14e-01
MRWISPPQQQQLVPPFQNTAGPSKPYVPPPIQQQQQQQSQQKQQAIEVPPQPSLEELVRQMTIQNM

SEQ ID NO: 126875 - protein, 228 aa, Glycine max
  Coding DNA Sequence Number=SeqID_35190
MSPFLVRDFGTQNFKAIQRIHKAWETLLRKDKELRGIHNGIIGGYHEWLKVHTRGLDWLPKLKVVSEESFEAPEEDEEVQALKNELGKARLAKEKFKLAATDIRKECAGLREENATTARALEQETKRARKEEYGRNKFRRALWGSNSELKLQREERDQSRAHGMVLKEELVACSRSKRNLSQRLCETETNMLAIIAKYQEELSLAMAHEHRVADEYAQVYADKEARGR

SEQ ID NO: 126876 - protein, 140 aa, Glycine max
  Coding DNA Sequence Number=SeqID_35191
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MKHFTDTLISANIGGGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 126877 - protein, 64 aa, Glycine max
  Coding DNA Sequence Number=SeqID_35192
MEVEETYQGLWLPLNYRVDMRASLAYDIEIWGESYRLFAAKFFFGFVVDLGMAFVDNWVVGKEK

SEQ ID NO: 126878 - protein, 186 aa, Glycine max
  Coding DNA Sequence Number=SeqID_35193
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MTMITPSSKLTLTKGNKSWYRAPPRGNAPAFIDELRGSGGGGDVSVAHCWPSPGPCGASPYACLGAHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 126879 - protein, 124 aa, Glycine max
  Coding DNA Sequence Number=SeqID_35194
LRDDHGDDGRLRLVGRKLGDGKTSGQRLGRIAALRGHAGICTVGAEFQPVALSDDRRAAAHRGDAVSPSSASLSAAAFLPGAGWRSGGYLSEFSRHLTASRNDNITQRRDSSGNNQWGCTAEEV

SEQ ID NO: 126880 - protein, 225 aa, Glycine max
  Coding DNA Sequence Number=SeqID_35195
  Gene Ontology: Mol. function=N-acetylmuramoyl-L-alanine amidase activity; Biological process=peptidoglycan catabolic process
  Homolog annotation: Hit_ID=A4W531; Match level="QueryCoverage=94%, HitCoverage=67%, E-value=1e-110, Identity=94%"; Hit description =Putative uncharacterized protein precursor
  Pfam annotation: Domain name=Polysacc_deac_2; Domain location=22-225; Score=367.2; E_value=2.7e-107; Accession=PF04748.4; Description =Divergent polysaccharide deacetylase
MVLSVVSALALAAPVYAGKLAIVIDDFGYRPHYENQVLAMPPAISVAVLPNAPHAREMATKAHNSGHQVLIHLPMAPLSKQPLEKDTLRPDMSSDEIERIIRDAYNNVPYAVGLNNHMGSAMTSSLYGMLKVMQALERYNLYFLDSMTIGNSQAMRAAQGTGVKVIKRKVFLDDTQNEADIRAQFNRAVQLARRNGSAIAIGHPHPSTVRVLQQMLPTLPPDITL

SEQ ID NO: 126881 - protein, 161 aa, Glycine max
  Coding DNA Sequence Number=SeqID_35196
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=72%, E-value=2e-24, Identity=70%"; Hit description=LacZ protein
  Subcellular localization annotation: CTP_CleavageSite=55; ConfidenceScore=5.17e-01
MKHFTDTLISANINVNGSTQSSTPKRSQQEQLQHWQISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 126882 - protein, 275 aa, Glycine max
  Coding DNA Sequence Number=SeqID_35197
  Gene Ontology: Mol. function=nucleic acid binding; Cellular component= cytosol; Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDGYANANNVQVQTAYKCACILRDMISPYLLRRMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 126883 - protein, 132 aa, Glycine max
  Coding DNA Sequence Number=SeqID_35198
MSHHSSSGNGKGTSHKDPLSRILDELSSLKLWKEKIERKEKGKERVEINQDEREQIREEERGKILKELRKEKHASYCSLDFCKSLSEELRDYYEGRHRSHLRPHSHSREKERKPQEANINLPYFHGKDNVEP

SEQ ID NO: 126884 - protein, 96 aa, Glycine max
  Coding DNA Sequence Number=SeqID_35199
MIHNCRNVPFASERGRGSRVRFPKEERCAESPPTFICEKHRENRRKPVEMKILSSGVVFTLEEGEELANQLAQASKVASSRSNRLLEEETGRPKWA

SEQ ID NO: 126885 - protein, 99 aa, Glycine max
  Coding DNA Sequence Number=SeqID_35200
RVPFAIQAAQLLGRAIGAGLFAITPAGERGMCCKAIKLGNARVFPVTTLANWSSTAVAAALELVDPPGCRNSMPWEAKTRESIEPLGRLRSGDPLSPRV

SEQ ID NO: 126886 - protein, 257 aa, Glycine max
  Coding DNA Sequence Number=SeqID_35201
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSVTGEFESLIHLTFIMRRIMRYVRSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 126887 - protein, 99 aa, Glycine max
  Coding DNA Sequence Number=SeqID_35202
MKMQASNTHAAESTQVLKARRVQRFGCKEVILLSWVMENLSLTVNHLIQPYFNLLSENQLRGKLPGSHIINKTSKRVELRPQKETTPEYLAFHRFKQKT

SEQ ID NO: 126888 - protein, 57 aa, Glycine max
  Coding DNA Sequence Number=SeqID_35203
FCTPSPLGFERRYSRREKKESHQDSTSGGFNPFSVSLTIGNSIGVVREKNRVISRYC

SEQ ID NO: 126889 - protein, 139 aa, Glycine max
  Coding DNA Sequence Number=SeqID_35204
MIGPLDESISCFLIRVDPWVLVPITLRGLHVLAIRGLHVLNLRGLHVLAIRGPHVLALRGLPALTSRGLHVLALRGLHTLTLEGYTPSPWVLVTLTVERTTRPRLERTTCPHHQRAARPYLQRTTGPRLERATRPHLGY

SEQ ID NO: 126890 - protein, 161 aa, Glycine max
  Coding DNA Sequence Number=SeqID_35205
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=Q8FJN1; Match level="QueryCoverage=100%, HitCoverage=25%, E-value=1e-61, Identity=67%"; Hit description =Probable ATP-dependent helicase dinG
MALTAAIKSQIAQWYKALQQQVPDFIPRAPQRQMIAEVAKSLAGDEGRHLAIEAPTGVGKTLSYLIPGIADQIFSKDLPLLKKIIPDLTFTAAFGRGRYVCPRNLTALAATDDQQGDLLLYLDEQAVIGSKEEQKFCARLEKDLSSYKWDGLRDHSDVAID

SEQ ID NO: 126891 - protein, 114 aa, Glycine max
  Coding DNA Sequence Number=SeqID_35206
MAQPPPRERTRREMVTPDFTYESLCIQYHDEDVPYVLKTGLIHLLPKFHGLAGLSNMERRMIDAASGGALGDMTPAEARNLIEKMASNSQQFSARSDAIVIRGVHEVATNSSHQ

SEQ ID NO: 126892 - protein, 139 aa, Glycine max
  Coding DNA Sequence Number=SeqID_35207
  Homolog annotation: Hit_ID=A2Q6B4; Match level="QueryCoverage=64%, HitCoverage=36%, E-value=9e-09, Identity=33%"; Hit description =Ribosomal protein L33; Nucleic acid-binding, OB-fold
MDLKEGCTYVMHNFKVTKNDGQYRVCDHPYKLTFIGVTVVRQYGLDGLPLKKYRFVDFSDIIVGQLQFDLLVDIIGVVDEVVFHHISPRSKRVVFKLMNLRLSELGIEIRSVLTRRSQWSSQPSGSVQLSSRETFISKS

SEQ ID NO: 126893 - protein, 146 aa, Glycine max
  Coding DNA Sequence Number=SeqID_35208
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSGPAFRFTGVIPLYGRVCLITLTLSS

SEQ ID NO: 126894 - protein, 83 aa, Glycine max
  Coding DNA Sequence Number=SeqID_35209
MGVCGQAMTKRPWEVKEERAVYYLSKQVRRPAIKGSALADYLAQQPLNDYQPMLRNSRMSGSWPFEERRSRGNLSTGHGSFVP

SEQ ID NO: 126895 - protein, 75 aa, Glycine max
  Coding DNA Sequence Number=SeqID_35210
MAVVSHLYLPLNPHTKKNTLIGVEFSESSSKIRWRKSLNPPFHSFSKRLALDRQVRMRERPLSDAKKNWQRAHDR

SEQ ID NO: 126896 - protein, 297 aa, Glycine max
  Coding DNA Sequence Number=SeqID_35211
MAPRKLSMKRSRKDAAAEGTSAAPEFDSHHFRSAEHQQRFEAIKGWSFHRERRVQLRDDEYTDFQEEIARRRWTSLVTPMAKFDPDIVLEFYANAWPTKEGVRDLRSWVKGQWIPFDTDVLSQFLGYPLVLEEGQECEYGQDFARTAAGRRVRIMRTNMTTLTQTWMTLLLSNILPRDHNSDLPLPKCQLVYAILTRMSVHVAQLIVDAIYLFAGMPPTRHPLDPDKSNWALGFPALITGLCQSFRVPVTPSKVIRSPITRAFTEKYCTPRQAQGGDPQALEAPSPPHQADQAGSFD

SEQ ID NO: 126897 - protein, 190 aa, Glycine max
  Coding DNA Sequence Number=SeqID_35212
  Homolog annotation: Hit_ID=A0PAV3; Match level="QueryCoverage=20%, HitCoverage=17%, E-value=9e-07, Identity=76%"; Hit description =Restriction endonuclease
  Pfam annotation: Domain name=Ins_element1; Domain location=43-116; Score=-27.4; E_value=0.066; Accession=PF03811.4; Description =Insertion element protein
MVKVGTSYVPINVSFSPKVGPGLPGINRDTRIYLFCEVIFRHSCPSCSATDGVVRNGKSTPDISAGKCSGHAARRVPFAIQAAQLLGRAIGAGLFAITPAGERGMCCKAIKLGNARVFPVTTLANWSSTAVAAALELVDPPGCRNSIGAPNKTALGNEFMGLRRKVENGELANSARQSIRGAKDSLVEDA

SEQ ID NO: 126898 - protein, 275 aa, Glycine max
  Coding DNA Sequence Number=SeqID_35213
  Homolog annotation: Hit_ID=Q6WAY6; Match level="QueryCoverage=98%, HitCoverage=58%, E-value=3e-27, Identity=28%"; Hit description =Putative uncharacterized protein
QLQRQAFHKAYSKIWDLAMVEVSAEAIASLAQYYDQPLRCFTFGDFQLSPMVEEFEEILGCPLGGRKPYLFSGFYPSLARISKIVQISVQELDHRKQVENGVVGIPRKWLEAKAIILAGGGEWAPFINILALLIFGGVLFPNVDGLVDLAAIDAFLAYHDRKESPVVAILADLYDTFDRRCEKSRFPNVPFMGTRGCISYNLVLAIRQLGYPMRGAPLEEELAPVISRGFNKTNMETLHKVCKAWEVVQKKDKELRGSNNGPIGGYRKWLKAHVQ

SEQ ID NO: 126899 - protein, 234 aa, Glycine max
  Coding DNA Sequence Number=SeqID_35214
  Subcellular localization annotation: CTP_CleavageSite=66; ConfidenceScore=5.05e-01
MTLLLSNILPSDRNANLPLQKYQLVCVVPTWVSMHMVQLISSVQSCGCGMTGPALQRIHVLEKPSRAAALPPEATCGLFSLERCLPPPGQVTLTVHRPQDPRGPEEVQQGRLGGTRSNLRVVTFISSTEYLYLQQGHQPPTNRAFIKKYCAPRQASKGETPQQHWMPVAGNDTCPTSRGGHALTFRGLHVLAIIGLHSLAFERRHVLNFRGLHALDFRGLRVLTFSGLHIHTLR

SEQ ID NO: 126900 - protein, 88 aa, Glycine max
  Coding DNA Sequence Number=SeqID_35215
MEVRDKVELLPYRDLDELVQLCIRMEQQLKIKPSSKSYGFHSYPRKDQAQGILGATPSKPKDDKVEVKMKQGVKSLVRKSTPMKKVTS

SEQ ID NO: 126901 - protein, 41 aa, Glycine max
  Coding DNA Sequence Number=SeqID_35216
MEENVEEAWTGPPSRLDFGIDKLDRSDDRLPVHDVIDYTKD

SEQ ID NO: 126902 - protein, 211 aa, Glycine max
  Coding DNA Sequence Number=SeqID_35217
  Homolog annotation: Hit_ID=Q5XM22; Match level="QueryCoverage=47%, HitCoverage=71%, E-value=1e-15, Identity=39%"; Hit description =Resistance-like protein HAAS-2
CTLFANKSVTHVHVVFLDAFCDLNQAGSYSWGAAALVHMYENLNDASKRNIKQLAGYITLLQCWIYEHFPTIAPCIAAKDYHERKSRACHWKFGKALPVSTYRKRLDRLTSDVLGDPPRHPPVVHNDTFIEPDPSQQVVVALAMPKPPADELADVDMPRHALACHEIVERLEGLINLRVVTKGTEAYTVTEECLRIARGVTAQGNVYVRSR

SEQ ID NO: 126903 - protein, 91 aa, Glycine max
  Coding DNA Sequence Number=SeqID_35218
  Subcellular localization annotation: CTP_CleavageSite=83; ConfidenceScore=5.60e-01
LSSWAKCTSTAKRSFSALSATEESSKASISRLCAKRKISALSAAVVFSQAQRMTGVKLKSTYGTEFHSSHNAHFGKRALEAARGAALVEIP

SEQ ID NO: 126904 - protein, 154 aa, Glycine max
  Coding DNA Sequence Number=SeqID_35219
MKQANVFPLKKTLKKFIIWEINSDKGILKEDFQASSRVLIINKDSGGRTLVTMSNHKSTESALKNLEVQVGQLAKQIADKSSNNFVANTEKNPKEECKAVMTRSKRFVEAEDEESVVHKKKAAKKKGTEGKKNDVRGESNQEKEKQIMVKKKRI

SEQ ID NO: 126905 - protein, 108 aa, Glycine max
  Coding DNA Sequence Number=SeqID_35220
  Homolog annotation: Hit_ID=Q51617; Match level="QueryCoverage=37%, HitCoverage=57%, E-value=3e-14, Identity=95%"; Hit description =Putative uncharacterized protein
MTVKTSDTCSSRRRSQLVCKRMPGADKPVRARQRVLAGVGGWLNYAASEQIMRKEKIPHQAPFAIQAAQLLGRAIGAGLFAITPAGERGMCCKAIKLGNARVFPVTTL

SEQ ID NO: 126906 - protein, 50 aa, Glycine max
  Coding DNA Sequence Number=SeqID_35221
MASMDTSAMVNSKIFPVFAPCPLFKGPIRGELTRHLVITPQGSRISLDGF

SEQ ID NO: 126907 - protein, 228 aa, Glycine max
  Coding DNA Sequence Number=SeqID_35222
MHTGARFHPCRCKETSADHAHQHDHSYTDIDDVAIVSNILPSDQEVQQGAWGQTLVTGLCQSYSAVPPSRSCHRDIGKDRAHKTPSGPEEVQQGPGVSSSGYGPLSVLQGAHSPSKESHPQRHPVDPEKSNRALGFPALVTGLCSPTGCPFPPARSRHHYIGIVAARHLVDPKKSNRVLELPSSNYVPLSVLRSACRPQQGHQAPYSSSFHQEVLRRQAGAGRNTTAA

SEQ ID NO: 126908 - protein, 145 aa, Glycine max
  Coding DNA Sequence Number=SeqID_35223
MVVSDHAILSDRAHIPTKRSLLELSSQDALLAQNKLLPKKLEALTETLSCAICGGAHEFGYCISTKDTTHEGQWRTHPSNQFNKDQGGPSNRPQQQGPSLYDKTTKLEETLAQFMQLSMSNQKSTKPAIMNLEVQVGQLAKQLAD

SEQ ID NO: 126909 - protein, 290 aa, Glycine max
  Coding DNA Sequence Number=SeqID_35224
  Homolog annotation: Hit_ID=Q652R5; Match level="QueryCoverage=29%, HitCoverage=34%, E-value=8e-16, Identity=54%"; Hit description =Putative uncharacterized protein P0603C10.50
MCKCRSHGTFPLFGLQSSHLNICYYHQDLHRRPLRPGSRPGFCSDRRALLLIGAWSLPRRPGRGRCAPDASNHWLYPIELAPRAPAILRETFGGNQLLDGSISLSPLYPSQTNDLHVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGIL

SEQ ID NO: 126910 - protein, 189 aa, Glycine max
  Coding DNA Sequence Number=SeqID_35225
MTGRLLAGSLAFESRILHYLIVRILLLRSSNLAQVSEEDLIVMWAFHKGLKIDWAHFVRYRMHKALRLNAPLPYPHLVTLFLQQFNIPLDYEPYVPIKRSFLIGASVIASFGYQKEHDEGHDGEDSSLLLKILDRFDGLQTFVGEKFDTLELQVDMRFNEMESRITKVEEDMSYIRSSFDLPPSPPPSS

SEQ ID NO: 126911 - protein, 99 aa, Glycine max
  Coding DNA Sequence Number=SeqID_35226
MRAYNVQAQLEREASRSYYAYRGKISPCPAKRQVWIMRTNMTTFTQIWMTLLLSNVLPNDRNVDLPLRKDRGYKTPSGPGEIHSPGVSSSGYGLYQSYR

SEQ ID NO: 126912 - protein, 17 aa, Glycine max
  Coding DNA Sequence Number=SeqID_35227
FSKGEDFESSEDEDFVN

SEQ ID NO: 126913 - protein, 142 aa, Glycine max
  Coding DNA Sequence Number=SeqID_35228
  Gene Ontology: Mol. function=deoxyribodipyrimidine photo-lyase activity; Biological process=DNA repair
  Homolog annotation: Hit_ID=Q8I0W8; Match level="QueryCoverage=57%, HitCoverage=8%, E-value=5e-09, Identity=34%"; Hit description =Deoxyribodipyrimidine photolyase (Photoreactivating enzyme, DNA photolyase), putative
  Subcellular localization annotation: CTP_CleavageSite=51; ConfidenceScore=5.18e-01
MSSLQRATRPHLGTSYPHRERTTRPRHQRAARPHLERTTLTLTVERTTRPRLERTTCPHLQRATCPRLERTTCPHLQRATSPRHQRTSCPHHQRAACPHLQRTTCPHLERATCPRHQRATCPRHQRSSCPRHQRATRPHLGY

SEQ ID NO: 126914 - protein, 98 aa, Glycine max
  Coding DNA Sequence Number=SeqID_35229
MGIAPKRHPVDPEKSNRALGFPALVTGLCQSYRVLVPPQQGHIIIALITGLCQFYGVPVTSSKGIRPPTNRAFIKKYCVPGRRRAKHHSSIGMADSGQ

SEQ ID NO: 126915 - protein, 138 aa, Glycine max
  Coding DNA Sequence Number=SeqID_35230
  Gene Ontology: Mol. function=succinate dehydrogenase activity; Cellular component=plasma membrane; Biological process=anaerobic respiration
  Homolog annotation: Hit_ID=P00363; Match level="QueryCoverage=82%, HitCoverage=18%, E-value=3e-61, Identity=98%"; Hit description =Fumarate reductase flavoprotein subunit
MNMMEGTLVQIRANAVVMATGGAGRVYRYNTNGGIVTGDGMGMALSHGVPLRDMEFVQYHPTGLPGSGILMTEGCRGEGGILVNKNGYRYLQDYGMGPETPLGEPKNKYMEARPARQSSPRPSGTSGVKATPSPRRAA

SEQ ID NO: 126916 - protein, 114 aa, Glycine max
  Coding DNA Sequence Number=SeqID_35231
MSARDISLEVRILVFPELDTPLPMERPSLDGLEALLVLDTPKTLHLLRYCLHGGGIVLRRRDGVLCGGSVVLCLYDGDFRGGGAVLRCRDGALLSGFCVSVAEVQNSKSQDRIK

SEQ ID NO: 126917 - protein, 273 aa, Glycine max
  Coding DNA Sequence Number=SeqID_35232
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDIHLEGKTLQWHTAFMKFVHSFPLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 126918 - protein, 67 aa, Glycine max; identical to SEQ ID NO: 103795
  Coding DNA Sequence Number=SeqID_35233

SEQ ID NO: 126919 - protein, 253 aa, Glycine max
  Coding DNA Sequence Number=SeqID_35234
MDNEEGVQEQMKADLSTFKDQMASITEAMLKLQKTIEDNATATASNTAREAEPVLQPTINLGRDRNTTVFGRRYSPQAYPYGLPLDFTPRTAPDDLNQAPTFEGQLPPYADYPLQEDDEEDARLGPLLPLKDPAPHELPQPNIVRHVPSPPAPVKESVPFAKDKGKIDLLEERLRAVEGLGNYPFSDLADLCLGRHVQKDIFGCIAERWGIFYGRKVVDAFLSRQLSRSSSAMVYQSGSFLGLVMERLGNCLH

SEQ ID NO: 126920 - protein, 110 aa, Glycine max
  Coding DNA Sequence Number=SeqID_35235
  Pfam annotation: Domain name=Ins_element1; Domain location=3-59; Score=-22.1; E_value=0.019; Accession=PF03811.4; Description =Insertion element protein
  Subcellular localization annotation: CTP_CleavageSite=72; ConfidenceScore=5.79e-01
APVASVSISCPSCSATDGVVRNGKKHRRTSALASVAVSLRVTTTPAALNAPLQGASHSPFRLRNCWEGRSVRASSLLRQLAKGGCAARRLSWVTPGFSQSRRCKTTASEL

SEQ ID NO: 126921 - protein, 126 aa, Glycine max
  Coding DNA Sequence Number=SeqID_35236
  Homolog annotation: Hit_ID=A5AV98; Match level="QueryCoverage=74%, HitCoverage=15%, E-value=4e-14, Identity=35%"; Hit description =Putative uncharacterized protein
MKFDGSRTMHEHVIEMTNIATRLKTLGMTVNKNFLVQFILNSLPPESDPFQMIQEKTRLKNQGSHLVHYVSHQGNQGAEKKFMKKHDKGKSSLKINDDTLQIQNEVSKRAIIANFMGNLDISRTIA

SEQ ID NO: 126922 - protein, 299 aa, Glycine max
  Coding DNA Sequence Number=SeqID_35237
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVIFRHSCPSCSATDGVVRNGKSTRRTSALASVAGASHSPFRAAQLLGRAIGAGLFAITPAGERGMCCKAIKLGNARVFPEFDSSRKHPPFKPSTFNLSSRTPSPTLSSLTPSLMSDWVLHTYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 126923 - protein, 61 aa, Glycine max
  Coding DNA Sequence Number=SeqID_35238
MGHLSDQGVPTDPKRIKVIPDWPTPPSVEGRSPEYEEPRDLRSNPFQRGGDDAILPPKGIG

SEQ ID NO: 126924 - protein, 121 aa, Glycine max
  Coding DNA Sequence Number=SeqID_35239
  Homolog annotation: Hit_ID=A7QL08; Match level="QueryCoverage=51%, HitCoverage=84%, E-value=8e-13, Identity=66%"; Hit description =Chromosome undetermined scaffold_116, whole genome shotgun sequence
MVGAGLKKDLRVSRVVPGGSLNAFLFLLIGVISQRLAMDGPAASREKKRKTDLTPSCMLHSARGGYSSVGRAPLLQLGRCDYGRAVKNVEEGFLTWAPGEEDQAGPREQLDALSPFNPLSE

SEQ ID NO: 126925 - protein, 253 aa, Glycine max
  Coding DNA Sequence Number=SeqID_35240
MSRKSVPGYEKKMQLPQEPLNGKPRGLARKSMAETNFVELYGATTVSSSFEGKRETNHSRILSLACISFFLYPLLTFGFLGKNTITKRATRHPYRTRSKSRTMGDQEKTQEQMKADMSALKEQMASMMEAMLGMRQLMEKNVATAAAVSSAAEADPTLLATAHHPPSNIVGRGRDTLGHDGNPHLGYNRAAYPYGLPPNYSPPVLQDDAGHIASPILEREPSQQPDEVHKDPQDYARRDVEFFPPIPEGPAPS

SEQ ID NO: 126926 - protein, 210 aa, Glycine max
  Coding DNA Sequence Number=SeqID_35241
  Homolog annotation: Hit_ID=Q6UUU1; Match level="QueryCoverage=28%, HitCoverage=40%, E-value=2e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGNASVFPNSALQYLKSVYTDYGTKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 126927 - protein, 60 aa, Glycine max
  Coding DNA Sequence Number=SeqID_35242
  Subcellular localization annotation: CTP_CleavageSite=46; ConfidenceScore=5.26e-01
MAFSFMNCVFVHVSSTFEFGAMRSDCLVQFSILNLFRSPMNCVFVMCPPPSSLELCVVIA

SEQ ID NO: 126928 - protein, 52 aa, Glycine max
  Coding DNA Sequence Number=SeqID_35243
RVPFAIQAAQLLGRAIGAGLFAITPAGERGMCCKAIKLGIKLIDTVDLEGGP

SEQ ID NO: 126929 - protein, 555 aa, Glycine max
  Coding DNA Sequence Number=SeqID_35244
  Gene Ontology: Mol. function=phosphotransferase activity, alcohol group as acceptor; Cellular component=cytoplasm; Biological process =carbohydrate metabolic process
  Homolog annotation: Hit_ID=P22713; Match level="QueryCoverage=57%, HitCoverage=83%, E-value=1e-133, Identity=75%"; Hit description =Galactokinase
  Pfam annotation: Domain name=DUF477; Domain location=380-514; Score= -25.1; E_value=0.091; Accession=PF04536.5; Description=Protein of unknown function (DUF477)
  Pfam annotation: Domain name=GHMP_kinases_N; Domain location=331-399; Score=68.9; E_value=1.6e-17; Accession=PF00288.17; Description=GHMP kinases N terminal domain
  Pfam annotation: Domain name=GalP_UDP_tr_C; Domain location=100-257; Score=238.3; E_value=1.7e-68; Accession=PF02744.8; Description =Galactose-1-phosphate uridyl transferase, C-terminal domain
  Pfam annotation: Domain name=GalP_UDP_transf; Domain location=1-94; Score=45.5; E_value=1.9e-10; Accession=PF01087.13; Description =Galactose-1-phosphate uridyl transferase, N-terminal domain
  Pfam module annotation: Pfam domain module=DUF477::GHMP_kinases _N::GalP_UDP_tr_C::GalP_UDP_transf; Domain location=380-514::331 -399::100-257::1-94
MTDTPDAPQSDDVLMRCEGARGTSRVICFSPDHSKTLPELPLHNLQDIVRTWQEQTAELGQHYPWVQVFENKGAAMGCSNPHPHGQVWANSFLPNEAQKEDDNQRRYFADKGTPLLVDYVTRELQDGSRTVVETDHWLAVVPWWAAWPFETLLLPKTHVKRITDLNEAQRTDLALALKQLTSRYDNLFQCSFPYSMGWHGAPFNGEANDHWQLHAHFYPPLLRSATVFADTFGYAPSHSIQAPGRVNLIGEHTDYNDGFVLPCAIDYQTVIACARRDDRQVRVVAVDYDNQQDSFSLDAPIEPLSEPMWANYVRGVVKHLQQRDASFGGVDMVISGNVPQGAGLSSSASLEVAVGTVFQQLYQLKLDGAAIAVNGQEAENQFVGCNCGIMDQLISALGQQDHAMLLDCRTLGTRAVSMPEDVAVVIINSNFRRNLVGSEYNTRREQCETGARFFNKKALRDVTLEEFAAAEQQLDPLVAKRVRHVITENARTLEAADALSSGDLQRMGELMAASHASMRDDFEITVAPIDQLVEIVKAEIGPRGGVRMTGGGFGG

SEQ ID NO: 126930 - protein, 120 aa, Glycine max
  Coding DNA Sequence Number=SeqID_35245
MVSRYALNQIAAELECVDYAGKNPSSCGYMVRTMLGLPCACELSKYVSGCIPLDSIHMFWRRLSFSDQGLFEPENSMCPPPAKVNTKGAPKKVMSRIPRSTKHDPSYWEYVDAFESMTTK

SEQ ID NO: 126931 - protein, 97 aa, Glycine max
  Coding DNA Sequence Number=SeqID_35246
MWAFLTGCQIDWAHLVRYRMHKALRADAPLPYPQLATLFLCHFQIPLDDEPFVQVKRSFAIGAGAVTSFGYRKDRNGQWLKKDALPSQDERTSSPPP

SEQ ID NO: 126932 - protein, 179 aa, Glycine max
  Coding DNA Sequence Number=SeqID_35247
MGIAPTRHPVDPEKSNRALGFPTLVTGLYQSYRVPVPPPARSRHHRDRDCRHPVTRRSPTGSWKCQALITGLCQFYGVPVTPARASGPLLIELSSRSTAPQTGAGRNTTAALGWSAAGNRRTAITSRVHLYSSTKRFEYCLHNMADQQATKSKAKGKQSTRSVTYKPSCVQLKTLKKRY

SEQ ID NO: 126933 - protein, 243 aa, Glycine max
  Coding DNA Sequence Number=SeqID_35248
  Homolog annotation: Hit_ID=Q6WAY4; Match level="QueryCoverage=90%, HitCoverage=51%, E-value=3e-22, Identity=30%"; Hit description =Putative uncharacterized protein
MGTNQNGKRFYQVKVKGLDVTNLKELGLLMGPLQRQAFRKVYGKILDLTAAEVFTEAIVSLAQYYDQPLRCFTFGDFQIVPTVEEFEEILGCPLGGRKPYLFSGFLPSLSKIAAVVGDSAKELDRMKQTRNGVVGQPRKYLDGKARDMASQEKWVPFADILALLIFWGCPLSERGRVDWDQHLAGIGGSTINWFPRWKEGKEGVLFSCGDYPNVPLIGMRGCINYNPALATRQLGYPMRGGTI

SEQ ID NO: 126934 - protein, 240 aa, Glycine max
  Coding DNA Sequence Number=SeqID_35249
  Homolog annotation: Hit_ID=Q1QUY6; Match level="QueryCoverage=95%, HitCoverage=81%, E-value=2e-25, Identity=32%"; Hit description =Abortive infection protein
  Pfam annotation: Domain name=Abi; Domain location=125-240; Score=4.4; E_value=0.009; Accession=PF02517.7; Description=CAAX amino terminal protease family
MKRWHILLIIGLTGVASLLLATFEQLIPGQQASLAMRLLILVQPAILTVTAVATGQALAAKLGLGAPLIDSWLQGDNTRAVLRRQLPPALAAGIAVAVLMIIYSSVILPLVTDAATLAKMTRFDIPLATRILYGGITEELLTRWGLMSFFAWALWRVTGSGEIRSSLVWAAIIIAAALFAAGHLPLLFTIAAQPQPALVLAVLLGNFIPGLIFGWLFWRRGLEAAILSHGFAHCLNALAA

SEQ ID NO: 126935 - protein, 64 aa, Glycine max
  Coding DNA Sequence Number=SeqID_35250
MKDKRDECEKEAKFGIAKCSIWAKLSSWAKCISTAKRSFSAFSAKENLAEHQHQSHALSARSVR

SEQ ID NO: 126936 - protein, 111 aa, Glycine max
  Coding DNA Sequence Number=SeqID_35251
MVAIIPEKIPQPSFSQGYNSNATWAYHGGVIGHSIEHCMTLKHKVQTLIDAGWLKFEEDNCITCTVPFTFPCYKVMTKDSNRYLRALHWGNERHHASASSEPRGRSEVLAR

SEQ ID NO: 126937 - protein, 87 aa, Glycine max
  Coding DNA Sequence Number=SeqID_35252
  Homolog annotation: Hit_ID=A5BKY7; Match level="QueryCoverage=91%, HitCoverage=14%, E-value=2e-13, Identity=51%"; Hit description =Putative uncharacterized protein
  Pfam annotation: Domain name=zf-CCHC; Domain location=51-68; Score =22.9; E_value=0.00052; Accession=PF00098.14; Description=Zinc knuckle
MCVQEEERLVMEMGESALLTTAYRYRRPIKSQAYQKGNAKIPPQADIKKVAKCFFCKKKGHMKKNCPGFQKWLEKKGYAKPKETSGK

SEQ ID NO: 126938 - protein, 120 aa, Glycine max
  Coding DNA Sequence Number=SeqID_35253
  Homolog annotation: Hit_ID=A5AZG1; Match level="QueryCoverage=79%, HitCoverage=30%, E-value=2e-07, Identity=32%"; Hit description =Putative uncharacterized protein
  Pfam annotation: Domain name=zf-CCHC; Domain location=89-106; Score =15.5; E_value=0.0068; Accession=PF00098.14; Description=Zinc knuckle
MKESLKRLTLTSYFHGKDNVEAHLDWEMRVEQKLKRKSTLKSYGSHSYPKKDQGLGILGAAPSKPKDDNWKTIEKQPPKASMQEKTSSMKCFKCLGRRHITSQCPTKKTMIMRAKTFIVA

SEQ ID NO: 126939 - protein, 156 aa, Glycine max
  Coding DNA Sequence Number=SeqID_35254
  Gene Ontology: Mol. function=transcription factor activity; Cellular component=nucleus; Biological process=regulation of transcription, DNA-dependent
  Homolog annotation: Hit_ID=B0KG63; Match level="QueryCoverage=92%, HitCoverage=96%, E-value=8e-53, Identity=66%"; Hit description =Transcriptional regulator, MerR family
  Pfam annotation: Domain name=MerR; Domain location=14-50; Score=48.7; E_value=2.1e-11; Accession=PF00376.14; Description=MerR family regulatory protein
  Pfam annotation: Domain name=MerR-DNA-bind; Domain location=55-120; Score=64.7; E_value=3.2e-16; Accession=PF09278.2; Description=MerR, DNA binding
  Pfam module annotation: Pfam domain module=MerR::MerR-DNA-bind; Domain location=14-50::55-120
MARNEPIDANRLLTVGEVAKRSGVAISALHFYESKGLIQATRNAGNQRRYPSVVLRYIAVIKIAQRAGIPLEEIRAALSRFPIGSKLTSEQWGVLSSAWRKTLDERIQRLTVLRDHLDSCIGCGCLSLADCPLRNPNDILGRQGAGAHIFEHPDGQ

SEQ ID NO: 126940 - protein, 127 aa, Glycine max
  Coding DNA Sequence Number=SeqID_35255
VPPTRHPLDPDKSNSALGFPAFDHGSLPVVRERYLRHLVRQQAANHRVHVQTHDCLYQLSLSLQSQGFPPFPCPTSDQFREEVAWPGDWPEAQAGEAPAVAPGDADEARMDEEMTNLLDFLGGSGAT

SEQ ID NO: 126941 - protein, 37 aa, Glycine max
  Coding DNA Sequence Number=SeqID_35256
MKGKELEGGLVPSLEEFELRRKGPTALKAIGLRSTPN

SEQ ID NO: 126942 - protein, 162 aa, Glycine max
  Coding DNA Sequence Number=SeqID_35257
MKVDPSVPYKVITCVPRKGKQIGRTLGRKDKELRGSNNGVISGYHKWLKDRTQGITWLPKLKISSGEEAEVLEESEEVQALKAKLERTRVVKEKFKMTTIRVRKECDELRDVNMTMIEALEREMKRVRKEEWAKTSSEGLYGAATTNSSFEGPKETSRGWKV

SEQ ID NO: 126943 - protein, 46 aa, Glycine max
  Coding DNA Sequence Number=SeqID_35258
MAQSTNIKQDFFDPFAPVARQDTIWMLLAIAAQKGRKMYQLDVKFS

SEQ ID NO: 126944 - protein, 326 aa, Glycine max
  Coding DNA Sequence Number=SeqID_35259
  Homolog annotation: Hit_ID=Q2HW90; Match level="QueryCoverage=92%, HitCoverage=71%, E-value=2e-24, Identity=27%"; Hit description =Putative uncharacterized protein
MGTNQTGKRFYQVKVKGLDTTSIKELGRLMEPLQIEAFHKIYGKILELTIAEISIEAIASLTQYYDQPLRCFTFGDFQLVPTIEEFEEILGCPLGGRKPYLSSGCLPSLSRIATVVKVLARAIDAFLAYHHSKESPVVAVLADLFDTFDRRCEKSSARIICCLPALCVWLVSHLFQQDTRHPCPLLSHRSCTEKRRIDWDQLLAGIGGRTISWFPRWKEGKEGVLFSCGRYPNIPLVGTRGSINYNPALAIRQLGYPMRGAPTEESMSPFLVRDFGAQNSKTIQRIHKAWETPLRKDQELRGIRNGIIGGYHEWLKVHIRGLDWLA

SEQ ID NO: 126945 - protein, 247 aa, Glycine max
  Coding DNA Sequence Number=SeqID_35260
  Homolog annotation: Hit_ID=Q2HW90; Match level="QueryCoverage=68%, HitCoverage=31%, E-value=6e-22, Identity=37%"; Hit description =Putative uncharacterized protein
MDVLALLIFGVVLFPNVDGLVDLAAINAFLAYHHSKESPVVAVLADLFDTFDQRCEKSSARIICCLPALCVWLVSHLFQQDTRHPCPLQSHRSCTEKRRIDWDQFLTGIGGRTINWFPRWKEGKEGVLFSCGGYPNIPLIGMRGCINYNSTLAIRQLGYPMKGAPTEESMSPFLVRDLEKSFEAPEEDEEVRVLKSELGKEKLAKEKFKLAATHIRKECAGLREKNATTAKALEQETKRARKEKYGQ

SEQ ID NO: 126946 - protein, 111 aa, Glycine max
  Coding DNA Sequence Number=SeqID_35261
  Pfam annotation: Domain name=zf-CCHC; Domain location=70-87; Score =18.6; E_value=0.0023; Accession=PF00098.14; Description=Zinc knuckle
EHEMELQCLNQNEENDKKKRSIALKVSSSMQEENEEEDSDDEEKFIKKRRINRRQNFNNGRKSQEDSQVLRCYKCIQIGHIKANFPSNEECPEKSEKKRYDERRTKKAYIA

SEQ ID NO: 126947 - protein, 106 aa, Glycine max
  Coding DNA Sequence Number=SeqID_35262
MEVDLPLGWKLLSLEHYDGTTNLDEHIDVFFTQANIYTMTVITYPSAGGRRPNRWAKALVSKGENKKMASPIIFLLHSAIIHLQEAKDSIDEEIQGLQAPHGATSC

SEQ ID NO: 126948 - protein, 83 aa, Glycine max
  Coding DNA Sequence Number=SeqID_35263
MKSGDMWGYRMGQQVRWQAEIPYNHSYLSSTKVFTLVVRRHSSPTMHEILLCWAGTMKFDRVWKRCSAGQYIDRLNDVPLERN

SEQ ID NO: 126949 - protein, 243 aa, Glycine max
  Coding DNA Sequence Number=SeqID_35264
  Homolog annotation: Hit_ID=Q6WAY4; Match level="QueryCoverage=98%, HitCoverage=48%, E-value=2e-17, Identity=28%"; Hit description =Putative uncharacterized protein
LDVTSLKELGRLMGPLQRQAFRKVYGKILDLTATEVFMEVVVSLAQYYDQSLSKVAAVVGDSARELDRMKQTRNGVVGLPRNYLEDKARDMASQEKWGPFADILALLIFGVVLFPNVDGLVDLAAIDAFLAYHHSKESPVVAILADLFDTFDRRCEKNSARIVCCLPALSVWIVSHLFQQGTRHPCPLQSYRSCAEKGRVDWGQHLAGIGGNAINWFPRWKEGKEGVLFSCGDYPNVPLIGTT

SEQ ID NO: 126950 - protein, 151 aa, Glycine max
  Coding DNA Sequence Number=SeqID_35265
MAAQLIHDRVEMECLEGAWETLEGNAWCRFRGTIQFTATSLVHPEEPARTLQCTVEWILPTPTPYRLVEPVQVIEVTSSKEDPEELHPEPAMDALDFLEGDEDPLPEWTLPRTSCRHLRQTLRRRAALERWRLVEALHHSRQLLRLVLYTF

SEQ ID NO: 126951 - protein, 78 aa, Glycine max
  Coding DNA Sequence Number=SeqID_35266
MTEARQKGVQKQNRGGACHPARPGEQGCFLQKQQPSGGRIWKAQLLKKLRKLTDCEKYLLSISVTLRNFHGSRKPASF

SEQ ID NO: 126952 - protein, 132 aa, Glycine max
  Coding DNA Sequence Number=SeqID_35267
  Subcellular localization annotation: CTP_CleavageSite=48; ConfidenceScore=5.76e-01
MPVCWPQTSTGTGPWRFCYSQSQSSCRRSRSAPRTAVRTQKVFAWGVSSVAAWPQRSLSASSLITRCLLAAGTFFTGAFMRAQTSARGVPGETWRMTSVMYAASRSIVTSASAGTCPEFSASGRIAASGTGR

SEQ ID NO: 126953 - protein, 192 aa, Glycine max
  Coding DNA Sequence Number=SeqID_35268
DGWHVSLAGTGFGHRGQAIWLEYYAFLSLDSTRAFPEILIDRMILRPIVPQLGNLPATKLFVWPGASLWALGKQSHLVDIRELAKNSTKEGLSGKEAIRQGNMEFCLLHFLLSSARCHCSKRMQPHSCLLLPIDKGMTLGEPMSSNQARELPEPDSVTAELIAIYQFPEFSSEPRRPGMPSRSLFLSVSVSA

SEQ ID NO: 126954 - protein, 132 aa, Glycine max
  Coding DNA Sequence Number=SeqID_35269
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=65%, HitCoverage=72%, E-value=4e-25, Identity=69%"; Hit description=LacZ protein
  Subcellular localization annotation: CTP_CleavageSite=40; ConfidenceScore=5.40e-01
MTMITPSSKLTLTKGNKSWGITSNSCSPGDPLVLERPPPRGSSNSPYSESYYNSLAVVLQRRDWENPGVTQLNRLAAHPPFASWRNSEEARTDRPSQQLRSLNGEWDAPCSGALSGGGCGGYAQRTRYTCQR

SEQ ID NO: 126955 - protein, 55 aa, Glycine max
  Coding DNA Sequence Number=SeqID_35270
MGVPMATKPTRAFQDVPPEGGCFWRKQPSSPGRAELVWASWGKEGRTKMFNLPGI

SEQ ID NO: 126956 - protein, 282 aa, Glycine max
  Coding DNA Sequence Number=SeqID_35271
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMLKVPALLGKGVTSHMEMMNCARGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 126957 - protein, 121 aa, Glycine max
  Coding DNA Sequence Number=SeqID_35272
  Homolog annotation: Hit_ID=UPI0000F2E5CB; Match level="QueryCoverage =76%, HitCoverage=10%, E-value=8e-07, Identity=34%"; Hit description =PREDICTED: similar to LON peptidase N-terminal domain and ring finger 3
MSSPSEDNTSSPSKDSTSSSLEGYTISPSEDYTSSPSEDYTPSPSQDYMSLPSEDSTSSPSEDYTSSSLEGYTPLPSEDCTPSPLEDYTSSPSEGYTSSPAKGCTPSPLRATRPHLQCLYI

SEQ ID NO: 126958 - protein, 38 aa, Glycine max
  Coding DNA Sequence Number=SeqID_35273
MGLVLPDSQRPFLGGCAKKATGHPEIEHCPPRFVSWGL

SEQ ID NO: 126959 - protein, 64 aa, Glycine max
  Coding DNA Sequence Number=SeqID_35274
MEMLRQMNIRESMDKNEVLKVHQHIARFWYQAGEKLFELLDAIVEEVGEENVVQVVTDNGSNYV

SEQ ID NO: 126960 - protein, 220 aa, Glycine max
  Coding DNA Sequence Number=SeqID_35275
MGDQEETQEQMKADMSALKEQMASMMEAMLGMRQLMEKNVAAAVSSAAEADPTFLATTRYPPSNTVGRGRNTLGHDGNPHLGYNRTAYPYGLPPNYSPPVMQDDAGHISSPVLEGEPPQQPDEVHENPQDYARRDVEFYPPIPEGPAPNTLPQPNLTTQPIVLSMEGPPRATEERRKLDLLEERLRAVEGFGDYPFADMTDLCLVPDVVIPPKFKVPDFD

SEQ ID NO: 126961 - protein, 209 aa, Glycine max
  Coding DNA Sequence Number=SeqID_35276
RVQLREDEYTDFQEEIAGRHWTSLVTPMAKFDPEWIPFDADALSQFLGDPLVWRKARSVSSARGGTGPTGRRMRIMCTSMTTLTQMWMTLLLSNVLPSDHNSDLPLPKCQLMYAILTRMSVHVAQVIADTIYLFAGMPPPRHHLDPDKSNRALRFLVLITGLCQSFGVPVTPSKVIRPPITRAFIEKYCTPRQAQGDAHQAANAPPPPR

SEQ ID NO: 126962 - protein, 257 aa, Glycine max
  Coding DNA Sequence Number=SeqID_35277
  Gene Ontology: Mol. function=nucleoside-triphosphatase activity; Cellular component=chloroplast
  Homolog annotation: Hit_ID=Q2PMM5; Match level="QueryCoverage=99%, HitCoverage=16%, E-value=2e-52, Identity=77%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPIFISHLMENPFSLRLALPPPSRGILAIGSIGTGRSYLVKYLATNSYVPFITVFLNNLLDHKPKGFLIDDSDDIDDSPDSDDIARDLDMELELLTMMNTLTMDMMPEIDRFYITFQFELAKAMSPCIIWIPNIHDLDVNESNYLSLGLLVNYLSRDCERCSY

SEQ ID NO: 126963 - protein, 185 aa, Glycine max
  Coding DNA Sequence Number=SeqID_35278
  Gene Ontology: Mol. function=endonuclease activity
  Homolog annotation: Hit_ID=A4WAV5; Match level="QueryCoverage=95%, HitCoverage=72%, E-value=9e-86, Identity=82%"; Hit description =Xylose isomerase domain protein TIM barrel
  Pfam annotation: Domain name=AP_endonuc_2; Domain location=1-144; Score=68.4; E_value=2.3e-17; Accession=PF01261.15; Description=AP endonuclease family 2
MGWIGDFIEERRLNGLTQIERILEALSEVGGKGIIVPAAWGILEGDRNAVSASLRWLDEVAGRTGTTIYLEPLNRYQDHMINTLADARRYIEENALKHVQIIGDFYHMNIEEDSLTEALHRNRDLLGHVHIADNHRYQPGSGSLDFASLFDQLRADNYQGYVVYECRVRADDPAQAYQGLTHLFA

SEQ ID NO: 126964 - protein, 37 aa, Glycine max
  Coding DNA Sequence Number=SeqID_35279
MTRWMTLKNLVLEDAGTQWRIISNWIWIRNWAEPAWT

SEQ ID NO: 126965 - protein, 180 aa, Glycine max
  Coding DNA Sequence Number=SeqID_35280
MSVLELYIEKDVAGGSMFHSANSLTSCGNYLSNDDTQPPTNMSNLNLDEDDDDYLVSNSYVEESLDKDDSVDGVQGIHNPFWNDALHYNNINLSHPDEEDIYGLEMPSSFNVGQELYVGMEFDSKDAVKNAVKQYVMKVHQSFKVVESKWDKYVVCCVNKYADCPCPFYMRAILSKKTDS

SEQ ID NO: 126966 - protein, 243 aa, Glycine max
  Coding DNA Sequence Number=SeqID_35281
  Homolog annotation: Hit_ID=Q2HW90; Match level="QueryCoverage=79%, HitCoverage=38%, E-value=4e-23, Identity=32%"; Hit description =Putative uncharacterized protein
MGQLQRQAFRKAYGKIWDLAMVEISTEAIASLAQYYDQPLRCFTFGDFQLSPMVEEFEEILGCPLGGRKPYLFSRFYPSLARISKIVQISAQELDHRKQVENGVVGIPRKYLEAKARIWVGKGEWAPFIDILAMLIFGGVLFPNVDGLVDLATIDAFLAYHNHKESPVVAMLADQYDTFDRRCEKSNTRIVCCTPALYVWGCISYNLVLAIRQLGYPMRGVPLEEELAPVMSRGFNKTNMETL

SEQ ID NO: 126967 - protein, 113 aa, Glycine max
  Coding DNA Sequence Number=SeqID_35282
MSYRMSRHHASEHADYIWEYEQINQRLLSEQKRSTLHTRDQLYTQEINSTHKRSTLHTQVQHLMLGYHQGGSQNTQVPKLTKQLFNPGLGTKLVQPSCLYSSERIWTATSCAG

SEQ ID NO: 126968 - protein, 180 aa, Glycine max
  Coding DNA Sequence Number=SeqID_35283
GLSTSISSPPDLPPNLKIISGRRLLPKVLPLCFAPAKETEKDPYLIPRVLLRQLPVEVQSIEDEYMEAPMKKEEAYISGLFFSPVTSAKERRLPRVEIDPGASINVMPLRALADLGMNSYEPAKSDQGYYSGNEKYQMGETRYFNEIYYLTKMAVSPSASGLGVTAYTSSGSLSVADLLP

SEQ ID NO: 126969 - protein, 52 aa, Glycine max
  Coding DNA Sequence Number=SeqID_35284
MTLRSANMHNSSFFQILPRAQPRSVALSGWLAKPADWLSEKGMQLFIEENQM

SEQ ID NO: 126970 - protein, 202 aa, Glycine max
  Coding DNA Sequence Number=SeqID_35285
  Homolog annotation: Hit_ID=Q2PEW8; Match level="QueryCoverage=98%, HitCoverage=66%, E-value=4e-20, Identity=40%"; Hit description =Putative uncharacterized protein
  Pfam annotation: Domain name=SURNod19; Domain location=1-201; Score= -66.8; E_value=1.2e-09; Accession=PF07712.3; Description=Stress up -regulated Nod 19
MGLGSIAAKTFEDIKFPKGHIGIKSFDAELVNQEGNSIPSYETYLYHWFAIKYHKNITMSLNPKLHRPEDAFFKRNEGTCNGGILSHYWGFRVESRGTSSNILDPFAIEQGFQGSRRMVSFRYKISWVDWNKHQVPVKVYILDSTNRIRSNGSKIIHDCQVEYTIPENGDGDSPHVQKANIPIEKGGYLIYGTAHMHSGIVN

SEQ ID NO: 126971 - protein, 440 aa, Glycine max
  Coding DNA Sequence Number=SeqID_35286
  Gene Ontology: Mol. function=binding
  Homolog annotation: Hit_ID=A7QHR2; Match level="QueryCoverage=75%, HitCoverage=23%, E-value=2e-94, Identity=55%"; Hit description =Chromosome chr8 scaffold_99, whole genome shotgun sequence
  Pfam annotation: Domain name=HEAT; Domain location=110-146; Score =19.1; E_value=0.017; Accession=PF02985.13; Description=HEAT repeat
MAATSREKLASLVNAAKLAIDIPSKLESLRQLRHELPPEDPVLLTEFLPSLFLFHSDRFGPVRKFLTEIDSGSYPSLTLPLPLQCLGPVCKFVTEDTFFPMLGEIGLKNTEFLSNIVPVLIDLLDDDTPAVVRQVLLCGTDLFRATLEKIVVQGLYSSDLDGALESAWAWMLKFKDKVYSIAFQHGSGGAKLLALKFVEAVIRLYTPDPNGSSEPTSHQGITLRLVGPVEFNILWLRRGHPVLNIGDLKIEASHRLGLLLDQLRFPTVKSLSNSVIIVLIKSLSAIAFDRPAFYGRILPVLLSLEPSSSVVNGVCVSATHFALKNAFVTCSKCTHPSAAPEMQSEGKADRVFHLISASNGTIEREKDDQPVIKLNEILAVCLSMLSMADAGMWWKAKIPPYRHAIAAYGAAMVGLPSQIAYGGWQKSAMPFRYSSHGATI

SEQ ID NO: 126972 - protein, 125 aa, Glycine max
  Coding DNA Sequence Number=SeqID_35287
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=78%, HitCoverage=75%, E-value=3e-25, Identity=66%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSGGGCGWLRAGVTRYTCQR

SEQ ID NO: 126973 - protein, 100 aa, Glycine max
  Coding DNA Sequence Number=SeqID_35288
  Subcellular localization annotation: CTP_CleavageSite=42; ConfidenceScore=5.55e-01
VIASLSSCARTVGAPPISGGGPGTVWIWSPLKVRTRSPLKVRACSPFKARMCSPLEVRACSPLKARTCGPLEVRAYNPLMVRTCSPLKARTCSPLNGEGN

SEQ ID NO: 126974 - protein, 104 aa, Glycine max
  Coding DNA Sequence Number=SeqID_35289
MECLEGVWETLEGNTRCRFRGTIRFTATSLPVQVIEVTSSEEDPEEDLEELPPEPAVDALDFLEGDEDPLLEVNSPEEVMSASEADSTEDGGPGEMAISGGSSS

SEQ ID NO: 126975 - protein, 48 aa, Glycine max
  Coding DNA Sequence Number=SeqID_35290
MTSRDHVCSFCTLVSSRGGGPDYTRIYLTVIRTLVSSRGGGPYDKQRP

SEQ ID NO: 126976 - protein, 353 aa, Glycine max
  Coding DNA Sequence Number=SeqID_35291
  Gene Ontology: Mol. function=protein binding; Cellular component =outer membrane-bounded periplasmic space; Biological process=cell wall organization and biogenesis
  Homolog annotation: Hit_ID=A8GJF8; Match level="QueryCoverage=65%, HitCoverage=100%, E-value=1e-76, Identity=62%"; Hit description=Pili assembly chaperone precursor
  Pfam annotation: Domain name=Pili_assembly_C; Domain location=270 -350; Score=34.9; E_value=2.9e-07; Accession=PF02753.8; Description =Gram-negative pili assembly chaperone
  Pfam annotation: Domain name=Pili_assembly_N; Domain location=142 -265; Score=191.8; E_value=1.8e-54; Accession=PF00345.11; Description= Gram-negative pili assembly chaperone
  Pfam module annotation: Pfam domain module=Pili_assembly_C::Pili _assembly_N; Domain location=270-350::142-265
  Subcellular localization annotation: CTP_CleavageSite=75; ConfidenceScore=5.25e-01
YLGDRRGNTVGPITKNKKSFSLTFSGCSPAAGTAGTPLKIYFSSADNISTDGKYLLNNSVNENDASVAKNVGFSLAETGSSTPIQLNVPYVTDIMGDKEAPDSETLTLDAQALDRAWPPGGTMKKYMMIAALMLGSVGAQANVVVNGTRVIYPANNKDVIVQLLNNGTDPSLVQAWIDDGDINSTPETANVPFLLSPPVVKVNGNSGQQLRIQKVGAALAADRESVFYLNVLDIPPTPENLQGTNTLQLAIKSRIKLFYRPQALTRGVENALEELTLQANGKGFNVINKSPYFITVANIGQGADKHLLVDSLMVAPFSTQFAASKRAVSKNARYDLMYIDDLGAYKSKAITAH

SEQ ID NO: 126977 - protein, 48 aa, Glycine max
  Coding DNA Sequence Number=SeqID_35292
MAKGAEDDVSLYASTGSFAPWLTKGAGRQKVQETMLVSARQWAYLPPG

SEQ ID NO: 126978 - protein, 67 aa, Glycine max
  Coding DNA Sequence Number=SeqID_35293
LKIVAGDSMGSFSIASAYCQLNKFHEIQQNETPSELVEHRSSVSVGAHVELHPLVKGAVIVAYQATE

SEQ ID NO: 126979 - protein, 56 aa, Glycine max
  Coding DNA Sequence Number=SeqID_35294
MQSSKQDVYLGAYVNESDNYLKGIINSALKGLDDTPQPKSKAAGARWNVVKLTLNI

SEQ ID NO: 126980 - protein, 119 aa, Glycine max
  Coding DNA Sequence Number=SeqID_35295
  Subcellular localization annotation: CTP_CleavageSite=58; ConfidenceScore=5.62e-01
MEGQPTQTSVSNANVNSGVGAIPDQTIGTISSTASTVMNQTGVTSPMTNMTLASSTTSASALAPWNNPSLGNPSGSPFRPLQNPLYGMPTSLMAGLQNSQPNIENLNMSSPSGQNYQGV

SEQ ID NO: 126981 - protein, 230 aa, Glycine max
  Coding DNA Sequence Number=SeqID_35296
  Gene Ontology: Mol. function=motor activity; Cellular component=cell projection
  Homolog annotation: Hit_ID=UPI00016621D1; Match level="QueryCoverage =97%, HitCoverage=40%, E-value=3e-18, Identity=32%"; Hit description =UPI00016621D1 related cluster
QVLAFRGLHALTISGLHALTFKGLHVLTFIGLHVLTFRGLHALTFRGVHALAFRGLDVLAFRGLDVLTFRGLHALAFIGLHILAIRGLHALTFRGLRVLAFRGLHILTFRGLHVLAIRGGLHTLAFRGLHILASRGLPVLAFRGLHVLTFRGLHTLIFRGLYVLPLRGLHILAFGGLHALTFRGLHVSPFRGLHALAFRGQHILAFEGLHTPSPLEGYASSLSEGSTSAP

SEQ ID NO: 126982 - protein, 182 aa, Glycine max
  Coding DNA Sequence Number=SeqID_35297
MASRKRKSSTSLPQEPYDTTRFVFEVAWERYEQNVHAKNILLERNVDLYMTQYNEFRKELEMRRWHKALTRQLDGCIDVALVKEFYAYLFDPEDKSLRQVRVRGKLIKFDDETLNTFLETLVVLEPGERARLVYGLVMKMDMDVGSIICSQISQMAQSNSSRFKFQHSSLLYASPRELFLIH

SEQ ID NO: 126983 - protein, 73 aa, Glycine max
  Coding DNA Sequence Number=SeqID_35298
  Subcellular localization annotation: CTP_CleavageSite=54; ConfidenceScore=5.08e-01
MYIKYGPKYIMKHSQRNMLSNKTPYTYSQNNSKAPKFLKVKEASTRIKPRLLCKQSMGQNTPNDYDDGSNSHK

SEQ ID NO: 126984 - protein, 200 aa, Glycine max
  Coding DNA Sequence Number=SeqID_35299
ITENTNHAPLEGTRGIAQAERHPPIGKSAEGAGECGLFLILRSNSSLHITRKTIKETVVRFTCQAFKHLINEWQGKMVLFGNLVQPPIVNADSPTVLHPSRNQFLLLIFDHCEAGLLRDYLDGTHPLAVGDRINDSSLQKLGYLCRNMPFCGRARRGSRVRFPKEERCTESPPTFICGKRRKTEGNRSKRNSKFGSCIYV

SEQ ID NO: 126985 - protein, 268 aa, Glycine max
  Coding DNA Sequence Number=SeqID_35300
VAGCTIYGGAHQSGCCIPIEEQTTHEFNYMGNQPKNNFNAGGFSGFQHGQQYNQQQGQWRNHPRNQFNRDQGGPSVRPKQQGPSLYDRTMKVEETLAQFMQVSMSNQKSTEFAINNLEVKVGQLAKQLVDRSSSIFKANTKKNPKEKCKAVMTRSRMAIHVDESEAEKKMEEHKQQLAPKPALEPIFDSVELDENNEETEDDKEEETPIKEKEKERIKEEKEKEKKLKNEKQKEKVVDDEMRKGKSEANTKKKKDTTPNEGKEVPYPL

SEQ ID NO: 126986 - protein, 105 aa, Glycine max
  Coding DNA Sequence Number=SeqID_35301
MVKVGTSYVPINVSFSPKVGPGLPRYQQGHQDLFILRSDLPSQVLQWLLFLSAVPPVQLLTGVAAQLLGRAIGAGLFAITPAGERGMCCKAIKLGNARVFPVTTL

SEQ ID NO: 126987 - protein, 152 aa, Glycine max
  Coding DNA Sequence Number=SeqID_35302
VEVSMEPIASLAQYYDQPLRCFIFGDFQLSPMVEEFEEILGCPLGGRKPYLFSGKDRELRGSSNGIIGGYHKWLRVRTQGLDWLPNLKTVRDDEVKASEESDEVQALKAELERARVVEEKFKAAIVSSSSEEVKGIITGQRHDLEGRAKGLP

SEQ ID NO: 126988 - protein, 69 aa, Glycine max
  Coding DNA Sequence Number=SeqID_35303
MGAKHLTRTKEWSHVIKQRPDEIRDVQKTKLVSLRAMHQAVSALIAKRVQITVRGADNRKVSPRIMGAE

SEQ ID NO: 126989 - protein, 68 aa, Glycine max
  Coding DNA Sequence Number=SeqID_35304
MHSSCVIASLSGCARTVGPPPISGGGQEPLKVWIWSPLKVRTRSPLKVRTCSPLKVRACSPLKDGEDV

SEQ ID NO: 126990 - protein, 142 aa, Glycine max
  Coding DNA Sequence Number=SeqID_35305
MTLGNGYLGSCIDEERSEMRYLAEGTPAWVSHIVSPTQTCNNVAARGCMLTSREHPPRGWLKSGFMADFAVIKMVDEPRSRPITCEPVSSGPIDDPLRARTLPTRPQVRRGYPLSLSISISGGKETNKDSLSNGERTGKSPP

SEQ ID NO: 126991 - protein, 94 aa, Glycine max
  Coding DNA Sequence Number=SeqID_35306
MWAIIDECKEKLNLAATHEQRLEDEYAKISAEREARERVIDSLHQEATMSQELPRLLAKAKAVADTYSASEEIHGLLSYCQHMIDLMDHMIGNR

SEQ ID NO: 126992 - protein, 183 aa, Glycine max
  Coding DNA Sequence Number=SeqID_35307
  Subcellular localization annotation: CTP_CleavageSite=29; ConfidenceScore=5.59e-01
SVGLEHSGRVRCMGLGAVPSNTFRNTRLRASSLSSSSSGVGFPSSNQWQEKYNNLESAFKAYMIMKEGTGPAASLLLDFILHCTATPVFSGRSQDIVSDIVDPATSILHLPFYLALYIVQPILFLDKLVVTSCAATPKAVPSYVYSAYLNDAKCSNTLGKRTIAEQIEVGLTQSIVDESEFLS

SEQ ID NO: 126993 - protein, 276 aa, Glycine max
  Coding DNA Sequence Number=SeqID_35308
VKEKLKTAVTRIRKECDELRHANMTTAEAAKRDESRVEGMILEDKLKACQRSKRSLTEQLSRTEENMLTIIDQYKEKLNLAASHEQRLEDKHAKVSALHVEKEARERVIESLHGKAMKWLDRFAHTLNGSQELSSLLAKAKAMADEVQEQMKADMEAMKDQMTSMIEAMLSMRWVMEDNAAVVAAISAVAEADLTHPSIINQTSCLVLDMVGQGGEVVYLYAPTGNDMPYNYTLFYHEVTFFKIQHKAKGHPPIGKSAKGTGECGLFLILRSNMNL

SEQ ID NO: 126994 - protein, 67 aa, Glycine max
  Coding DNA Sequence Number=SeqID_35309
  Subcellular localization annotation: CTP_CleavageSite=54; ConfidenceScore=5.42e-01
MILHKFRKPNSLKIVPSGVANCRNLPFGGRATQGSRDASSKGGRRAESPPTFIRGKRRKNQNAVYEL

SEQ ID NO: 126995 - protein, 214 aa, Glycine max
  Coding DNA Sequence Number=SeqID_35310
  Gene Ontology: Mol. function=unspecific monooxygenase activity
  Homolog annotation: Hit_ID=O04892; Match level="QueryCoverage=65%, HitCoverage=45%, E-value=4e-23, Identity=62%"; Hit description =Cytochrome P450 like_TBP
VPPQPNSPPDNVFRPDRPAEADLGSKKRGSAPLPIHGITPTYPTPLKSFHKVGLESSSTGSSFPADSAKPVPLAVVSLDSRQGQGPEGPVPNPSPDRHATTRSRRGSSSSSPPTATGSGLGPPCQPQSQSFSRGYGYILPTSLAYIVPSTRGCSPWRLDAVMSTTGRGRHSVLRIFKGRRGRTGHHATCGALPAAGPYLRLSRFQGGQAVKQKR

SEQ ID NO: 126996 - protein, 104 aa, Glycine max
  Coding DNA Sequence Number=SeqID_35311
MSSLPSEPTQQQLEAHYRAYILRLIGGVLMLDKTRNQVTNPDAKTMGGCASLLQSWAWYRMPFIATRVNRTPSYPLVTSFTGTPHGDVIGYRMRLDYMTTEQFL

SEQ ID NO: 126997 - protein, 95 aa, Glycine max
  Coding DNA Sequence Number=SeqID_35312
GGGESKRPRAESQWIVAARPLCHLQYPVAYLSSSAKDSTRPRGGGGELRFKASRRANPPHEGHQRHVPLGGRGPPTAGRQTNGGAHASLLARILT

SEQ ID NO: 126998 - protein, 202 aa, Glycine max
  Coding DNA Sequence Number=SeqID_35313
MGEVEEIQEKMKADMEAMKERMATMMTMMSMKKIMEANAVAIAATSVIAKVNLMSPSGINQMNHPTLDMVGKDLGSRGGPYYAQNKHAFPPYGLPPNYTPPNVAYTPNKNVNNSTPIPIESQQPQTDHAHVSQPMGETHEMPHHNLADFEPCLGYATEGQAVGGIPLQTLWKALSITPSYTSCIPQQVKTLVLWQKWKSWII

SEQ ID NO: 126999 - protein, 272 aa, Glycine max
  Coding DNA Sequence Number=SeqID_35314
  Gene Ontology: Mol. function=motor activity; Cellular component=cell projection
  Homolog annotation: Hit_ID=UPI00016621D1; Match level="QueryCoverage =95%, HitCoverage=41%, E-value=9e-17, Identity=31%"; Hit description =UPI00016621D1 related cluster
YPGLQRTTLLANRGLHALTLRGLCVLTFRGLHVLTFRGLHALAIRGLRVLTFRGLHALAIRGLHVLTFRGLHALAIRGLHVLTFVGLHALTFRGLHVLANRGLHALTLRGLHVLANVGLHALTFRGLHVLANRGLHALTFRGLHILALRGLHVLTLRGLHILALRGLHVLTLRGLHVLALRGLHILALRGLHVLTIRGLHALTFRGLHVLTFVGLHALTFRGLHILAFRGLHVLTLRGLNVLALRGLHVLTIRGLHALTSRGLHVLALRGLH

SEQ ID NO: 127000 - protein, 121 aa, Glycine max
  Coding DNA Sequence Number=SeqID_35315
  Subcellular localization annotation: CTP_CleavageSite=44; ConfidenceScore=5.42e-01
MATQLNQAQSQNSDKLPSQTVHNPKNVSVITLRFGKQSEVPPPVAAPAPEPVKLHSTPEKEDEIVAQKRKLPNKNFHAGGPSSNSDLLQPPIPLPFPPRAIPNKKMEEAEKVILETFRKVE

SEQ ID NO: 127001 - protein, 61 aa, Glycine max
  Coding DNA Sequence Number=SeqID_35316
MENWRTSPSNEFVGLQTRSARQLIHGAPNKSGEWRIAEQREAINSPGSRLEGGGHMNSAKQ

SEQ ID NO: 127002 - protein, 229 aa, Glycine max
  Coding DNA Sequence Number=SeqID_35317
MEESMSPFLVRDFGAQNFKAIQRIHKAWETPLRKDQELRGIRNGIIGGYHEWLKDEEVQALKSELGKANLPRKSSSWPLHTSRKECARLREENATTARALEQETKRARKEEYGRNKFRGALWGSNNELKLRREERDQSRAHSMVLKEELVACSRSKRSLSQRLCETETNMLAIIAKYQEELGLATAHEHRIADEYAQVYAEKEARGRVIDSLHQEATMWMDRFALTLNG

SEQ ID NO: 127003 - protein, 90 aa, Glycine max
  Coding DNA Sequence Number=SeqID_35318
MENAQSHSLLITLFTNPKSREILAQGLKGTNEIQSTSQGIQGFGVSKCQFVFFLCPVFFWLQSISGLSFCVQHLGMFPAFDDSFPGSAIQ

SEQ ID NO: 127004 - protein, 69 aa, Glycine max
  Coding DNA Sequence Number=SeqID_35319
MTFAIMSLALSRKFIEMASQGPILETMTPTSGMDQHRTLRSTQDTDDPQAYTSVVSRRPSAQYSLKQFT

SEQ ID NO: 127005 - protein, 86 aa, Glycine max
  Coding DNA Sequence Number=SeqID_35320
MVDSWYLTHATKNRKIQGSCMSKQKGAQCPMCVVKKTIWIFQLPMTKDETHIQRMRDGMMQMRMHETERKQHKGVIHTYETAEIQL

SEQ ID NO: 127006 - protein, 181 aa, Glycine max
  Coding DNA Sequence Number=SeqID_35321
  Homolog annotation: Hit_ID=A5AXX4; Match level="QueryCoverage=63%, HitCoverage=49%, E-value=7e-18, Identity=42%"; Hit description =Putative uncharacterized protein
MQIFIQSMIPVHGMLLLKEHFIPTKEVNSELVPKEWDEMKDERCKSAKEIRKMLEVTLEGTMDNGETISKLQTRFTHIVNHLLGHGKTFKDDELNIKILNYLTRTWEPKITTIKESNDLASMSMKALFEKLLAYEHELIQQSHVEETKKKRKGIAVKVNSSKEDCKESSSDDKDEENLSLM

SEQ ID NO: 127007 - protein, 84 aa, Glycine max
  Coding DNA Sequence Number=SeqID_35322
MEAPLELVGLGSSSSMGSFTSWEDEWQREWRRKRERRHHFKEKMSLKEAHHHRRPWIRAWEEEGNEWKGEEEKSTKVLCLLKEL

SEQ ID NO: 127008 - protein, 177 aa, Glycine max
  Coding DNA Sequence Number=SeqID_35323
MHSDTVVSDGTQRQNLVILHHLSSRGGGPDDTRRQNLVIPHPFAIQTQSCPMARRDKIWSFCTLCHPEAAGPMTRGDKIWSFRTPLPFRHSRVRWHARQNLVILHPLSSRGDGPDDMRRQNLVIPHPFAIQTHSCPMATQRQNLVILHPLSSRGGGPDDMRRNLHYLPHPFTRSVMD

SEQ ID NO: 127009 - protein, 82 aa, Glycine max
  Coding DNA Sequence Number=SeqID_35324
MVDEPRSRPITCEPVSSGPIDDPLRARTLPTRPQGESPRRARTLSHPEALSASRVVWECSPNRAGSGWGPAMCPGRMWNGES

SEQ ID NO: 127010 - protein, 191 aa, Glycine max
  Coding DNA Sequence Number=SeqID_35325
LHGFCTKSEIEELFCEFCDLSVFVSHLDVTLTSSVGPECVELISIVQRAISEWLLGRSCTGSDVGDVAPNWVNNSLVLFTCLICSYGHIQSACSEARCRDILYDICPQNQNFTHLVTFFLHHFNVPLDDEPFVKFKRSFSIGGGAVTSIGYQKDMDDMPLPIPDERTPSPPPHRDASSSLVTEVLTELHDL

SEQ ID NO: 127011 - protein, 97 aa, Glycine max
  Coding DNA Sequence Number=SeqID_35326
  Homolog annotation: Hit_ID=A5C3T2; Match level="QueryCoverage=60%, HitCoverage=6%, E-value=2e-19, Identity=76%"; Hit description =Putative uncharacterized protein
MDSFASWKMNGSGMEKEEKEETPLQGEDESRTSQTVSFSDIQCNVLELKGDNYKIWKERILLQLGWMDIDYAIRKDEPLAITDESSPTDVALYERWE

SEQ ID NO: 127012 - protein, 56 aa, Glycine max
  Coding DNA Sequence Number=SeqID_35327
MGALESKGCSYDSSLLESWDTLTVIVSNFALDGKFSMYNVTNSLLNEESRRNEKEA

SEQ ID NO: 127013 - protein, 78 aa, Glycine max
  Coding DNA Sequence Number=SeqID_35328
MIHLVEIRWGHRVHLSNIPGSGYCNRIGFMLIMASIIMAICSFMATMSAFICSCASSTSPIALALAQRKMQGPRMSEM

SEQ ID NO: 127014 - protein, 48 aa, Glycine max
  Coding DNA Sequence Number=SeqID_35329
MGIRESMCDGTKIPTPTSHENSLLYNSMGEQRDAHPVLQLWSLSALAG

SEQ ID NO: 127015 - protein, 134 aa, Glycine max
  Coding DNA Sequence Number=SeqID_35330
MHWLYVDDILPYLVVLGKVYEGSSIVHHGPLANDMVKVGVEEIRDADACDLTPTKKIQLVGIKSGHWQLVVICPNDNVVAWFYFLHNKSDKYFKGIVNRFNDKQGSKSKTNVKWIPVKCNKQRGSTECDYYVMH

SEQ ID NO: 127016 - protein, 102 aa, Glycine max
  Coding DNA Sequence Number=SeqID_35331
MTLPNIITAIQSSITDNGVTPIINALWYLCPVYQFNGEVQYREIQIIDEEGVLCMFHTFLNMTSVICMELKVDVHNLLSPTQVNDLSWANMEQKLENTLKLE

SEQ ID NO: 127017 - protein, 88 aa, Glycine max
  Coding DNA Sequence Number=SeqID_35332
  Gene Ontology: Mol. function=oxidoreductase activity, acting on single donors with incorporation of molecular oxygen, incorporation of two atoms of oxygen; Biological process=DNA integration
  Homolog annotation: Hit_ID=Q6Q623; Match level="QueryCoverage=86%, HitCoverage=24%, E-value=2e-16, Identity=70%"; Hit description =Dioxygenase RAMOSUS1
MPLRYCAQNLLKVEPTPLYKFEWHLESKALMHAMCKTGGKIVGRFRIPLDGSPYGTLEAALEPNEHGRGGIDICSIGAKGTLEYTVSK

SEQ ID NO: 127018 - protein, 59 aa, Glycine max
  Coding DNA Sequence Number=SeqID_35333
MMVMSYRLWGYMYNMKNVHTWWHELWFVLKLPKGFIQPEATPIGWMSEQSITFSVICMP

SEQ ID NO: 127019 - protein, 83 aa, Glycine max
  Coding DNA Sequence Number=SeqID_35334
MDMMQKTLHGMQMTEKVMDCSDIQPIGVASDRGDECEHYIQTWVKESQREVYLGTYLNHAMKTIKTTVDGKNDQGTPKWIKVK

SEQ ID NO: 127020 - protein, 127 aa, Glycine max
  Coding DNA Sequence Number=SeqID_35335
  Gene Ontology: Mol. function=ferredoxin-nitrite reductase activity; Cellular component=chloroplast; Biological process=electron transport
  Homolog annotation: Hit_ID=O04840; Match level="QueryCoverage=77%, HitCoverage=16%, E-value=2e-32, Identity=69%"; Hit description =Nitrite reductase
  Subcellular localization annotation: CTP_CleavageSite=47; ConfidenceScore=5.03e-01
MMSKKTGGEYISNWHSIIAASFSRSSNLTGSRTLLHMALKKKHKYLRSEEVERQVDVTRPLRMHWTACRNTSGQVQVAHIAFMGRMARDDNGKATEGVDMFLGGRIGSDSHLPQVYKKGFPCKDFIV

SEQ ID NO: 127021 - protein, 90 aa, Glycine max
  Coding DNA Sequence Number=SeqID_35336
  Subcellular localization annotation: CTP_CleavageSite=58; ConfidenceScore=5.45e-01
MLARIIRTRLFASAQVKSCPGMYSSCVIASLSGCVRTVGRPPISGGGARTDKRKRPLKARTRSPLKARTCSPLKARTCSPLMVKTSSPLK

SEQ ID NO: 127022 - protein, 62 aa, Glycine max
  Coding DNA Sequence Number=SeqID_35337
MKLGLIRPDEGLRRHDLHVHHHHGVEVGVVEVVAVMVEVAKIDTVDVASIDICDGEGESHKM

SEQ ID NO: 127023 - protein, 286 aa, Glycine max
  Coding DNA Sequence Number=SeqID_35338
VKGHLIKFDEDTLNTFLKTPVIIEEGEDLLAYSRFYRLRPDPQELAARLCIPGRGFELNADGLPLKILRNNLTTLAQTWSVLSFSNPTPTSHTSDITLDRARLGFPALIIALCKARGVTFDSLTFESLSLTINLAYVKKNCWNLDDPTVTFRGPIKAKHKRSKAPSSDIPPTSTPSTSIAALSAPASSTPLPIPTPPIMSVEEFISQEDELIPPEPFVYETDLASAQEEVASLEPVPQSSPAAVLDDPQPSAPASVPDQPIVQDPPVAPVLDLNEHAQDHSHDQDF

SEQ ID NO: 127024 - protein, 261 aa, Glycine max
  Coding DNA Sequence Number=SeqID_35339
  Gene Ontology: Mol. function=protein heterodimerization activity; Cellular component=cytoplasm; Biological process=vitamin B6 biosynthetic process
  Homolog annotation: Hit_ID=A7NZH8; Match level="QueryCoverage=17%, HitCoverage=22%, E-value=3e-11, Identity=73%"; Hit description =Chromosome chr6 scaffold_3, whole genome shotgun sequence
MIEYCKEGSKPHIIDFLGNNEPISIYFFPLIEPFKSHIKIEAYYTYITRESNSDDDCEARFLLSARLTPLLAILTLLSLTYLSLKYSTPTQVTKLSIENLNDVLVNEKEGDHVSVEPGLCHRAILGDGADHVVGDCEEEGGVAVEEAAGDGGVNVFEAGGSCVEVAKPGGNALRGGGQVLQGGSGGGGRERKWDGCYGFEAVLSVPELVSKEGGLETFCGIFIRAPTILEAGPEVQVLADYPRPSSKLLSSDSSIEDQKIS

SEQ ID NO: 127025 - protein, 271 aa, Glycine max
  Coding DNA Sequence Number=SeqID_35340
MVLGILEVISKPWRFMLENWLCDSDLDIPTRMHQILIEKDLLADSFSDCLETSILDENEFLLLKGWVWGLKVVIISRSNGKAKDHGSSSSVVQMEKPLFKPVKVSKKAKHKFKELRKQKSYTEEIGDSNSELLSKINSLLKTIPETPQPLEESSKIRTRYTSKLINAINGDSDNNSEQVSQEGLVSEKENTFSRIHIVEEEGVLEWKEAQALKSKKEEVVAMRESFLEINRLREGEGVLGNSERVKGFVGSWKSHRTNTCILERGTCERVR

SEQ ID NO: 127026 - protein, 91 aa, Glycine max
  Coding DNA Sequence Number=SeqID_35341
MQTASPIGVFAVAMTRGEDTTTTGEFHGVASPIGDFIVQGGVASQTGKFQAQARGSCITPTAPLLPLRSSLPCSCSTSFSSSSYYVLSLLG

SEQ ID NO: 127027 - protein, 129 aa, Glycine max
  Coding DNA Sequence Number=SeqID_35342
  Pfam annotation: Domain name=zf-CCHC; Domain location=57-74; Score =27.5; E_value=4.9e-05; Accession=PF00098.14; Description=Zinc knuckle
MQEEEEEEEEEEEEESDDEEDFLLFVKKFHKFVKNRRMERSHNFNNGKRSQEVSPTIKCYMCNQPGHIKVNCPTNESWPEKNEKKSYKERRSKKACIAWDDNDSSDGSEKEISLLSKDYESDENITQED

SEQ ID NO: 127028 - protein, 113 aa, Glycine max
  Coding DNA Sequence Number=SeqID_35343
MSVEEFISQVAWPGVQPSPLGRGEASAAQETVPEEDELIPLEPFVYETDLASAQEEVASLEPIPQSSPAPVLDDPQPSAPTSVPDQPIVQDPPVAPLLDLNEHAQDHSQDQNF

SEQ ID NO: 127029 - protein, 184 aa, Glycine max
  Coding DNA Sequence Number=SeqID_35344
MAFRKRKESTLASQARYDRSIFTSQEAWDRYSDIVIGRRILPERNAIIYLAKFGEFKYKLERRNWHKEMINFMDGSIDVAIVKEFYANLYDPEDKSPKQELAARLCIPGRGFELNVDGLPLKILWKNLTMLALMQAPLELVGLGSSSSMDSFASWKINGSGMEKEEREETPLQGEDKSRRSSPP

SEQ ID NO: 127030 - protein, 182 aa, Glycine max
  Coding DNA Sequence Number=SeqID_35345
SSHSLRLERPKRWLHLFKGNSLKTWDEVVDKFVKKYFLESKTAEGKAAISSFHQFPDESLRGKIKLKTPEEAMELIGNMAASDHAILRDRAHIPTKRSLLELSSQDALLAQNKLLSKQLEALTETLKHMSPTAVFPKKKHHKKSTAWGTSQDKISMQVDIPDFSMANHIINSRDNGGITLET

SEQ ID NO: 127031 - protein, 196 aa, Glycine max
  Coding DNA Sequence Number=SeqID_35346
AVVSSALSARLALSQISLTRAKCENGAKHAFERTEEKLSKEAKVLRGGGDIPTTLYLEVAAEVVQKLQPREASTVFIKLVRPKSPPSPVGYVSTIQTDNKGEDEWWNQFDTTKAEQDKVKIWFKAHPEFLKAADLETSMFLNQKSKLTTFLARSKSKEHLTKNLKEVLQLLQDHKEGYSSSKKEDAKSTSTLDVFY

SEQ ID NO: 127032 - protein, 112 aa, Glycine max
  Coding DNA Sequence Number=SeqID_35347
MVEAESSQNLQSIQDSINWTNDTYSKVKGPEKRGHVRCLGKLPHQASSSQSSCANNRIKKLENLLGNLVVVLKVGFVEDPQINQVLETIDEEAPTNGSTSKNHQTTNDPNQS

SEQ ID NO: 127033 - protein, 28 aa, Glycine max
  Coding DNA Sequence Number=SeqID_35348
STLEDPTALASQGSFLKKASQGSYLVYK

SEQ ID NO: 127034 - protein, 81 aa, Glycine max
  Coding DNA Sequence Number=SeqID_35349
  Pfam annotation: Domain name=SLR1-BP; Domain location=11-74; Score =1.0; E_value=0.00077; Accession=PF07333.3; Description=S locus -related glycoprotein 1 binding
MIAKPAEDPEEASLTLVISKTSEADRCQKVIQPSNCNLGKCQADCSFQYRDYRGIGKCIGGSNATFQCVCFYDCGAPSSLV

SEQ ID NO: 127035 - protein, 72 aa, Glycine max
  Coding DNA Sequence Number=SeqID_35350
MFLVFSSALKGLDDTPQPKSKAAARQKGTTERGYYVMHWMSTIILGSFRNNGEAYFNNARPLEPERLKALRI

SEQ ID NO: 127036 - protein, 348 aa, Glycine max
  Coding DNA Sequence Number=SeqID_35351
MKKILPSNMALMHRYGRNLRQPAKPLIGRKKMQEIQKNNDCLHLLSRGGYDLLEKKPLDEKIKKRQHDALMIENPALIEDPPSPIKRHVKWKMARTNRYGKMTSEAARQIADKIASSNFNLDYNNFNFGLKCHMGRQNILNTAIGRPDHGGRVRAVGFGITISQYYGRTSRASTTLSISFTKEQLAEIIAWKNKLKDSIITDIFNGDKVSARANFDLNVLGARVSTKESNAEIAVNPSEEEHVGRVTPPMGLYVQSQDCTKLVALGKIHDGPSTIHCVAYADDVVRVSIEKVIDGEAEVPLATSKIKYVREVVNTFIAWPLPLHSGITPNKVTNAAELNNDVPKQDPL

SEQ ID NO: 127037 - protein, 181 aa, Glycine max
  Coding DNA Sequence Number=SeqID_35352
  Gene Ontology: Mol. function=nucleotidyltransferase activity; Biological process=RNA processing
  Homolog annotation: Hit_ID=A7QT56; Match level="QueryCoverage=20%, HitCoverage=8%, E-value=1e-08, Identity=78%"; Hit description =Chromosome chr1 scaffold_166, whole genome shotgun sequence
MTADGKVPKTRPQWLELKTNVQRGGYECGYYVMHWMRNIIGVELKSDWSVWFGDGSTLDPEAITTLRKKWAAYFLKLRTIQSYEAPNVSFHIVGIVRKNGCRIMSLQVLSSCIRGRKHTVVTAETIKGRLLMEMNYMLAYGSGEASLRLLWNSGSLHILLPFEVDIDFAFNFIAVFVLQLG

SEQ ID NO: 127038 - protein, 38 aa, Glycine max
  Coding DNA Sequence Number=SeqID_35353
MRLTCGIIVVEETDKLAKEGKVVMIKKKRQLEPTIWQH

SEQ ID NO: 127039 - protein, 106 aa, Glycine max
  Coding DNA Sequence Number=SeqID_35354
MLKPPAFCNAFFVLLLLHLLLALVSARGSHRTTWNILTRYSNNSGFGKEVVGEIKRKIEVMCLIKCQYDIFGGSVPWIRNRHLYSLELKLIIMILQPPIDLIGTNI

SEQ ID NO: 127040 - protein, 89 aa, Glycine max
  Coding DNA Sequence Number=SeqID_35355
  Subcellular localization annotation: CTP_CleavageSite=63; ConfidenceScore=5.33e-01
MEVVVKSLSDDDLTIKILQPFAQVNNQLTWTNQVSSGLSNQLAWASYSSPGRVSTFSTKQETRLGELVNTSWLKLYINQTKLEETRGIK

SEQ ID NO: 127041 - protein, 154 aa, Glycine max
  Coding DNA Sequence Number=SeqID_35356
MKAYVKQAHKKRKEVVLEPGDDPEHLRTNVFQEGGNDENHETGQIQAKGPSGEGRRPKLIKVILVASTQTYLPSPEVASTQTYLPSLEVASTQTYLPSPEVASTQTYLPSPEVASTLTYLPSPEVASSKISVTCIKRSTPTQVHIITSVLFQNP

SEQ ID NO: 127042 - protein, 200 aa, Glycine max
  Coding DNA Sequence Number=SeqID_35357
MDWADTKSGTSFELEVTQALCRLEHDQRVISNQDQSATFSRPDDEGLFYDGYNERQVQMPIKNLYMFIEMAAQGKQLCLCNNDDNSNNDDRDSGVDDIGSSGDDVNVDSGCWQIGNGVCRGYVDNILAVLVVMMVLIVTIWEGSDLGSGVGNPLDLVAFYVLSPGVVVRLPDQWGRVAVLQQWQSGRWGCAMGRKEVVTH

SEQ ID NO: 127043 - protein, 233 aa, Glycine max
  Coding DNA Sequence Number=SeqID_35358
KFEIPDAFDSRTKNKLLKTIGERWRQFKSDLTRKWALAADQDGVDDIVFEKYDISKEKMGPVLPDSQRPFDEDTTKGKDHEALEGPMTRGRLKQAQHIIETRLDVWKKAQVIQKQNTVPHILSRGGYEYLEQKLLAEKTKKKLEEATQSGSVDGVIDPPSLVRRHVKWKMAHTKKTGEMTIEAAKEIADKIVSHFQLTIKVTRCGSNAFQEYFDDAKELRVKHVSRIKIKIQE

SEQ ID NO: 127044 - protein, 141 aa, Glycine max
  Coding DNA Sequence Number=SeqID_35359
  Gene Ontology: Mol. function=protein serine/threonine kinase activity; Cellular component=cell surface; Biological process =protein amino acid phosphorylation
  Homolog annotation: Hit_ID=A7P3Y4; Match level="QueryCoverage=46%, HitCoverage=8%, E-value=9e-28, Identity=84%"; Hit description =Chromosome chr1 scaffold_5, whole genome shotgun sequence
  Pfam annotation: Domain name=Pkinase_Tyr; Domain location=11-139; Score=-169.7; E_value=0.051; Accession=PF07714.8; Description =Protein tyrosine kinase
MIEENDVGSTLTVVNQNGCCSHVCICLLHSYGLLHSYDHRVVTVKCLKNVTSGDAEFWAEVTIIARMHHLNLVRMWGFCAEKGQRILVYEHIPGGSLDKYLFRVNKSHNNNHLKEQSSSLNPNTPQQVISLCYTYDGQVGD

SEQ ID NO: 127045 - protein, 167 aa, Glycine max
  Coding DNA Sequence Number=SeqID_35360
MGTCWGVGVGDWGDNTRPRPIPLPCLFPLLWEKGYFGIYRFSSFPKRITQPKIDSSFPKAMFLIFLHLPHFQKLLQEKFSSPTLPQLITLENLPTTVTHSNTRRCTTTHGNAHPYNRSRRRMSDEISLILHHNGKFIQNENGVLEYVDGEFCVREEIEIDLVNVWTP

SEQ ID NO: 127046 - protein, 27 aa, Glycine max
  Coding DNA Sequence Number=SeqID_35361
MAAPFFSTPFQPYVYQIQYHALMASLS

SEQ ID NO: 127047 - protein, 129 aa, Glycine max
  Coding DNA Sequence Number=SeqID_35362
  Gene Ontology: Cellular component=membrane
  Homolog annotation: Hit_ID=A7PTC6; Match level="QueryCoverage=100%, HitCoverage=37%, E-value=4e-20, Identity=41%"; Hit description =Chromosome chr8 scaffold_29, whole genome shotgun sequence
MEHKPSVSTIGWDMNLLAAAYDGIISSGITYYVQGIVMQKKGPIFVTTFNPLIHHGCLHPCRKNISWKGKHKENKEKETEITIEVLKCCSENRMTLETVVEDAETNNDIEMQKGEASRKLRVAIGVQKV

SEQ ID NO: 127048 - protein, 49 aa, Glycine max
  Coding DNA Sequence Number=SeqID_35363
MGEYLETPTEDAHPCGSDKPQRQSRTPAATMMRRRRRSQVANDGDSSSR

SEQ ID NO: 127049 - protein, 127 aa, Glycine max
  Coding DNA Sequence Number=SeqID_35364
  Subcellular localization annotation: CTP_CleavageSite=86; ConfidenceScore=5.06e-01
MSPLYPYPYQSGTSSDAYFMGTQPPLQPGYVMADLFGSPSPAGTPSFAHGCQISMPNAPMDPPWSVSRNISNITDLLGVDLGNQFSAETDERRGDRRRNSDRQARRWERPCGMSSRHNTHDVVVDDD

SEQ ID NO: 127050 - protein, 120 aa, Glycine max
  Coding DNA Sequence Number=SeqID_35365
MASELSTDSTKTNTSSDSSLATNKDIIEVPSFCHRQWAPEYPKFVNFRYDGAINQIRLRQHRAKVYFVEGLNEFRKDLSIFESVISLNFISVLQTTGIELIPDNKIMYCILIIIVQYDAA

SEQ ID NO: 127051 - protein, 461 aa, Glycine max
  Coding DNA Sequence Number=SeqID_35366
  Gene Ontology: Mol. function=DNA binding; Cellular component =mitochondrion; Biological process=positive regulation of transcription, DNA-dependent
  Homolog annotation: Hit_ID=A7P1K5; Match level="QueryCoverage=92%, HitCoverage=91%, E-value=1e-145, Identity=58%"; Hit description =Chromosome chr19 scaffold_4, whole genome shotgun sequence
  Pfam annotation: Domain name=PPR; Domain location=133-166; Score =16.6; E_value=0.084; Accession=PF01535.11; Description=PPR repeat
  Pfam annotation: Domain name=PPR; Domain location=167-201; Score =26.3; E_value=0.00012; Accession=PF01535.11; Description=PPR repeat
  Pfam annotation: Domain name=PPR; Domain location=202-236; Score =16.9; E_value=0.075; Accession=PF01535.11; Description=PPR repeat
  Pfam annotation: Domain name=PPR; Domain location=277-311; Score =11.8; E_value=0.31; Accession=PF01535.11; Description=PPR repeat
  Pfam annotation: Domain name=PPR; Domain location=312-346; Score =24.6; E_value=0.00036; Accession=PF01535.11; Description=PPR repeat
  Pfam annotation: Domain name=PPR; Domain location=347-380; Score=3.7; E_value=2.9; Accession=PF01535.11; Description=PPR repeat
  Pfam module annotation: Pfam domain module=PPR::PPR::PPR::PPR::PPR::PP R; Domain location=133-166::167-201::202-236::277-311::312-346::347 -380
  Subcellular localization annotation: CTP_CleavageSite=24; ConfidenceScore=5.31e-01
MPLAPLFSASRSLAAAAAFLRHCSTAATTNRRNLYSRISPLGDPSISVVPVLDEWIEEGNAVDGPHLHHIIKILRTRNRNTQALEVSEWMSSKGLPISSRDQAVQLDLIGRVHGVESAERYLQSLSDGDKTWKVHGALLNCYVREGLVDKSLSLMQKMKDMGFVSFLNYNNIMSLYTQTQQYEKVPGVLEQMKKDGVPPNIFSYRICINSYCVRGDLANVEKLLEEMEREPHIGIDWITYSMVTNFYIKADMREKALGGMMRAWKLQKANCKKQLNREYITMLGCLVKLGELDKAEKVLGEWELSGNTCDFRVPNILLIGYCQRGLVEKAEALLRKMVAEGKTPIPNSWSIVASGYVAKENMEKAFQCMKEAVAVHAQNKRWRPKVDVISSIFSWVTNNRDIEEAEDFVNSWKSVNAMNRGMYLSLMKMCIRYGKHVDGILESMKADNIEIDEEIKETLNS

SEQ ID NO: 127052 - protein, 49 aa, Glycine max
  Coding DNA Sequence Number=SeqID_35367
MIQSFEAELSVPELVSKEGGPEVQVLADYPVPSSKLLSSDSSIEDLTET

SEQ ID NO: 127053 - protein, 137 aa, Glycine max
  Coding DNA Sequence Number=SeqID_35368
MTTPFKTKEVNEEITTKDIRSLMEQANYANKYLQVLQESISEEKENTFSRIHTVEEEGVLEQKEAQASKSKKEEVVAMRESVLEIKRLREREGVLGNSERVRGVVGLGRAIGTILVFWKETYARELDRERELHHEGE

SEQ ID NO: 127054 - protein, 112 aa, Glycine max
  Coding DNA Sequence Number=SeqID_35369
MADTLSNIETQEIESINVMPMDTPISFEEVMPGDASNDAEEMNIQPCLGLEFESLEKMSVPAQSLVEKFEEEGLPTRKVASIFNNGDSSFSNKDCWNHIRNLRRKNLDIGRC

SEQ ID NO: 127055 - protein, 783 aa, Glycine max
  Coding DNA Sequence Number=SeqID_35370
  Gene Ontology: Mol. function=protein phosphatase type 2A regulator activity; Cellular component=protein phosphatase type 2A complex; Biological process=signal transduction
  Homolog annotation: Hit_ID=Q9LDG7; Match level="QueryCoverage=73%, HitCoverage=72%, E-value=1e-173, Identity=53%"; Hit description=WD -40 repeat protein-like
  Pfam annotation: Domain name=WD40; Domain location=372-410; Score =40.4; E_value=6.5e-09; Accession=PF00400.23; Description=WD domain, G-beta repeat
  Pfam annotation: Domain name=WD40; Domain location=482-526; Score =39.8; E_value=9.7e-09; Accession=PF00400.23; Description=WD domain, G-beta repeat
  Pfam annotation: Domain name=WD40; Domain location=530-574; Score =4.8; E_value=8.1; Accession=PF00400.23; Description=WD domain, G -beta repeat
  Pfam annotation: Domain name=WD40; Domain location=576-616; Score =17.6; E_value=0.045; Accession=PF00400.23; Description=WD domain, G -beta repeat
  Pfam module annotation: Pfam domain module=WD40::WD40::WD40::WD40; Domain location=372-410::482-526::530-574::576-616
MTQETVDHDHQQDDDTESCFFHDSNDRLLSSSSSCSTSTSDDDTPTTQNDTLTHRNDASINALPQFPFPTMCKYDAWISEPSSLSERRSRLLRQFGLPAPPPSSAAIPRSASSHHCTDTSSTAASIPRSKSDNTSDRGTKHCKSSVVPIHDNDDGFLVNNSNNRGGGGSVCVNNNRICVSVYEDDDDGGGGIGEGNVNVSNVVDETVQACTIRDLDNGKEFVVKEDGVWNEVKEVGTGRRLTVEEFEMTVGHSPIVQELMRRQNVEEGGNGEGVDGDRDGDGGVGGDDDEGDGGKVKRKGGWFKFMSLKSVVVGQKERRSGDEKDTSLSEKGGGQRSSSATDDSQDGGGLVHGGERVRVRQYGKSFKEVTGLYRSPEIQAHEGSIWCIKFSLDGRYLASAGEDCVIHVWQVVESERKGELLVEKPEDGNLNIMFLVNGSPEPSSPGMDNNSEKKRRGRLSVSRKSLSLDQLVVPETVFALTEKPVCSFKGHLHDVLDLSWSKSQFNPVDDRYFISGSLDAKVRIWSIPDRQVVDWADLHEMVTAACYTPDGQFVPGSSSEVLITSSDSRIRLVDGIELVHKFKGFRNANSQISACLTANGKYVVSASEDSHVYIWKNEADCRPSRSKGVTVTSTYEHFHCKDVSVAIPWSGMDDTWEMHDSYFAEEPELDDDGDEDEVSSANHPPTPVEENLGSEGSQFASGCNNSPLHGTIASATDSYFLDRISATWPEEKLLTTRDRSPRVSVDLSNGVNQNMSAWGMVIVTASLQGEIKIFQNFGLPLGI

SEQ ID NO: 127056 - protein, 346 aa, Glycine max
  Coding DNA Sequence Number=SeqID_35371
  Gene Ontology: Mol. function=hydrolase activity, acting on glycosyl bonds; Cellular component=membrane; Biological process=cell wall organization and biogenesis
  Homolog annotation: Hit_ID=A7Q0H4; Match level="QueryCoverage=54%, HitCoverage=81%, E-value=8e-54, Identity=50%"; Hit description =Chromosome chr7 scaffold_42, whole genome shotgun sequence
  Pfam annotation: Domain name=Glyco_hydro_28; Domain location=9-292; Score=-132.3; E_value=0.015; Accession=PF00295.8; Description =Glycosyl hydrolases family 28
MVVKRKGKGQGSAPTVPLPLPLSKTSKFARRWVPFSKKYNIEPWAPEWYFDQKMDYLKNKVHPTFVKERRAMKMQPFNSANGLFHSDCYRGIMKNLSNVQIQNITYRAPTEFPYTSGIVPNSFQYVCIDNNSISIGHDAIILKGGASLAFGSDMPGGIFDIIAEKRRILNSPIGIELKTTRGRGGYMRGIFIFDAELENISLGISMTGYSDFHPDDKYDTSSLPVVGDITFKNMIGENISVARNFSGIVESPFSKICLSNMTFSLNSDASPSWFCSNVIGFSEHDGLNVVSCRKYPLPIALMYGAKDPSIAGMVLDSPFSDLVDLMMELVDTYKVHLPKFTVKFAM

SEQ ID NO: 127057 - protein, 41 aa, Glycine max
  Coding DNA Sequence Number=SeqID_35372
MMMPVTEPSLTASAIMVVVLVKAKVEVEHEVVTVTVESKSE

SEQ ID NO: 127058 - protein, 123 aa, Glycine max
  Coding DNA Sequence Number=SeqID_35373
MFSQKEEMMRILKLAKFRLKAQVEKGEGPSGEGQSPQVEKDEGPEAETLSRLIIVVEGSEINLKAHNKYVLIFLAQTVLKAHTYQGNPCGIYPDLSSFTGSGIFQNLRSIYQAIHPVRFTSSR

SEQ ID NO: 127059 - protein, 93 aa, Glycine max
  Coding DNA Sequence Number=SeqID_35374
  Gene Ontology: Mol. function=ubiquitin thiolesterase activity; Cellular component=nucleus; Biological process=ubiquitin-dependent protein catabolic process
  Homolog annotation: Hit_ID=Q2R2A3; Match level="QueryCoverage=65%, HitCoverage=4%, E-value=2e-09, Identity=49%"; Hit description =Ubiquitin carboxyl-terminal hydrolase family protein, expressed
MAWVLLDEEFCPKKFQFFRTSTFTALLQLLSGCRAIKRRDIYGAWEQYLGLEHDDSAPKKSYAVNEEINCCFVEWMCKLRCNINKRLCSSIVS

SEQ ID NO: 127060 - protein, 75 aa, Glycine max
  Coding DNA Sequence Number=SeqID_35375
MGKRRKLNTIQNDDQSQAKEQSIESSTGVNQNNNSIIKENAQFEREQHIQEESHVESHTSLGSARKVQLKVKKED

SEQ ID NO: 127061 - protein, 162 aa, Glycine max
  Coding DNA Sequence Number=SeqID_35376
  Gene Ontology: Mol. function=aspartic-type endopeptidase activity; Biological process=DNA integration
  Homolog annotation: Hit_ID=Q2QSG2; Match level="QueryCoverage=70%, HitCoverage=7%, E-value=3e-09, Identity=35%"; Hit description =Retrotransposon protein, putative, Ty1-copia subclass
MVLTEKTTRILAVGTPKKVARTPTVAQTMAPWALWTCPPSPYPSYNNWAKPTFSPRPPQPAALHTLSLAQPDPSWYMDIGATSYMTSTEGNLSSYSNLSKSHGIIVGNGHSIPIRGFGSANLPHPHPPLVASYIPSPPPPQILKSFLHPLLQLCLLLFGITV

SEQ ID NO: 127062 - protein, 185 aa, Glycine max
  Coding DNA Sequence Number=SeqID_35377
  Gene Ontology: Mol. function=structural constituent of ribosome; Cellular component=intracellular; Biological process=translation
  Homolog annotation: Hit_ID=Q8S6I4; Match level="QueryCoverage=45%, HitCoverage=27%, E-value=1e-31, Identity=79%"; Hit description =Putative 40s ribosomal protein S23
  Pfam annotation: Domain name=Ribosomal_S12; Domain location=62-182; Score=60.3; E_value=6.4e-15; Accession=PF00164.16; Description =Ribosomal protein S12
MEENDEECLLQPLKPKSLCFSGSQALFVALNQLCLFISANFSVLKALGLLSFQRLAEREIWLKSHCRRQRWAGKSYKNSHLGNEWKKLFAGSSHAKGIVLEKIGIEAKQPNFAIDKCARVQLIKNWKKIAAFFPNDGFLNYIEANVSACLCLLVSLLSYPNFVRGPLLGGMQLVFGHFEVLGTHH

SEQ ID NO: 127063 - protein, 128 aa, Glycine max
  Coding DNA Sequence Number=SeqID_35378
  Subcellular localization annotation: CTP_CleavageSite=46; ConfidenceScore=5.01e-01
MLSQVPPSWPHFRFSHSPLKTLSFFRSPQNLSQKNNDPELIHRWIKFGYNVHNTIPNIFTVGNFKIISEIRGKPFAMKPFIFPQKSKTISKSHEDSTSGGFNLFSVSLTFGNSIGAVGGITGGTSGNR

SEQ ID NO: 127064 - protein, 84 aa, Glycine max
  Coding DNA Sequence Number=SeqID_35379
MHLVEPLGNGDERSVDVASRKRRQCQDFSDIFFIGWDLFMVGGFDDEDFEVGGQIVGEYTTLDWGLGFPPSERDEARVKESHAL

SEQ ID NO: 127065 - protein, 98 aa, Glycine max
  Coding DNA Sequence Number=SeqID_35380
MPDTTTVDNRCYRLQITDVVGFHCSSVNKRNWRSRDLGGSIINGCENLQTKDYNIDFNSSIIFLCFIGYISNESLAKQVEKGANSIEGVEAKLWQACV

SEQ ID NO: 127066 - protein, 201 aa, Glycine max
  Coding DNA Sequence Number=SeqID_35381
MSMSLNSNFQRNKLRKEWRVHKEQGLLFEFPLMVSFISQFGLGHSHRLVADPTPALVAPFGQPHAADFLVKSVIGSSTSSSLQTFVVAAIAIAFGAQLRERASERERVRELRHERLGEHTKGKGERVDAPRETEKAKRNMDLLFVDILSDKQEKDLETNEVETPHSQAPLPSFKVPRIEEVDIPLLEKDPRKMLFYLAISC

SEQ ID NO: 127067 - protein, 104 aa, Glycine max
  Coding DNA Sequence Number=SeqID_35382
  Gene Ontology: Mol. function=acid phosphatase activity; Cellular component=cellulose and pectin-containing cell wall
  Homolog annotation: Hit_ID=Q9LU48; Match level="QueryCoverage=66%, HitCoverage=26%, E-value=1e-20, Identity=68%"; Hit description=Acid phosphatase
  Pfam annotation: Domain name=Acid_phosphat_B; Domain location=8-104; Score=-62.8; E_value=0.0024; Accession=PF03767.5; Description=HAD superfamily, subfamily IIIB (Acid
MAAPFKAFLEDLGKAGHLAGKSAGWNLHHHHFPSWLEVFDREKFNNWVEKGVTPAIEPSLKLYEDVLNLGFKVILLTGRSERRRSVTVDNLINAGFKEWDQLIL

SEQ ID NO: 127068 - protein, 90 aa, Glycine max
  Coding DNA Sequence Number=SeqID_35383
MERGHEMYYTPETFFQYPLQMYQYPFEGHHTDTSVSEHSFGGVDLRQEFSTEAEQVKAGRHRGRKNPDRQARRWDRSCGTSSRHHGHHNE

SEQ ID NO: 127069 - protein, 98 aa, Glycine max
  Coding DNA Sequence Number=SeqID_35384
MVTSKKIVKVRLGFILNQNREASLEDSAPIEGFLLVWGFNGELRWFRGGCGLHEKQSLKHSSACAREKGSIPNTPDMIQTKFQEDPTVNEGRSAILAR

SEQ ID NO: 127070 - protein, 69 aa, Glycine max
  Coding DNA Sequence Number=SeqID_35385
MHFQMNSLSTPTVLSEFIFWGRIFIFLRRYLWLSGVSPAIIRLSGQSLAKPIMQKLNFLQYPLSGPPCR

SEQ ID NO: 127071 - protein, 126 aa, Glycine max
  Coding DNA Sequence Number=SeqID_35386
  Gene Ontology: Biological process=transposition, DNA-mediated
  Homolog annotation: Hit_ID=Q1J7G7; Match level="QueryCoverage=26%, HitCoverage=48%, E-value=7e-12, Identity=97%"; Hit description =Transposase
MPPNVLYDAMGYINGVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 127072 - protein, 103 aa, Glycine max
  Coding DNA Sequence Number=SeqID_35387
  Subcellular localization annotation: CTP_CleavageSite=81; ConfidenceScore=5.29e-01
MSTQGAEGMGKATTRAYIQSPSDLRSLRFLFQPCKNPFTSKDPQGMYPPLFSLNNLVDVPSTRTDPQEMFPLLFSVNNPSRCTLYLYHKGCILQCVKTNFSGG

SEQ ID NO: 127073 - protein, 49 aa, Glycine max
  Coding DNA Sequence Number=SeqID_35388
VEGRSLEYEEPRDLRSNPFQGGGNDAILSPRALDRRLQEDWAIRCKRRP

SEQ ID NO: 127074 - protein, 96 aa, Glycine max
  Coding DNA Sequence Number=SeqID_35389
METFQVSQVIQNYVGHVTCTLVSSRGGGPDDTRRYLTVIRTLLSSRGGGPDDKQRPKTKFGHSAPMNAEIPMAHPLYHPEAAGPMIRGTKFGHSHP

SEQ ID NO: 127075 - protein, 111 aa, Glycine max
  Coding DNA Sequence Number=SeqID_35390
  Gene Ontology: Mol. function=oxidoreductase activity, acting on NADH or NADPH; Cellular component=mitochondrial respiratory chain; Biological process=electron transport
  Homolog annotation: Hit_ID=A7KNI1; Match level="QueryCoverage=62%, HitCoverage=19%, E-value=1e-33, Identity=100%"; Hit description=NADH dehydrogenase subunit 7
  Pfam annotation: Domain name=Complex1_49kDa; Domain location=1-110; Score=-135.4; E_value=0.0018; Accession=PF00346.10; Description =Respiratory-chain NADH dehydrogenase,
MHASFIRPGGVAQDLPLGLCRDIDSFTQQFASRIDELEEMSTGNRIWKQRLVDIGTVTAQQAKDWGFSGGAGHPPSNGVGPTDREWIRLWPLGTSEPHEFTGVEHSPPKSA

SEQ ID NO: 127076 - protein, 96 aa, Glycine max
  Coding DNA Sequence Number=SeqID_35391
MLDKQVAVSPAKPADRPDPEVMWDAFLFGLFNSDFPLYIKHEDLSEIAHGGQCLSISVIQLWILKLHEELDAEFKTRCLPWSLPEWRILANGRHFA

SEQ ID NO: 127077 - protein, 88 aa, Glycine max
  Coding DNA Sequence Number=SeqID_35392
MSLHSSSSVNGEGSTPKDPLYKILDELRSLKLWKEKQERKEKEGAIAHILNITPKEEKMIEGLKDVTLVPYFHGKDNVEAYFRLGNEG

SEQ ID NO: 127078 - protein, 131 aa, Glycine max
  Coding DNA Sequence Number=SeqID_35393
  Homolog annotation: Hit_ID=A0ST23; Match level="QueryCoverage=20%, HitCoverage=55%, E-value=2e-08, Identity=100%"; Hit description =Putative reverse transcriptase
MEKLGRGRRETRVGDLGAVGRGNLTESLTGSPLQGEPKKEKKRQGTQHPQRTCYVAGSAGSPEHIKLIDTVDLEGGPVGKPVVPAALMNRPTRGERRFAYWALAECILAYYVGTDEGVSEVLHVAGEKRLH

SEQ ID NO: 127079 - protein, 127 aa, Glycine max
  Coding DNA Sequence Number=SeqID_35394
VPPVQLLTGWCVTAKAPPDISAGKCSGHAARRVPFAIQAAQLLGRAIGAGLFAITPAGERGMCCKAIKLGNARVFPSHDVVKRRPVNCNTTHYRANWSSTAVAAALELVDPPGCRNSILSNFSGRGG

SEQ ID NO: 127080 - protein, 313 aa, Glycine max
  Coding DNA Sequence Number=SeqID_35395
  Gene Ontology: Mol. function=RNA-directed DNA polymerase activity; Biological process=regulation of transcription, DNA-dependent
  Homolog annotation: Hit_ID=A7PT07; Match level="QueryCoverage=63%, HitCoverage=12%, E-value=1e-52, Identity=47%"; Hit description =Chromosome chr8 scaffold_29, whole genome shotgun sequence
MVATAYQTSHECSEETIIDILVAGFSGKLKGWWDNYLTNEEKSKIYSAVKTDLNGKVISNDDDKEIPDAVNTLIFTIAQHFIGDPSLWKDRSAELLSNLKCRTLADFRWYRDTFLTRVYTRKDSQQPFWKEKFLAGLPRSLGDKVRDKIRSQSANGDIPYENLSYGQLISYVQKVALKICQDDKIQRQLAKEKAQTKRDLETSEEETETSSSVLSDENLNLIQQDDQLSSTDDDDGQINTLTREQDLLFEAINSIPDPQEKKVFLEKLKKTLEVKPRQKDFITNNKFDVSNILKRLENSSTKPTTIQDLQGIL

SEQ ID NO: 127081 - protein, 172 aa, Glycine max
  Coding DNA Sequence Number=SeqID_35396
VDVTYENWKQVPAAQKDLIWDDVQVEFDIPEASDSDLTSKWALVVDKDSVDDTDSLEEQASQGSFATHGRQDVLIAAIGRPEHLDRVRVAGANGLALPPEPEVGPSAARVSTKESCVDPSGNDPDTGDSDKPGRVYEGSTTVFNIPLLHDQVKVSVEEVRDADAPIPIPTEE

SEQ ID NO: 127082 - protein, 142 aa, Glycine max
  Coding DNA Sequence Number=SeqID_35397
  Homolog annotation: Hit_ID=Q6UUU1; Match level="QueryCoverage=42%, HitCoverage=40%, E-value=9e-19, Identity=78%"; Hit description =Putative uncharacterized protein
MLTIGPHSLLACRVSAERSAVSLMGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127083 - protein, 159 aa, Glycine max
  Coding DNA Sequence Number=SeqID_35398
  Gene Ontology: Mol. function=helicase activity; Biological process =viral genome replication
  Homolog annotation: Hit_ID=Q2A9I1; Match level="QueryCoverage=95%, HitCoverage=11%, E-value=6e-25, Identity=34%"; Hit description =Putative uncharacterized protein
MMISTAKGAQSYSDIRTVNGVVYGTFKETCFAKGFLGSDQEFISALQEANNWGTAHYLRKLFVKILFMNTMDRPEYVWQQTWQWMADDITFDHRKQGIHLTEKETIHLCLTEIENMLQANRTTLRDFPSMPYPIGYAPNQHHNKPIHNEMAYDKQMLAA

SEQ ID NO: 127084 - protein, 57 aa, Glycine max
  Coding DNA Sequence Number=SeqID_35399
KATRGGHRWSVVVEEEVVGVEGGFRGRGGERNGSFALLDVFVACKTRLGEIWLAWAS

SEQ ID NO: 127085 - protein, 77 aa, Glycine max
  Coding DNA Sequence Number=SeqID_35400
MLQCEGLFSKLKYDFEITNGKTVRNWVVNMILKFHDDPTVNEFEIVVLLRQVWWAAGKRKGFERRRGKTKMRPKGGS

SEQ ID NO: 127086 - protein, 93 aa, Glycine max
  Coding DNA Sequence Number=SeqID_35401
MTDLVSTKDDVNLRVSTGLPAAIDEGRRMTIICLCVPSDTTVSEWQKGADNRKVSPRATSFWVMITKSGAVDKSEAPTPTYPPMRNSDLRSSG

SEQ ID NO: 127087 - protein, 55 aa, Glycine max
  Coding DNA Sequence Number=SeqID_35402
  Gene Ontology: Mol. function=aspartic-type endopeptidase activity; Biological process=DNA integration
  Homolog annotation: Hit_ID=A5B2I2; Match level="QueryCoverage=96%, HitCoverage=10%, E-value=8e-16, Identity=62%"; Hit description =Putative uncharacterized protein
MKKECSKYAAWRIKKDTWWVNSSATTHIGMTMQGCLWNRLPSDDERFIFVGDGGI

SEQ ID NO: 127088 - protein, 86 aa, Glycine max
  Coding DNA Sequence Number=SeqID_35403
MHALLGSFNSGNWSDSKVLGSTGLSCCAITRDRAEWRRKRERRRHFKEKMSLEEAHHHRRPWIRAWRKKEMNEGRGREEHEILCSK

SEQ ID NO: 127089 - protein, 185 aa, Glycine max
  Coding DNA Sequence Number=SeqID_35404
MIMRSQDIYSSQDEATTSSSSSESEEAKGEESSEEIYPQEEGQLLMFKEECKEVSVSSKSLAKKERHFEIKTNIKEFSSLRQPPHFLLCKKTLVSIATPLGLEFIPQVKELLDEGLVCKSLNPYALLVPKIGIIRHQIPKIGGMMNVLSGATLFCKITRAPNIFMICVHRDSLGRNNQHENTEKK

SEQ ID NO: 127090 - protein, 105 aa, Glycine max
  Coding DNA Sequence Number=SeqID_35405
MVGYTPSSFTDLVFASESIEVGLKRGKFGHPPLIKTGANEEDENEGETHVVAAIPIWPSFPPTQQCHYSANNSPSPYPPPSYPQRSSLNQTTKPTYHTTNAEHHL

SEQ ID NO: 127091 - protein, 47 aa, Glycine max
  Coding DNA Sequence Number=SeqID_35406
MEDRVMTDRSSSLLGTGQAENVAARQPSIRNTLECARVQFLVAKMAI

SEQ ID NO: 127092 - protein, 63 aa, Glycine max
  Coding DNA Sequence Number=SeqID_35407
MAYTHIPDSQAILLKFQPARINWTFAPYALRSYSAQWNAPGLLHDKHTLRSSRILGKMEVKET

SEQ ID NO: 127093 - protein, 101 aa, Glycine max
  Coding DNA Sequence Number=SeqID_35408
MSKSCGFGMTGPLDESISCFLIRVDPWVLVPITFRGLHVLANRGLHALTFRGLHVLALRGLHALTLGTSYPHRQRTTRPRLERTTRPHHQRAARSYLQRTT

SEQ ID NO: 127094 - protein, 61 aa, Glycine max
  Coding DNA Sequence Number=SeqID_35409
IDGEVSMSFAVRWKDVLDRLWHFIDKDENFHTVVYKQDLDKPAIVAGWTTLRDFYHLIGDH

SEQ ID NO: 127095 - protein, 221 aa, Glycine max
  Coding DNA Sequence Number=SeqID_35410
MVGIVQPGFEERDLTVKFEAVHVIERPRQLYLIHMPGVKHSLVGEIVHRKHRFRRTAARRQIGRRQARVPVMGVHHLRAPEWIQPAGHFAPHPAEQRKAQHVVGIGVHVGVVIRAPRTIVEMRRVDQIDTDAVKWPNSRVMRPAKVSRRVTTCASVIPRRISGYPGSSTRVSTPSAICAAGSAPITSARPPVFNNGNISEHTCKTCIIAPVCAPVSAACRA

SEQ ID NO: 127096 - protein, 155 aa, Glycine max
  Coding DNA Sequence Number=SeqID_35411
  Homolog annotation: Hit_ID=A5BSR3; Match level="QueryCoverage=42%, HitCoverage=21%, E-value=3e-08, Identity=48%"; Hit description =Putative uncharacterized protein
QKLLAKKTKKKLEEAAQSGSVDGVIDPPSPVRCHVKWKMACTKKIGEMTTEAAKEIAEKIDSFEEQATQRSFVPHGRQDVLTAAIGRLEHPGRVHAARAGVTIKQYFGSAPRMSRSSSSLPLEELQQLTQQIRDQLEESITENVMRQLMALFNQM

SEQ ID NO: 127097 - protein, 401 aa, Glycine max
  Coding DNA Sequence Number=SeqID_35412
  Homolog annotation: Hit_ID=Q6WAY6; Match level="QueryCoverage=87%, HitCoverage=59%, E-value=6e-22, Identity=27%"; Hit description =Putative uncharacterized protein
MKQTRNGVVGQPRKYLEGKARDMASQEKWGPFADILALLIFGVVLFLDVDGLVDLAAIDAFLAYHHSKESPVVAILADLFDTFDRRCEKNSARIVCCLPALCVWLVSHLFQQDTRHPCPLQSYRSCAEKGRVDWDQHLAGIGGNAINWFPRWKEGKERVLFSCGDYPNVPLIGTRGCINYNPALAIRQLGYPMRGAPTEESLSPFLVRDLGAQSLKVMQRVHKAWRSPLKKDKELRGIRNGVIGGYHGWLRVHTRGLDWLSKLKVINEDNFEAPEEDEEVQNLKLELGKARLAKEKFKSAATHIRKECTKLQEENAATARALEQETKRARKEEYGREKFRGALWGSNNELKLRREERDRSRVHGMILKEELAACARSKRSLAQHLEATEQSMLAIIGQYKE

SEQ ID NO: 127098 - protein, 150 aa, Glycine max
  Coding DNA Sequence Number=SeqID_35413
MTIEESIHVTFDETNITSSRKEFVDDIADTLEDTQNEEKNLKRKRDDEDKDDQDDTAQENDNLPKEWKTSRNHPLDNCHTLISSGDLCLMICDLSLVLVRCLAPIIRQFVKFQDMPENQKILMHNPPFQNILEVGLLKEEATGRQAPPRF

SEQ ID NO: 127099 - protein, 129 aa, Glycine max
  Coding DNA Sequence Number=SeqID_35414
MVKSWNLLRADQRLIFAKKLAQGFPVSTGTPWIYLFLRSDLPSQWLLFLSAVPPVQLLTGVVRNGKSTAGHQRWQAAQLLGRAIGAGLFAITPAGERGMCCKAIKLGNARVFPEFDPIRTPQLSVLGRE

SEQ ID NO: 127100 - protein, 70 aa, Glycine max
  Coding DNA Sequence Number=SeqID_35415
MRSLGRMLLSSNVIYICVRVVMLVRMIPLSLCSGTGEILPGRYAIVACVIASLSGCDCTVGPPPISGGVA

SEQ ID NO: 127101 - protein, 65 aa, Glycine max
  Coding DNA Sequence Number=SeqID_35416
  Subcellular localization annotation: CTP_CleavageSite=19; ConfidenceScore=5.29e-01
MKGNQQRSKSWSPVESPTVATYPSAEGRRVTRGMRVPRTEYARSRHQRLFEENVGKTGKDAIYEL

SEQ ID NO: 127102 - protein, 201 aa, Glycine max
  Coding DNA Sequence Number=SeqID_35417
  Gene Ontology: Mol. function=nucleoside-triphosphatase activity; Cellular component=integral to membrane; Biological process=response to antibiotic
  Homolog annotation: Hit_ID=Q6A9X8; Match level="QueryCoverage=43%, HitCoverage=13%, E-value=2e-32, Identity=85%"; Hit description=ABC transporter, ATP-binding protein
MLRRGAPARSSKPRYRVEAANALVANVPEPRDKLELARFSATRLGKDVLDLNEVTVTVSSDELGERTLLDKVTWSIGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 127103 - protein, 304 aa, Glycine max
  Coding DNA Sequence Number=SeqID_35418
  Homolog annotation: Hit_ID=Q1H4C2; Match level="QueryCoverage=99%, HitCoverage=74%, E-value=1e-147, Identity=82%"; Hit description =Putative uncharacterized protein
MINSLNFARHGDKQNSAFFEEYLQKLLEERDQMGLTEMIQEIDALMITVDPDHSIQYIAELSLMTSYHYLVTLESEKHWTHILRIDLNSPDLLVREVKDPNLRGIFRSLNEIYPVGARKPNSRYMGEIIRVTNMHEVVKLQEEREFRFFTQDEVRKLELPGNVAISKPSPYTHNIVGYMKREPGELRVYSLGISTIRPDVQAAYEQAKDQQAKLRIDDLILPVDHLATRVYSQNREVAILEYLSWSSYFFWGAYNIWDQNSSTNVTKSAHGFAETKSPAKVFTANNTPYFVNHLEKLPSPTETF

SEQ ID NO: 127104 - protein, 269 aa, Glycine max
  Coding DNA Sequence Number=SeqID_35419
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDNKSIDTNMVDHCGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127105 - protein, 117 aa, Glycine max
  Coding DNA Sequence Number=SeqID_35420
MGSSQKPSLKKRFYPVKVKSLGITSLRELGQLMGQLQRQAFRKAYGKIWDLAMLSPMVEEFEEILGCPLGGRKPYLFSGFYPSLARISKKGPNLGAGIRPPKASRKWGGRNTEKIFG

SEQ ID NO: 127106 - protein, 115 aa, Glycine max
  Coding DNA Sequence Number=SeqID_35421
MGAGALGCTGAELEESPAQAEKLGCSDPPSVGTCGVDVIELPSLQIYFNSFPGEHQVREAGGHVPPSLSVLFKGLTFLFNHVLQLSAIRSHIGIVLILPKEGSNQILPSADAGSF

SEQ ID NO: 127107 - protein, 114 aa, Glycine max
  Coding DNA Sequence Number=SeqID_35422
  Gene Ontology: Biological process=transposition, DNA-mediated
  Homolog annotation: Hit_ID=Q1J7G7; Match level="QueryCoverage=34%, HitCoverage=55%, E-value=2e-15, Identity=97%"; Hit description =Transposase
IYSAQSASGDAAQLTDLVYDGVFEVLQWLLFLSAVPPVQLLTGWCVTAKAPPDISAGKCSGHAARRVPFAIQAAQLLGRAIGAGLFAITPAGERGMCCKAIKLGNARVFPVTTL

SEQ ID NO: 127108 - protein, 86 aa, Glycine max
  Coding DNA Sequence Number=SeqID_35423
  Homolog annotation: Hit_ID=A6PV85; Match level="QueryCoverage=91%, HitCoverage=39%, E-value=1e-09, Identity=33%"; Hit description =Chromosome segregation ATPases-like protein
MSILTLGSKKEEKENFQSQKKRRKISNQRKKEKKGNSQSKSGRKQKEKKGNSQSKSGRKQKEKKGNSQPKSGRKQKEKERKFPTKE

SEQ ID NO: 127109 - protein, 173 aa, Glycine max
  Coding DNA Sequence Number=SeqID_35424
  Pfam annotation: Domain name=zf-CCHC; Domain location=102-119; Score =21.1; E_value=0.00096; Accession=PF00098.14; Description=Zinc knuckle
MWDTLQLTHEGTTDVKREWQPKEHEMELQRFNQNEENDKKKRSIALKASSSTQEENEEEDSDDEEDFSFFVKKFQKFIKKRRIDRRQNFNNGRKSQEDSQVLRCYKCNQIGHIKANYPSNEEWPEKSEKKRFDERRAKKAYIAWDDNDSSDGSEKEINLLTKDYDSDENISQE

SEQ ID NO: 127110 - protein, 131 aa, Glycine max
  Coding DNA Sequence Number=SeqID_35425
MSLATLFGKLQEHEMELMRLHQHEENDIKRKGIALRASSSFIQEESDKEDLTETEEDDDDFKLFVKRFNKFLRNKRNKRESNINTKKKEEDSSLAPTCYESNQPGHMRFDYLVFERRSEESDKRNLKEKKA

SEQ ID NO: 127111 - protein, 80 aa, Glycine max
  Coding DNA Sequence Number=SeqID_35426
  Subcellular localization annotation: CTP_CleavageSite=50; ConfidenceScore=5.10e-01
DWARAAKEGFGVLMNLRVDFLSPWAKLSSSFSRNLLKEASQESFSRKLLKEEASQTSFSRKFLKKASQGSFSRKFLKEAT

SEQ ID NO: 127112 - protein, 98 aa, Glycine max
  Coding DNA Sequence Number=SeqID_35427
MVEEQNDKTTLTQNEDFPVKGLPEKRDGCGKKEVSLEEASEFLRIIQQSEFKVLNEAHVAQDISVEGFGGLVNNITANNYLAFAEEEIPAEGRGHNRA

SEQ ID NO: 127113 - protein, 30 aa, Glycine max
  Coding DNA Sequence Number=SeqID_35428
MHMTQMQFTNTGAREIVSFLDTTFGQRGTQ

SEQ ID NO: 127114 - protein, 19 aa, Glycine max
  Coding DNA Sequence Number=SeqID_35429
MAQALHVGGRNDEAYRGNT

SEQ ID NO: 127115 - protein, 84 aa, Glycine max
  Coding DNA Sequence Number=SeqID_35430
  Gene Ontology: Biological process=transposition, DNA-mediated
  Homolog annotation: Hit_ID=Q1J7G7; Match level="QueryCoverage=35%, HitCoverage=42%, E-value=2e-10, Identity=100%"; Hit description =Transposase
  Subcellular localization annotation: CTP_CleavageSite=33; ConfidenceScore=5.01e-01
GTSYVPINVSFSPKVGQGFPVSTGDTRILFILRSDLPSQWLLFLSAVPPVQLLTGWCVTAKAPPDISAGKCSGHAARNHHTRRA

SEQ ID NO: 127116 - protein, 78 aa, Glycine max
  Coding DNA Sequence Number=SeqID_35431
AFSGGALVLTNMDGEELPSPMNSDVGQDHLELPFGVETKHEQQKPIKERMQVGMGSRPTGRRPFLHAKQAENVAARQP

SEQ ID NO: 127117 - protein, 77 aa, Glycine max
  Coding DNA Sequence Number=SeqID_35432
MKVRLCSVLYRNRETSLEDSTSIEGFLSMWGFNGELRQFVVAIGDLWVVKKKLGMLGKGFGRKKEKGMAVFQGYTKK

SEQ ID NO: 127118 - protein, 248 aa, Glycine max
  Coding DNA Sequence Number=SeqID_35433
MAKSHKRGLDWLSKLKVIDEENFEALEEDEEVQALKLELGMARRAKEKFKSATTNIRKECAELREENAITARALEQETKRARKEEHGRDKFRGALWGSNSELKLRREERDHSRVHGIILKEELAACSRSKRSLAQHLEATERSMLAIIGLYKEELNQSLTHEQKLVEDFAQAYAEKEARGRVIDALHQEATMWMDRFALTLNGSQDLPRLLAKAKAITEVCSAPEEIHGLINCCQHMIDLMAHIIRNR

SEQ ID NO: 127119 - protein, 165 aa, Glycine max
  Coding DNA Sequence Number=SeqID_35434
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=1e-24, Identity=52%"; Hit description =Putative uncharacterized protein
  Subcellular localization annotation: CTP_CleavageSite=30; ConfidenceScore=5.17e-01
MTMITPSSKLTLTKGNKSWYRAPPRVCVCVQRAVVAYEQLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 127120 - protein, 129 aa, Glycine max
  Coding DNA Sequence Number=SeqID_35435
  Subcellular localization annotation: CTP_CleavageSite=23; ConfidenceScore=5.15e-01
MTLVFVVAKSPSRPLMVSSWCLVSSHLSQVSFVCSLSHSVWLIHVSHLPLTENPDPIVGGSHHLLCYGCRNLPFGRRANWGSRVHLPMEEAHGVATNVYSRKTSENRIMWSTNFKCERFRNCFYAQGRY

SEQ ID NO: 127121 - protein, 119 aa, Glycine max
  Coding DNA Sequence Number=SeqID_35436
  Homolog annotation: Hit_ID=Q2HW90; Match level="QueryCoverage=85%, HitCoverage=21%, E-value=6e-08, Identity=28%"; Hit description =Putative uncharacterized protein
MEQLQLQAFRKAYGKIWDLAMVEVSTEAISSLAQYYDQPLRCFTFGDFELSPMVEEFEEILGCPLGGRRPYLFSGFYPSLARISKIVQISAQELDHRKQVKNGVVRNTEKIFGAKPRLS

SEQ ID NO: 127122 - protein, 104 aa, Glycine max
  Coding DNA Sequence Number=SeqID_35437
MTRGNPSDLQPFDPEIDRTFHGLVRHHLVPFEHPENSVIGDFEHNSFEHSENMAQPPPRERTLKEMAAPDFTYASLCIQYPHEDVPYALKTGLIHLLPKFHGLA

SEQ ID NO: 127123 - protein, 182 aa, Glycine max
  Coding DNA Sequence Number=SeqID_35438
SLNTFLEKPVVLAEGESLPVYSRYYRKPTDIREIEAALCIPGRGFGLNDEGHHGKILKKDLTTLAQLDMNVGALISSQITSMAQSNSSRLGFPALITALCRSRGVASDSLVFERLSLVINLAYIRKSYWNHADLTVTIRGARRARARPAEAPSTSAAPPPAPSAKRNTPGLSVRKNPEDELY

SEQ ID NO: 127124 - protein, 93 aa, Glycine max
  Coding DNA Sequence Number=SeqID_35439
MEASVSPYKSTTLTFHSGIRTLESQRVLEMPEKTERRSGPLKAGQLQKCAKRGHESFKEYAQKVEGSGGPGGTPNDGKGEDDRDGRHIIDTLL

SEQ ID NO: 127125 - protein, 166 aa, Glycine max
  Coding DNA Sequence Number=SeqID_35440
  Gene Ontology: Mol. function=helicase activity; Biological process =viral genome replication
  Homolog annotation: Hit_ID=Q2R1R7; Match level="QueryCoverage=62%, HitCoverage=6%, E-value=1e-25, Identity=54%"; Hit description=AT hook motif-containing protein, putative
NIRDSSEDESSESTQGSASVSSPENQNYMSSANEPAINREGYSDLGGQLIHGATVMQICGSKVELPLLQNPPKYLYQLLYDHDTSDSKNYQQNIRTYNMMFAFTSTGIKFDKSINHSRGPPTIKIQGQPCHRIGSMLPMPGKEPKFAQLYIFDTENEVQNRINAIR

SEQ ID NO: 127126 - protein, 221 aa, Glycine max
  Coding DNA Sequence Number=SeqID_35441
  Homolog annotation: Hit_ID=Q6UUU1; Match level="QueryCoverage=32%, HitCoverage=46%, E-value=1e-18, Identity=71%"; Hit description =Putative uncharacterized protein
MVKVGTSYVPDQRLIFAKSWPRASRYQQGHQDLFILRSDLPSQWLLFLSAVPPCSATDGVVRKRQKHRRTSALASVAVTAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGARFPGRCQEDT

SEQ ID NO: 127127 - protein, 150 aa, Glycine max
  Coding DNA Sequence Number=SeqID_35442
  Homolog annotation: Hit_ID=A0ST23; Match level="QueryCoverage=16%, HitCoverage=51%, E-value=3e-07, Identity=100%"; Hit description =Putative reverse transcriptase
VLLSATDGVVRNGKSTPDISAAKCSGHAARRVPFAIQAAQLLGRAIGAGLFAITPAGERGMCCKAIKLGNANQAYRYRRPRGGARYQLLFPLVRVNFELGVIMVIAVSFGKPVVPAALMNRPTRGERRFAYWALAECILAYYVALMRVSV

SEQ ID NO: 127128 - protein, 120 aa, Glycine max
  Coding DNA Sequence Number=SeqID_35443
AQKTTLVYACYQAFRLTDSKKVYTDNHSGISARQRDSKVSMTDLVSVEDDGAEDDISLCVLSGFSSYRQQKVYTDNHSGISARQRDTKVSMTDLVSVEDDVNLRMSTGLSNAIDEDRRRR

SEQ ID NO: 127129 - protein, 69 aa, Glycine max
  Coding DNA Sequence Number=SeqID_35444
MAGTNPNDGVGLSQFQMQALMHHLERLMKQRDDALHERPNRIDGIKLNIPPFKGKNDPEAYLEWEMKIE

SEQ ID NO: 127130 - protein, 51 aa, Glycine max
  Coding DNA Sequence Number=SeqID_35445
MGVEEKNPKFQEPWELRSNPFQGGGNNAILLHKGIGWKAPRRLGQRCKKRP

SEQ ID NO: 127131 - protein, 170 aa, Glycine max
  Coding DNA Sequence Number=SeqID_35446
  Gene Ontology: Mol. function=nucleoside-triphosphatase activity; Cellular component=intracellular; Biological process=DNA replication initiation
  Homolog annotation: Hit_ID=A5FHS1; Match level="QueryCoverage=74%, HitCoverage=35%, E-value=3e-35, Identity=59%"; Hit description =ATPase associated with various cellular activities, AAA_3
QQLSPAENTAALLSKYILELKKEGIYIGRLNPIYTSSPMESVFVLPENDMSIPEEHANSGSMIRTEDKTEAVGRVITAQQLKNYQQLVKEIIVEAQLMEYIAKIIVNTRENQFLYLGASPRASLALLTASKAFAALRGRDFVTPEDIKEASYAVLRHRVIVSPEREMEGL

SEQ ID NO: 127132 - protein, 283 aa, Glycine max
  Coding DNA Sequence Number=SeqID_35447
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVWRPLGTLWTQISPTGPGIPALITGLCQSFESRCTYQGAPPPPHQAGQAGAFDIEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 127133 - protein, 18 aa, Glycine max
  Coding DNA Sequence Number=SeqID_35448
SKYSMGSGLWRVSLIEIN

SEQ ID NO: 127134 - protein, 305 aa, Glycine max
  Coding DNA Sequence Number=SeqID_35449
  Homolog annotation: Hit_ID=Q84VH5; Match level="QueryCoverage=97%, HitCoverage=48%, E-value=1e-129, Identity=74%"; Hit description =Envelope-like protein
LSSLSIPSTPPDVEKDVPTSSGPNAEVLSSPSKERSTEEDDQATKETPAPRAPEPAPGDLIDLEEVESDEEPIANRLAPGVAERLQSRKGKTPPKRSGRIKTMAQKKSTQSLLPHQKEQGPRNLGERCLENVPDAPLDNISFHSIGNVEKWKYVYQRRLAVERELGRDALDCKETMELIKAAGLLKTVTKLGDCYEGLVREFIVNIPSDITNRKSDEYQKVFVRGKCVRFSPAVINKYLGRPTDGVIDIAVSEHQIAKEITAKQVQLWPKKGKLTAGKLSVKYAILHRIGAANWVPTNHTSTVAT

SEQ ID NO: 127135 - protein, 100 aa, Glycine max
  Coding DNA Sequence Number=SeqID_35450
  Subcellular localization annotation: CTP_CleavageSite=60; ConfidenceScore=5.60e-01
MHTQSFTIPQFPKIGLTHKNSPQWSRQLSQPTLLRASEARLTGASSKGGKCAESPPTFICGKRRKNRRKPVMKNIPDSGVVFMFEEGIGTSHVCPKGQQP

SEQ ID NO: 127136 - protein, 179 aa, Glycine max
  Coding DNA Sequence Number=SeqID_35451
LQVVPFVVRLMKQANVFPLKKTLKKFIIWEINSDKGILKEAFQASRPIQQGPYIFQRTTKLEETLTQFMHVTMSNHKSTESTLKNLEVQVGQLAKQIADKSSNSFVANIEKNPKEECKAVMTRSKRFVEAEDEETVVHKKKAAEKKGTDGKKNDVRGESNQEKEKQIMVKKKEFNDQEK

SEQ ID NO: 127137 - protein, 59 aa, Glycine max
  Coding DNA Sequence Number=SeqID_35452
  Subcellular localization annotation: CTP_CleavageSite=20; ConfidenceScore=5.02e-01
MAHQMSRGFSMTSIRCVRVVSSEKWRLRKPNKGFLLQNPFLVGVLVCAKGMAFVDNWVV

SEQ ID NO: 127138 - protein, 189 aa, Glycine max
  Coding DNA Sequence Number=SeqID_35453
  Homolog annotation: Hit_ID=Q5NRP4; Match level="QueryCoverage=51%, HitCoverage=6%, E-value=5e-08, Identity=34%"; Hit description =Putative gag-pol polyprotein, identical
  Pfam annotation: Domain name=zf-CCHC; Domain location=116-133; Score =22.7; E_value=0.00056; Accession=PF00098.14; Description=Zinc knuckle
MSHHSSSVNGKGRHRSHLRPHSHRREKERKPQKANIKLSYFHGKDNVEANLDWEIRVEQQLKKNSTSKSYGSHSYPKKDQGQGILGVTPSKPKDDKGKTIEKQAPKASMQEKTSSRKCFKCLGRGHITSQCPTTKTMIMRGQEIYSSQDEATTSPSSSESEKAKAEESSEEIYPQEEGQPLVVKEKCKE

SEQ ID NO: 127139 - protein, 58 aa, Glycine max
  Coding DNA Sequence Number=SeqID_35454
GGGCRPARPGELSSPRRAQLAQASSARPGELSSPRRAGLLPPEATAFWRNLLEGPNGP

SEQ ID NO: 127140 - protein, 258 aa, Glycine max
  Coding DNA Sequence Number=SeqID_35455
  Gene Ontology: Biological process=transposition, DNA-mediated
  Homolog annotation: Hit_ID=Q1J7G7; Match level="QueryCoverage=12%, HitCoverage=47%, E-value=2e-11, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIAATSGASTASALTTLRSGCSRPACSVVAARASTVNFELGVIMVIAVSFGKPVVPAALMNRPTRGERRFAYWALAECILAYYVGTDEGYIPLPRSLTRYARSFDCGRAGMAYERGGDFLEDARKILNRE

SEQ ID NO: 127141 - protein, 77 aa, Glycine max
  Coding DNA Sequence Number=SeqID_35456
  Subcellular localization annotation: CTP_CleavageSite=39; ConfidenceScore=5.41e-01
SVAVTLRVTTTPAALNAPLQGASHSPFRLRNCWEGRSVRASSLLRQLAKGGCAARRLSWHNLHLKDSFRGGLFTDTH

SEQ ID NO: 127142 - protein, 164 aa, Glycine max
  Coding DNA Sequence Number=SeqID_35457
MTTLTQTWSVLSLSTLIPTYHTSDVTLDRAKLIYGIIMKMNMNVGYLISHQISLIAPHDTSRLGFPALITTLCKARGILQGLGLPSIMSMEEFDAQVAWPGNQPSSSRGGGASTAQEPVIEEPSAAAAEEETTPEETQLSTPVAEPEQPIQNSSAAPALDLNKD

SEQ ID NO: 127143 - protein, 97 aa, Glycine max
  Coding DNA Sequence Number=SeqID_35458
MDLEERLRIFAKIGEKLAAQLAQASKVASSRSNSLLEESSGGPKSYGNSRIAQKHLFPTSATLRNFTDHASLLPFGFLRHLGTSFIACHQVIIPGRN

SEQ ID NO: 127144 - protein, 43 aa, Glycine max
  Coding DNA Sequence Number=SeqID_35459
VSQRDVYLGAYLNGPDNYLKGIINSAIKGLDDAPQPKSKGSCL

SEQ ID NO: 127145 - protein, 102 aa, Glycine max
  Coding DNA Sequence Number=SeqID_35460
MGGGAAASEKETPPFFKKLHVLGRVSEWVTVFAVLVVHGGCVGSADGGFRWLCWLGRWLGSADGGSRRRKGAEWWLVVALGCSGVLTVRIPLSLSLSDMHSN

SEQ ID NO: 127146 - protein, 70 aa, Glycine max
  Coding DNA Sequence Number=SeqID_35461
MCETSGFSRPGDNIEHRNIVRSPIGNLVPLDLEIEATLRRNRAERRRKLLQDKTVASIPEEEAQSFDSTS

SEQ ID NO: 127147 - protein, 186 aa, Glycine max
  Coding DNA Sequence Number=SeqID_35462
MGDQEETEEQMKADMSALKEQMASMMEAMLSMRQLIEKNAATAAAVSSAAEADPTLWATAHHPPSNIVGRGRDTLRHDGSPHLGYNRAAYPYGLPHNYSPPVLQEDAGHIASPVLEREPPQQPDEVHKDPQDYARRDVEFYPPIPGRPAPGTLPQPNIAAPPTVLSTEGPPLATEERRSSISLRKD

SEQ ID NO: 127148 - protein, 307 aa, Glycine max
  Coding DNA Sequence Number=SeqID_35463
  Homolog annotation: Hit_ID=Q6WAY6; Match level="QueryCoverage=93%, HitCoverage=60%, E-value=2e-29, Identity=28%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGCLPSLSRIATVVKDSARDWVPFMDVLALLIFGVVPLPNVDGLVDLAAIDAFLAYHHSKEKSGGAKRVAHGSSVAYPPSVFDWDQLLAGIGGRTISWFPRWKEGKEGVLFSCGRYPNIPLVGTRGCINYNPTLAIRQLGYPMRGAPTEESMSPFLVRDLGAQNSKTIQRIHKAWETPLRKDQELRGIRNGTIGGYHEWLKVHIR

SEQ ID NO: 127149 - protein, 159 aa, Glycine max
  Coding DNA Sequence Number=SeqID_35464
MKKSLLELSSHDPLLAQNKLLSKQLDILTETLGKLPTELLQVVPSVVRLMKQANVFPLKKTLKKFIIWEINSGKVMTTKDDDKGDEQKPQRSKNKSSESKNISSESRTSQEFKNQEEFKTQEENLESRIKIQDSRSQESRSRFKTQDSRMKKRLNQDKY

SEQ ID NO: 127150 - protein, 67 aa, Glycine max
  Coding DNA Sequence Number=SeqID_35465
MSALPIIVKQNSPSVGLFPTNRERELGLDRRETVIQPSTRGTVDSHNWSSRLVEKPGARSYRALDYD

SEQ ID NO: 127151 - protein, 100 aa, Glycine max
  Coding DNA Sequence Number=SeqID_35466
  Subcellular localization annotation: CTP_CleavageSite=37; ConfidenceScore=5.55e-01
MHTQSFTIPQFPKIGLTHKNSPQWSRQLSQPTLLRVSEARISGAFSKGGKFAELPPMFICGKRQKNRRKPVIKNIPESGVVFTFEEGISTSHVCPKGQQP

SEQ ID NO: 127152 - protein, 172 aa, Glycine max
  Coding DNA Sequence Number=SeqID_35467
MAKYDPEIVMEFYANAWPTEEGVRDKRSWVRGQWIPFDEDAINYNHNSDLPLPKCQLVYTILTHVSIHVAQLISDAIYQFAGITPPRHPVDLEKSNRALGFPALITGLCQFYGVTVTPVKLIRPPINRAFIEKYYVPRQAPQQGQTQQQEEGQQQLATDATDQQAANHWGQV

SEQ ID NO: 127153 - protein, 45 aa, Glycine max
  Coding DNA Sequence Number=SeqID_35468
MPPFDFRHITEYSQIALGQKMLTTLGKVLMMTFVTALLLGFESYG

SEQ ID NO: 127154 - protein, 198 aa, Glycine max
  Coding DNA Sequence Number=SeqID_35469
MKREKHASYSSHNSCKSLSEELHDYYEGRHRSHLRPHSHRREKERKPQEANINLSYFHGKDNVEANLDWEIRVEQQLKKKSTSKSYGSHSYPKKDQVQGILGVTPSKPKDDKRETIEKHALKAKDTLLLNAPPNKTMIMRGQDIYSSQDKATTSPSSSESEEAKGEESSEEIYPQEEGQPLVVKEKCKEVLLGTKSLD

SEQ ID NO: 127155 - protein, 136 aa, Glycine max
  Coding DNA Sequence Number=SeqID_35470
  Gene Ontology: Mol. function=nucleic acid binding
  Homolog annotation: Hit_ID=Q2H7J5; Match level="QueryCoverage=100%, HitCoverage=73%, E-value=4e-14, Identity=28%"; Hit description =Putative uncharacterized protein
MSLLDIVGVTPTEMTLSTVFAYLEGERLNNVVWALQQFQGLFMKVDALLGNVKAGRCKMLVGKKNAWNYVMKAWGSLVDCLCESYFDEYLKKFEMACFPWPMFVDYVCQTWVIPYKEKFVKAWTNKVMHLGNTTTN

SEQ ID NO: 127156 - protein, 155 aa, Glycine max
  Coding DNA Sequence Number=SeqID_35471
MTNLTWIWMKLLFSNILPSDHNANLRLQMYRLGSRPQDAQWTQISPIGPWGFQLWLRASIVLQGVRSPGKGSRLQDTQWTRRSPAGSWSCQALITGLCQFYGVPITSSKGIRPPTNRAFIKKYCVPRQAQGEIPQQPGDGRQRATGAPPSPLEFT

SEQ ID NO: 127157 - protein, 99 aa, Glycine max
  Coding DNA Sequence Number=SeqID_35472
MTSGSSKANCCQIDSLKELTSQGSFVAHGRQDVLTATIGRPEHPGCVRAAGVNVTIKQYFGLTPRTSCTSSSMAPEGLEHLTQQIRDQLEESITEKVTR

SEQ ID NO: 127158 - protein, 978 aa, Glycine max
  Coding DNA Sequence Number=SeqID_35473
  Gene Ontology: Mol. function=endopeptidase inhibitor activity; Cellular component=plasma membrane; Biological process=peptidoglycan- based cell wall biogenesis
  Homolog annotation: Hit_ID=A8GHX1; Match level="QueryCoverage=62%, HitCoverage=36%, E-value=1e-166, Identity=52%"; Hit description =Alpha-2-macroglobulin domain protein
  Pfam annotation: Domain name=Transgly; Domain location=715-851; Score= 161.2; E_value=2.8e-45; Accession=PF00912.13; Description =Transglycosylase
MAQFWSEDSFGAADRKMVVAAPLVSELATPRFLASGDQSTLALDLTNLTDQPQTLNVAVNASGLIALNGQIPARVQLAKGARTTLAIPVKAQDGFGEGDVQVTVSGLSLPNETLAPSVRRWKIGVRPAYPAQTLSFDNVMNSGQRWQVMASAFNGLQASTLSGQLSLSSQPPLNIASYISQLYAYPYGCLEQTASGIWPSLFTNHAQLSAMGIKTSSDEARRAAIDTGIARLAGMQRGNGSFGLWSKESSEEFWLTAYVTDFLLRASEAGYSVPEGVINRADQRLLRYLQDPAQIETSWSSDADALRFSVQAYAGLVLARQQQAPLGALRALYDQRAQAKSGLALVQLGVALQQMGDTQRAQLALMQGIALQRQPDMWLGDYGSPLRDRALTLALLRENQLLPAQQGPLLIELAQTLHGQRWFSTQENNVLFLAARTLQQHPGEVWQATLQDQPLRSDRPLSLGLSAQQLQQGLTVTSDTPSPLYGTLNVVGYPRTAPSPVSNVLSISREYFTLDGKPADLNNLKSGELLVVRLKVGARQRVSDALVVDLLPAGLELENQNLSDSSASLGDSADALKESMMDMQQANIKHLEFRDDRFVAALALDGYTPGHAAVSGARGDAGQLSSAATAGGVDVCARVARHRHHAGKTSCALSARDAAPPTPVRAGAAVTAAGGRSMAAGLARSAAAAPVTAGAGGGSGRWHAAVALCRSTGCVALSGDAGRDRWFWHHPGINPLAIVRAVGQNLLQHDIVSGGSTLTMQVARLIDPQPRTLRGKVVQAWRALQLEWHLSKREILTLYLNRAPFGGTVEGVGAASWMWLGKPASQLTRGEAALLAVLPQAPSRVAGADRRRNQTGAGMAAAASAAATGAAAGTPAAVAVARQQNYLHAGCVAAARTGEPRCVAANPAAAAHLAGTAGCRPQHHEGARLRRLGCATPLWRLSSRQFRQRLSRPGQRQRSAAAFAQSAGGAAAEALGPK

SEQ ID NO: 127159 - protein, 268 aa, Glycine max
  Coding DNA Sequence Number=SeqID_35474
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
LELLRADQRLISPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLLAGYYFEHVRIDRCYTVNEFMHLSCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAK

SEQ ID NO: 127160 - protein, 97 aa, Glycine max
  Coding DNA Sequence Number=SeqID_35475
HGPEIYPKAHKNPRAFSCISGPIYLEFSIQCPCGSFASQVLQGKVAEEPQLFVISGAVAVIVVAAGLVEERMVCLGQQHSENKVVVVVAAVVKDSTI

SEQ ID NO: 127161 - protein, 192 aa, Glycine max
  Coding DNA Sequence Number=SeqID_35476
MGEAEEVQEKMKAEMEAMKEQMATMMEAMMSMKKIMEANAVIVAATSAVAKAKIWEVRMTHDVQIQNKHAFPPYGLPPKLYTTNVAYIPNEDVNNSTPILIKSQQPQSDHAHVSRPMEETHEIPHHDLADFEPCLGYAAEGQAVGGVPLQNTLEGPQYHPQPQPSHSTAIKNPHDYGKNGKVGSSRGKAPGH

SEQ ID NO: 127162 - protein, 137 aa, Glycine max
  Coding DNA Sequence Number=SeqID_35477
MTCSTGDVKRAAQELFVVHWLSMCGWFHTLFSKKVGPSIRYKEGRIRILSSCKGCPNVPLMEQGGRELRGSSNGSIGGYHKWLRVRTQGLDWLPNLKTMRDDEVKASEESHEVQALKAELERARVVEEKFKSIAIKV

SEQ ID NO: 127163 - protein, 266 aa, Glycine max
  Coding DNA Sequence Number=SeqID_35478
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNSMPFPLLGCARGYLNPPWLACTQIFAEPISGRSVWRNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127164 - protein, 148 aa, Glycine max
  Coding DNA Sequence Number=SeqID_35479
MTRRDKIWSFCTLVSSRGGGPDDTRRYLTIIRTLLSSRGGGPDDKQRPMWSFCTLVSSRGGGPDDTRRYLTVIRTLVSSRGGGPDDTRRYLTVIRTLLSSRGGGPDDTRRYLTVIRTLLSSRGGGPDDTQRQNLVILHPCVIQRRWAR

SEQ ID NO: 127165 - protein, 233 aa, Glycine max
  Coding DNA Sequence Number=SeqID_35480
  Homolog annotation: Hit_ID=Q8XW66; Match level="QueryCoverage=76%, HitCoverage=90%, E-value=9e-88, Identity=90%"; Hit description =Probable lipoprotein
AAQLLGRAIGAGLFAITPAGERGMCCKAIKLGNARVFPEFDLRIPTEPGNRIRVFPASDNSASVLPFFCGCDGLHIRASTRMHRYGSTVLCFGTRAHPRIVGFVRRLPMTLPLVTADERARLLAHGAALAAGQRLDPLPVVRLFTPDAHVTWLLVSLDPADGDTAYGLIDLGIGLPSLGTVKLSDLAGIVGPRKLPVRRDRYFQAAHLLSEYVRLAQENGIKLIDTVDLEGGP

SEQ ID NO: 127166 - protein, 42 aa, Glycine max
  Coding DNA Sequence Number=SeqID_35481
MAPKTCSRPASAPDRTSSIKRYLNYLAQKKENHAREILCKNK

SEQ ID NO: 127167 - protein, 248 aa, Glycine max
  Coding DNA Sequence Number=SeqID_35482
MAESHIRGLDWLAKLKVVSEESFEAPEEDEEVQALKSELGKAKLAKEKFKLAATHIRKECAGLREENATTARALEQETKRARKEEYGRNKFRGALWGSNNELKLRREERDQSRAHSMVLREELVACSRSKRSLSQRLCETETNMLSIIAKYQEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 127168 - protein, 37 aa, Glycine max
  Coding DNA Sequence Number=SeqID_35483
MGTNQTGKRFYQVKVSYPNFVRGPLLDDMRPFFGPCE

SEQ ID NO: 127169 - protein, 106 aa, Glycine max
  Coding DNA Sequence Number=SeqID_35484
MRAHPEREAITHLLCIPGQDFTRAAAKRRVRIMRTNMTTLTWIWMTSLFSHILPSDHNANLPLQMYQLGSRPQDAQWTRRSPIGPWGFQLWWRASVSPTGCPFPQR

SEQ ID NO: 127170 - protein, 68 aa, Glycine max
  Coding DNA Sequence Number=SeqID_35485
KKGVEMRVVITERAGRTKSVSYLCFPLISDERFFLQKAVASRGSNIAPLGELSSPGRAGWQSSSPILL

SEQ ID NO: 127171 - protein, 48 aa, Glycine max
  Coding DNA Sequence Number=SeqID_35486
MMAKVMNKKLKDQSKNNSSESKNISSESRTSQEFKIRIKKNSRLKKKV

SEQ ID NO: 127172 - protein, 92 aa, Glycine max
  Coding DNA Sequence Number=SeqID_35487
  Subcellular localization annotation: CTP_CleavageSite=38; ConfidenceScore=5.32e-01
MPITPCKSISWSVSSRHGDRTHKTPSGPGKVQQGPGVSSSGIAPARHPVGPKEVQQGLGSCQALITGLWSVLREYLSPQARASGPQLIELFI

SEQ ID NO: 127173 - protein, 152 aa, Glycine max
  Coding DNA Sequence Number=SeqID_35488
MAPTRHPLDPGKSNRALGFPALITGLCQSFGVPVAPTKVIRPPITRAFIEKYCTQRQAQGDAPQAAGAPPPPHQAGQAGAFDMEQYLRHLVRQQAANHRAHTSSGQRLHGPEIGPRPKQAEAPPEAPGDGEEAHEDEEMADLLDFLGGSGDT

SEQ ID NO: 127174 - protein, 187 aa, Glycine max
  Coding DNA Sequence Number=SeqID_35489
  Homolog annotation: Hit_ID=A1IW39; Match level="QueryCoverage=45%, HitCoverage=96%, E-value=1e-15, Identity=60%"; Hit description =Putative uncharacterized protein ophh-69
MGDKLHRREGNSPDHQLRPLNDRSVIKEVGVQRQPGGCLEAATLERVRNSSLIERSCAKMTGLAICRSCGMTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSRKT

SEQ ID NO: 127175 - protein, 103 aa, Glycine max
  Coding DNA Sequence Number=SeqID_35490
MSNTHCRGICKVPGCFGKKAAKNTKVGVNLSNTGDIGEGEENKEENQVLNTSKNQTRLILLQDSYKIVSTNKALIQDFFKIKPCLTMKGFKSFKAHVIDYQYM

SEQ ID NO: 127176 - protein, 276 aa, Glycine max
  Coding DNA Sequence Number=SeqID_35491
  Homolog annotation: Hit_ID=Q6UUU1; Match level="QueryCoverage=21%, HitCoverage=40%, E-value=4e-18, Identity=78%"; Hit description =Putative uncharacterized protein
GPGLPGINRDTRIYLFCEVIFRHSGFCFYQLSLPVQLLTGWCVTAKAPPDISAGKCSGRVPFAIQAAQLLGRAIGAGLFAITPAGERGMCCKAIKLGNARVFPEFDQLSPNITLHNVLYIPTFTFNLISISKLVSYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127177 - protein, 102 aa, Glycine max
  Coding DNA Sequence Number=SeqID_35492
MSHHSSSVNGEGTSHKDPLSRILDELSSLNSHDSCKSLSEELSDYYRGRHRSHPRPHSHRREKERKPQEANINLPYFHGKDNVEAYLDWEMKVEQLFAWHHT

SEQ ID NO: 127178 - protein, 55 aa, Glycine max
  Coding DNA Sequence Number=SeqID_35493
MDEDQWAYYSAMSEEVDMDFQNEEDCGVNEAHVDCSNAFNTSQVFETREDVLKWA

SEQ ID NO: 127179 - protein, 194 aa, Glycine max
  Coding DNA Sequence Number=SeqID_35494
MTRGNPGDLQSFDPEIDRTFHRLVRHSVHLDHFVHFEHSEYSVAGNSEYSDFEHSTTNFHTENMAQPPPHERTLREMAALDFTYESLCIQYPDEGVPYVLKTRLIHLLPKFHGLAGPFSSGMTLRGCSWRNSSLHLGPLPSEKTFQASGNLVERACRSTGKDSRNCVQAVLTTRFLSNSFFNISTRDLATWRGV

SEQ ID NO: 127180 - protein, 146 aa, Glycine max
  Coding DNA Sequence Number=SeqID_35495
MEKGQGRSCLAQRLLNFDSPGQQAGGVLILCDNTTERVALLGGQLCDNTTEKAALSFNMLWSQRPYEIVMSFTRSKPGPRAVRKIGRNLSGTTHPTLPPIGGRPFYSRPKRTAVILNRDPTAIDRIPIKIPLDRAPVISYPGQNLG

SEQ ID NO: 127181 - protein, 147 aa, Glycine max
  Coding DNA Sequence Number=SeqID_35496
YTTEESDGNKKVYKYKGPGRNVITPEWYKEQYADPSRSLIKKVTYQFRPDWKELSVKKKESTTTLRTLSNSKRIPFFNEKEKENSALSQKLQKLEQERGIIAQRRVEEGNNTEDNNTLEQNNAKRAEDNINGDLLDPDTMPRDKKPP

SEQ ID NO: 127182 - protein, 139 aa, Glycine max
  Coding DNA Sequence Number=SeqID_35497
MTWKSVLEVEESAYADEDQGRLEVGIKGKEEQHICMQSTEGSGVAKPKPLVIYFTKSAASQKPGHPLMAKPVPFPYQNSHAVPWRYTPPGKKEEEVTDVSSLSAKVTNITGLSGVTRSGRVFAPPDLPVQPADVKGKES

SEQ ID NO: 127183 - protein, 140 aa, Glycine max
  Coding DNA Sequence Number=SeqID_35498
  Homolog annotation: Hit_ID=A5B6Y9; Match level="QueryCoverage=29%, HitCoverage=8%, E-value=7e-14, Identity=85%"; Hit description =Photosystem I P700 chlorophyll A apoprotein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDE

SEQ ID NO: 127184 - protein, 65 aa, Glycine max
  Coding DNA Sequence Number=SeqID_35499
MKKIQGLQVPHGATSVKVSDEELDDAILPRKGPVTRAMSKRLQEDWAIAVEEGPRVLMNLKGSIM

SEQ ID NO: 127185 - protein, 241 aa, Glycine max
  Coding DNA Sequence Number=SeqID_35500
  Gene Ontology: Mol. function=RNA-directed DNA polymerase activity; Biological process=RNA-dependent DNA replication
  Homolog annotation: Hit_ID=Q5NRP4; Match level="QueryCoverage=40%, HitCoverage=6%, E-value=2e-09, Identity=36%"; Hit description =Putative gag-pol polyprotein, identical
  Pfam annotation: Domain name=zf-CCHC; Domain location=72-89; Score =22.6; E_value=0.00058; Accession=PF00098.14; Description=Zinc knuckle
DNVEANLDWEIRVEQQLKKKSTSKSYGSHSYPKKDQGQGILGVTPSKPKDDKGKTIEKQAPKASMQEKTSSIKCFKCLGRGHITSQCPTTKTMIMRGQDIYSSQDEATTSPSSSERQPLVVKEKCKEALASIATPLGLEFIPQVKKLLDEGLVRKSLNPCALLVPKIGVPMNPKRIKIIPEWLTPPTPLIELVRNHVPSWEDAQEMGVEGRSPEYEEPHDLRSNPFQGGGNDAILPHKGIG

SEQ ID NO: 127186 - protein, 118 aa, Glycine max
  Coding DNA Sequence Number=SeqID_35501
MLPFDFRCVTETYGLCINIFWFSGMSWNFTNCLMMGAKHLTRTKERSHVIKQRSPDEIRGEKECGSNVFQGHFDDSKESRVKQNPQIQESSFKFQDSRIIKIKIQDSRFKNQEKTQSR

SEQ ID NO: 127187 - protein, 149 aa, Glycine max
  Coding DNA Sequence Number=SeqID_35502
MASFSQMQSQLQSQMQSQGLALPLEPEVGPSAAHVSTNGSCVDPSPTDPEMGDSDKCGLYIEENPSRLVALGRVYEGFTVVHNITLLHGQVKVGVEEVKDAEAPVPIPTDEAVVSPAKPPDRPDPEVDDPLYQMTLTIPQLLLKPLQVM

SEQ ID NO: 127188 - protein, 37 aa, Glycine max
  Coding DNA Sequence Number=SeqID_35503
MEVDEPWLGFMATIELSNFVVDLGMAFVDNWAVGKEK

SEQ ID NO: 127189 - protein, 109 aa, Glycine max
  Coding DNA Sequence Number=SeqID_35504
  Pfam annotation: Domain name=Ins_element1; Domain location=3-59; Score=-24.8; E_value=0.036; Accession=PF03811.4; Description =Insertion element protein
  Subcellular localization annotation: CTP_CleavageSite=77; ConfidenceScore=5.81e-01
APVASVSISCSSCSATDGVVRNGKSTRRTSALASVAVTLRVTTTPAALNAPLQGASHSPFRLRNCWEGRSVRPLRYYAAAKGGCAARRLSWVTPGFSQSRRCKTTASEF

SEQ ID NO: 127190 - protein, 239 aa, Glycine max
  Coding DNA Sequence Number=SeqID_35505
  Gene Ontology: Biological process=transposition, DNA-mediated
  Homolog annotation: Hit_ID=Q6UUU1; Match level="QueryCoverage=30%, HitCoverage=51%, E-value=1e-20, Identity=72%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPEFDLGVVVKEYVSHSKDHDSCPSSWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERNGLRTGRRFLEDARKILNRE

SEQ ID NO: 127191 - protein, 102 aa, Glycine max
  Coding DNA Sequence Number=SeqID_35506
QTQLDVPSTCTTKDVPSNVLRQRSQAVKPLILCEWGYKRILRLCLFEFFDKGEGRHKRIQAGGENEKMNSTSFQALENQKTSESFWYKEEEEVQRDSRLVKD

SEQ ID NO: 127192 - protein, 112 aa, Glycine max
  Coding DNA Sequence Number=SeqID_35507
NKRGYISCGSVLVEGTSTRFKENKEGVEQQLKRKPSYKNSTSYSYTKKDQAPSVLGVPPSKPKDDNGKNIKEITPKASSQDRTSNINGSKGEAKGDEHIEEVYPYEEGDLQM

SEQ ID NO: 127193 - protein, 116 aa, Glycine max
  Coding DNA Sequence Number=SeqID_35508
MVSDVDSANKFGDGVGDLDAVRFLSRLVHTTTSIFLFRIQIRVRERVVDVVVIVREVAVQGFNPSKVGDSIWVKGGWESYDMDEVEEGTTWRRPWSAMLARSRKEHRGEKSCNIAK

SEQ ID NO: 127194 - protein, 66 aa, Glycine max
  Coding DNA Sequence Number=SeqID_35509
MGVQNKQPRPHLGPSQEDFLPERAVGFLEGKQPCSPGRAGWQSFSPIFLIKLGGESEEKFSFQPLP

SEQ ID NO: 127195 - protein, 145 aa, Glycine max
  Coding DNA Sequence Number=SeqID_35510
MTSHRFRSAVHQQRFEAIKGWSFLRERHIQLRDDEYTDFQEEIGRRRWASLVTPMAKFDPEVVLEFYANAWPTEEGVRDMRSWMLSASSWDIRWCWKRARSASMARGGTGLMGPMKRPSLSCYVYRGRILAGLLPEDGCGSCAPI

SEQ ID NO: 127196 - protein, 61 aa, Glycine max
  Coding DNA Sequence Number=SeqID_35511
MEEGYAASSEVGQVHLRMRKMLLVEVLDPAFPTSICLQHKLQAVQLLQIVAQKGKGLCGGR

SEQ ID NO: 127197 - protein, 222 aa, Glycine max
  Coding DNA Sequence Number=SeqID_35512
  Gene Ontology: Biological process=transposition, DNA-mediated
  Homolog annotation: Hit_ID=Q1J7G7; Match level="QueryCoverage=13%, HitCoverage=42%, E-value=5e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDGFTMEDMSLYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 127198 - protein, 77 aa, Glycine max
  Coding DNA Sequence Number=SeqID_35513
MCPQRTHFPINFIRYRHRRGEIERSTTPSPDEDFHLKKLSHNASERDRRKKVCVCVGLWHNLHFKDTFRGGLFTDTH

SEQ ID NO: 127199 - protein, 98 aa, Glycine max
  Coding DNA Sequence Number=SeqID_35514
NVYTDNHSGISARQRDSNVNMTDLVSVEDDQKNVYTDNHSGISARQRDSNVNMTDLVSAEDDGAEDDVSLCMLSGFLSYRYQKNVLKVRTTTWVSPHV

SEQ ID NO: 127200 - protein, 106 aa, Glycine max
  Coding DNA Sequence Number=SeqID_35515
DKELRGSSNGIIGGYHKWLRVRTQGLDWLPNLKTVRDDEVKASEESDEVQALKAKLERARVVEEKFKSIAIKGLYMAELVSSSSEEVKGIIMGQRHDLEGRAKGLP

SEQ ID NO: 127201 - protein, 263 aa, Glycine max
  Coding DNA Sequence Number=SeqID_35516
MKREKHASYSSHNSCKSLSEELRDYYEGRHRSHLRPHSHRREKGRKPQEANINLSYFHGKDNVEANLDWEIRIEQQLKRKSTSKSYGYHSYPKKDQGQGILGVTPSKPKDDKGKTIEKQPLKAKDTLLLNAPPENHDMRGQDIYSSQDEATTSPSSSESEKAKGEESSEEIYPQEEGQPLVVKEKCKEALASIATPLGLEFIPPLKKLLDEGLVRKSLNPCTLLVPKIGIIRYQVPKIGGMMNVLSGATLFCKITRAPNIFME

SEQ ID NO: 127202 - protein, 60 aa, Glycine max
  Coding DNA Sequence Number=SeqID_35517
MTKARQKEVRKVNETRIKVHETNGDHYGQIGEELATQLAQASQVASSKRNRLLEEESGRP

SEQ ID NO: 127203 - protein, 46 aa, Glycine max
  Coding DNA Sequence Number=SeqID_35518
LAEIRGGESLVSSDVVKQYYTTDTFEPYIAAMRGTMHEPQANLGED

SEQ ID NO: 127204 - protein, 54 aa, Glycine max
  Coding DNA Sequence Number=SeqID_35519
MQTLSAPMVSQKRKSLASSSSQIRYDRHKFSSPEAWDRYTNNIFRRKIIPERNV

SEQ ID NO: 127205 - protein, 209 aa, Glycine max
  Coding DNA Sequence Number=SeqID_35520
  Homolog annotation: Hit_ID=Q6WAY6; Match level="QueryCoverage=27%, HitCoverage=9%, E-value=2e-08, Identity=47%"; Hit description =Putative uncharacterized protein
HGLSIVYPLSVCGWFHTYSNKTQDTRVRFKAIAHVPKKGRVDWDQHLAGIGGNAINWFPRWKEGKEGVLFSCGDYPNVPLIGTRGCINYNPALAIRQLGRAKSQGDTKSPQGMEKSIEEDKELRGIRNGVIGGYHGWLRVHTRGLDWLSKLKVINEENFEAPEEDEEVQALKLELGKARLAKEKFKSAATHIRKERTELQEKRGHCKSP

SEQ ID NO: 127206 - protein, 210 aa, Glycine max
  Coding DNA Sequence Number=SeqID_35521
  Subcellular localization annotation: CTP_CleavageSite=71; ConfidenceScore=5.23e-01
MVPLSANLEKLSANPCGNGQLSGPCLAKSPMASRKCKSIGSRPTSQYDTRRFHSFDAWNQYTDNVLGRNILPERKVELYYTELEILRLELERWPPGRILRKDLTTLAQVWSVLSYSNMAPTSHTSDLIVDRARLIFGLVSRMDMNIGALISGQMTSIAQSNTSRLGFPALITALCRARGVVSNSLTFERLSPVINLAYIRKNCWNPEDLT

SEQ ID NO: 127207 - protein, 162 aa, Glycine max
  Coding DNA Sequence Number=SeqID_35522
MGDQEETQEQMKADMSALKEQMASMMEAMLGMSSSWRRTRPLPPLSVRLPKQTHSLGNYAPSSSNIVGRGRDTLGHDGNPHLGYNRAAYPYGLPPNYSPPVLQDDAGHIASPVLEREPPQQPDEVHKDPQDYARRDVEFYPPILEGPAPSTLPQPNIAMQPI

SEQ ID NO: 127208 - protein, 65 aa, Glycine max
  Coding DNA Sequence Number=SeqID_35523
MATSLNNHTIETHMTFKRWLSLSMASRDTIPFDINVVAVGTTNNNISSKRKTLDEVSLSSSKSGT

SEQ ID NO: 127209 - protein, 146 aa, Glycine max
  Coding DNA Sequence Number=SeqID_35524
  Homolog annotation: Hit_ID=A5ATL8; Match level="QueryCoverage=29%, HitCoverage=34%, E-value=1e-15, Identity=93%"; Hit description =Putative uncharacterized protein
TLGLRHGPDSYGRQQWGFFRNGRKPDGAMPREGRRPTVRRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEE

SEQ ID NO: 127210 - protein, 123 aa, Glycine max
  Coding DNA Sequence Number=SeqID_35525
  Homolog annotation: Hit_ID=UPI0000ECBAF8; Match level="QueryCoverage =34%, HitCoverage=49%, E-value=4e-17, Identity=100%"; Hit description= UPI0000ECBAF8 related cluster
IVMAAQLIHDRAVMECLEGVWETLEGNERCRFRGTIQLTATSLVSSSIEFLQPGGSTSSRAAATAGGAPIRPIVSRIKIHWPSFYNVVTGKTLALPNLIALQHIPLSPAGVIAKRPAPIALPN

SEQ ID NO: 127211 - protein, 203 aa, Glycine max
  Coding DNA Sequence Number=SeqID_35526
MASCKRKAATLVSQAGYDRSRFVSQEAWDHYSDNMLARNILPERNVKMYINEFDDFRRELIRRNWHKQLTNLTEGSIDVAIVKEFYANLYVPKDKSPKQVRVRRHLIKFDVDSLNTFLETPVVMEQGESLPSYSRFARLRPNPQELAAWLCIPGRGFVLNVEDFTHCSVQLLAAWISSPDYCLVQGPRSHLRFSYLRVTQPSH

SEQ ID NO: 127212 - protein, 237 aa, Glycine max
  Coding DNA Sequence Number=SeqID_35527
  Homolog annotation: Hit_ID=A5B5V0; Match level="QueryCoverage=98%, HitCoverage=52%, E-value=2e-08, Identity=22%"; Hit description =Putative uncharacterized protein
MEFFSNENFECFQAFENSNLIPFMSLKLPVYSELVKAFYSNLEIHEDVLMSEIYGIKMVIDQSLFYDLTKLPSEGVPFEAALIDEWKFDFSVHDARRLVCTNQADMTGRLLVGSLAFESRILHYLIVHILLPRSSNLSQVSEKDLIVMWAFHKGLQIDWSHLVRYRTDKGLRLNAPLAYPHLVTLFLPHFNIPLDSQPYVPIKRSFPIGASVIASFGYIKEHDGSWVKKGARNIGEE

SEQ ID NO: 127213 - protein, 198 aa, Glycine max
  Coding DNA Sequence Number=SeqID_35528
MTYGELLPSLIANQLVVVVPGKIFQCPFPKWSHGPKLLEDVKTPRRFIYKALQKVGMIPCGGRREDSCLMHPGVLHDMETCSAVRDLLQRMIDQGRLEVSSEREEEQHVYMQSTNEEGPKKPKPLVIHFTRNTAPLIPQHPSAVSGGRSIPFPYENSHAVPWRYAPLGGRKEEATDISSLSTKVTNITELSGITRSGH

SEQ ID NO: 127214 - protein, 86 aa, Glycine max
  Coding DNA Sequence Number=SeqID_35529
MKRKSLKSPDQKISFDLFEAMKYSDMGDACFEEEEVEQEIALLASTMVLQSPLEKEPGYRRDCLACDEELDDSKDSGVDQVVFEEL

SEQ ID NO: 127215 - protein, 157 aa, Glycine max
  Coding DNA Sequence Number=SeqID_35530
  Homolog annotation: Hit_ID=Q2HW90; Match level="QueryCoverage=78%, HitCoverage=35%, E-value=5e-08, Identity=26%"; Hit description =Putative uncharacterized protein
MEPIASLAQYYDQPLRCFTFEDFQLVPTVEEFEEILGCPLGGRKPYLFFGFYPSTTRVAKELSSFRNMEGLVDLAVIDAFLTFHHGKESPVVAILAMYDTFDRGCEKSSARIVCYALALYVWLVSHLFLQEGRPVYPLQGHRSCVEKRKGELGPTLG

SEQ ID NO: 127216 - protein, 170 aa, Glycine max
  Coding DNA Sequence Number=SeqID_35531
MKADLSALKDQMASISEVMLKLQKTIEDKATATASSTVREAEPVLQPTLNPGRDRNTAVFGRRYSPQAYPYGLPPDFTPRAAPEDFSQAPTFEGQLPPYDDYPGQDDEEGDTHLGPLLHLKDPAVEGLDNYPFSDLADLCLVPNIVIPPKFKVPDFDKYKGTTCPKGHLR

SEQ ID NO: 127217 - protein, 96 aa, Glycine max
  Coding DNA Sequence Number=SeqID_35532
MTRGNPGDLQPFNPKIDRTFHRLVRHSVHPGHSMHFEHSEHSVEGDSEYSDFEHSTTNFYTENMAQPPPRERTLREMADPDFTYAQVSWSCRRRSS

SEQ ID NO: 127218 - protein, 155 aa, Glycine max
  Coding DNA Sequence Number=SeqID_35533
  Homolog annotation: Hit_ID=A1IW39; Match level="QueryCoverage=44%, HitCoverage=98%, E-value=1e-17, Identity=69%"; Hit description =Putative uncharacterized protein ophh-69
MGDKLHRREGNSPDHQLRPLNDRSVIKEVGCRDTRSALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDT

SEQ ID NO: 127219 - protein, 89 aa, Glycine max
  Coding DNA Sequence Number=SeqID_35534
MHPPPTSLQPRELIAYRTVRLSSILHFYSEPNEFIVIHASSTNESRAPRIDFLALFAYPPFSTLIFEPHELIFIHASSTNESRAPRIDC

SEQ ID NO: 127220 - protein, 112 aa, Glycine max
  Coding DNA Sequence Number=SeqID_35535
MVHDIFVKVKLKVTRTSTVLNVFGSRRSSDVYDPNMVGSWYLIHETKNARKMQGSCMSKHENKRNDTSITMPWRDAYAMHDMNAFTDTRARKILSSYLCIWGRSAPYVQLRR

SEQ ID NO: 127221 - protein, 120 aa, Glycine max
  Coding DNA Sequence Number=SeqID_35536
MAATSGLWVVGSRGCDDPPRRYDITTLNHPSSPRLASGSPRPCNGFVPKQPARLGELIPSKLSISSPGKVDDHNLSLCANGLDCLWKVRKADDHDLSPRANRLDCLWKAKETLIVSVERH

SEQ ID NO: 127222 - protein, 95 aa, Glycine max
  Coding DNA Sequence Number=SeqID_35537
MITSILGREFLIELAKGLAKTCKRNLQDSGTLKRVAWGLDVGTRVSTTDYRTQLCGMLMRILKLAKYKLKAQVEKDKAPEWRRMKAQRQRHYQDY

SEQ ID NO: 127223 - protein, 208 aa, Glycine max
  Coding DNA Sequence Number=SeqID_35538
  Homolog annotation: Hit_ID=UPI00006A2D9E; Match level="QueryCoverage =70%, HitCoverage=94%, E-value=1e-12, Identity=16%"; Hit description =UPI00006A2D9E related cluster
MAPLPSLQNGQVTKSKRTYTLREFPERFAKDRISPHLPNFTTKVACINIPKNHGGPLGTSTLAFGGLHVLPSRGLHALAFRGLHALAFRGLHMVTFRGLHVLAFRELHALTFRGLHVLVFRGLHVFTFRGLHALAFRGLHTLTFRGLHVLAIRGLHALTFRGLHVLAFRGLHVLAFRGLHILAFRGLRVLTFSGLHSHTLREFKFLCP

SEQ ID NO: 127224 - protein, 119 aa, Glycine max
  Coding DNA Sequence Number=SeqID_35539
MWGCQANLGLFWFRRRTIAAPEVPELSQGPISNSENYLRLCHVGWGGGRKKQTSKKSKNKISFKRTTSSLVFKNPLKTRDPRSLNPFSEIRRREEEIFLKRDRLYNEDESKFLIEYASG

SEQ ID NO: 127225 - protein, 113 aa, Glycine max
  Coding DNA Sequence Number=SeqID_35540
MSLHSSSSVNGEGSTPKDPFSHNSCKSLCEELRDYYEGRHRSHLRPHSHRREKERKPQEANINLPYFHGKDNVEANLDWEIRVEQQRKRKSSLSIPSTSRGGPVPAFVPFSEG

SEQ ID NO: 127226 - protein, 101 aa, Glycine max
  Coding DNA Sequence Number=SeqID_35541
GIKTEPMCDAYAKGATRECIILFEKHIAAVGTTSNNKFSKKKALDEVESPTVATYPSAGGRRVTRGMRVPRKEYARSRHQRLFEENVGKTGKDAIYELSSE

SEQ ID NO: 127227 - protein, 139 aa, Glycine max
  Coding DNA Sequence Number=SeqID_35542
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=70%, HitCoverage=75%, E-value=3e-25, Identity=66%"; Hit description=LacZ protein
  Subcellular localization annotation: CTP_CleavageSite=32; ConfidenceScore=5.04e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAHPVSS

SEQ ID NO: 127228 - protein, 110 aa, Glycine max
  Coding DNA Sequence Number=SeqID_35543
GQDHLGLPSGVKTKHEWQKPIKVLKDERKRGWGHDRPIVALLCAKQAGNVAARQLRGNRAPAMGITGYSHGQWIPFDADAIGQLLGYPLVLEEGQECEYGQRRNRSDGVR

SEQ ID NO: 127229 - protein, 102 aa, Glycine max
  Coding DNA Sequence Number=SeqID_35544
MTKLGLCLSSALNGKGVRITVRMTKLGLCLSSALDDKRVRITVRMTKLGLCLSSALDDKRVRITVRGVRHMTSESVWQRLWGGRQKQSSCSYVSSNEELRPT

SEQ ID NO: 127230 - protein, 129 aa, Glycine max
  Coding DNA Sequence Number=SeqID_35545
KTFGIFIKLGESFSLGSLLNQYQTYQGNPCGVYPDLSSFTQSGVYPDLSSFTGSGVYPDLSSFIGSGVYPDLSSFIRSGVYPDLSSFTGSGVIQNLRSLYQTIRSYSGSHHLVSELRLLIQVLSYFFSL

SEQ ID NO: 127231 - protein, 68 aa, Glycine max
  Coding DNA Sequence Number=SeqID_35546
  Subcellular localization annotation: CTP_CleavageSite=26; ConfidenceScore=5.10e-01
MTWDMSLPLSLKGSFLDSRTRFTRIVESMPKETSISTPRSPSRGRHPTHYLSPTSRENLETSQHSQYS

SEQ ID NO: 127232 - protein, 26 aa, Glycine max
  Coding DNA Sequence Number=SeqID_35547
MEKNEETTMEEKRKAKEKRRGEATIH

SEQ ID NO: 127233 - protein, 41 aa, Glycine max
  Coding DNA Sequence Number=SeqID_35548
MAQPPILRTYQMNTILVGSKTMIVILTPLPSPKDLSLYVLK

SEQ ID NO: 127234 - protein, 70 aa, Glycine max
  Coding DNA Sequence Number=SeqID_35549
TAQGQGDGCLSVPETKATRRGQNGHFLNPSLPRLAFGSPGHEIRFNLKQPTRLGEQPLPQMAFSINSHAR

SEQ ID NO: 127235 - protein, 106 aa, Glycine max
  Coding DNA Sequence Number=SeqID_35550
  Subcellular localization annotation: CTP_CleavageSite=58; ConfidenceScore=5.68e-01
PLGPSRMFLQKAVASGGSNLARLGELENSSRGASVTFPWVISRRLSTVLRRSSTFFVRSSSFFGLQPGVIVHILNITPKEEKRIEGLKRLTLASHISTEKIMLRPT

SEQ ID NO: 127236 - protein, 136 aa, Glycine max
  Coding DNA Sequence Number=SeqID_35551
  Homolog annotation: Hit_ID=Q2HW90; Match level="QueryCoverage=66%, HitCoverage=18%, E-value=3e-08, Identity=35%"; Hit description =Putative uncharacterized protein
MKIKSCKNMGVEVLVIKISILANIGSNQAWSFKKRFYHVKVKNLEVASLRKLGQQMDQVQRQAFSKIYGKIWDLAMIEVSIQAITSLTQYYDQSLRCFTFGDFQLAPIIEEFEGILGCPIGGSHTSFLGTILLWRE

SEQ ID NO: 127237 - protein, 100 aa, Glycine max
  Coding DNA Sequence Number=SeqID_35552
  Homolog annotation: Hit_ID=A5BP71; Match level="QueryCoverage=51%, HitCoverage=13%, E-value=3e-08, Identity=50%"; Hit description =Putative uncharacterized protein
  Pfam annotation: Domain name=zf-CCHC; Domain location=76-93; Score =17.8; E_value=0.0031; Accession=PF00098.14; Description=Zinc knuckle
MGLGLSEQQTPRYSHMTTNLSECVNKWPLGNEVAIPLSDESWTLIPDPSTIRAKVRPKSTRIRSEMDWLEPSEHQQKCSRCGREGHNIHQCPMQSECGSC

SEQ ID NO: 127238 - protein, 84 aa, Glycine max
  Coding DNA Sequence Number=SeqID_35553
MTSRDQVWSFCTLVSSRGGGPDDTRKYPSGYPYKHSFAISTRPIWALQKIPPEGGCFWRKQPCSPGRAELAWASWAATTSPILL

SEQ ID NO: 127239 - protein, 76 aa, Glycine max
  Coding DNA Sequence Number=SeqID_35554
MDLRRFQVSVPGVTGGDTEGPPKCFARVYHQLLTLQWHIRAKARSRLDCGGEFHVSPPRFKRHVHDQFGVVGSQWV

SEQ ID NO: 127240 - protein, 118 aa, Glycine max [sequence omitted]

SEQ ID NO: 127241 - protein, 88 aa, Glycine max
  Coding DNA Sequence Number=SeqID_35556
MAQPPPRERTLREMVAPDFTYESLCIQYPDEDVPYVLKTGLIHFASKVSWPCRGSGKGLAVYLAPRTTAIRKDISGIRQLSGESLYEY

SEQ ID NO: 127242 - protein, 85 aa, Glycine max
  Coding DNA Sequence Number=SeqID_35557
  Homolog annotation: Hit_ID=A5C3T2; Match level="QueryCoverage=100%, HitCoverage=12%, E-value=9e-17, Identity=44%"; Hit description =Putative uncharacterized protein
MDIDYAIRKDEPPAITNKSSPTIVMLYERWERSNQLKVMFIKTKISTWIGGFVDQHEKEEERLVMEMGESALLTTACGKNKATKS

SEQ ID NO: 127243 - protein, 37 aa, Glycine max
  Coding DNA Sequence Number=SeqID_35558
MMDTSEPYTGAMKGIMHKPHANLGADQKFSPNRFPAT

SEQ ID NO: 127244 - protein, 132 aa, Glycine max
  Coding DNA Sequence Number=SeqID_35559
  Homolog annotation: Hit_ID=A2Q6B4; Match level="QueryCoverage=63%, HitCoverage=37%, E-value=2e-08, Identity=32%"; Hit description =Ribosomal protein L33; Nucleic acid-binding, OB-fold
FAGFTDVVAGQFELGLLVDVIGVVEEVFFCHVSGKGRRVVFKLKDLSQQLLSCTLWDDYCLQFLKFLDDHEGHGPITVLSTHGRIKEAQGSYLPSVSNSFKASKLVINQPVMEIQEFNEGLAELGIEARVSF

SEQ ID NO: 127245 - protein, 232 aa, Glycine max
  Coding DNA Sequence Number=SeqID_35560
  Homolog annotation: Hit_ID=Q84VH5; Match level="QueryCoverage=100%, HitCoverage=42%, E-value=2e-82, Identity=61%"; Hit description =Envelope-like protein
MIPGPAPVPEKLVPKRQQGVKISENPSLATSPREVDSEMDKKIRSYVPTSSTPNAEVLSSSSEEESTEEEDQATEETPAPRAPEPCSGKITKQKGKTPITRSGRIKTTAQKKSTSITPTTSRWSKVAIPSKKRKEISSSDSDDDVELDVPDIKRAKKSGKKVPGNVPDAPLDNISFHSIGNVERWKFVYQRRLALERELGRDAFDCKEIMDLIKAAGLLKTVTKLGDCYESL

SEQ ID NO: 127246 - protein, 84 aa, Glycine max
  Coding DNA Sequence Number=SeqID_35561
MSIEASTHVSFDESTAILSRKNILDDIVESLEQIHIHGQDSKGKGKGSNEDPQEEAKSNDELPKEWKASKDHPYDSIIVLSQKG

SEQ ID NO: 127247 - protein, 76 aa, Glycine max
  Coding DNA Sequence Number=SeqID_35562
MVIPKFKVPDFGKYKGTTRSKNHLKMMQLQKVCKKGDGSFKEHAQKVEGSGGPGGTPNNGKGDDNRDGRHIIGTPL

SEQ ID NO: 127248 - protein, 117 aa, Glycine max
  Coding DNA Sequence Number=SeqID_35563
MESQPPQGVLLPYHTPKRRGLPLLKYALKCDTHAKIRFNCAIHLRSVRRRIVMLNLELFAQIFHHLVIQVRSIICDDSVGHTITADDLILDKADHNLLSHICIRCCFNPLGEVTNSH

SEQ ID NO: 127249 - protein, 70 aa, Glycine max
  Coding DNA Sequence Number=SeqID_35564
MVHDIFVKVKLEVTRTSTILNMFGSRRSSDIVTSILQLDLMNFFRKSMSLVQPHNPGNGNFDRQYFNNIS

SEQ ID NO: 127250 - protein, 193 aa, Glycine max
  Coding DNA Sequence Number=SeqID_35565
  Homolog annotation: Hit_ID=Q6WAY6; Match level="QueryCoverage=87%, HitCoverage=27%, E-value=2e-16, Identity=34%"; Hit description =Putative uncharacterized protein
MCKESPVVAIFAYHYSKESPVVAILADLFDTFDRRCEKNSARIVCCLPALCVWLVSHLFQQDTRHPCPLQSYRSCTEKGRVVWGQHLAGIGGSAINWFPRWKEGKEGVLFSYGDYPNIPLIGTRGCINYNPVLAIRQLGYPMRGAPTEESLSPFLVRDLGAQGLKVIQRIHKAWRSLLRKDKELRGIRNGVIG

SEQ ID NO: 127251 - protein, 101 aa, Glycine max
  Coding DNA Sequence Number=SeqID_35566
  Subcellular localization annotation: CTP_CleavageSite=32; ConfidenceScore=5.09e-01
KWVYDPNMVGSWCLTHATKKATRTLRRFAKVRGSKTKPTHDAYAKRHNTGMYIVVISLLMVSRGIILFEEHNAAVGTTSNNMSSKRKTLDEGSLQSSKSET

SEQ ID NO: 127252 - protein, 159 aa, Glycine max
  Coding DNA Sequence Number=SeqID_35567
AKFDIPEGLTAKKKVMSTVATRWRQFKSSLTSRYLYTDKDDQQNIDPSAKYGFDRETWEAFSKTRQTPTWKGIRKKAQEIQKFNDCPHVLSRGGYDVLEKKLMAEKTNSRVNQGDGTDNTDVVVDPPSPIARHVKWKKARTNKFGQMTSAAAQKSQTKL

SEQ ID NO: 127253 - protein, 108 aa, Glycine max
  Coding DNA Sequence Number=SeqID_35568
  Homolog annotation: Hit_ID=Q5NRP4; Match level="QueryCoverage=79%, HitCoverage=5%, E-value=2e-07, Identity=37%"; Hit description =Putative gag-pol polyprotein, identical
MLQRLRQGSMSVEEYRQQMELLLLRAGLMEEEITSIARFFSGLNMEGPSDVAPCGACRPWIFFINGVLCFLKIMAAEQRRKKDDWRSHFKEKMSQAQAHHHRKPWIRA

SEQ ID NO: 127254 - protein, 160 aa, Glycine max
  Coding DNA Sequence Number=SeqID_35569
ALASIATPLRLEFIPQVKKLLDEGLVRKSLNPCALLEPKIGIIMHQVPKIAGMMNVLSGATLFCKITRTPNIFMVCVHRDPLGSDQGVPMNPKRIKVIVATYPSAGGRCETCGMRVPRKEYARSRHQRLFEENVGKTGKDAIYELFSERFGSCIYARGRY

SEQ ID NO: 127255 - protein, 93 aa, Glycine max
  Coding DNA Sequence Number=SeqID_35570
MDAFQAFRKLAKIIQNKKNLKIISIRSDHGGELKIKNLNYFVWIEEKVVHRFSAKMLKNMTGDESKFTHISPKKSGHVTYGDNNKGRFLELEN

SEQ ID NO: 127256 - protein, 248 aa, Glycine max
  Coding DNA Sequence Number=SeqID_35571
  Homolog annotation: Hit_ID=Q84VH5; Match level="QueryCoverage=100%, HitCoverage=42%, E-value=5e-84, Identity=62%"; Hit description =Envelope-like protein
MDKKIRSIVSSILKNASVPDADKDVPTSSTPNAEVLSSSSKEESTEEEDQATEETPAPRAPEPAPERLQSRKGKTPITRSGRINTTAQKKCTPITPTTSRWSKVAIPSKKRKEISSSDSDDDVVLDVPDIKRAKKSGKTVPGNVHDAPLDNISFHSIGNVERWKFVYQRRLALERELGRDALDCKEIMDLIKAAGLLNTVTKLGDCYESLVREFIVNIPSDITNRKSDEYQKVFVRGKCIRFSPAVIN

SEQ ID NO: 127257 - protein, 159 aa, Glycine max
  Coding DNA Sequence Number=SeqID_35572
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
  Pfam annotation: Domain name=PCNA_C; Domain location=1-67; Score =48.5; E_value=2.3e-11; Accession=PF02747.6; Description =Proliferating cell nuclear antigen, C-terminal domain
MQLARQPEEATVIEMNEPVSLTFALRYMNSFTKATPLSNTVTISLSNELPVVVEYKIAEMGYRPPPRWSSNSPYSESYYNSLAVVLQRRDWENPGVTQLNRLAAHPPFASWRNSEEARTDRPSQQLRSLNGEWDAPCSGALSAGGCGGYAQRDRYTCQR

SEQ ID NO: 127258 - protein, 489 aa, Glycine max
  Coding DNA Sequence Number=SeqID_35573
  Gene Ontology: Mol. function=nucleic acid binding
  Homolog annotation: Hit_ID=A7PN40; Match level="QueryCoverage=82%, HitCoverage=80%, E-value=3e-72, Identity=41%"; Hit description =Chromosome chr14 scaffold_21, whole genome shotgun sequence
  Pfam annotation: Domain name=TPX2; Domain location=384-440; Score =77.9; E_value=3.4e-20; Accession=PF06886.2; Description=Targeting protein for Xklp2 (TPX2)
  Subcellular localization annotation: CTP_CleavageSite=15; ConfidenceScore=5.81e-01
MALASTNTDQSTTTTASKKPSKKSENLNPNVPHHRSPSSKSPALQSSKSSTSNPIAQSTQNNIRQKKFVVAKKKKNQKGTQNDAFSCKCKHNGGAKCVCVAYQTLRASQEEFFLKEKKDCDYDFDEEEEREAKAENAIEINGTKSETVADEENEEMEGGSTVKRRRERDRLLEEARNSVPENGFGRVMHLVKAFEKLLTIPKSSKEKDHKEEHDNEHEEKENKSKVMKWALPGLQFQQHTKALKASTEDASGSGSSSFCCTSDLGQGISVSSSWDFSRASVSSRNSGGRRSRRNSSESSGTFGGRRWKQKEKLKVTRQKPFKLRTEHRGKLKEEELVKKVQEMMAEEEKMRIPIAQGIPWTTDEPECLLKPTVKESTRPIDLKLHSDIRAIDRAEFDQQVAEKMNFTEQLKLEKERQHKLEEEEEIKRLRKELIPKAQPMPYFDRPFVPRRSMKHPTIPREPKFHIPQHKKIKCLVSRNDMNPYSSYLN

SEQ ID NO: 127259 - protein, 544 aa, Glycine max
  Coding DNA Sequence Number=SeqID_35574
  Gene Ontology: Mol. function=transferase activity, transferring hexosyl groups; Cellular component=Golgi apparatus; Biological process=carbohydrate biosynthetic process
  Homolog annotation: Hit_ID=A7PN29; Match level="QueryCoverage=94%, HitCoverage=98%, E-value=0.0, Identity=77%"; Hit description =Chromosome chr14 scaffold_21, whole genome shotgun sequence
  Pfam annotation: Domain name=Glyco_transf_8; Domain location=184-517; Score=391.0; E_value=1.8e-114; Accession=PF01501.11; Description =Glycosyl transferase family 8
MRCWRRPSLKKEHRGSDDGGDMGDEDGFSITISSNNGFIDLMKIKVAACHISYRTLFHTILILAFLLPFVFILTALVTLEDCLGRRLGPKLLGRVDDPAQRLVRDLYNILNEVKTGEIPSALELPDSFDQLVSDMKNNQYDAKTFAFMLRGMMQKFEREIRESKFSELMNKHFAASSVPKGIHCLSLRLTDEYSSNANARKQLPPPELLPTLSDNSYHHFIVSTDNILAASVVVTSTVQSSQKPENIVFHVITDKKTYAGMHSWFALNPVTPAIVEVRGIHQFDWLTRENVPVLEAVENQNGIRNYYHGNHFTGTNLSDTNPYKFASKLQARSPKYISLLNHLRIYIPELFPNLDKVVFLDDDVVVQRDLSPLWEIDMNGKVNGAVETCRGDDQWVMSKHFRNYFNFSHPLVAQHLDPDECAWAYGMNVFDLRAWRTTNIRETYHTWLKENLRSNLTMWKLGTLPPALIAFKGHVHPIGPSWHMLGLGYQNKTDIESVRKAAVIHFNGQSKPWLQIGFDHLRPFWNKYVNYTNDFVRNCHILDS

SEQ ID NO: 127260 - protein, 217 aa, Glycine max
  Coding DNA Sequence Number=SeqID_35575
  Homolog annotation: Hit_ID=A9P8I0; Match level="QueryCoverage=99%, HitCoverage=99%, E-value=1e-104, Identity=71%"; Hit description =Putative uncharacterized protein
MILTKQYRCVHSASCQCTKGHLSEDVIFLVFQHLNWNPKLIAALSCVCKWFDDLSKQVLWKEFCKTRAPKMMLDLQSSGSHSVDGNWRALGKLLIFCSGCRQGSLFNNVQVPGHFVNKTRFSRTSGKSFLMPQCINDVLYVSDPCEHIGQSEEGDLGFFRGIFKSFASSNANMIPQTASCRLGSYEDYTEYYVCLNGHLLGVCTLLPLSDSEDVSEE

SEQ ID NO: 127261 - protein, 315 aa, Glycine max
  Coding DNA Sequence Number=SeqID_35576
  Gene Ontology: Mol. function=protein binding; Cellular component=GPI -anchor transamidase complex; Biological process=regulation of protein metabolic process
  Homolog annotation: Hit_ID=A7PU42; Match level="QueryCoverage=90%, HitCoverage=65%, E-value=2e-84, Identity=47%"; Hit description =Chromosome chr7 scaffold_31, whole genome shotgun sequence
  Pfam annotation: Domain name=Gpi16; Domain location=1-313; Score= -99.1; E_value=1.1e-11; Accession=PF04113.5; Description=Gpi16 subunit, GPI transamidase component
MELSFTQGRWNYDRWGGFDSISSCNAKPPGVELWAVLDVPSSTTYSAPELAFQSALGCLRYGTLPREARPSIYRSFYHSQRLHLTMSTDHSNGSRLGINLEQTVTVVLQPNEQKAGPKDFRRNAGFELSVTPKRVHAEMETSSSILYEYPIKEYTETEQFDLGLTRKHPIVWSSPHAPLYASRFSMGSGNERGAIAISLKSIQGLVAINNMLKRVDERPQALTDFVERMRVSPSEDKVSPEVMEMVLQFPCEMKSAILSIVFDKGFLHIDEYPPDVNQGFDIPSAIISFPDFHAGLQFSDKSRSKSPLLSKLQVI

SEQ ID NO: 127262 - protein, 63 aa, Glycine max
  Coding DNA Sequence Number=SeqID_35577
  Gene Ontology: Mol. function=sequence-specific DNA binding; Cellular component=nucleus; Biological process=regulation of transcription, DNA-dependent
  Homolog annotation: Hit_ID=B0LUS4; Match level="QueryCoverage=82%, HitCoverage=11%, E-value=1e-17, Identity=80%"; Hit description =Transcription factor
MDPKAVITTYEGKHNHDVPATRNRSHNIATYNLMPLKPHKVVLEKHPLLKGLLSERYKLNCDA

SEQ ID NO: 127263 - protein, 518 aa, Glycine max
  Coding DNA Sequence Number=SeqID_35578
  Gene Ontology: Mol. function=protein serine/threonine kinase activity; Cellular component=nucleus; Biological process=protein amino acid phosphorylation
  Homolog annotation: Hit_ID=Q9XF25; Match level="QueryCoverage=100%, HitCoverage=100%, E-value=0.0, Identity=86%"; Hit description=SNF-1 -like serine/threonine protein kinase
  Pfam annotation: Domain name=KA1; Domain location=469-517; Score =93.1; E_value=9e-25; Accession=PF02149.10; Description=Kinase associated domain 1
  Pfam annotation: Domain name=Pkinase; Domain location=20-275; Score =265.7; E_value=9.8e-77; Accession=PF00069.16; Description=Protein kinase domain
  Pfam annotation: Domain name=Pkinase_Tyr; Domain location=20-224; Score=-24.6; E_value=6.8e-11; Accession=PF07714.8; Description =Protein tyrosine kinase
  Pfam annotation: Domain name=UBA; Domain location=297-333; Score =31.5; E_value=3.1e-06; Accession=PF00627.22; Description=UBATS-N domain
  Pfam module annotation: Pfam domain module=KA1::Pkinase::Pkinase _Tyr::UBA; Domain location=469-517::20-275::20-224::297-333
MDRSTGRGGGGSVDMFLRNYKLGKTLGIGSFGKVKIAEHVRTGHKVAIKILNRHKIKNMEMEEKETPTDIYVVMEYVKSGELFDYIVEKGRLQEDEARHFFQQYCHRNMVVHRDLKPENLLLDSKFNIKIADFGLSNIMRDGHFLKTSCGSPNYAAPEVISGKLYAGPEVDVWSCGVILYALLCGTLPFDDENIPNLFKKIKKIPDLMGWVQVPKDRLLVIGTLERKSISLDKEGGIYTLPSHLSPGARDLIPRMLVVDPMKRMTIPEIRQHPWFQVHLPRYLAVPPPDTLQQAKKIDEEILQEVVNMGFDRNQLVESLSNRIQNEGTVTYYLLLDNRFRVSSGYLGAEFQETMDSGFNRMHSGEVASPVVGHHSTGYMDYQGVGMRQQFPVERKWALGLQSRAQPREIMTEVLKALQELNVCWKKIGHYNMKCRWVAGTAGHHEGMINNSLHSNHYFGNDSGIIENEAVSKSNVVKFEVQLYKTREEKYLLDLQRVQGPQFLFLDLCAAFLSQLRVL

SEQ ID NO: 127264 - protein, 198 aa, Glycine max
  Coding DNA Sequence Number=SeqID_35579
MEEKWLETYCPELRKRIFLALAACFPLLPCSSASLHDTHAERACPIGSSARALSALARDSCLQMYLLALSGLLGLSGPNSLSKEELDETSGTIRCRKGCFFCTYPTWEAPVELATSCMCDKWQALDESADMVGDFTLQVAIPVSALTAAGSGSSSSSSAGLAIGAGKRHCHWRFLPPEGAASIGASFFFYKIRLAFKL

SEQ ID NO: 127265 - protein, 316 aa, Glycine max
  Coding DNA Sequence Number=SeqID_35580
  Gene Ontology: Mol. function=pectinesterase activity; Cellular component=cell wall; Biological process=cell wall modification
  Homolog annotation: Hit_ID=A7PMZ9; Match level="QueryCoverage=100%, HitCoverage=100%, E-value=1e-149, Identity=79%"; Hit description =Chromosome chr14 scaffold_21, whole genome shotgun sequence
  Pfam annotation: Domain name=Pectinesterase; Domain location=5-298; Score=278.5; E_value=1.4e-80; Accession=PF01095.10; Description =Pectinesterase
MAALVITVSQDGTGQYRTVQEAIDAVPLGNTRRTVIRVSPGTYRQPLYVAKTKNFITLVGLRPEDTVLTWNNTATSIHHHQDARVIGTGTFGCGTIIVEGGDFIAENITFENSSPQGAGQAVAVRVTVDRCAFYNCRFLGWQDTLYLHYGIQYLKDCYIEGSVDFIFGNSTALLEHCHIHCKSAGFITAQSRNSPQEKTGYVFLRCVVTGNGGTSYAYLGRPWRPFARVVFAFTYMDQCIKPAGWNNWGKIENEKTACFYEYRCFGPGWCPSQRVKWARELQAEAAEQFLMHSFIDPESERPWLAQRMALKIPYSA

SEQ ID NO: 127266 - protein, 183 aa, Glycine max
  Coding DNA Sequence Number=SeqID_35581
  Gene Ontology: Cellular component=integral to membrane; Biological process=red or far red light signaling pathway
  Homolog annotation: Hit_ID=Q2HT55; Match level="QueryCoverage=100%, HitCoverage=33%, E-value=3e-38, Identity=40%"; Hit description=SPX, N-terminal; EXS, C-terminal
MFLKYVEEGGEKDFVFFKKLDSEFNKVNAFYRKKGSRVQLPPTIHLLAQLQLHINDARPRRSSLLMDLIHEIEMSSESHLKDGSGTVINVVTLETPVSTLRGLLLASNHDHLSFSKKELWKLLELDGILKNHEEVTARNASKEYLKVVGISYFGNTDEVNRLMDKVESAFIKHFGNGNRRKGM

SEQ ID NO: 127267 - protein, 338 aa, Glycine max
  Coding DNA Sequence Number=SeqID_35582
  Gene Ontology: Mol. function=pyruvate kinase activity; Cellular component=chloroplast; Biological process=glycolysis
  Homolog annotation: Hit_ID=A5BTB0; Match level="QueryCoverage=76%, HitCoverage=44%, E-value=1e-106, Identity=74%"; Hit description =Pyruvate kinase
  Pfam annotation: Domain name=PK; Domain location=1-239; Score=-25.6; E_value=1.3e-18; Accession=PF00224.12; Description=Pyruvate kinase, barrel domain
MLDKRVAILFYATWTCVLFRKGGMMSMTIKSKTEDSVKCDIVDGGELKSRRLLNVREKSATLSSITKKDWDDITFEVDNKVYFYVASFVKDAEFVHELKNYLKSCGVDIHVIVKIESANSIPNLHTIITASGGTMVVRGDLSVELPIEEVPLLQEEIINLCRNIGKAIIVATNMLGSMIVHPTPTRTKVSNITTVVREGSDGIMLSGETTHGKFLLKVVQVMHTVALQTKATILGGKIPPNIGQVLKNYMSEMFAYHATMMSITLGTSIIVFIGTVRGLNLVLIWQLDHNYHLEDKVFFDGIGDVRKGIMARQDTTRIGTNERPKRKINPPRHLKDFI

SEQ ID NO: 127268 - protein, 63 aa, Glycine max
  Coding DNA Sequence Number=SeqID_35583
MKDIQDEEEEDELGRRRRTRGSSNDREKNHVKGILVLSPKLLGVPVKMLGVQSNRREIIDQRL

SEQ ID NO: 127269 - protein, 102 aa, Glycine max
  Coding DNA Sequence Number=SeqID_35584
MLQCEGFSSKVRYDFEIPNGGFVRSVGSAPWPSRLSTLNKEPEMVLATLPARKYKALGPTACTIEGWKWIVRLWYMTSETFLPSLVKDLPVSEFDKVFNLVF

SEQ ID NO: 127270 - protein, 243 aa, Glycine max
  Coding DNA Sequence Number=SeqID_35585
  Gene Ontology: Mol. function=aspartic-type endopeptidase activity; Biological process=RNA-dependent DNA replication
  Homolog annotation: Hit_ID=Q69F85; Match level="QueryCoverage=36%, HitCoverage=4%, E-value=1e-13, Identity=44%"; Hit description=Gag -pol polyprotein
MVCGTGLGIPDGYGDGTINSNPSGIGYGYEDILRSRGELTTVRGQPQLKPKGDPLVGAKAKLTACQISKATKACVQQDHTHSLIMEATLPSNWKNLNIEKYDGTTDPDKHLDYKRESLRTFKEHFGKIALNIRNLDSTVSMHHLIMTLGLGPFVNSLCKKSTSNMDELLRRASKYMQMEELAKYKNQARTEATSTKKKADKPNIDPGSSSGQQDPRYAKKGKHPTLGRLFPTSLIPLQTRKLH

SEQ ID NO: 127271 - protein, 43 aa, Glycine max
  Coding DNA Sequence Number=SeqID_35586
MADGCDPFVRPTEEQTVRLKIHHGRMFIYQSFIVYINGQIVEE

SEQ ID NO: 127272 - protein, 703 aa, Glycine max
  Coding DNA Sequence Number=SeqID_35587
  Gene Ontology: Mol. function=catalytic activity; Cellular component =nucleus; Biological process=metabolic process
  Homolog annotation: Hit_ID=A7QIL2; Match level="QueryCoverage=93%, HitCoverage=89%, E-value=0.0, Identity=64%"; Hit description =Chromosome chr9 scaffold_104, whole genome shotgun sequence
  Pfam annotation: Domain name=PPR; Domain location=129-163; Score =12.3; E_value=0.27; Accession=PF01535.11; Description=PPR repeat
  Pfam annotation: Domain name=PPR; Domain location=195-229; Score =20.6; E_value=0.006; Accession=PF01535.11; Description=PPR repeat
  Pfam annotation: Domain name=PPR; Domain location=230-264; Score =11.8; E_value=0.31; Accession=PF01535.11; Description=PPR repeat
  Pfam annotation: Domain name=PPR; Domain location=296-330; Score =31.8; E_value=2.6e-06; Accession=PF01535.11; Description=PPR repeat
  Pfam annotation: Domain name=PPR; Domain location=397-431; Score =38.0; E_value=3.5e-08; Accession=PF01535.11; Description=PPR repeat
  Pfam annotation: Domain name=PPR; Domain location=468-502; Score=0.9; E_value=6; Accession=PF01535.11; Description=PPR repeat
  Pfam annotation: Domain name=PPR; Domain location=535-569; Score =16.4; E_value=0.088; Accession=PF01535.11; Description=PPR repeat
  Pfam annotation: Domain name=PPR; Domain location=93-127; Score=18.8; E_value=0.021; Accession=PF01535.11; Description=PPR repeat
  Pfam module annotation: Pfam domain module=PPR::PPR::PPR::PPR::PPR::PP R::PPR::PPR; Domain location=129-163::195-229::230-264::296-330::397 -431::468-502::535-569::93-127
MLVLKLPRVTPAFSMYLPHPCSLKEVVNLLKFSATAKSLRFGKTIHAQLVVRNQTSKDSDITQINSLINLYSKCGQSKCARKLFDRMLQRNVVSWSALMMGYLHKGEVLEVLGLFRNLVSLDSAYPNEYIFTIVLSCCADSGRVKEGKQCHGYLLKSGLLLHQYVKNALIHMYSRCFHVDSAMQILDTVPGDDVFSYNSILSALVESGCRGEAAQVLKRMVDECVIWDSVTYVSVLGLCAQIRDLQLGLQIHAQLLKTGLVFDVFVSSTLIDTYGKCGEVLNARKQFDGLRDRNVVAWTAVLTAYLQNGHFEETLNLFTKMELEDTRPNEFTFAVLLNACASLVALAYGDLLHGRIVMSGFKNHLIVGNALINMYSKSGNIDSSYNVFSNMMNRDVITWNAMICGYSHHGLGKQALLVFQDMMSAGECPNYVTFIGVLSACVHLALVQEGFYYFDQIMKKFDVEPGLEHYTCMVALLGRAGLLDEAENFMKTTTQVKWDVVAWRTLLNACHIHRNYNLGKQITETVIQMDPHDVGTYTLLSNMHAKARKWDGVVKIRKLMKERNIKKEPGASWLDIRNNTHVFVSEGSNHPESTQIFEKVQQLLAMIKPLGYAPDVGVVLHDVEDEQKEGYLSHHSEKLALAYGLMKIPPPGPIRIIKNLRMCDDCHIAVKLISKATNRLIIVRDANRFHHFREGLCTCNDHW

SEQ ID NO: 127273 - protein, 472 aa, Glycine max
  Coding DNA Sequence Number=SeqID_35588
  Gene Ontology: Mol. function=zinc ion binding; Cellular component =nucleus; Biological process=regulation of transcription
  Homolog annotation: Hit_ID=Q0GLC4; Match level="QueryCoverage=67%, HitCoverage=97%, E-value=1e-138, Identity=77%"; Hit description=Dof27
  Pfam annotation: Domain name=zf-Dof; Domain location=121-183; Score =139.3; E_value=1.1e-38; Accession=PF02701.6; Description=Dof domain, zinc finger
MLEAKDSTMMKLFGNTIPAPEIPAGAPAFSSGDVFGDSVGQNRGSSSVNGDGEEHEIQQDIMGEETTESKKEDEVTNLDTVSRSGEGSINPSTEKEDLTLKTSKKTEQEQGENSQNKTLRKPDKILPCPRCNSMDTKFCYYNNYNVNQPRHFCKNCQRYWTAGGVMRNVPVGAGRRKNKNFASQYRHITVPEAALSSSQPDLSNGVSNPSLNCNATLLAYGSDRPLCESMTSVLNLADKAVNNSTTNGFNGSEELEIPVTYVGGEKVNDDSNKSSDTSTKPMKGETTNRSQEQVIENCHPFPPHVPYFPGAPWPFPWNPAPWNSPVPLPPPFFPQGFTMPLYPAAAYWSLTIPGARSIPWLAQPSLLNSTVSNSGPNSLTLGKHSREENMHKSNGVAVEDEHSKENNKEKCLWVPKTLRIDDLGEAAKTSIWTTLGIKNNKADLFPGGGLFKSLPSQGAVDEPTDMAVFHCT

SEQ ID NO: 127274 - protein, 560 aa, Glycine max
  Coding DNA Sequence Number=SeqID_35589
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=80%, HitCoverage=99%, E-value=0.0, Identity=68%"; Hit description=UDP -glucosyltransferase HRA25
  Pfam annotation: Domain name=UDPGT; Domain location=109-559; Score= -80.7; E_value=1.5e-06; Accession=PF00201.9; Description=UDP -glucoronosyl and UDP-glucosyl transferase
MVSCMLQSHLSIELARMINSQQHGHSEQRQSREQRQSRDVWLWYVHILKQLNMCCSSSWKSSTTCEAEADAVLEALSWIGQLNMQHVTIELDCKIVVRGRKSKYNMGIPTVLALPYPAQGHVNPLMTLSQKLVEHGCKVFFVNTDFDHKRVVSSMVEQLDSLDESLLKLVSIPDGLGPDDDRNDLSKLCDSLLNNMPAMLEKLIEDIHLKGDNRISLIVADVCMGWALDVGSKLGIKGALLCPSSAAFFALLYNVPRLIDDGIIDSDGGLRITTKRTIQISQGMPEMDPGELFWLNMGDTINGKIVLNYLMQCTQRLNMTEWWLCNTTYELEHAPLSSIPKLVPIGPLLRSYDDTIATAKTIGQYWEEDLSCMSWLDQQPHGSVLYVAFGSFTHFDQNQFNELALGLDLTNRPFLWVVRQDNKRVYPNEFLGCKGKIVSWAPQQKVLSHPAIACFVTHCGWNSTIEGVSNGLPLLCWPYFGDQICNKTYICDELKVGLGFDSDKNGLVSRMELERKVDQILNDENIKSRSLELKDKVMNNIAKAGRSLENLNRFVKWLKE

SEQ ID NO: 127275 - protein, 268 aa, Glycine max
  Coding DNA Sequence Number=SeqID_35590
  Homolog annotation: Hit_ID=A5C6V8; Match level="QueryCoverage=73%, HitCoverage=55%, E-value=3e-22, Identity=39%"; Hit description =Putative uncharacterized protein
MAFLNYESKRGSGKKLKVHFDLPEDDDYPNHKHSSSSVSSECSLDSDDTDNDNSIDNVDSKYGSYGSPVWSFQGGSVTQSPPVQFLSSPEYDPNRIPSSIFNKPTSPMEWSVASNESVFSIHLGNNSFSRDYAFPFNNKSGELPRTSDLPSMPATLPPVQEVPAKDKNVDMERHSVSSDSSSETADSVRGHDHKKTSHETAGSVGEVVDLVKIENSEDIGTNEVVLDKTPDDHSNEAKIPNGEANNYTSVLYRSVESDMSTHSFQFPI

SEQ ID NO: 127276 - protein, 46 aa, Glycine max
  Coding DNA Sequence Number=SeqID_35591
KNDDLGLNYRWIVVKFEYQVRNSFSNILTVGNYENMSEQREIPFAS

SEQ ID NO: 127277 - protein, 79 aa, Glycine max
  Coding DNA Sequence Number=SeqID_35592
MHELEESKFAALQNMRENQGLDKGNMTEIDGYQNLFGLMKQRFLSFKNPKYIKELEHFQALAEAQFPKVITDLPSPFGI

SEQ ID NO: 127278 - protein, 42 aa, Glycine max
  Coding DNA Sequence Number=SeqID_35593
MWQEYGDQWGPNPRRRKIAKEKEGANFQKSGGQSRLLKTLEN

SEQ ID NO: 127279 - protein, 381 aa, Glycine max
  Coding DNA Sequence Number=SeqID_35594
  Gene Ontology: Mol. function=receptor activity
  Homolog annotation: Hit_ID=A5C157; Match level="QueryCoverage=57%, HitCoverage=13%, E-value=2e-40, Identity=35%"; Hit description =Putative uncharacterized protein
MEIKYQQPLILGMEIKYLPNRSILISQSKFVRDLLHKTQMAETHSISTPMVTNCKLSIQLSIVSIDEEEIIHLPARHSLPTSESLPEHEMENTSLDLLDRLICCLSDSLYEAKTNLNRTLVKILASEKNHKCKYNIPRTLVAWNLLQFDNAGHDKCTDINAGLLGSFVFNYQIPLGTSSSCFVKNEAVNLYAHQVLDAWFSCIKLLEDEDDSVRLRLSFDVQKCFTTEKTRSNLTPGSVPIQWVLRVESSVAPQGDLVGRVFDKEIDNHYEEKLLISQICCSNMEKLLILKSWADKDEFRSYLHGWRARFSHQLVSYDEDHLGKQEGNDWIGGMVVLGRAINPFKLVLQSHEKMAGDVANGSFPEMGNFSSWDSFNSYFLG

SEQ ID NO: 127280 - protein, 232 aa, Glycine max
  Coding DNA Sequence Number=SeqID_35595
  Subcellular localization annotation: CTP_CleavageSite=74; ConfidenceScore=5.43e-01
MPNLFNILMTLSEFKVKIKPLVTAKNRHFLVCSSFFSHHRKSPPNGSQTTATEKTITTTNSNIKTTNIWFSKIMCVMDLGLWVLVVEFGYGFGALSLSPLPRVNLAGVRCYDVLVVWCVGDMGFGDGVWGFGRDGVGQVDLRDEPTTVRAKTMTSTMASKGPKCVGVTAKLFFSGVFVWESAVATMTMHVSLTRGERRGFRVWSTNAFKISIFGHGQIVGEPKQICSFSYNF

SEQ ID NO: 127281 - protein, 197 aa, Glycine max
  Coding DNA Sequence Number=SeqID_35596
MKEGICSIQHFFNTWKAIPFQARTNVRRSVLVRIGEKERQPCKSPLPLAIQPWVQHVAFRHCHWRNSQWFRHWSWRHSHAVVFATLTSELRAGALGFAIPTGETAYAMLVFLFNTSLVICMMKKFPPSFLACFAKSYSEIVEAAGTLFLQVVRERERKCWCCYACGGGGKACASGKSLVVLHCGGHSSPVIWLSNSG

SEQ ID NO: 127282 - protein, 195 aa, Glycine max
  Coding DNA Sequence Number=SeqID_35597
  Homolog annotation: Hit_ID=A2Q4P8; Match level="QueryCoverage=24%, HitCoverage=20%, E-value=2e-09, Identity=61%"; Hit description=IMP dehydrogenase/GMP reductase, related
  Pfam annotation: Domain name=DUF1723; Domain location=31-80; Score =25.3; E_value=0.00023; Accession=PF08330.1; Description=Protein of unknown function (DUF1723)
MPTVSARRQRQQEHPELKLSSHGRKMTKFNKGDRGLMPAFVEPWHKETSSFNLPVREVTITLDDMASLLYFPICWIYEHFPSVGFVLAVEDYDEQRPHACRWTSGEALPVSTYHRRLDRLTPDVVHLRWGPLTVIHRLERVILQFGYIQTILPHPVAPSASIEEIDARWMQLCDYIAPVEKIFVVSDQCSSDYME

SEQ ID NO: 127283 - protein, 102 aa, Glycine max
  Coding DNA Sequence Number=SeqID_35598
  Gene Ontology: Mol. function=DNA binding; Cellular component=nucleus; Biological process=response to brassinosteroid stimulus
  Homolog annotation: Hit_ID=A7PMV9; Match level="QueryCoverage=61%, HitCoverage=67%, E-value=3e-16, Identity=64%"; Hit description =Chromosome chr14 scaffold_21, whole genome shotgun sequence
  Pfam annotation: Domain name=ZF-HD_dimer; Domain location=17-78; Score=119.9; E_value=7.4e-33; Accession=PF04770.3; Description=ZF-HD protein dimerisation region
MRKRQVVVRREEPQRSARTVKYGECQKNHAANVGGYAVDGCREFMASGATGEGTSAALTCAACGCHRNFHKRQETEVLHNVAVVISLKFDEENWYWFWFCLN

SEQ ID NO: 127284 - protein, 859 aa, Glycine max
  Coding DNA Sequence Number=SeqID_35599
  Gene Ontology: Mol. function=ATPase activity, coupled to transmembrane movement of substances; Cellular component=integral to membrane; Biological process=anthocyanin accumulation in tissues in response to UV light
  Homolog annotation: Hit_ID=A7PMS6; Match level="QueryCoverage=96%, HitCoverage=98%, E-value=0.0, Identity=66%"; Hit description =Chromosome chr14 scaffold_21, whole genome shotgun sequence
  Pfam annotation: Domain name=ABC_membrane; Domain location=34-315; Score=158.3; E_value=2e-44; Accession=PF00664.14; Description=ABC transporter transmembrane region
  Pfam annotation: Domain name=ABC_tran; Domain location=390-574; Score= 225.5; E_value=1.2e-64; Accession=PF00005.18; Description=ABC transporter
  Pfam annotation: Domain name=SMC_N; Domain location=378-578; Score= -134.5; E_value=0.097; Accession=PF02463.10; Description=RecFRecNSMC N terminal domain
  Pfam module annotation: Pfam domain module=ABC_membrane::ABC _tran::SMC_N; Domain location=34-315::390-574::378-578
MAEASEPKALPEAEKKKEQTLPFYKLFSFADKCDWMLMISGSIGAIVHGSSMPVFFLLFGEMVNGFGKNQMDLKKMTEEVSKYALYFVYLGLVVCISSYAEIACWMYTGERQVSTLRKKYLEAVLKQDVGFFDTDARTGDIVFSVSTDTLLVQDAISEKVGNFIHYLSTFLAGLVVGFVSAWRLALLSVAVIPGIAFAGGLYAYTLTGLTSKSRESYANAGIIAEQAIAQVRTVYSYVGESKALNSYSDAIQNTLKLGYKAGMAKGLGLGCTYGIACMSWALVFWYAGVFIRNGQTDGGKAFTAIFSAIVGGMSLGQSFSNLGAFSKGKAAGYKLMEIINQKPTIVEDPSEGKCLAEVNGNIEFKDVTFSYPSRPDMFIFRNFSIFFPAGKTVAVVGGSGSGKSTVVSLIERFYDPNEGQVLLDNVDIKTLQLKWLRDQIGLVNQEPALFATTILENILYGKPDATMAEVEAATSAANAHSFITLLPNGYNTQVGERGVQLSGGQKQRIAIARAMLKNPKILLLDEATSALDAGSESIVQEALDRLMVGRTTVVVAHRLSTIRNVDTIAVIQQGQVVETGTHEELIAKAGTYASLIRFQEMVGNRDFSNPSTRRTRSSRLSHSLSTKSLSLRSGSLRNLSYQYSTGADGRIEMISNAETDKKNPAPDGYFFRLLKMNAPEWPYSIMGAVGSVLSGFIGPTFAIVMSNMIEVFYFRNYASMERKTKEYVFIYIGAGLYAVGAYLIQHYFFSIMGENLTTRVRRMMLAAILRNEVGWFDEEEHNSSLVAARLATDAADVKSAIAERISVILQNMTSLLTSFIVAFIVEWRVSLLILATFPLLVLANFAQIPYLTINFDVTH

SEQ ID NO: 127285 - protein, 455 aa, Glycine max
  Coding DNA Sequence Number=SeqID_35600
  Gene Ontology: Mol. function=transferase activity, transferring glycosyl groups; Cellular component=cytoplasm; Biological process =metabolic process
  Homolog annotation: Hit_ID=Q9FUJ6; Match level="QueryCoverage=99%, HitCoverage=99%, E-value=0.0, Identity=70%"; Hit description=UDP -glucosyltransferase HRA25
  Pfam annotation: Domain name=UDPGT; Domain location=4-454; Score= -93.9; E_value=7.1e-06; Accession=PF00201.9; Description=UDP -glucoronosyl and UDP-glucosyl transferase
MSIPTVLALPYPAQGHVNPLMTLSEKLVEHGCKVIFVNTDFDHKRVVGSMGEQQDSLDESLLKLVSIPDGLGPDDDRNDAGKLCDAMQNTMPTMLEKLIEDVHLNGDNRISLIVADFCMGWALDVGSKLGIKGALLWASPAALFGLLYNIPKLIDDGIIDSDGGLTLTTKKTIHISQGIPEMDPRDFFWLNMGDTINGKIVIKYLIQCTRSLNLTEWWLCNTTNELEPGPLSSIPKLVPIGPLLRSYGDTIATAKSIGQYWEEDLSCMSWLDQQPHGSVLYVAFGSFTHFDQNQFNELALGIDLTNRPFLWVVRQDNKRVYPNEFLGSKGKIVGWAPQQKVLNHPTIACFLTHCGWNSTMEGLSNGVPLLCWPYFGDQLYNKAYICDELKVGLGVDKDKNGLVSRMELKRKVDQLFNDENINSRSLELKDKVMKNITNGGRSLENLNRLVNWLKE

SEQ ID NO: 127286 - protein, 212 aa, Glycine max
  Coding DNA Sequence Number=SeqID_35601
MNGISFLEVIKSRKFKKLLASGIQSTQTCKEHNQQRMHGPRPESQQQLQHSNMITTSPHEGSNQCIMHLKSILMQQFFNTEVYMELGRDHNGAFVRAKTVATSGSPNPREAKAWALLQALKWIPQLDLTEIVIEFESDYKTVVDVLHTRFKGASEFFILYMKTVNQLSFYPSIGWAVKISEKKRIRRAAFCPASAAQLVLGSSIPKMIDTAS

SEQ ID NO: 127287 - protein, 175 aa, Glycine max
  Coding DNA Sequence Number=SeqID_35602
  Gene Ontology: Cellular component=microtubule; Biological process =ribosomal large subunit biogenesis and assembly
  Homolog annotation: Hit_ID=A7PA93; Match level="QueryCoverage=86%, HitCoverage=25%, E-value=3e-36, Identity=54%"; Hit description =Chromosome chr14 scaffold_9, whole genome shotgun sequence
  Pfam annotation: Domain name=NLE; Domain location=14-82; Score=119.3; E_value=1.2e-32; Accession=PF08154.3; Description=NLE (NUC135) domain
MNMNEESGEGSARRVQVRFVTKLGEPYKVPTTAIAIPADLARLGLSSLVNALLQSNDADHQPEPFDFLIDGEFVRMSLEQFLLAKGISAHQCVYISEANKCYACYGDSVKWDDAVEWGVLVKEVAAVERILEIEYARAVAPRKEEDPSLHDDWVSAVDGSSSRSSQRTQPNPLCE

SEQ ID NO: 127288 - protein, 67 aa, Glycine max
  Coding DNA Sequence Number=SeqID_35603
MPHSDEFITTHSYLHSRQISPFGVLLKSISPDEARLQELFSEKGELQLPLASWLQVATPIGDLGHKK

SEQ ID NO: 127289 - protein, 39 aa, Glycine max
  Coding DNA Sequence Number=SeqID_35604
MTTMQPPTRTLRQDLVTGVFPRTAPTPPNTNNAKLFYKH

SEQ ID NO: 127290 - protein, 152 aa, Glycine max
  Coding DNA Sequence Number=SeqID_35605
  Homolog annotation: Hit_ID=Q6UUU1; Match level="QueryCoverage=39%, HitCoverage=40%, E-value=1e-18, Identity=78%"; Hit description =Putative uncharacterized protein
YNYLGLTENKREYISCGLVLVEGTSTRFKENKGGYIPCGSLLVKGFLQVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127291 - protein, 65 aa, Glycine max
  Coding DNA Sequence Number=SeqID_35606
  Subcellular localization annotation: CTP_CleavageSite=34; ConfidenceScore=5.42e-01
VDSRGSPPRRFRGRFREGFPPFFIVLRSFFVVLRSSTDVSMSDFVKILHRSSSFFVRSSSFLVFN

SEQ ID NO: 127292 - protein, 230 aa, Glycine max
  Coding DNA Sequence Number=SeqID_35607
IQQGIGPGCIKGPISTQGGCNKEDIHPVELLGIEEKHPQLQDGIQALADQLANQDKVKNQSYVDSERRLKSIIECSDKVLQEAQQLWHLGENLGMETVTDNLHFLHSYASMECRDRKEAKENLVGKHKIDLLCLQETKRDSVDKALCQALWGHSDFDWKWFPAVNTAGGLLCVRNNNNFQVDIKIAERGFIMLEGVWLVESQRGTSTALYTQLKEWEALFVMQTLIFKLN

SEQ ID NO: 127293 - protein, 71 aa, Glycine max
  Coding DNA Sequence Number=SeqID_35608
MSQAEPINVNIGNPIEEMICDLGQEGFEQAHAPLDEFAEMHCYPICGVSRYRVNDGEYSVDATANNRRLAK

SEQ ID NO: 127294 - protein, 57 aa, Glycine max
  Coding DNA Sequence Number=SeqID_35609
MGAKHLTRTKERSHVIKQRSPDEIRGQYDKDYGAADKSKALAPTYPPMRNSDLRSSR

SEQ ID NO: 127295 - protein, 57 aa, Glycine max
  Coding DNA Sequence Number=SeqID_35610
  Homolog annotation: Hit_ID=A5C859; Match level="QueryCoverage=77%, HitCoverage=3%, E-value=2e-08, Identity=52%"; Hit description =Putative uncharacterized protein
MAGPLAKVLWYLPIVPRFKRLFANADVAKDLTWHANGSNYDGMQKYTMLSMMISGPR

SEQ ID NO: 127296 - protein, 93 aa, Glycine max
  Coding DNA Sequence Number=SeqID_35611
  Subcellular localization annotation: CTP_CleavageSite=11; ConfidenceScore=5.22e-01
MAATRLSLPCRKARKASITARSTNPSIFGMRTTPKIKSAKMSIKESPLGGDLPGPCFYLQIFSRYSDHPIFRLAFGGLIPAPRFGLFLEILDQ

SEQ ID NO: 127297 - protein, 116 aa, Glycine max
  Coding DNA Sequence Number=SeqID_35612
MSLHSSSSVNGEGSTPKDPLYKILDELRSLKLWKEKQERKEKGKKRVEEISQDEEEIERKKEENMKEMKRENMPPIDNVEANLVWEIRVEQQIKNKSMSKSYGSHSYPMKYQGQGI

SEQ ID NO: 127298 - protein, 87 aa, Glycine max
  Coding DNA Sequence Number=SeqID_35613
MVSRGIIPFEKHIAVVGTTNNNMLSKRKTLDEGSLLSSKSETQHDHKFTSTPYVPMDLAIGPLFNSSCVQKGYNVNDQLDFILIVIK

SEQ ID NO: 127299 - protein, 179 aa, Glycine max
  Coding DNA Sequence Number=SeqID_35614
  Gene Ontology: Mol. function=helicase activity; Biological process =viral genome replication
  Homolog annotation: Hit_ID=Q2R1R7; Match level="QueryCoverage=85%, HitCoverage=10%, E-value=9e-29, Identity=41%"; Hit description=AT hook motif-containing protein, putative
MWYDERISKDRNKTSPKFTLCCGDGKVELPLLQSPPKYLERLLFDGKASDSKNYQCNIQTYNMMFAFTYAGIKLDKSINESRGPPTIRIQGQPCHRIDSLLPMPGKQPKFSQFQHVGIQPEIVSTLSQMLDEYNVHAKSFRMARDRLTDTQVDNTQEGILFLKPKMENYKESMNYTLAI

SEQ ID NO: 127300 - protein, 294 aa, Glycine max
  Coding DNA Sequence Number=SeqID_35615
  Homolog annotation: Hit_ID=Q6WAY6; Match level="QueryCoverage=92%, HitCoverage=45%, E-value=3e-36, Identity=35%"; Hit description =Putative uncharacterized protein
MIEVSIEAISSLAQYYDQPLRSFTFGDFQLSPMVEEFEEILGCPLGGRRPYLFSGFYPSLARTSKIVQISAQELDHGKQVRNGVVGIPRKCLEAKARSLAGRGEWAPFIDILALLIFGGVLFPNVDGLVDLAVIDAFLAYHDHKESPVVAMLADLYDTFDRRCEKSSTRIVCCTPALYVWLVSHLFRQEVRHACPLESHRSCTEKGGANWDQLLANKEGVSINWFPRWKEGRTRVLISCRGFPNVPLMGTRGCISYNPILAIRQLGYPMRGAPLEEELAPVISRGFNKTNGETL

SEQ ID NO: 127301 - protein, 175 aa, Glycine max
  Coding DNA Sequence Number=SeqID_35616
  Subcellular localization annotation: CTP_CleavageSite=73; ConfidenceScore=5.44e-01
MPISPCRCIGIAPTRRPVGPKKSNRALGFPALVTGFCQSYRVPVPPARNRTHKDTQWTRRSPTGPWGFQLWLRASVVLQGARSPRQGHVIIGIMPARHPVDPKKSNRLYGVPVTSSKGIRPPTNRAFIKKYCAPRQAQGETPQQPGDGQQRATDAPPSLLEFTSAHPQKGKRGIL

SEQ ID NO: 127302 - protein, 70 aa, Glycine max
  Coding DNA Sequence Number=SeqID_35617
  Subcellular localization annotation: CTP_CleavageSite=50; ConfidenceScore=5.15e-01
MASYGGELLLDSSSPSSGVSNHLSSFSILLPLNIKKQRNPLMKKILRPTSSTMELHHGSNDAILVPPKGL

SEQ ID NO: 127303 - protein, 101 aa, Glycine max
  Coding DNA Sequence Number=SeqID_35618
GMFVIPFMTRLGITNSWGGWNITGGTITNPGIWSYEGLYGPGNMGVRSLWTNWEGYNPLLSLLELCGMVQQQPLLNYSVLLVINGIRDTFSKKYIEELVLD

SEQ ID NO: 127304 - protein, 156 aa, Glycine max
  Coding DNA Sequence Number=SeqID_35619
MARKARSSPFWPCMTRSTGDVKRAAQELFVVHWLSMCGWFHTFFSKKVGPSIRYKEGRIRILSSCEGCPMRGVPSDESITPFIARGFSDHNARLLQGVRKAWDAADEVQALKAKLERARVVKEKFKAAIMSSNSEEVKGIITGQRHDLEGRAKGLP

SEQ ID NO: 127305 - protein, 71 aa, Glycine max
  Coding DNA Sequence Number=SeqID_35620
MYCRKMGAYAKDEELLIHFFQESLTGVAVTCTTLIWLRIGCNYRAYARGGMDLSKNTPKGGGIWQPKWFPR

SEQ ID NO: 127306 - protein, 89 aa, Glycine max
  Coding DNA Sequence Number=SeqID_35621
  Homolog annotation: Hit_ID=A0K9D8; Match level="QueryCoverage=80%, HitCoverage=19%, E-value=8e-08, Identity=37%"; Hit description =Putative uncharacterized protein
MNGDETHPCLLSNQQFKHSLNRFGFKVPAWEYHAANEWERAYMSNSEGFTILKEQVYSHCPDIEPRSDRFPGIPRLCKRWWDRSFIKNA

SEQ ID NO: 127307 - protein, 90 aa, Glycine max
  Coding DNA Sequence Number=SeqID_35622
MEESKEFPDYVVLISLTREKGDTKEFRRLVLRCFGKREKRDTKRIQAEKRIKDIAHFYFQGLENQKTLERLLQRKKKKKKKKMFEEIQRS

SEQ ID NO: 127308 - protein, 192 aa, Glycine max
  Coding DNA Sequence Number=SeqID_35623
  Homolog annotation: Hit_ID=Q6WAY6; Match level="QueryCoverage=51%, HitCoverage=17%, E-value=8e-11, Identity=38%"; Hit description =Putative uncharacterized protein
HACSLESHRSSTEKGGANWDQLLASKEGASVNWFPRWKEGRTRVLISSGGFPNVPLMGMSGCISYNLVLVIRQLGYPMRGEPLEEEIVPVISRGFNKTNVETLQKVRKAWGGGAKEGQRTQGQEEVEAPEEDEEVQALRVELEQAQAVKERFKLAALKIRKENAELRDINIATTKALEQETKRARREEHSRN

SEQ ID NO: 127309 - protein, 57 aa, Glycine max
  Coding DNA Sequence Number=SeqID_35624
MRRFLVDRASIENVNVVQQEAELEPPPNVVNEFNPNEIVRDPVIGNKLMSMLRIFKI

SEQ ID NO: 127310 - protein, 77 aa, Glycine max
  Coding DNA Sequence Number=SeqID_35625
MPFCERARRGSRVRFPKEERCVESPPMFICGKRQKNRRKLVKMKILSSGVVFTFEEGRQKRGFCSYVPSFGEEIRPT

SEQ ID NO: 127311 - protein, 126 aa, Glycine max
  Coding DNA Sequence Number=SeqID_35626
RVHALAFRGLHALAFRGLHALAFKGLLSSPFRDYTSSPSEGYYTLALRASTPLPQRTHVLVFRGLHTLTFRRTTCPRLQRSTRPHLQRATRPPLQRTTHPPLQRTTRPRHQRATRPHPQRATRPYL

SEQ ID NO: 127312 - protein, 128 aa, Glycine max
  Coding DNA Sequence Number=SeqID_35627
  Gene Ontology: Biological process=transposition, DNA-mediated
  Homolog annotation: Hit_ID=Q1J7G7; Match level="QueryCoverage=26%, HitCoverage=48%, E-value=7e-12, Identity=97%"; Hit description =Transposase
  Subcellular localization annotation: CTP_CleavageSite=55; ConfidenceScore=5.11e-01
MVKVGTSYVPINVSFSPKVGQGFPVLQWLLFLSAVPPVQLLTGWCVTAKAPPDISAGKCSGHAARRVPFAIQAAQLLGRAIGAGLFAITPAGERGMCCKAIKLGNARVFPEFDLKRSCGRGRTLPTYV

SEQ ID NO: 127313 - protein, 111 aa, Glycine max
  Coding DNA Sequence Number=SeqID_35628
MKQKGKRKKDREGRHVIVKKYKSFVKSKRIFWKQGTDTKSLFSGITEIRMDEFIELMKEHNLETLAMTNFARCFQIIIVARALWNNMEVQPKTDTLTPKFVCPDIKIGFPQ

SEQ ID NO: 127314 - protein, 101 aa, Glycine max
  Coding DNA Sequence Number=SeqID_35629
MENWRSSATQCNSRGSRLEVGGHMNSARQCNSWGSEKMWRMENWRTTLGNDIRGAPDSKAMTFMGLRKNVENGELANNRLGNDIREGSRLEGGGHMNSARQ

SEQ ID NO: 127315 - protein, 95 aa, Glycine max
  Coding DNA Sequence Number=SeqID_35630
  Subcellular localization annotation: CTP_CleavageSite=78; ConfidenceScore=5.18e-01
MQFQQETRASIQSLTNQMGQLATQLNQQQSQNSDKLPSQAIQNPKNVSAISLRPTWALQNIPPEGCCFWRKQPGSPGRAELAWASWAATTSPILL

SEQ ID NO: 127316 - protein, 116 aa, Glycine max
  Coding DNA Sequence Number=SeqID_35631
MWTTTAISREREVPKGLNPFLLHFSPIYSKIGEKLATQLAQASKVASSRSNSLLEEGSGRPKWVRLLFAPPFLLNAPPSIFLLSKKLRKLTDCAKTPLFDFRHITEFHGSRKPASF

SEQ ID NO: 127317 - protein, 79 aa, Glycine max
  Coding DNA Sequence Number=SeqID_35632
MVQLISDIIYCLHESHPQRHPVDPEKSNRALGFLALVTGLCSPTGCPFPPARSRHHRDRACKTSSGPEEVQQGLGVVKL

SEQ ID NO: 127318 - protein, 227 aa, Glycine max
  Coding DNA Sequence Number=SeqID_35633
  Homolog annotation: Hit_ID=Q6WAY6; Match level="QueryCoverage=71%, HitCoverage=28%, E-value=7e-18, Identity=32%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVFLAYHNHKESPVVAMLADLYDTFDRRCEESNARCPNVPLMGKRGCINYNPVLAIRQLGYPMRGVPSNESITPFIARGFSDHNARVLQGVRKAWDAA

SEQ ID NO: 127319 - protein, 133 aa, Glycine max
  Coding DNA Sequence Number=SeqID_35634
MKVDMEAMKGQMATMMEGMMSMKTNDGGQCDYSCCCKYRHRSGPNSLIEPQSSKSSSLGYGRSGRRSIGKYSANENINDSTPILIESQQPQSGHAHVSQPMGEAHEAPQDHNLVDFEPHLGYAAEGKTFCGIP

SEQ ID NO: 127320 - protein, 74 aa, Glycine max
  Coding DNA Sequence Number=SeqID_35635
RGSNLDTLLRQFKDTVGSIQRAFKSAEIQVGKLVEEETQVMGRREEEFVEVEAQEESPVNEHDLEEEEEEKAQK

SEQ ID NO: 127321 - protein, 94 aa, Glycine max
  Coding DNA Sequence Number=SeqID_35636
  Homolog annotation: Hit_ID=A5BSZ8; Match level="QueryCoverage=80%, HitCoverage=7%, E-value=8e-18, Identity=60%"; Hit description =Putative uncharacterized protein
MLEEKFVIIIDASSNEEKAQFKAWERSDRLSLMLMRMTVANSIKTTLPKIESTKKFMGLVGERSQSADKSVAGTLMGTLTTMKFDGSHMNMSLR

SEQ ID NO: 127322 - protein, 239 aa, Glycine max
  Coding DNA Sequence Number=SeqID_35637
  Gene Ontology: Mol. function=GTP binding; Cellular component =intracellular
  Homolog annotation: Hit_ID=Q6UUU1; Match level="QueryCoverage=41%, HitCoverage=68%, E-value=3e-20, Identity=55%"; Hit description =Putative uncharacterized protein
  Pfam annotation: Domain name=MMR_HSR1; Domain location=60-170; Score=- 5.1; E_value=0.0031; Accession=PF01926.14; Description=GTPase of unknown function
TDGVGGNGKSTARTSALARRVPFAIQAAQLLGRAIGAGLFAITPAGERGMCCKAIKLGIRYVYVVGVTNVGKSTLINAIIKSASGSEDVITTSRFPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGSERAAAKPFFHRLRPPDSITKSDAQI

SEQ ID NO: 127323 - protein, 241 aa, Glycine max
  Coding DNA Sequence Number=SeqID_35638
  Homolog annotation: Hit_ID=Q6UUU1; Match level="QueryCoverage=34%, HitCoverage=57%, E-value=1e-22, Identity=66%"; Hit description =Putative uncharacterized protein
  Subcellular localization annotation: CTP_CleavageSite=29; ConfidenceScore=5.19e-01
VPPVQLLTGVVRNGQKHRRTSALASVAVPAARRVPFAIQAAQLLGRAIGAGLFAITPAGERGMCCKAIKLGNARVFPVTTLNSMPVFVDSDKIQASKQKFRFWETWICHHELDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWAYERGGDFLEDARKILNREVRGPRKPFFH

SEQ ID NO: 127324 - protein, 45 aa, Glycine max
  Coding DNA Sequence Number=SeqID_35639
MEELHGVDVEEQGIKQNGEGGKVIGDTTSRRRWVKNKFTTIGSHG

SEQ ID NO: 127325 - protein, 84 aa, Glycine max
  Coding DNA Sequence Number=SeqID_35640
RRGSRVRLFKEERCAESHQRLFVENVGKTEGNPVKMKILSSGVVFMLEEGISTSYVDKSGAFAPTYPPLERKSDLRSSFLSVNQ

SEQ ID NO: 127326 - protein, 133 aa, Glycine max
  Coding DNA Sequence Number=SeqID_35641
MAKFDPEIVLEFYANAWPTEEGVRDMRSWVRGQWIPFDADAIVQFLGYPLVLEEGQECEYGQRRNRTDGIGEEAIAQLLCITGQDFARTAAGRRVRIMRTNMTTLTQIWMTLLLSNILPTYHNSDLPLPKCQL

SEQ ID NO: 127327 - protein, 148 aa, Glycine max; identical to SEQ ID NO: 109517
  Coding DNA Sequence Number=SeqID_35642

SEQ ID NO: 127328 - protein, 65 aa, Glycine max
  Coding DNA Sequence Number=SeqID_35643
MTPESDDESLEGTNTRDPAIDFKQEAGQTESEENEDVGLPPELERIVAQEDRKMGPDVPSFSSIF

SEQ ID NO: 127329 - protein, 208 aa, Glycine max
  Coding DNA Sequence Number=SeqID_35644
  Gene Ontology: Mol. function=transferase activity, transferring glycosyl groups; Cellular component=cytoplasm; Biological process =metabolic process
  Homolog annotation: Hit_ID=A4F1R6; Match level="QueryCoverage=69%, HitCoverage=29%, E-value=2e-60, Identity=77%"; Hit description =Putative glycosyltransferase
MANANCSQESLHSVSNGNLRLWKSIHYCFIEIYLVNEEIRVRFSGAVRVPSASAIVFNTFDELERDAMNGLSSMLPFLYTIGPFPLLLNQSPQNNFASLGSNLWKEDPKCLEWLESKESGSVVYVNFGSITVMSTEQLLEFAWGLANNKKPFLWIIRPNLVIGGLVILSSEFVNETKDRSLIASWCPQEQVLNHPWWILDSLWIELNH

SEQ ID NO: 127330 - protein, 98 aa, Glycine max
  Coding DNA Sequence Number=SeqID_35645
SFNNGNWSDSKVLDSAGLSCRAFTWNRAEQVLGAVAGELLFIWEVSSFLVNILQMIQFHEIESFLKGGMNILTAHSQEWEQELSSNYQYEEERTPNLE

SEQ ID NO: 127331 - protein, 83 aa, Glycine max
  Coding DNA Sequence Number=SeqID_35646
MYIVVVKQGQDHLGLPFGVKTKHERQKPVKVLKDERKRGWGHDRPIVTLLCAKQAGNVAARQPRILCILQLSFTICLFSKGKE

SEQ ID NO: 127332 - protein, 153 aa, Glycine max
  Coding DNA Sequence Number=SeqID_35647
MEANAVIVAATSAVAKYGRPHDVQIQNEHAFPSYGLPPNYTPPNVSYTLNENLNNSTPILIKSQQPQSDHAHVSRPMEETHEIPHHNLADFEPWLGYATEPASNWWAIEGGEDYAFANLKELFLEPNIITPPKFKVLDFDKYKGITCPKNHLK

SEQ ID NO: 127333 - protein, 135 aa, Glycine max
  Coding DNA Sequence Number=SeqID_35648
MGCYSNTQWLSARKNPKEDELYRFAERITPGHQAHCFSSSAKREMRATSKITNSLDWDSELCMSRVSRERKVQVPESFERFCCVKICRDQSLKQEPASWYGKLNPLLDLPCSGNWSDSKVLDSAGLSCRAFTRNR

SEQ ID NO: 127334 - protein, 112 aa, Glycine max
  Coding DNA Sequence Number=SeqID_35649
MDNKKRRPIICRTKPNLNKTFKEDTKAIEVVQVSISNQKKTNAFIKILEVHVGQPAKQLSEHRSGSFSATTRVNPKEHCNLITTRWRSVVGLKDNDEKKNIEGVEKENQKKR

SEQ ID NO: 127335 - protein, 60 aa, Glycine max
  Coding DNA Sequence Number=SeqID_35650
MWTTTGEMVAAQLAQASSARPGELSSPRRARLLPPEATTFWRNLLEGPSGPGCYLHPHFY

SEQ ID NO: 127336 - protein, 250 aa, Glycine max
  Coding DNA Sequence Number=SeqID_35651
  Gene Ontology: Mol. function=4 iron, 4 sulfur cluster binding; Cellular component=integral to membrane; Biological process=protein -chromophore linkage
  Homolog annotation: Hit_ID=Q3ZIZ3; Match level="QueryCoverage=100%, HitCoverage=42%, E-value=1e-107, Identity=64%"; Hit description =Photosystem I P700 chlorophyll a apoprotein A2
  Pfam annotation: Domain name=PsaA_PsaB; Domain location=1-250; Score=- 27.2; E_value=5.1e-06; Accession=PF00223.10; Description=Photosystem I psaApsaB protein
TAILTLLGGFHPQTQSLWLTDIAHHHLAIAFLFLVAGHMYRTNFGIGHSIKDLLEAHTPPGGRLGRGHKGAFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGALDARGSKLMPDKKDFGYSFPCDGPGRG

SEQ ID NO: 127337 - protein, 202 aa, Glycine max
  Coding DNA Sequence Number=SeqID_35652
MTSRLLVGSLTFDNQIMHYIIVRILLPGSSNLAQASEEDLILMWAFLTGRQIDWAHLVRYQMHKALRANAPLPYPQLITLFLRHFQIPLDDEPFVQVKRSFAIGAGAVTSFGYRKDRKGQWLKKDTLPPQDERTPSPPPWRDDSALMTEVLSELRGLRSYVGEHFDLLDTRFAGMDIRLTQLEEDVGYIRQSFDLPPPPPPS

SEQ ID NO: 127338 - protein, 154 aa, Glycine max
  Coding DNA Sequence Number=SeqID_35653
MTSIYVRGRGCHTLKLWKEKLERKEKEKGRVNINQDEREQIKEEERRKILKELRKEKHVSYSSHNSCKSLSEELRDYYEGRHRSHLRPYSHRREKERKPQEANINLPYFHGKDNVEANLDWEIRVEQQLKKKSTSKCYGSHSYPKKDQGQGILG

SEQ ID NO: 127339 - protein, 84 aa, Glycine max
  Coding DNA Sequence Number=SeqID_35654
MGAKYLEVVKRGPHPNNGWFPDEIRNDHNLSLRFVGHDRAWAARHKMTIICLCVSLDTIASGWRKGARNDHNLSPPTSRLTVPE

SEQ ID NO: 127340 - protein, 194 aa, Glycine max
  Coding DNA Sequence Number=SeqID_35655
MTLLLSNILPSDRNANLSLQKYQLVCVVPTWGSHPQDTQWTRKSPTGPWGFQLWLRASMQSYRVPVPPRQGYVIIGKDRTCQDTQWTRRSPTGSWSCQALITGLCQFYGVPVTSSKGIRPPTNRAFIKKYCVSRQAQGETPQQPGDGRQRATDAPPSPLEFTSAHPQKGLSIAYTTWPTNRRPSPKPKDAPSCS

SEQ ID NO: 127341 - protein, 54 aa, Glycine max
  Coding DNA Sequence Number=SeqID_35656
MTRSRTKQSVDTLQQMVAGILSKAQVEKDKSPSGEGQKPKWRRTKAEVEKDEAP

SEQ ID NO: 127342 - protein, 71 aa, Glycine max
  Coding DNA Sequence Number=SeqID_35657
MVAGNTTIEKPREEWSEEERRLVQYKLKAKNIITSSLGMDEYFRVSNCKSAKDMWDTLQEYEMELQRHKST

SEQ ID NO: 127343 - protein, 154 aa, Glycine max
  Coding DNA Sequence Number=SeqID_35658
MALEWWSQRKRFVPVKVPGLWDLHLPYEEKVGPQARLPSPKTAQWKAWILEAPPPVNSEVKLMLGLKRSKVRLFETTLPARHRAMIRAGNPSQEELDWAIEVVWPEMSTPMFMSMQETKPKISLALSIVSILPGWPSVFKMNPRPGIIGQPQSP

SEQ ID NO: 127344 - protein, 73 aa, Glycine max
  Coding DNA Sequence Number=SeqID_35659
MRKMLLVEVLDTAFPTSMIRPSKVGMIPPPWIVPVAGEHKLQAIQLLQIVAQKGKGLCGGRQRSINHRVWRQV

SEQ ID NO: 127345 - protein, 48 aa, Glycine max
  Coding DNA Sequence Number=SeqID_35660
MACTHIPVEAKMIHKRFSSNFSQPALIRLFTLRFKVIQCSMECPETPP

SEQ ID NO: 127346 - protein, 140 aa, Glycine max
  Coding DNA Sequence Number=SeqID_35661
LPSPLRGLHILALRGLHVLTIRGLHALTFRGLHVLALRGLHALTLGLHVLTIRGLHVPHLQRTTRPRLRGLHAFTLGTTLPSPLRGLHVLALRGLHVLTIRGLHALTSRGLHVPRLREGYIALTFRVLVTLTVRGLHSLA

SEQ ID NO: 127347 - protein, 287 aa, Glycine max
  Coding DNA Sequence Number=SeqID_35662
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLAPDYGAITAAILASVPPQPQLALGNMNPSQHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127348 - protein, 87 aa, Glycine max
  Coding DNA Sequence Number=SeqID_35663
RNLKSQRLLTVGRKGSYFRPWARDGGSLNQTSRGNRPLQPIRTDVRKKAQTIQKQNTAPHVLSRGGYGYLEQKLLAEKMKKKLEEAA

SEQ ID NO: 127349 - protein, 56 aa, Glycine max
  Coding DNA Sequence Number=SeqID_35664
MVNNTSEFNIHRKVERNRKGGLVPSLEEFESRSKRATTLRAIGTKKHFKLSGSPKR

SEQ ID NO: 127350 - protein, 25 aa, Glycine max
  Coding DNA Sequence Number=SeqID_35665
MAKRALCAKPECPSGEAELSASMLC

SEQ ID NO: 127351 - protein, 218 aa, Glycine max
  Coding DNA Sequence Number=SeqID_35666
  Homolog annotation: Hit_ID=Q2HW90; Match level="QueryCoverage=83%, HitCoverage=35%, E-value=2e-16, Identity=33%"; Hit description =Putative uncharacterized protein
AIDAFLAYHHSKESPVVAILADLFDTFDWRCEKNSARIVCCLPALCVWLVSHLFQQDTRHPCPLQSYRSCAEKGRVDWDQHLTGIGGNTINWFPRWKEGKEGVLFSCGDYPNVPLIGTRGCINYNPALATRQLGYPMRGAPTEESLLPFLVRDLGAQSLKVIQRVHKAWRSPLRKDKELRGIRNGVIGGYHGWLRVHTRGLDWLSKLKVINEENFEAP

SEQ ID NO: 127352 - protein, 78 aa, Glycine max
  Coding DNA Sequence Number=SeqID_35667
  Gene Ontology: Mol. function=hydrogen ion transmembrane transporter activity; Cellular component=proton-transporting two-sector ATPase complex; Biological process=ATP synthesis coupled proton transport
  Homolog annotation: Hit_ID=A7M951; Match level="QueryCoverage=53%, HitCoverage=8%, E-value=1e-09, Identity=76%"; Hit description=ATP synthase subunit alpha
MTALPIVETQSGDVSAYIPTKVRKFLVELRAYLNTNKPQFKEIISSTKTFTGEAEVLLKEAIQEQMELFLLQEQVEKN

SEQ ID NO: 127353 - protein, 105 aa, Glycine max
  Coding DNA Sequence Number=SeqID_35668
MWRQNFVIPHPFAIQTQSCPMARRDKIWSFCTLCHPEAAGPDDMRRQNLVIPHPFAIQTQSCPMARRDKIWSFCTLCHPEAVGPMTSRAMWSFLHPFRQSRRQAR

SEQ ID NO: 127354 - protein, 90 aa, Glycine max
  Coding DNA Sequence Number=SeqID_35669
MIIGASNEANIYSAEAEYMTATSVDVEANGSRNNSARTPRLQQLFIDQYLATEMTKNPVFHSRTKPLRLRYLIQESSWNMEKIKGGSGQD

SEQ ID NO: 127355 - protein, 123 aa, Glycine max
  Coding DNA Sequence Number=SeqID_35670
MSGFTRDSPQISANPHQLDLAPYASEPYNAQWNAPGLLRDKHTLRSSRILGEMELSRCKIHFLVGVFGFVVDLGMAFVDNWVVGKEKVCYWLSKDIVGMIKFASFQIHFDPFTGEDQIRKALR

SEQ ID NO: 127356 - protein, 271 aa, Glycine max
  Coding DNA Sequence Number=SeqID_35671
  Homolog annotation: Hit_ID=Q2HW90; Match level="QueryCoverage=94%, HitCoverage=55%, E-value=6e-20, Identity=28%"; Hit description =Putative uncharacterized protein
MGTNQTGKRFYQVKVKSLDTTSIKELGRLMEPLQMQAFRKTYGKILELTIAEVSIEAVASLTQYYDQPLRCFTFGDFQLVPTIEEFEEILGCPLGGRKPYLSSGCLSSLSRIATVVKDSARGLDRIKQTRNGIAGLPQKYLEDKARDLAAIDAFLAYHHSKESPVVAVLADLFDTFDRRCEKSSARIIGCLPALCVWLVSHLFQQNTRHPCPLLSHRSCTEKRRMDWDQLLAGIGGRTISWFPRWKEGKEGVLFSCGRYPNIPLVAPEGLY

SEQ ID NO: 127357 - protein, 240 aa, Glycine max
  Coding DNA Sequence Number=SeqID_35672
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNSIKPALLVRKFKGSSIPAIPRGARYQLLFPLVRVNFELGVIMVIAVSFGKPVLPAALMNRPTRGERRFAYWALAECILAYYVGTDEGVSEVLHVAGEKRLHRCVSRICDTGYIPLPRSLTRYARSFDCGEREWLTNGAEISWKMPGRYLTG

SEQ ID NO: 127358 - protein, 276 aa, Glycine max
  Coding DNA Sequence Number=SeqID_35673
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSISVVAESTFRRNISPAVETYNIKGAIGSTVITTYTSVKININSTRFSSINIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127359 - protein, 124 aa, Glycine max
  Coding DNA Sequence Number=SeqID_35674
  Homolog annotation: Hit_ID=Q84VH5; Match level="QueryCoverage=62%, HitCoverage=11%, E-value=3e-24, Identity=77%"; Hit description =Envelope-like protein
MKRESPLSLHYKLFEGTHVPDIVSTSGKAAASGAVSKDALIAELKDTCKVLEATIKATTEKKMELEWLIKRLSESGIDDGEAAEEEEEAAEQEDEAAEEEVEAAKEEEDAAEHTESDDDSEATP

SEQ ID NO: 127360 - protein, 383 aa, Glycine max
  Coding DNA Sequence Number=SeqID_35675
PGGPVDPRGGAGHRGDGRGAVGAGRPGPVDRRRAGGRHHHGLDADAVPGATGAFPAPAWRCDLAVPERHESGGGPAAGMGGAGHHARQPAAAAADQARREPVDAADPGRGAGRHVRLRHCRPVHRPGDPGGDLHTAQGLGRRSAAAGRRRVAGGSPVRRALSRANCPARAAVGKPRNIRARPHACAESAARGRSVPAFHAVFEMTIFPPISRPIHFPRPPGQAAGRRAILFPWRRRTLHRGRLGRRGRQGRRGTRFPRQPWPGCRPAAGRAAGRDAAGEHTGAQAGGPVGVGPGAFGAGPGRARKPDAGRPFGPALSQAHVQRPQAGHAAGARGQRAGGVHAGIRGRAQAGGRGAPRRAGIHCAGARHAGCGRAGATAARPGL

SEQ ID NO: 127361 - protein, 220 aa, Glycine max
  Coding DNA Sequence Number=SeqID_35676
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=4e-25, Identity=29%"; Hit description= UPI00006A17C9 related cluster
  Subcellular localization annotation: CTP_CleavageSite=12; ConfidenceScore=5.44e-01
MVRTRSPLKARACSHRKARMCSVLMARACSPLKARTCNPLMARTCSPLKARACSPLKARTCALLMAWACSPMKARVRSPLKVRKCSPLKARTCSPLKARMSSPLKVTTCSPLKAIVCIPVKARTCAPLMARACSPMKARTSRPMKARACSPLKARPCSPMKARTCCPLKARTCKRTCSPQKARACNPLTARTCSPLKVRTCSPLKARTCSALKARTSSLI

SEQ ID NO: 127362 - protein, 241 aa, Glycine max
  Coding DNA Sequence Number=SeqID_35677
MCQVAGGYTQVIIRTKTTSGDPDLCVRGQVPSGYTQVIIRTKTTSADPDPCVRYTQVIIRTKTTSVDPDPCVRWQADIPKRIYPAVIRTSTTFADPDPCVRNTPSGYPYKHNSVTLTSERSETIESDSIEDVMVFTNRAIGRSGGALKKLHLERSGRCGELIKWGVFSGNLIRNFFRKPLEGVNLSKEGALKNLPQEALGTKKVKKEGNPSRVAFVTLPRRFCERIIEDFPPFFVVLRSST

SEQ ID NO: 127363 - protein, 31 aa, Glycine max
  Coding DNA Sequence Number=SeqID_35678
MWMMLSYNLRQDGWEFSRMGAGEIGTGEVGS

SEQ ID NO: 127364 - protein, 196 aa, Glycine max
  Coding DNA Sequence Number=SeqID_35679
MGDQEETQEQMKADMSALKEQMASMMEAMLGMKQLMEKNAATAAAVSSAAEADPTLLASTHHPPSNIVGRGRGTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPATEERRKLDLLEERLRAVEGFGDY

SEQ ID NO: 127365 - protein, 125 aa, Glycine max
  Coding DNA Sequence Number=SeqID_35680
  Subcellular localization annotation: CTP_CleavageSite=70; ConfidenceScore=5.34e-01
MDLPQQSSASLAFTQDSKAMQVVFAFNMYCLRVCKIPSYRPVLSTDNKWSSSSHSRKFYSSIQDGRRSLTAAEFRHIAAEGIIEASSLPFQCLLTARQLLPGQASGAAVIISAMLLVPANPQPGF

SEQ ID NO: 127366 - protein, 115 aa, Glycine max
  Coding DNA Sequence Number=SeqID_35681
MGQIPSRLVVLTGRLPGKLGGAAGGSLSLWPLVGALVDLFFSLSIPHSTFCKPLTLCLALFSLNSIPSLTSGPFGDSWVRLESKTDYLRAPHPRSPVVHSDRGISQRTAKTMGIL

SEQ ID NO: 127367 - protein, 84 aa, Glycine max
  Coding DNA Sequence Number=SeqID_35682
MVSVLDDAMFHTLDVVYIHGGCFDLVGCDAILPRKGPVTRAMSKRLQEDWARAAEEGPRVLMNLRVGYPRNIGFFSPCILGHID

SEQ ID NO: 127368 - protein, 161 aa, Glycine max
  Coding DNA Sequence Number=SeqID_35683
MWAFLTGHQIDWAHLVRYQMHKALRANAPLPYPQLITLFLRHFQISLDDEPFIQVKRSFAIGVGAVTSFGYRKDRNGQWLKKDALPPQDERTPSPPPQHEDSALLNEVLSKLRGLRSYVGERFDSLDTRFAGMDICLTQVEEDVSFIRTCFDPPPPPPSSS

SEQ ID NO: 127369 - protein, 67 aa, Glycine max
  Coding DNA Sequence Number=SeqID_35684
MKKQLRKKEKQLKKKKKLLRKRKMQQKRQNQMMILKPPHDHQTFMFLLLLLLAKGACPFEQLFTMGL

SEQ ID NO: 127370 - protein, 63 aa, Glycine max
  Coding DNA Sequence Number=SeqID_35685
MVKVGTSYVPINVSFSPKVGPGLPAVPPVQLLTGWCVTAKAPPDISAGKCSGHPARNHHTPRA

SEQ ID NO: 127371 - protein, 127 aa, Glycine max
  Coding DNA Sequence Number=SeqID_35686
DLDELVQLCIRVEQQLKRKPSSKSYGSHSYSRKDHAHGILEAAPSKPKEDKGHIASQCPTKKTMIMRGQDIYSSEEETTSSPSSSGSEDEVRGEESSEEVYTHEEGDLLMVRRLLGVDLVAIVVAQD

SEQ ID NO: 127372 - protein, 84 aa, Glycine max
  Coding DNA Sequence Number=SeqID_35687
  Subcellular localization annotation: CTP_CleavageSite=71; ConfidenceScore=5.42e-01
MASMDTLLWSTLRSFRMHMTQMQSRNAGARGIVSFLDTTSRGSKVPRHTFLRRRHRPSIGLFTEGIKTEPICDAYAKDAMRECT

SEQ ID NO: 127373 - protein, 44 aa, Glycine max
  Coding DNA Sequence Number=SeqID_35688
GGDSVRIPFVEHASRESRVALPPEGEQVTDAQDFGWPSKGEDHF

SEQ ID NO: 127374 - protein, 251 aa, Glycine max
  Coding DNA Sequence Number=SeqID_35689
  Gene Ontology: Mol. function=sugar:hydrogen symporter activity; Cellular component=periplasmic space; Biological process =carbohydrate transport
  Homolog annotation: Hit_ID=A8GLK0; Match level="QueryCoverage=100%, HitCoverage=85%, E-value=1e-99, Identity=78%"; Hit description =Monosaccharide-transporting ATPase precursor
  Pfam annotation: Domain name=Peripla_BP_1; Domain location=10-250; Score=-40.6; E_value=0.003; Accession=PF00532.12; Description =Periplasmic binding proteins and sugar
MKDGAQQEATAGLHLVVLDSQIPGERAGQRAGSDGARAQAAADQPDRLRCGGQRDQDGPTRLRSPVITLDRVASKGEVVSHIASDNRVGGKMAGDFIAKKVGADAKVIQLEGIAGTSAARERGEGFKQSLDQNKFKLLASQPADFDRTKGLNVMQNLLTAHPDVQAVFAQNDEMALGALRALQTAGKTDVIVVGFDGTADGVKAVEGGKLAATVAQRPDQIGVIGVETADKVLKGEKVPATIPVDLKLVTK

SEQ ID NO: 127375 - protein, 287 aa, Glycine max
  Coding DNA Sequence Number=SeqID_35690
MAKFDPEIVLEFYANAWPTEEGVRDMRSWVRGQWIPFDADAIGQLLGYPLVLEEGQECEYGQRRNRSDGFDEEAIAQLLCIPGQDFARTAAGRRVRIMRTNMTTLTQIWMTLLLSNILPSDHNSDLPLPKCQLVWCLLGTLWDPDKSNRALGFPALITGLCQSFGSPRCTYQGRRRAPTTSSGWQAGAFDMEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 127376 - protein, 184 aa, Glycine max
  Coding DNA Sequence Number=SeqID_35691
RHRQGITHAASARQCHVGLCFACADYRFRFQSGAAAGDESRRRAAAITVGDAARCAEPGCPVALVAGRDADADRRGGGPYRALYAGPRRAGPGDGIADRHAAAALRPAGAGVGADRRPGRRRQPGAGEPDHRHQYRAGSGRRCTPAAEGAAHGLDHPGGCGHHRRDVRHAGRRRADLLANPGGQ

SEQ ID NO: 127377 - protein, 98 aa, Glycine max
  Coding DNA Sequence Number=SeqID_35692
MSRNFTDYATIPPLTSGMLQNFMDCAIMLPFDSRHVAELHGLPNDGCQVPRSGQVKVASHQTDGPRMKLGYDTKSLVVDYHKGVIDYTSTDVTLHFEF

SEQ ID NO: 127378 - protein, 79 aa, Glycine max
  Coding DNA Sequence Number=SeqID_35693
MHANARVMSEIEVVQEQMKANMEAMKEQMTTMMEAMISMRKMMEVNTATAVAASTSTKVDLTHPPGLNQVNCLVSDMVG

SEQ ID NO: 127379 - protein, 354 aa, Glycine max
  Coding DNA Sequence Number=SeqID_35694
MAPNNNRRAPVVGARKKEGDAHAVTTAPTWMKAPQNIESSYQPNPPNFLIRAGNSLPTQVKGPPAAERAPAQRTAPAAPRPVNNTAPGTTYKYAQHPPPKDNFPPIPMAYSELWPSLLENHLVVAIPGKVLPAPPTPSGMTRVPSEEGPNVKTNPLASHGGASVNAIKEDGPSRAKRLGDIATSRRFIYQSLQAACMVSRGGGERDECLFHLGESHDMETRPAVEELLQRLMDWGQLEVSIGGREEPQVCMQSEEKKVPLTPKALVICFTRKGTGSTPTYPRTAPKPTPFAYQSNKVVPWKYTPPASSERVATEVDSLSAKVTNITGLSGVTRSGRVFASPHPAELPSKGKAPM

SEQ ID NO: 127380 - protein, 48 aa, Glycine max
  Coding DNA Sequence Number=SeqID_35695
MAVKKGYRFTNGKYDYSFYPSLKGDNLWDYIVTYQDKVIAQDIGARFK

SEQ ID NO: 127381 - protein, 232 aa, Glycine max
  Coding DNA Sequence Number=SeqID_35696
  Homolog annotation: Hit_ID=Q84VH5; Match level="QueryCoverage=79%, HitCoverage=31%, E-value=5e-17, Identity=37%"; Hit description =Envelope-like protein
  Subcellular localization annotation: CTP_CleavageSite=38; ConfidenceScore=5.63e-01
FPNSSQKLRNHSKRSAFPWLLTKRNFSSGSPSVPSSPSSTKAPSIQEQPEFHIQPIQMIPGQAPVPEKLRWDKKIRSIVSTILKNASVGIPDADWAGRCKQISTPNDFWCLMFYLEQRSSNFMASAHRMQNVLSIYSSKESINAEEELIPSCLQRSRLLHHGDNNKNLLQNDYKAEKEKPPLSRSGRIKTMHQKKSGLRSTPTTSRLEQSCNPFKKRKRNFSSLEGLDVETV

SEQ ID NO: 127382 - protein, 220 aa, Glycine max
  Coding DNA Sequence Number=SeqID_35697
  Gene Ontology: Biological process=transposition, DNA-mediated
  Homolog annotation: Hit_ID=Q6UUU1; Match level="QueryCoverage=27%, HitCoverage=40%, E-value=2e-18, Identity=78%"; Hit description =Putative uncharacterized protein
WNLLRADQRLIFAKVGPGLPGIYSAQSASGDAAQLTDLVYDGVFEVLQWLLFLSAVPPVQLLTGWCVTAKAPPDISAGKCSGHAARRVPFAIQAAQLLGRAIGAGLFAITPAGERGMCCKAIKLGNARVFPVTTLRFAYWALAECILAYYVGTDEGVSEVLHVAGEKRLHRCVSRICDTGYIPLPRSLTRYARSFDCGERKWLTNGAEISLEMPGRYLTG

SEQ ID NO: 127383 - protein, 126 aa, Glycine max
  Coding DNA Sequence Number=SeqID_35698
MMEAMRSMKKIMEANTVAIAATNAVAKVNPMPPSGLNQINHPTPDMVGLEGKELGGTSNPHLVRKTSMPSYHMACLPTIRHPMWRTLPMRMSITPLLYSFRANNLNLIMHMSLDPWERHMKCLTTI

SEQ ID NO: 127384 - protein, 400 aa, Glycine max
  Coding DNA Sequence Number=SeqID_35699
  Gene Ontology: Mol. function=transaminase activity; Biological process=mitochondrial electron transport, ubiquinol to cytochrome c
  Homolog annotation: Hit_ID=Q10KH5; Match level="QueryCoverage=54%, HitCoverage=26%, E-value=2e-21, Identity=32%"; Hit description =Putative uncharacterized protein
  Pfam annotation: Domain name=DUF1723; Domain location=145-194; Score =40.1; E_value=7.8e-09; Accession=PF08330.1; Description=Protein of unknown function (DUF1723)
MSQGQSVPFAGKWQHFTVRNDGEKVVPEPHGDAEQTETWESEVMIPWAVERTVYAFGGPLPDQASLSSKMSKVFPCYQTCEPRIFYSEPYNFNCLSKPNKLFRSAPSIAHRDYLPWLDRVEQAYEDFWKTYGIFDLIQFSRSGPEYRPEMLIAAMHFFESSTNTFQFKCGMMTPTLLDVAALTGLRPSGETYDPTNSSDNIKLVYKENTFSKYIAEHKGPVEEEVSDEEHVAFLTLWLSHYVFCTKSLQVAKRFIPMALQIHEGQNFGFGRLLLAVLYESLGEACDDLKKSKDGSSFLVSGPMWLLQLWLNATFEQEMGLIIPQDYAEEVANRSIEGQRALRLTPKTLDPSSQKLFLKYMSIFLSFDKFLPQHAPFISREVGPAWFTDYFPTVDPDNEEE

SEQ ID NO: 127385 - protein, 81 aa, Glycine max
  Coding DNA Sequence Number=SeqID_35700
  Subcellular localization annotation: CTP_CleavageSite=60; ConfidenceScore=5.42e-01
MRFHCYQASQKLSMTTNSPPLPMFPWTWSPMESPTVATYPLAGRRCGAHRCVFQGRKACRVATNVYSWKTSEKLERVVYEL

SEQ ID NO: 127386 - protein, 269 aa, Glycine max
  Coding DNA Sequence Number=SeqID_35701
  Gene Ontology: Mol. function=DNA-directed RNA polymerase activity; Cellular component=mitochondrion; Biological process=transcription
  Homolog annotation: Hit_ID=O47884; Match level="QueryCoverage=98%, HitCoverage=26%, E-value=2e-91, Identity=63%"; Hit description=DNA -directed RNA polymerase
  Pfam annotation: Domain name=RNA_pol; Domain location=1-267; Score= -138.8; E_value=1.6e-05; Accession=PF00940.10; Description=DNA -dependent RNA polymerase
MSFVDLYNCVPVTQDASASAYQLMAYFLLDKNFAKLTNLFDTGSGEIFDIYSHMRIELISFIKDSLSEENPELCAILDRVLTRSIVKQIYMPIIYGKTANSTTKDLIVSLCQDLLPKECTILSVLCFKFWQEKYSFMYSFIQLISLVGRVCSYLDRPVLYSTEYFSTSQDYKKMEKHSVRVFNSYLKKAHNVTLSFPSKERDKRKSGVSTFVNFIHQKDAQIAMSIAFYENSYNIPLYTVHDNFITNIHYCKYISKIYLHVIKEMGPPS

SEQ ID NO: 127387 - protein, 75 aa, Glycine max
  Coding DNA Sequence Number=SeqID_35702
MHLQRPPSLSHSFFRQAVVDQSSLQQPADPSTPVLEIPKDPATPVLGLTTTLPATPMLHLTDEEGTQDQETQQDD

SEQ ID NO: 127388 - protein, 169 aa, Glycine max
  Coding DNA Sequence Number=SeqID_35703
  Gene Ontology: Mol. function=chitin binding; Cellular component =extracellular region; Biological process=chitin metabolic process
  Homolog annotation: Hit_ID=UPI00006A17C9; Match level="QueryCoverage =89%, HitCoverage=99%, E-value=8e-12, Identity=31%"; Hit description =UPI00006A17C9 related cluster
  Subcellular localization annotation: CTP_CleavageSite=74; ConfidenceScore=5.27e-01
MLVRMTRTRLFAAARVKSCPGMHSSCVIASLSGCARTVGPPPISGGGPGTVWMWSTLKMRTRSPLKVRACSPLKARMCSPLEVRACSPLLARTCSPLQGRTALCWRGRVVLSKQSACSPLLARTCSPLKVRACSPLKVRTCSPLMARACSPLKVRTCRSSDARACSPSE

SEQ ID NO: 127389 - protein, 108 aa, Glycine max
  Coding DNA Sequence Number=SeqID_35704
  Subcellular localization annotation: CTP_CleavageSite=40; ConfidenceScore=5.12e-01
MYPPLGLIHKRCTLSYSQSATQVDVSFTCTTKDVPSNVLRQSSQAVKPLKLCEWGNKSILRREKGDTKEFRQLVLCSFGKGRRETQKEFRRLVLDEFFLAKGEENEKD

SEQ ID NO: 127390 - protein, 127 aa, Glycine max
  Coding DNA Sequence Number=SeqID_35705
  Homolog annotation: Hit_ID=Q6WAY6; Match level="QueryCoverage=67%, HitCoverage=15%, E-value=5e-07, Identity=34%"; Hit description =Putative uncharacterized protein
MGTRGCINYNPVLAIRQLGYPKRGGPLEEVLTPFIARGFNSTNTGMLQRVRKAWEMVQKKDKELRGSSNGPISGYHRWLKAYAQGLDWLSNLRTTKEAEGEASEEDEEIQALKTELEKAQTAKEKFK

SEQ ID NO: 127391 - protein, 73 aa, Glycine max
  Coding DNA Sequence Number=SeqID_35706
MGPPRLFREREKCLRGLTLFFFTSPPIYSKIVEKLAAQLAQASKVASSRRTAFWRNLLEGPSGPGCYLHPHFY

SEQ ID NO: 127392 - protein, 232 aa, Glycine max
  Coding DNA Sequence Number=SeqID_35707
  Gene Ontology: Mol. function=chloramphenicol O-acetyltransferase activity; Biological process=response to antibiotic
  Homolog annotation: Hit_ID=P62577; Match level="QueryCoverage=82%, HitCoverage=87%, E-value=1e-111, Identity=100%"; Hit description =Chloramphenicol acetyltransferase
  Pfam annotation: Domain name=CAT; Domain location=6-198; Score=434.5; E_value=1.5e-127; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVVLLHVFPGWTQDDSYRIRRSGRTERGVRAYSPAWSELPTRN

SEQ ID NO: 127393 - protein, 177 aa, Glycine max
  Coding DNA Sequence Number=SeqID_35708
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=73%, E-value=1e-24, Identity=68%"; Hit description=LacZ protein
MDFRGQPFGPMPALCAVAEDVTKVHAVCVRCGELAQYSHRLVAGDNQVMLGEMQTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 127394 - protein, 71 aa, Glycine max
  Coding DNA Sequence Number=SeqID_35709
MGSSPVWLLSLSNFAEKMFTNEKENLKPEVASSNLGIGTNFCRNLVIKRVSFSLLRSIVIPVIFVPGKSLH

SEQ ID NO: 127395 - protein, 246 aa, Glycine max
  Coding DNA Sequence Number=SeqID_35710
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMALDYHQNKNSVGNSFVSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127396 - protein, 74 aa, Glycine max
  Coding DNA Sequence Number=SeqID_35711
MTPVNRKAGTGERTREPPGGNAGIFIVLSGFATTDLSVRFRDACQGGGAYGKTALPRPSHSLSSWLVLPSSMAC

SEQ ID NO: 127397 - protein, 61 aa, Glycine max
  Coding DNA Sequence Number=SeqID_35712
MSAEKYQSGLFNCRCRLWKCSIGVIRRCFFFKPGSSSFLADSRLACFSISIGESCFFPRWA

SEQ ID NO: 127398 - protein, 147 aa, Glycine max
  Coding DNA Sequence Number=SeqID_35713
MARTKKTGEMTTEAAKEIAEKIISHFQLTITIIFQYFVNAMYNCVFSVHDSFEEQATQGSFVPHGRQDVLTAAIGRPEHPGRVHVAGASVTIRHYFADPANQGPVRGVHHRKSDEAAHGIVQPDAVPDAISGTCTASRPSGGPSGPQ

SEQ ID NO: 127399 - protein, 96 aa, Glycine max
  Coding DNA Sequence Number=SeqID_35714
MTSRDKIWSFCTLVSSRGGGPDDTRRYLTVIRTLLSSRGGGPDDKQRQNLVILHPCVIQSGGPDDTRNTQVVIRITFFCYLNDKSWSPATLVNREE

SEQ ID NO: 127400 - protein, 202 aa, Glycine max
  Coding DNA Sequence Number=SeqID_35715
  Subcellular localization annotation: CTP_CleavageSite=43; ConfidenceScore=5.46e-01
SGRWNNVGKGSRQNGSVTSGKGLRLGLGNGVPRPSRLYGRTVRAAVPPGIESVVRAFLVRTGDRDEPEAGLTVLPTCVDSQPQNPGTDKGTLFNQARVNGGSNYDSRVKVAKCLVISVVTRMNGLTRFPLSCTIQRNHSQGNGLGGIAGKEDPVELDSRTGEARLIALCARTPKGNRPAHPGNGSAGGRVQRLESTARRVVS

SEQ ID NO: 127401 - protein, 90 aa, Glycine max
  Coding DNA Sequence Number=SeqID_35716
MAYTHIPVWHLLSMSGFTRNSPQISASPHQLDLAPYASEPYHAQWNAPGLLRDKHTLRSSRILGEMEVDEPWLGLWLPLNYHVDMGSSLA

SEQ ID NO: 127402 - protein, 134 aa, Glycine max
  Coding DNA Sequence Number=SeqID_35717
MDNEEGMQEQMKADLSALKDQMASISEVMLKLQKTIEDKATATASSTVREAEPVLQPALNPGLDRNTAVFGRRYSPQAYPYGLPPDFTPRATPEDLSQAPTFEGQLPPYETIPGKTMGKEIPIWPLLPSKIHPA

SEQ ID NO: 127403 - protein, 230 aa, Glycine max
  Coding DNA Sequence Number=SeqID_35718
  Gene Ontology: Mol. function=aspartic-type endopeptidase activity; Cellular component=small subunit processome; Biological process=DNA integration
  Homolog annotation: Hit_ID=A7PNB5; Match level="QueryCoverage=91%, HitCoverage=62%, E-value=1e-22, Identity=30%"; Hit description =Chromosome chr1 scaffold_22, whole genome shotgun sequence
MKVTALKQTSHDMIAHVGKALAAVEELRKFLVADSLEEVNRKLDKFYMVLILRSLHLNFDHVCDQVLAGDQVPSMDSLITRLLRVPHVSKDENPADSMETSAMVASRGRGGGCNSRRGRSGRGGCPHCTYYNRMGHTQENCYLLHGFPDKVTHVSRSEKAEFRFFDEEYQEYLKLKFEKPSNQAQSSSVPCFSTACISQSIEGPSPWIFDSGAFDHIYGTWDGAIDWRRT

SEQ ID NO: 127404 - protein, 39 aa, Glycine max
  Coding DNA Sequence Number=SeqID_35719
LVSSSEMGHAGWPLTDHNIIASRFPGHSNYSNLPYVESH

SEQ ID NO: 127405 - protein, 115 aa, Glycine max
  Coding DNA Sequence Number=SeqID_35720
MWKIPKREGKRVILGLFQTPGPTRKLRNEATSSFGRARLLQVEATTHLGELLFNLLPSFPINRREGVEGKKEKEKTRLRSFRIASVIDSYTVLRSFFVHRPISFYFEVLNSLYAP

SEQ ID NO: 127406 - protein, 110 aa, Glycine max
  Coding DNA Sequence Number=SeqID_35721
MKSGDMRGYRMVTRTFRQPGANEPVDAKRLTSSYTPFAIQGQRVRWQAEIPYGHPHLSSTEGNEFDGFTLVVRKHSSPMTCEILLYWARTIECNGVGKCHGCPTLSLSRH

SEQ ID NO: 127407 - protein, 99 aa, Glycine max
  Coding DNA Sequence Number=SeqID_35722
MLVATPRILPPLGSAPMSLALARPRRARCDSWRLHSGLILFYQVKVKGLDVTSLKELERLMGPLQRQAFRKVYGKILDLTVAEVFTEAVVSLAQYYDQP

SEQ ID NO: 127408 - protein, 52 aa, Glycine max
  Coding DNA Sequence Number=SeqID_35723
  Homolog annotation: Hit_ID=A7R8W3; Match level="QueryCoverage=59%, HitCoverage=39%, E-value=3e-07, Identity=83%"; Hit description =Chromosome undetermined scaffold_3027, whole genome shotgun sequence
MDLIFFIFLLLTTVIKAFDSLVVLELQEDGKLTTSDDPPVVFGCLDGSFIQQ

SEQ ID NO: 127409 - protein, 130 aa, Glycine max
  Coding DNA Sequence Number=SeqID_35724
MLKMGDSAKVVIKQDMKGIRHKYGFNNNEREKAQKKRVVDDETADKHQLDEDWPYDYLKGINNIAIKGLDDAQQPKSKASARSIALKLQKKEELSAANFQTQTAIAQTSEWTVARGIHRYQNSPLAYMFQ

SEQ ID NO: 127410 - protein, 56 aa, Glycine max
  Coding DNA Sequence Number=SeqID_35725
MSLKLPSLLRELHVLALRGLRVLTIRGLHALTIRGLHVLALRGLHALILGTSYPHR

SEQ ID NO: 127411 - protein, 42 aa, Glycine max
  Coding DNA Sequence Number=SeqID_35726
MLVATPRTFPPLESAPVAWKTPFNGNGPKEACLKEIQERQSG

SEQ ID NO: 127412 - protein, 100 aa, Glycine max
  Coding DNA Sequence Number=SeqID_35727
MAQERTWMSCVLLEQVRNQPNTEGGYFCGRPAMPFRVCFMRSKPLAESLTTVAILLKEGRHPEERYGFLPPRGHPRISSNSSMVGTNWKSPNVKHLKGWS

SEQ ID NO: 127413 - protein, 145 aa, Glycine max
  Coding DNA Sequence Number=SeqID_35728
MYPLLELIHKRCTLSCSQSTTQVDVPSTCTTKDVPSNVLRQSSQAVKPLKLCEWGYKRILRREKGGTKEFRWLVLCSFGKGRRETQKEFRRLVLGESFLAKEEEMKRMNSTSFQGLENQKTLESFWQKEEEETQKSIGKSLLSKE

SEQ ID NO: 127414 - protein, 142 aa, Glycine max
  Coding DNA Sequence Number=SeqID_35729
MIMRGQDIYSSQEETTSSSSSCGNEDEVRGEESTEEAYPHEEGGLLMHKISFQVEPLYHFPTPKPYKLQWLNEQGEMIVNQQVKVAKDQLTMKDKRDEEEKLEKQKKKKGSKALSSKAKGKEKEEKDSSKKIVKKENHFATK

SEQ ID NO: 127415 - protein, 251 aa, Glycine max
  Coding DNA Sequence Number=SeqID_35730
  Homolog annotation: Hit_ID=Q84VH5; Match level="QueryCoverage=100%, HitCoverage=52%, E-value=2e-77, Identity=66%"; Hit description =Envelope-like protein
MDKKIRSIVSSILKNASVPDADEDVPTSSTPNVSVPDVDKDVPTSSAPNAEALSSPSEEESTEEEDQATEKTPAPRAPEPAPGDLIDLEEVESDEEPIANRLAVERELGRDALACKEIMDLIKAAGLLKTVTKLGDCYESLVREFIVNIPSDITNRKSDDYQKVFVRGKCVRFSPAVINKYLGRPTEGVVDIDVSEHQIAKEITAKRVQHWPKKGKLSAGKLSVKYAILHRIGAANWVPTNHTSTVATRFG

SEQ ID NO: 127416 - protein, 259 aa, Glycine max
  Coding DNA Sequence Number=SeqID_35731
MARAGDNGGVYHQLDESQRLFLDAWTTQMQRLLNRNKEEPYRRIVKSSSFTLKPLSPREVCDDQIRMGEKREQEKENSEAPQRNMKKKSDTPEEKSDTHKRESDTHERKFNYFAKASEVRKVLPVHEPLNLQYCKDSKISTDNSNEFTISISPSATYKSNPQETQRKDAHDKVEYVKRLYDQVKVQIAKKNESYVKQAHKKRKEVVLEPGDDPEHLRTNIFQEGGNDENHETGQIQAKGPSGEGRRPKWRRTKPPSGEG

SEQ ID NO: 127417 - protein, 230 aa, Glycine max
  Coding DNA Sequence Number=SeqID_35732
  Gene Ontology: Mol. function=chloramphenicol O-acetyltransferase activity; Biological process=response to antibiotic
  Homolog annotation: Hit_ID=P62577; Match level="QueryCoverage=73%, HitCoverage=77%, E-value=1e-98, Identity=100%"; Hit description =Chloramphenicol acetyltransferase
  Pfam annotation: Domain name=CAT; Domain location=6-178; Score=342.1; E_value=9.5e-100; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPFSPWANIIRKATVLMRCDSVVLLHVFPGWTQDDSYRIRRSGRTERGVRAYSPAWSELPTRN

SEQ ID NO: 127418 - protein, 126 aa, Glycine max
  Coding DNA Sequence Number=SeqID_35733
MSTTGRGEALGPPDFQGPPGAHRHHATCGALPAAGPYLRLSVSRICTDDRSARARALGFAATAAPSYSSGLGPCPDGRVSAQLGTVTQLPVHPASPVLLTKNGPLGALDSMARLNRAAAPSYLFKV

SEQ ID NO: 127419 - protein, 115 aa, Glycine max
  Coding DNA Sequence Number=SeqID_35734
MMIGGGITWMLWKLGRIDGDPTLRGTRIRATWEYVSSIGGGQQGMETLGMSGGVLLPKTKLDQSRPNPGIGTKTTKQGGLCGGWPAVNFECYMGYGLWSVIDYQLKTSQKARGLL

SEQ ID NO: 127420 - protein, 62 aa, Glycine max
  Coding DNA Sequence Number=SeqID_35735
MAFVDNWAVGKEKVGYWQSNDIVGLVGNLAVLGSNGLEEGSKLSVPKYMAYTQSVREGISKH

SEQ ID NO: 127421 - protein, 31 aa, Glycine max
  Coding DNA Sequence Number=SeqID_35736
MNPKRITVIPEWSTPPRVGRKESMSFKNPWI

SEQ ID NO: 127422 - protein, 89 aa, Glycine max
  Coding DNA Sequence Number=SeqID_35737
VIGMFLLHGSMLAHATCDMHPVHGHLSLRGLDPFHPGLFVGDAGGFQSPTREPLNVGGLVPPHCSLKSVVSDDACPGACFVQRDATTLS

SEQ ID NO: 127423 - protein, 278 aa, Glycine max
  Coding DNA Sequence Number=SeqID_35738
  Homolog annotation: Hit_ID=Q6WAY6; Match level="QueryCoverage=84%, HitCoverage=43%, E-value=1e-13, Identity=26%"; Hit description =Putative uncharacterized protein
DWDQHLAEIGGSTINWFPRWKEGKEGVLFSCGDYPNVPLIGTSGCINYNPVLAIRQLGYPMRGAPTEGSLSPFLVKDLGAQGLKVIQRIHKAWRSPLKKDKELRGIRNGVIGGYHGMAKNSCARLGKARLAKEKFKSAASHIQKEYTELQEENAALQKPLNKKQKGRRRNMARKIPRSIEELVACARSKRSLAQHLEATEQSMLAIIGQYKEELNQSVAHEQKLVEDFAQVYTEKEARGRVIDALHQEATMWMDRFALTLNGSQDLPRLLAKEKAMAE

SEQ ID NO: 127424 - protein, 47 aa, Glycine max
  Coding DNA Sequence Number=SeqID_35739
MWTTTGEKLAAQLAQVSKVASSRSNSLLEESSGGPKWAWLLFTPPVY

SEQ ID NO: 127425 - protein, 140 aa, Glycine max
  Coding DNA Sequence Number=SeqID_35740
MGSFGEEGWQWEFLWRRNLFDNELGSASDFIEQVTALSPNAALKDYWVWGADPKRIFTTSTTYLCIKGHQHNLHQSPSPSTSPNKNDMEVKDDDYQDLAKELGVFFTDDKSSGTKLKTDMDNTENSPKSATVLGNEDNAS

SEQ ID NO: 127426 - protein, 134 aa, Glycine max
  Coding DNA Sequence Number=SeqID_35741
MEAMKEQMAAMMEAMMSMKKIMEANAVAIAATSVVAKVNLMSPSGINQMNHPTSDMVGKDLGSTDDPMMCKFKTSMPSRRMVCLSTIRHPMWRTLPIRMSITPLLYPLRANNPKLIMHMSPKPWGRHMKFPITI

SEQ ID NO: 127427 - protein, 179 aa, Glycine max
  Coding DNA Sequence Number=SeqID_35742
MGAKHLTRTKERSHVIKQRSPDEIREQKVQKTMSVSACYQAFCLTDSKRMFIRITTPGISARQHDSKVSMTDLVSAEDDVNLCVSTGLSAAIDEGCRMTTLAAACHRARRLWMTKGVRITVRCLRVSSGPPPLDDTRVRITVRCLRVSSGPPPLDDKRVRITVRCLRVSSGPPPLDDTR

SEQ ID NO: 127428 - protein, 312 aa, Glycine max
  Coding DNA Sequence Number=SeqID_35743
MGCYSEWIKFNVRLFVRKHLEEKEEALANQGEWAAFIDVLVLLVFGMVLFLNVDGLVDLAAIDAFLAYHHSKESPVIAVLVDAYDTFDLRCEKSSARIICCTPALYVWLVSPIVYHEGYPLRGAPSKEIIAPFIARGFNESNAKILQKIHKAWNRVERKDKELRGSSNGVIVELEKTRVVKDKLKVAITRVKKECDKLKDINMTMVEMLEDKQAKVSALQIEREASEGVIELLHREALKWTDRFTLTLNESQELPRLLAIVKEVADTYSAPNEANMEAMKDQITTMMEAMMSMRKMMEVNAATTTAISVATE

SEQ ID NO: 127429 - protein, 183 aa, Glycine max
  Coding DNA Sequence Number=SeqID_35744
  Gene Ontology: Cellular component=chloroplast
  Homolog annotation: Hit_ID=Q7Y618; Match level="QueryCoverage=33%, HitCoverage=82%, E-value=2e-20, Identity=83%"; Hit description =Putative uncharacterized protein
MTSKELNEEPYEVKISCTKHVKCVANPNNESFVRELEQATMRQKIFFLKKFDSELRYVQGPIWKEFQRFSLTLSVSTNNSKCLDFFRIGPSQIAMIRSTLHYFGNPRTQSYGYVKYRISNPSRKRGGTDTQFQVSKQNSILDIIDTYRILWKAVFDESRMYGLEGDLSYLSRSTLQYGAKKPK

SEQ ID NO: 127430 - protein, 170 aa, Glycine max
  Coding DNA Sequence Number=SeqID_35745
  Subcellular localization annotation: CTP_CleavageSite=35; ConfidenceScore=5.10e-01
MPNSNAAGSNSDRRFTSWPASALVGLGASAQIYLRCSAGGRRISKKDVPVLRAFRGKKLIVIERRPSLTAACHAQLIAAGAIIAGPATSLEQVLNLLEAGAADGAIIDVEVDAEMMLHLGLLLESMATPFVFASFTKVNPDGYALIGDTKHLRKIADALFGPPGTSSTLH

SEQ ID NO: 127431 - protein, 96 aa, Glycine max
  Coding DNA Sequence Number=SeqID_35746
MALCSVFLNLHLLLFVCLTIEALGVAPPSVASYLTQEILEQEADRVHGLPAQPPMKFKNMVVISLSMKLKAQHCSIGFSRPLANQNKKPFSYGPME

SEQ ID NO: 127432 - protein, 201 aa, Glycine max
  Coding DNA Sequence Number=SeqID_35747
MAQSNTSRLGFPALITTLCRLRGVGSDALISYENLRSVIDLTYIIRNCWNANDQTVNFPEERKTKLRATDTSDAKLQSLFEGQILIMQSLQELAQQRPIMSEDQFIKKVAPQQHELEPENDHSSEAIIPGVVDFSKIKLETRSNEVAHPGPVPVPADVPFPGGQTIPILALDTSPPTTPVLHLTDKEDVQAQDIQDQSHEF

SEQ ID NO: 127433 - protein, 147 aa, Glycine max
  Coding DNA Sequence Number=SeqID_35748
MGQINRQEVLPSQGKSLDTTSIKELGRFMEPLQMQAFRKTYGKILELTIAEKTIPFLRVSPLFEQNCNCGQGFSKRYLEDKARGMANQGDWVPFMDVLALLIFGVVLFPNVDGLVDLAAIDTFLAYHHSKESPVVAVLADLFDTFDR

SEQ ID NO: 127434 - protein, 130 aa, Glycine max
  Coding DNA Sequence Number=SeqID_35749
  Homolog annotation: Hit_ID=A4DID9; Match level="QueryCoverage=28%, HitCoverage=33%, E-value=3e-08, Identity=78%"; Hit description =Putative uncharacterized protein
HVWGLTPAQCRKVKEVGDLMTGEPTTEAPVNGGRNYNGPKGKEGLLLGGPEPSVRYHSGRARILTLCQDLRAEGQSQAEGSLTARPTRRAGTKVGLSDPTVPSGRAVAQRIKSYSRDNQADLPQELTSTG

SEQ ID NO: 127435 - protein, 132 aa, Glycine max
  Coding DNA Sequence Number=SeqID_35750
  Pfam annotation: Domain name=G-patch; Domain location=1-42; Score =30.5; E_value=6.2e-06; Accession=PF01585.14; Description=G-patch domain
MVARVMLGNGYEPGMGLGKDNDDITSLISTKGNRGKFGLGYKPTHADIRKSIAGRRSGSQGSRLRQEDEGSPPCHISRSFISAGLVDEGQVIAICEDAAPSGSNLVQPCPPDFRLGNWLVEERPDIYATSIM

SEQ ID NO: 127436 - protein, 186 aa, Glycine max
  Coding DNA Sequence Number=SeqID_35751
SQQFSARNDAIVIRGVPEVATNPSASSETKKLEGKLDALVNLVTQLALNQKYVPVARVCGLCSSVDHHTDLCPSMQQPRAIEQPEAYAANIYNRPPQPQQQNQPQWSSPQQQQQQPAPSFQNAAGPSRPYIPPPIQQQQQPQKQPTVEAPPQPFPRRTCEANDYADMQFQQETRASIQSLTIRWDN

SEQ ID NO: 127437 - protein, 229 aa, Glycine max
  Coding DNA Sequence Number=SeqID_35752
  Homolog annotation: Hit_ID=A9CGB8; Match level="QueryCoverage=95%, HitCoverage=70%, E-value=1e-67, Identity=56%"; Hit description=ABC transporter, substrate binding protein
MAGREDATFDPARPETIKGQKVGITAPGSSSDFFVRHFLAQHDIPADSISLIGVGSGAAAVAALEQGKIDLLVNYDPAATLITERKVGRIILDARSDDGARQVYGGLYPTSVMYANQSFLDKRPEAAEKIARAEQMALKFIADNSAEDIVAALPDSYVSGDRATYARAVENARAIFTRDGHFTPADLETPLKVLREFNTDVAKADIDLSRTYTNAFVERANAAAPAAQP

SEQ ID NO: 127438 - protein, 43 aa, Glycine max
  Coding DNA Sequence Number=SeqID_35753
MAEPGKKRKGSSRRSQRHSETQETPIPSSISSSSLFSSEEHRI

SEQ ID NO: 127439 - protein, 266 aa, Glycine max
  Coding DNA Sequence Number=SeqID_35754
  Gene Ontology: Mol. function=transporter activity; Cellular component= membrane; Biological process=transport
  Homolog annotation: Hit_ID=A2Z3V2; Match level="QueryCoverage=98%, HitCoverage=19%, E-value=1e-113, Identity=76%"; Hit description =Putative uncharacterized protein
MDWSLRSRYILTDDNGARNAESLYTYAEHVFVPQRLTMQVGEVNAMSDVLSGVPITGVQFMPTSGLQKESSGVSVSGIARTSQARVEVRQNGRLIFNTLVPAGPFTLDDVPMVRNNVDLDVTVVESDGSTNHYIVPAASVKAQNLSRPTGLTVSAGQVRDIDSHYSDPLVFNVSDGWRIFPWMNLLASGVVAEEYQAAGARTEFMVTDSWSLSTIMAASKAQFGDSDSGIKNELQSDYSLTENVGLSGSVAHYSGDYRELAPRHGR

SEQ ID NO: 127440 - protein, 116 aa, Glycine max
  Coding DNA Sequence Number=SeqID_35755
MLVHMIRTRLFAAARVKSCPGMHSSCVIASLSGCARTVGPPPISGVAQEPLKGNYWPLNRKGKSRTLKMRTRSPLKVRACSPLKARRCSPLEVRACSPLLARTCSPFKARTCSHLK

SEQ ID NO: 127441 - protein, 240 aa, Glycine max
  Coding DNA Sequence Number=SeqID_35756
  Gene Ontology: Mol. function=aspartic-type endopeptidase activity; Biological process=proteolysis
  Homolog annotation: Hit_ID=A5CBG1; Match level="QueryCoverage=43%, HitCoverage=6%, E-value=7e-23, Identity=46%"; Hit description =Putative uncharacterized protein
MEQANYTDKYLQVLGESISKEKVFTKTKDHGSSSSAVQMEKPLFKPFKVSEKAKHKFRELRKQRFPTEEIGDSHSELLSKINSLLKTIPKTSQPSKESSKIRTRHTSKLINAINKDSDNNSEQVSEEGSVSEKVINLINTKHWKTPFKLYYQRPTVPDLLLEEKGKSNFKSFRANNIYEWNIDVHTKYNIMNTLQHMIMVATTYQASHECPEETIVYILVAGFSGQLKGWWDNYITNEEK

SEQ ID NO: 127442 - protein, 139 aa, Glycine max
  Coding DNA Sequence Number=SeqID_35757
VPPVQLLTGWCVTAKAPPDISAGKCSGHAARRVPFAIQAAQLLGRAIGAGLFAITPAGKRGMCCKAIKLGNARVFPVTTLANWSSTAVAAALELVDPPGCRNSILARPGEEQPGEEGRGGRERRKIWDELHWAQRLGRG

SEQ ID NO: 127443 - protein, 123 aa, Glycine max
  Coding DNA Sequence Number=SeqID_35758
  Gene Ontology: Mol. function=protein dimerization activity; Biological process=DNA integration
  Homolog annotation: Hit_ID=A3B774; Match level="QueryCoverage=93%, HitCoverage=33%, E-value=3e-09, Identity=29%"; Hit description =Putative uncharacterized protein
MELTRERSKCFKRFFLDVDVRRKVNIEFANFSDGRKGFDDLDSLNDRGQMDPKAWWLDHDANAPILQKQPTTSLKEYSTISSRGNLWDVAGNDFESLDDCGILEIASLSLDEPELDDVFFNDD

SEQ ID NO: 127444 - protein, 190 aa, Glycine max
  Coding DNA Sequence Number=SeqID_35759
MPSSFADLVFSRERIEVGLKRGKFDYVSSTSTNARRIGATGEKRKERDTHAITLAPAWVKPPQASHARVGDSSNSAPIQPRAPAPIQREAPQAPAPTTTRPADNAHFGTGSNTMRNFTARPTPEFTPIPMTYEDLLPSLIANQMAVISLGKIYQPPFPKWYNPNATCAYLGKTPGTPPKNAWPLNTRSNI

SEQ ID NO: 127445 - protein, 165 aa, Glycine max
  Coding DNA Sequence Number=SeqID_35760
MDNKEGMQEQMKADLSALKDQMASITEAMLKLQKTIEDNATAATSNTAREAEPVLQPAINLGRDRNPMGFNQRYSPRAYPYGLPPDFTPRTAPDDLSQAPTFEGQLPPHANYPLQEDDEGDAHLGPLLPLKEPAPTLHNMNIYSMKCLTKCWMGNGSKKAFRKEI

SEQ ID NO: 127446 - protein, 110 aa, Glycine max
  Coding DNA Sequence Number=SeqID_35761
MGFDLNWEVDLSPYILATAIESLHYHGARSQVRCVKRQLIQSSLRHDIEGRAIVDEHFGHYVVQTFDRHMQGSVVSLALDVMLLTIPPKPSTDMSCATWASFKILTNNAL

SEQ ID NO: 127447 - protein, 129 aa, Glycine max
  Coding DNA Sequence Number=SeqID_35762
IWGLRRRVKGCEYATAAGYAAQPRDIGYFGRQRADVGSSFLLIAQRRVPPQNCVTIFVWKRNRLSRTFLICGLDAYMLFFIPLIADFLSALGYHMLQQVALGLYHLEKGGSKIFPGDITTIWLAMRDGK

SEQ ID NO: 127448 - protein, 190 aa, Glycine max
  Coding DNA Sequence Number=SeqID_35763
  Homolog annotation: Hit_ID=Q6WAY6; Match level="QueryCoverage=46%, HitCoverage=15%, E-value=2e-09, Identity=39%"; Hit description =Putative uncharacterized protein
CGRGFGKRVGSCKANSKRRSGPTAEVLGRQGKGYGESRGVGPVCGRIYFALSKRGRGDYPNVPLIGTRGCINYNPTLAIRQLGYPMRGAPTEESLLPFLVRGFGAQSFKIVQIVHKAWESPLRKDKELRGIRNGIIGGYHEWLKVHTRGLDWLSKLKIINEENFEAPEEDEEVRALKTELGKARLAKEKF

SEQ ID NO: 127449 - protein, 262 aa, Glycine max
  Coding DNA Sequence Number=SeqID_35764
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDSLGWSLTTPNLPSVTMVLVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127450 - protein, 66 aa, Glycine max
  Coding DNA Sequence Number=SeqID_35765
MFKMIKIESRTLQGSRGNLISRIKNQDSRFKFPRIKIQGSRFKTQDSKIKRRLNQDKYEKVFSKTE

SEQ ID NO: 127451 - protein, 77 aa, Glycine max
  Coding DNA Sequence Number=SeqID_35766
MVLTFGTRVMPLGVGWLEDPFGREVIFREWALCIIIARAGGRIVDWSGHGWSCALGRRSLCRGRPFYLSREGTPGSD

SEQ ID NO: 127452 - protein, 48 aa, Glycine max
  Coding DNA Sequence Number=SeqID_35767
MRLFRNLARKTLTSPGKVQSQLEDADISGKGAGYDVSHCTLSGFEAYE

SEQ ID NO: 127453 - protein, 92 aa, Glycine max
  Coding DNA Sequence Number=SeqID_35768
  Homolog annotation: Hit_ID=A2Y1D2; Match level="QueryCoverage=78%, HitCoverage=13%, E-value=2e-08, Identity=43%"; Hit description =Putative uncharacterized protein
MVAHIPDPRVDPSQYRDLVHYWCSEKGQKISNINKRSCSKYEDLHCMGTNNLPRRIHEMTTKAKGVQPSRAEIYIDTRTRKDGSIVPEKAAI

SEQ ID NO: 127454 - protein, 392 aa, Glycine max
  Coding DNA Sequence Number=SeqID_35769
  Homolog annotation: Hit_ID=Q2HW90; Match level="QueryCoverage=85%, HitCoverage=65%, E-value=6e-37, Identity=34%"; Hit description =Putative uncharacterized protein
MGPLQRQAFRKVYGKILDLTAVEVCTEAVVSLAQYYDQSLRCFTFGDFQMVRTIEEFEEILGCPLGGRKPYLFSGFLPSLSKIAVVVGGSTKELDRMKQTRNGVVGLPRKYLEGKARDMASQEKWGPFEDILALLIFGVVLFPNVDGLVDLAAIDAFLAYHHSKESPVVAILADLFDTFDRRCEKNSARIVCCLPALCVWSISHLFQQDTRPPVSASKLSLMRRKRKSRLGPTFGGDRGQRNQLVCWVGRKARKEFFSRVGTTLMFPLIGTRGCINYNPALAIRQLGYPMRGAPTEGSLSPFLVKDLGTQGLKVIQRIHKAWRSPLRKDKELRGIRNGVIGGYHGWLRIHTRGLDWLSKLKVIDEENFEAPEEDEEVRALKLELGKARLAKE

SEQ ID NO: 127455 - protein, 102 aa, Glycine max
  Coding DNA Sequence Number=SeqID_35770
MTAEWRRKKDDWRRHFKEKMSQEEAHHYSVATYPSAGGRRETHRCVFQERKMRGVATNVYSRKTSEKPEKTWSRNFKCERFGSCIYVRGRVFPLLLRIPQLW

SEQ ID NO: 127456 - protein, 174 aa, Glycine max
  Coding DNA Sequence Number=SeqID_35771
MASRKPKSIGSRPTTQYDTRRFSSLDAWNRSEGPSPKQSRVRGHLVKIDADSLNIFLETPVVLAEGETLPTYSRYCRLPIDYREIEAALCIPGQGYILNTEGHPGKILRKDLTTLAQVWSVLSYSNLAPTSHTSDLIVDKARLIFGLVSRMDMNIGALISGQMTSIAQSNTSRL

SEQ ID NO: 127457 - protein, 128 aa, Glycine max
  Coding DNA Sequence Number=SeqID_35772
MASSGTPAILTVLHISMNVSKCAYGSSLACTSGRAMLVKNCGTELLKDSLDDGKSGDNKSEKRVSSSRMDATVLSCRSFLLLSALFLCNVASISKSKGTKLPMGDLCNKKRQIGIKNKYSQKQSKNNK

SEQ ID NO: 127458 - protein, 108 aa, Glycine max
  Coding DNA Sequence Number=SeqID_35773
MESKRVGKKETNTQEFLYWFDNNPCLHPVPKRPVVLEISFNLWMYPPLELIHKRCTLSCSQSTTQVDVSSTCTTKDVPSNVLRQRSQAVKPLILCEWGYKRILKRLVL

SEQ ID NO: 127459 - protein, 212 aa, Glycine max
  Coding DNA Sequence Number=SeqID_35774
MLEIFQQQNQMLVLELYIEKDVAGGSMFHFANSLTSCGNNLSNNEAQLPRNVSNLHGDEDYDDDDDDDDYLVSNSYVEESLNEDDSVDGISDTDDEVTDMIQPVIIVHPAEGVQGIQNPFCNDALHYNNINWSHPDEEDICGLEMPSSFNVGQELYVDMDFDSKDAVKNAVKLYVMKVHQSFKVVESKLNKYVVCCLNKSTECPCLFYMRAI

SEQ ID NO: 127460 - protein, 83 aa, Glycine max
  Coding DNA Sequence Number=SeqID_35775
MPQHNSSHTHYMQVKGVTQGFSSLVIDYQRPNSNHTASGHEKLKKALLVIDYQRPPQPAAFISKPGNRLDPLGNRLPKALIAS

SEQ ID NO: 127461 - protein, 150 aa, Glycine max
  Coding DNA Sequence Number=SeqID_35776
MTIRGLGLNGPDDIYSPHGERPRGGHDIQRMWWSIDIICERLAFDLPGHSMPVGVRSKRALMDFLDHVICLPGIHTPQECHVVISLIQYASAHEETGCQPSQCPLIIVGNLWRVFFAYDISLDVEIPRLSVPFLFYLATMRGLPRHQNSM

SEQ ID NO: 127462 - protein, 94 aa, Glycine max
  Coding DNA Sequence Number=SeqID_35777
MSSSFADLVFVGERIEVGVEKRGSSITFPPQVPMLKESEQLGQKGRRGDAHAVTSAPAWVKPPQTSHGYTSVRATSSELLSSRRELLQFSTRTA

SEQ ID NO: 127463 - protein, 155 aa, Glycine max
  Coding DNA Sequence Number=SeqID_35778
MGDQEETQEQMKADMSALKEQMASMMEAMLGMRQLMEKNVATVATVSSATEADPTLLAIVHHPPPNAVGRGRSTLGHNNNPHLGYNQVAYPYGLPPNYTPPVMQDDAGRVSSPILEGEPSQQPDEVHKDHHEYAQGDVEFYPPIPVEGPAPNTVP

SEQ ID NO: 127464 - protein, 183 aa, Glycine max
  Coding DNA Sequence Number=SeqID_35779
  Homolog annotation: Hit_ID=Q6WAY6; Match level="QueryCoverage=91%, HitCoverage=27%, E-value=7e-19, Identity=36%"; Hit description =Putative uncharacterized protein
MFDRRCEKSSTRIVCCTPALYVWLVLHLFLQKSRPTCPLQGHRLCAKKGKANWEQLLASVAGASINWFPYWKEGRAGVLFSCEGFPNVPLMGTRGCINYNPALALRQLGYPMRGAPLEGSITHFIAWGFSDPNVRVLRGVCKAWDAVQGKDKELRGSRNEVIGSYHKWLKVQTQELDLLPKPK

SEQ ID NO: 127465 - protein, 165 aa, Glycine max
  Coding DNA Sequence Number=SeqID_35780
MGVAVDQHDVMALARQEVRGGPAPITRPHGPASWPRPSGAGVTAGLRRPAPQSARPSGGAVQLDDGGGGRIAHQVGQGIAVERLVERLQGLRQHPRQAAGAVQRTGRFAAVDQRPLLLQFTHQVAQAVISGRARQRQPAALAARRADPAALRHEVHHLDQVVARQ

SEQ ID NO: 127466 - protein, 16 aa, Glycine max
  Coding DNA Sequence Number=SeqID_35781
MGVVFIIGSAVDRLCG

SEQ ID NO: 127467 - protein, 165 aa, Glycine max
  Coding DNA Sequence Number=SeqID_35782
KILPERNVMIYHTKFDEFKADLERRNWHKELTNFLDGSIDVAIVKEFYANLYDPEGKSPKQVRVRGHLIKFDEDALNTFLKTPVIIEEGEDLPAYSRFCRLRPDPQELANRLFIPRRGFELNADGLPLKILRKNLTTLAQTWSVLSFSNLAPTSHTLASHWTGPG

SEQ ID NO: 127468 - protein, 71 aa, Glycine max
  Coding DNA Sequence Number=SeqID_35783
MVRTGKAAACSGKQLSGGVSYAQLLAPQATLAYVPAPEQETAMTRYARAQKPSYTKGNQKLAPPEVDGLLA

SEQ ID NO: 127469 - protein, 92 aa, Glycine max
  Coding DNA Sequence Number=SeqID_35784
SCHRQKGGDCRSKLHDESRLIQRSFDDNKGDDKKLKESKNEFKIESRTLQGSKGNLISRIKNQVSRFKFQESRSRFKTQDSRIKRRLNQDKY

SEQ ID NO: 127470 - protein, 222 aa, Glycine max
  Coding DNA Sequence Number=SeqID_35785
  Homolog annotation: Hit_ID=A0ST23; Match level="QueryCoverage=11%, HitCoverage=51%, E-value=7e-07, Identity=100%"; Hit description =Putative reverse transcriptase
  Subcellular localization annotation: CTP_CleavageSite=42; ConfidenceScore=5.16e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLNSIQTLVINCMDTAEEIVTPGAAASAFKNPSMLADQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 127471 - protein, 97 aa, Glycine max
  Coding DNA Sequence Number=SeqID_35786
MSGFTRNSPQISASPYQLDFTLYASGSYNAQWNAPGLLHDKHTLRSSRILRKMEVEEPWLGLWLPLNYQVDMGASQHMTTEFGVVFVIGSAVDRLCG

SEQ ID NO: 127472 - protein, 265 aa, Glycine max
  Coding DNA Sequence Number=SeqID_35787
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPNLGYEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127473 - protein, 22 aa, Glycine max
  Coding DNA Sequence Number=SeqID_35788
MNGKLPGSYIINRTSKRVKLRP

SEQ ID NO: 127474 - protein, 191 aa, Glycine max
  Coding DNA Sequence Number=SeqID_35789
  Homolog annotation: Hit_ID=Q6UUU1; Match level="QueryCoverage=31%, HitCoverage=40%, E-value=2e-18, Identity=78%"; Hit description =Putative uncharacterized protein
  Subcellular localization annotation: CTP_CleavageSite=42; ConfidenceScore=5.14e-01
WNSYVPINVSFSPKVGPGLPAVPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 127475 - protein, 263 aa, Glycine max
  Coding DNA Sequence Number=SeqID_35790
  Homolog annotation: Hit_ID=Q84VH5; Match level="QueryCoverage=100%, HitCoverage=35%, E-value=1e-93, Identity=72%"; Hit description =Envelope-like protein
  Subcellular localization annotation: CTP_CleavageSite=21; ConfidenceScore=5.40e-01
MATSPKETSAPGSPSVPSSPSSTKAPSNQERPEFNIQPIQMIPGSAPVTEKLVPKRQQGMKTSENPSLATSPREVDTKMDKKIRSIVSNILKNASVPDADEDVPTSSTPNVSVPEVDKDVPTSSTPNVSVPDADKDVPTSSTPNAEALPSPSEEESTEEEDQASEKTPAPRAPEPAPGNLIDLEEVESDEEPIANKLAPGIAERLQSRKGKTPITRSGRIKTMAQKKSTPITPTTSRWSKVAIPSKKRKEISSSDSDYDVELD

SEQ ID NO: 127476 - protein, 105 aa, Glycine max
  Coding DNA Sequence Number=SeqID_35791
  Pfam annotation: Domain name=zf-CCHC; Domain location=51-65; Score =16.3; E_value=0.0053; Accession=PF00098.14; Description=Zinc knuckle
MPRRCGILSNLHMKAPLMKFQKFVKKRRIERSQNFNNGRRSQEDSQVLRFYKCNQLGHIKANCPSNEEWPEKSDKKRYDERRTKKRALHGMTMTHSTVPRRRSTF

SEQ ID NO: 127477 - protein, 211 aa, Glycine max
  Coding DNA Sequence Number=SeqID_35792
MKDKRDEEEKLEKQKKKKDSKALCSKAKGKEKEEKDSSKKIVNKENHFATKCDIKIVLLLKQSFDLLLSRETSLSTAIPLELEVIPQVKELLDEGLVRKSLNPRALLVPKIGIIRHQIPMIGGIMNALSGATLFCKITHAPNIFKICVHRDSLGSDQGLPMDPKRIKAIPKWPTPPSVEERIHEFQEPLDLRSNPFQGGGNDAILPPKGIG

SEQ ID NO: 127478 - protein, 250 aa, Glycine max
  Coding DNA Sequence Number=SeqID_35793
MANQEEWVSFADILALLIFGVVLFPNVDSLVDLAAIDAFLAYHHSKESPMVAILADLFDTFDQRCEMNSAQIVCCLPALCVRLGRGGCINYNPALAIRQLGYPMRGAPTEESLSPFLVRDFGTQSLKIIQRVHKAWRSSLRKDKELRGIRNGVIGGYHGWLRVHTRGLDWLSKLKAINEEKFEASEEDEEVQALKLELGRTRLAKEKFKSAATNIRKECTELQEENAATARALEQETKRARKEEHDRDKF

SEQ ID NO: 127479 - protein, 41 aa, Glycine max
  Coding DNA Sequence Number=SeqID_35794
MAMHPKKLLAKRARKVTAGEGFSAVPQAEIEFDGHRFRSEE

SEQ ID NO: 127480 - protein, 119 aa, Glycine max
  Coding DNA Sequence Number=SeqID_35795
MCQRARWPRLTKGVEDDVSLCMLSCFESYGYQKNVYTDNHLGISACPLTSRSRPEDIDISGKGAGDDRVNECVRVTVGCLYMPPDSWVTVTKGGVVDKSRAFAPTYPQFVMRNSDLRSS

SEQ ID NO: 127481 - protein, 48 aa, Glycine max
  Coding DNA Sequence Number=SeqID_35796
MERCALRLRKWLPFAIWSKNGVQRLELCWSFNGEEEERKKQRMPHVSF

SEQ ID NO: 127482 - protein, 167 aa, Glycine max
  Coding DNA Sequence Number=SeqID_35797
  Homolog annotation: Hit_ID=Q6WAY6; Match level="QueryCoverage=97%, HitCoverage=25%, E-value=7e-11, Identity=26%"; Hit description =Putative uncharacterized protein
MARVSKVVKISLQELDRVKQNRNGVVGIPRKRLEEKAKALADQGEWTSFVDVLALIVFGIILFPNVDGLVDLALINAFLAYHHNKESPIVAVLANAYDIFNLRCEKSSARIVCCTPALYVWLVSHIFHHKSRPVCPLQGHRMCVEKGKAKWEELLARMVGASVNWFP

SEQ ID NO: 127483 - protein, 43 aa, Glycine max
  Coding DNA Sequence Number=SeqID_35798
MATPMSTACYLDKDETGQSIDVKQYRDFNQIPNNHILVPLKES

SEQ ID NO: 127484 - protein, 94 aa, Glycine max
  Coding DNA Sequence Number=SeqID_35799
MVEDSSIESFIKLTFATSSSLEELEDVDALSSQAIKLFSKVDRTFIFDVTLLPTCEACEGLENFLYLDLLRNFQNFFTIELKFSSSSSSLELSL

SEQ ID NO: 127485 - protein, 142 aa, Glycine max
  Coding DNA Sequence Number=SeqID_35800
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=73%, E-value=5e-25, Identity=67%"; Hit description=LacZ protein
MENGYDFLREGMHYIVLTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 127486 - protein, 134 aa, Glycine max
  Coding DNA Sequence Number=SeqID_35801
MTDCGVPDSITGDVPTCFPVLTSKVHMKGITGALYRARCDALTVTDVSWLPYTEHRGVRAFELISSFQDDRWMHFVDNVLAVDELCLVPGQVSADYMEWFFWISHPFMIPTQAGDQPRDAPAADPEEYMQPPSP

SEQ ID NO: 127487 - protein, 78 aa, Glycine max
  Coding DNA Sequence Number=SeqID_35802
MASSSFPLGGVYLYGTAWLFWYGKGTGLAAKGCPGFCEAVPLVKYITKGLGFATVLPSVDCMHMCYSSLPSLPTSSRP

SEQ ID NO: 127488 - protein, 229 aa, Glycine max
  Coding DNA Sequence Number=SeqID_35803
  Homolog annotation: Hit_ID=Q2HW90; Match level="QueryCoverage=48%, HitCoverage=22%, E-value=3e-09, Identity=30%"; Hit description =Putative uncharacterized protein
MGSSQKPSLKKRFYQVKIKSLEVTSLRELGQLMGQLQQQAFRKAYGKIWDLARVEVSMEPIASLSQYYDQPLRCFTFEDFQLVPTVKEFEEILGCPLGGRKPYLFSGFYPSTTRVANVVKISAQEVNQESPVVAILAMYDTFDRGCEKSGARIVCYALALYVWLVSHLFLQEGRPVYPLQGHRSCIEKGKANWDQLLASMEGRLLICSLARRKEESGFYLHAKDVQMFP

SEQ ID NO: 127489 - protein, 139 aa, Glycine max
  Coding DNA Sequence Number=SeqID_35804
MFSKKEGMMRIMKLAKYRLKAQVEKDEAPEWRRMKAQVEKDEGPEAETLSRLLIVAEGPNLSSFTGSGVYPDLSSFTGSGVYPDLSSLTGSGVYPDLSPFTGSGVIQIFVACIKRSAPTQVHISRPASVLKKIAQCRLK

SEQ ID NO: 127490 - protein, 371 aa, Glycine max
  Coding DNA Sequence Number=SeqID_35805
  Homolog annotation: Hit_ID=Q2HW90; Match level="QueryCoverage=43%, HitCoverage=29%, E-value=3e-17, Identity=35%"; Hit description =Putative uncharacterized protein
MANQGDWVPFMDVLALLIFGVVLFPNVDGLIDLAAIDAFLAYHHSKESPVVAVLADLFDTFDRRCEKSSARIICCLPALCVWLVSHLFQQDTRHPCPLLSHRSCTEKRRMDWDQLLAGIGGRTISWFPLWKEGKEGVLFSCGRYPNIPLVGTRGCINYNPTLAIRQLGYPMREHRRKKACLFLYQELRGIRNGIIGGYHEWLKVHIRGLDWLAKLKVVSEEDFEAPEEDEEVQSLKSELGKAKLAKEKIKLAATHVRKECAGLREENAITARALEQETKRARKEEYGRNKFRGALWGSNSELKLRREERDQSRAHSMVLKEELIACSRSKRSLSQRLCETETNMLAIIAKYQEELGLATAHEHRIVDEYAQ

SEQ ID NO: 127491 - protein, 192 aa, Glycine max
  Coding DNA Sequence Number=SeqID_35806
MDMNLGYLISHQISLIAQHDTSRLGFPALITTLCKARGVQSDSRSLENLSPAINLAYIKKNCWNLDDPIVTFRGPRKARGKRSEALTTSAPPETPAPSSSIAPLPPTQTPIIPPTSTQIPFPIPISEGPSDFIFTPKIMDEFYAQVAWLGAQPSPSGGGGASAAQEPVPEEPVAAAEGEDELTPQEEETSID

SEQ ID NO: 127492 - protein, 98 aa, Glycine max
  Coding DNA Sequence Number=SeqID_35807
DIKVAHKTLKSQNSQNNSSIPDLVQNSCNLHVYIAVCVSGLQQLALDEIYHSPEKSALKDLKDQDVLDIVSDIVDPAASILHLTFYLALCIVQPDLIP

SEQ ID NO: 127493 - protein, 45 aa, Glycine max
  Coding DNA Sequence Number=SeqID_35808
MSFSKGNDKMAPKKLSMKRFRRDATGEGSIAASKFDSHRFRSVEH

SEQ ID NO: 127494 - protein, 154 aa, Glycine max
  Coding DNA Sequence Number=SeqID_35809
MTSKELNEEPYEVKISCTFRKGTGAGYHETKDFLSKEIRFGTTICPRISNPSRKRGGTDTQFQVSKQNSILDIIDTYRILWKAVFDESRMYGLEGDLSYLSRSTLQYGGQKAKINDFSPYKSYKKTDSSFHAHVRGEGLEKKKPQNPIQFIVID

SEQ ID NO: 127495 - protein, 134 aa, Glycine max
  Coding DNA Sequence Number=SeqID_35810
MARRDKLWSFCTLLSSRGGGPDDMRRQIMVIPHTLLPFRQQSCPMARAETNYGQDLYTLLIIQRRRDTRVRKNYPYKHSAPLLHSKTLIADGRQRRQFVFCTLLFAPGTTSHLTCGNFMVIPYPATLVNREERN

SEQ ID NO: 127496 - protein, 115 aa, Glycine max
  Coding DNA Sequence Number=SeqID_35811
  Subcellular localization annotation: CTP_CleavageSite=57; ConfidenceScore=5.26e-01
MDHFKVLIPSSSVNTTPELRIFILTGFLRFFRRFPQINVGGDSAHLSSFGKRTREPRLARPRKGTLRQYSEKGRKISNINERNHSKCEDLHRMGTKDLPRRIHEMTTKAKGVQPS

SEQ ID NO: 127497 - protein, 123 aa, Glycine max
  Coding DNA Sequence Number=SeqID_35812
  Gene Ontology: Biological process=transposition, DNA-mediated
  Homolog annotation: Hit_ID=Q1J7G7; Match level="QueryCoverage=30%, HitCoverage=65%, E-value=3e-10, Identity=71%"; Hit description =Transposase
  Subcellular localization annotation: CTP_CleavageSite=48; ConfidenceScore=5.05e-01
GTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSIGIFLRKLLKEVNLAIIG

SEQ ID NO: 127498 - protein, 86 aa, Glycine max
  Coding DNA Sequence Number=SeqID_35813
MENGGLHSFKLCGFGLRRANEEGENEGEAHALTVIPIQPSFPPTQQCHYSANKQTFSLPTAQLSTKAIPKSTTKSVYYTSNDEHHL

SEQ ID NO: 127499 - protein, 68 aa, Glycine max
  Coding DNA Sequence Number=SeqID_35814
MYRLCLSLPAEPQHAEPGLRFFSCPTPDQFRAKVAWSADWPEAQAGEAPPEAPMMERRPRGRGDGRFA

SEQ ID NO: 127500 - protein, 104 aa, Glycine max
  Coding DNA Sequence Number=SeqID_35815
MGEAEEVQEKMKADMEAMKEQIATMMEAMMSMKKIMEANAVIVPLLALSLRQRFGKYGRPHDVQIQNEHAFPSYGLPPNYTPPNVAYTLNENLNNSTPILIENQ

SEQ ID NO: 127501 - protein, 29 aa, Glycine max
  Coding DNA Sequence Number=SeqID_35816
MKEGHTPPELGAMFGNTSNPRDEESGQDL

SEQ ID NO: 127502 - protein, 337 aa, Glycine max
  Coding DNA Sequence Number=SeqID_35817
MAVCTENVFLTPTQPISLGGMAVPRACPAVATSGIHYPAIATGVPLTQFGGGDGFDEEALFLIYPELQVLEWEETLVHLSPLFSPRILPQKPSITFPPVTVKEHFPKASSPTDSDIVARVVGVGRHPQTSSSPYGKVWQVYIARKRDKWGNHYGFVRYLEVGDVKSLKTKLDEIKIENVKMNANVPHFENNSNIGVRRGVMTKNGRAQSDMKPKGPQLGTYRVAREQTYNVPNNKGKGVVDTLYANVVRCPPTDVGQKWRVHKRKENIDNHIKEWTTKMKVDGETKGWLVDRWARRLKDLTLFERLNDIYLSEEGDRVKLRYLNSDAILSLVPPKRC

SEQ ID NO: 127503 - protein, 265 aa, Glycine max
  Coding DNA Sequence Number=SeqID_35818
  Homolog annotation: Hit_ID=A5BEV8; Match level="QueryCoverage=83%, HitCoverage=32%, E-value=4e-08, Identity=25%"; Hit description =Putative uncharacterized protein
MEALGSLVDCPFEQEFDDCLMKFEIACSPWPMVESTHWALKRLLQNSLGDLCSVWEAMNNMITLYALNQIAVEFQCVNYVGIDSSCCGCVMRTTHDLPYACLSEPEVTITKEMKATSKLFEELDVKTKGAQKKHMTKHQRLTKRDLSYWEYVDALHSMQNSNSSVKRAASSSEQPKPKRNFLILDQFHPCIHDFIENIVNVKADVNCGYCAIAALLDMGEDSWSLVCNHLLKELAKWSDEHMNLLGGIDRHEELKRLLLVDGLSM

SEQ ID NO: 127504 - protein, 194 aa, Glycine max
  Coding DNA Sequence Number=SeqID_35819
  Gene Ontology: Mol. function=helicase activity; Biological process =viral genome replication
  Homolog annotation: Hit_ID=A2YRS6; Match level="QueryCoverage=54%, HitCoverage=21%, E-value=6e-16, Identity=35%"; Hit description =Putative uncharacterized protein
MEEQDCKCRNIGFDDAKLLPQTHCFQQIKALVIDYQKKSLQSTLKERNLYIHLELNCNRETGCLLDCENCNQEIGCLLENLEHKGEGSEDDDNIDALLSKPIVKESMFTWLQANSIFNEGKHLTYVQFITKFTYVAKDRCWKPRKGGYTIERLNWVPPSTGELYYLRMMFAMVKGPTGYEQICTMNGQLYPSFR

SEQ ID NO: 127505 - protein, 28 aa, Glycine max
  Coding DNA Sequence Number=SeqID_35820
MDTRMKLRMRKNERGEVVGSSCKIPMLS

SEQ ID NO: 127506 - protein, 81 aa, Glycine max
  Coding DNA Sequence Number=SeqID_35821
  Subcellular localization annotation: CTP_CleavageSite=65; ConfidenceScore=5.41e-01
MGKNKGRQSHSAANQIMVKGTTSSSANQNAYTASQDNLVGKVLVKKTGTVLQKLMMSHTKCLIICQNAVLNLNLPQRFLAP

SEQ ID NO: 127507 - protein, 49 aa, Glycine max
  Coding DNA Sequence Number=SeqID_35822
MGDLQNKRLRRSKDEEMKQKREAEEMGDTMKTLDSKREMVILAAFDEMK

SEQ ID NO: 127508 - protein, 66 aa, Glycine max
  Coding DNA Sequence Number=SeqID_35823
MEKRMGGKRRMGGKRREGKDEWEGKDERENRNLGHHPLPHNLEPEPGVKKRGNIRLRPIICQNARN

SEQ ID NO: 127509 - protein, 69 aa, Glycine max
  Coding DNA Sequence Number=SeqID_35824
MFGRLCNYPKTNKFSRGSSLCEGMGEGCCTQPYPCICKEAVSGFEPMTNKSPKHNFTAAPGLALMNTNN

SEQ ID NO: 127510 - protein, 95 aa, Glycine max
  Coding DNA Sequence Number=SeqID_35825
MEAISCVTKKWLRHHQRPQKFRNAPLQRWPGHWKSPKEGEMLNHEEESDWAAQCTRQDKMSNEELKLQDPRCRIQCPGHPARKYWTHKSVISLTD

SEQ ID NO: 127511 - protein, 377 aa, Glycine max
  Coding DNA Sequence Number=SeqID_35826
  Homolog annotation: Hit_ID=Q9LEN6; Match level="QueryCoverage=77%, HitCoverage=51%, E-value=3e-71, Identity=61%"; Hit description =Putative uncharacterized protein
MEVDMWDTEDDTKVVKKSKQKQRKRKVEKDGKREKEAKRIFLSLTKPLLVLGLDPKPLRLEHRARLRHLLRRLVNRQQWVAASGVLSAYMKGTLNDTSPHTNRLKFWLVSEQALLELLKHVENHSINTTRIKNLYDIWSKKIGSMKTWPVESRYAVHLEFMVFCLLRGHAEDAYHLALCLEQEKGDIGPMLKMMMGLTFYELWYSSIPKEFQVRNSDQFHLQENSDMEEASFSNENVQSERYNSVESHMADSQSRRDSDASVMNGGLDLWLLPLRFSDEHSFEDFVYSQRNQPNHHYKNAVKYLQLALRSEPSASAALLPLIQCRPYELPKEWKKNTKGEIGSRHVSTTPFLSMHSPMHGACIMAGALNFKRNLVLN

SEQ ID NO: 127512 - protein, 72 aa, Glycine max
  Coding DNA Sequence Number=SeqID_35827
  Subcellular localization annotation: CTP_CleavageSite=17; ConfidenceScore=5.16e-01
MAQAFYRTPRVPSKVCRFASARNRQKIRGPKKSGRSVEGESLPRRRLCQDRPGQIKNDENNSWSTIVAGEKD

SEQ ID NO: 127513 - protein, 64 aa, Glycine max
  Coding DNA Sequence Number=SeqID_35828
  Subcellular localization annotation: CTP_CleavageSite=23; ConfidenceScore=5.27e-01
MATLLCESHVACKPPVVLATQAQCKSPVCLTSPVTGFQFHFSEGGSFSGRHVFQVRELQFPPAS

SEQ ID NO: 127514 - protein, 135 aa, Glycine max
  Coding DNA Sequence Number=SeqID_35829
MMPTFFRVLWWVVVINVVEDDVTSEALLLVERDVKFVKVAEKLGPSRASQDVLGGLKQEKDALDSVGDDEKRLVLKAVRVVAGFEGFEGCEVRNVKKKMMMRVEEKRRNSGERSLVGLFLFQTFAIEKDCVRYGS

SEQ ID NO: 127515 - protein, 249 aa, Glycine max
  Coding DNA Sequence Number=SeqID_35830
YILCGTSKWYIYLGLTENKRGYISCESVLVEGTSTRFKENKGGYIPCGSFLVKGVVRFSEDGNLYSDHVLTSLVLSWAPLEMDWFKVNINRVIRRARMEAACGGVVGDHHGKFLIGYVIEGEGRLWGCGYRTKGLWGWGYKMAMMGEGTLWGVEVMRLSLSLATFSILISISNLGEHVGTIVMVKSRPKVNPFGDAKPREELYIHIGWPLYRKYGHAFEVTKVVPTVSEEVKDYVVKNTRRQMTPTLEN

SEQ ID NO: 127516 - protein, 118 aa, Glycine max
  Coding DNA Sequence Number=SeqID_35831
  Subcellular localization annotation: CTP_CleavageSite=39; ConfidenceScore=5.06e-01
MGTTSRSGETQVFDKKPGSFSASTRVPVHQVFVEMPGCPADTETSPNDSCSLGEDDSSTEEDTSPSSGSDSNPQVGNGEASTPWINLFKDSRKPSKGFGLKFSPLSPEDVVLLDEDDF

SEQ ID NO: 127517 - protein, 100 aa, Glycine max
  Coding DNA Sequence Number=SeqID_35832
  Subcellular localization annotation: CTP_CleavageSite=22; ConfidenceScore=5.05e-01
MNPKAVSLLSPVITTKKLYPLLAMNPKAVSLLDPVINQEANPLLVMNSKAVSLLSPVFNQEDLLLKIVTNSRSLEKIFSLVIDHHYSVIDYTSTVVTLHV

SEQ ID NO: 127518 - protein, 530 aa, Glycine max
  Coding DNA Sequence Number=SeqID_35833
  Gene Ontology: Mol. function=binding; Cellular component=nucleus; Biological process=metabolic process
  Homolog annotation: Hit_ID=A7QMS3; Match level="QueryCoverage=88%, HitCoverage=72%, E-value=1e-133, Identity=37%"; Hit description =Chromosome undetermined scaffold_127, whole genome shotgun sequence
  Pfam annotation: Domain name=PPR; Domain location=126-160; Score=9.3; E_value=0.61; Accession=PF01535.11; Description=PPR repeat
  Pfam annotation: Domain name=PPR; Domain location=227-261; Score =35.6; E_value=1.8e-07; Accession=PF01535.11; Description=PPR repeat
  Pfam annotation: Domain name=PPR; Domain location=330-364; Score =32.8; E_value=1.2e-06; Accession=PF01535.11; Description=PPR repeat
  Pfam annotation: Domain name=PPR; Domain location=431-465; Score =41.2; E_value=3.7e-09; Accession=PF01535.11; Description=PPR repeat
  Pfam annotation: Domain name=PPR; Domain location=466-500; Score=3.9; E_value=2.7; Accession=PF01535.11; Description=PPR repeat
  Pfam module annotation: Pfam domain module=PPR::PPR::PPR::PPR::PPR; Domain location=126-160::227-261::330-364::431-465::466-500
EKLLSKREEYSNNGCRDLNTREAKKMLTGLVITSMLVQRCELPPRWFKGDTKHEKQKRFQNSNQYHSPTLRFTQCQPKPNVPHIQQGLDINLNETQQLHGHFIKTSSNCSYRVPLAALESYSSNAAIHSFLITSYIKNNFPADAAKIYAYMHRIDTEVDNFIIPPVLKPCCLIPSILLGQEVHGFVVKNGFHGDVFVCNALIMMYSEVGSLASARLVFDKIHKKDVVSWSTMIRSYDKSGLLDEALDLVRDMHVMRVKPSEIAMISITHVLAEIADLKLGKATHAYVMRNWKCGKSGVPLSTALIDMYAKCKNLAYARRVFDGMSETSIISWTAMIATYIHCNNLNEGVGLFVKMLGEGMSPNEITMLSFVKECGTAGALELGKLLHAFTLRSGFTMSLVLATAFIDMYGKCGDVRSARSVFDSFKSKDLMMWSAMISAYAQNNCIDEAFDIFVHMTGCGIRPNERTMVSRLMICAKAGSLEMGKWIHSYIDKQGIKGNIILKTSLVDTYAKCGDIDALLAAAMDRDVSM

SEQ ID NO: 127519 - protein, 247 aa, Glycine max
  Coding DNA Sequence Number=SeqID_35834
  Gene Ontology: Mol. function=damaged DNA binding; Cellular component =transcription elongation factor complex; Biological process=DNA repair
  Homolog annotation: Hit_ID=A7R0V7; Match level="QueryCoverage=55%, HitCoverage=38%, E-value=2e-48, Identity=73%"; Hit description =Chromosome undetermined scaffold_324, whole genome shotgun sequence
  Pfam annotation: Domain name=PAXNEB; Domain location=9-244; Score= -74.4; E_value=8e-09; Accession=PF05625.2; Description=PAXNEB protein
  Subcellular localization annotation: CTP_CleavageSite=7; ConfidenceScore=5.08e-01
MAATRARVSSFSRNVSTVTSQNHGLKHGPNGTMFISSGIPDLDKILGGGFSLGSLVMVMEDPEAPHHMLLLRNFMSQGLVQKQPLLYASASRDPKSFLGTLPSPASPKGDNKSSDLSHEKDLRIAWQYKKYFGEPQLNLNTNNVLLNGGHGGAMADLGGGFAKKRHRIAVAWRVWDGGAMAAVAVMAGWRKWRDFAWFLSANSPCVPPAPLRPPSPRRTQPPPRQATPAVRTPSRRRPRHPLHEDEG

SEQ ID NO: 127520 - protein, 93 aa, Glycine max
  Coding DNA Sequence Number=SeqID_35835
MTLFIARGRFGFKVGADISNLIPILVPTSGYHEKPELKPIPGQLGYYPSKQWYFFVVQLDSVFRLLKWIKFIIFRKTLLYPFVVSFGKVQEAI

SEQ ID NO: 127521 - protein, 204 aa, Glycine max
  Coding DNA Sequence Number=SeqID_35836
MVKYNNNKGDRCLLHPGELHDVEMCSVSKELLHGLIDEGRIEIGRVRREEGEVFMQSSDTNLGKPKPLVIHFTKDVTTQVPRGFQPAMVRIPSPFPYKSDKVVPWRYDVQGSNRRQDAPVMRVGASIPTAKVTNISGISGMTHSGRIFAPPEQLTKSKDKGKAKEDVVERDKIGPVMYNEAPIGKLAEEDGNFGKREIFDEAAT

SEQ ID NO: 127522 - protein, 470 aa, Glycine max
  Coding DNA Sequence Number=SeqID_35837
  Homolog annotation: Hit_ID=Q6WAY6; Match level="QueryCoverage=65%, HitCoverage=54%, E-value=3e-37, Identity=32%"; Hit description =Putative uncharacterized protein
MIEVSIEAISSLAQYYDQPLRSFTFGDFQLSPMVEEFEEILGCPLGGRRPYLFSGFYPSLARTSKIVQISAQELDHGKQVRNGVVGIPRKCLEAKARSLAGRGEWAPFIDILALLIFGGVLFPNVDGLVDLAVIDAFLAYHDHKESPVVAMLADLYDTFDRRCEKSSTRIVCCTPALYVWLVSHLFRQEVRHACPLESHRSCTEKGGANWDQLLANKEGVSINWFPRWKEGRTRVLISCRGFPNVPLMGTRGCISYNPILAIRQLGYPMRGAPLEEELAPKVRKAWEVVQKKDKELRGSNNGPIGGYRRWLKAHVQGLDWLPSLRTAKREEVEAPEEDEEVQALRAELEKAQIVKERGKRPITSTWHGLKGGVNCLLKIQEKFGPTLRSHGAKHVIAIIGQYIEELNQSLTHEKKLVEDFAQAYAEKEARGRVIDALHQEVTMWMDRFALTLNGSQELPRLLAKARAMAE

SEQ ID NO: 127523 - protein, 203 aa, Glycine max
  Coding DNA Sequence Number=SeqID_35838
MASRKRKATTSRPQEPYDTTRFISKTSWERYSQNVHSWNIFLERNVILYVTDYDEFCRELDRRCWHKSLTRQMDGHIDVALVKEFYANLYDPEDKSPKQVRVQGKLIKFNPASLNAFLETPPVIQPGEKYTSYSLFCRMRGEVSLWARHEDGHGLGLTHLRLDLTNGPVQLLAARLPSPYHRLMHRPRSYIRLTHIRVHKPCH

SEQ ID NO: 127524 - protein, 126 aa, Glycine max
  Coding DNA Sequence Number=SeqID_35839
MHKGGSISLQDHTIRLARLSQARSNVASSVGESQLTPLDLAEEQRLRTWCWVAAAGPKRKGRLSGTGDLAHTYKCGDENFMQHTQGSSSRAKDATKINLLREELRQSKEEMRVFQSVVLQFLLPKA

SEQ ID NO: 127525 - protein, 40 aa, Glycine max
  Coding DNA Sequence Number=SeqID_35840
MAAEWRRRKGNWRCHFKEKMSQVMDKRLKVGEDEWRERER

SEQ ID NO: 127526 - protein, 146 aa, Glycine max
  Coding DNA Sequence Number=SeqID_35841
MYSQLWVPKLLAKIHLGLPTKKEIVVTSNASSKKDHRRVRPFVEKTLYSGFIRCRTDVRVLRQFGLDGHNVVLCVYHPFHDSHNLGSHWQTGLIPDVVNSYAELVRPQSCTKGYESSLTHTTNFAIVVGGFSSQVQLRHTEPQEED

SEQ ID NO: 127527 - protein, 107 aa, Glycine max
  Coding DNA Sequence Number=SeqID_35842
MGGGANSNFEILKLDLPEYFRSWIASGGSNPARLGELGGKLLPFFPINMLKGVVLRVPDPPENPSRGASVTLSRCFRKQIREGFPPLFVVLHPFFVLQRVSFQIGDF

SEQ ID NO: 127528 - protein, 97 aa, Glycine max
  Coding DNA Sequence Number=SeqID_35843
MGSKIYPKVHENPRTFFSSSSPSLLESSIQYPWGVGLHQFPSLPLWSLGAQITLGLKNSISSKTYGLNLVGCYQEWCNRLPVSCNRLPVSKFDFKIF

SEQ ID NO: 127529 - protein, 90 aa, Glycine max
  Coding DNA Sequence Number=SeqID_35844
  Subcellular localization annotation: CTP_CleavageSite=16; ConfidenceScore=5.14e-01
MYVGYSSSHTSKSSVGGSVGSAEGFPAVLRTMWVSRERPPNQSQKNDDLEPVHRWIVVKFEYHVRNRIPSILTVGNFDIMSELRETPFAL

SEQ ID NO: 127530 - protein, 311 aa, Glycine max
  Coding DNA Sequence Number=SeqID_35845
  Homolog annotation: Hit_ID=A7QG88; Match level="QueryCoverage=73%, HitCoverage=45%, E-value=5e-35, Identity=38%"; Hit description =Chromosome undetermined scaffold_91, whole genome shotgun sequence
MEASDGIQRSAFFFFFSKEDYILVLECFGEELRFISPSEHLVLDWALGKEHSVLLRRSELKTFVDLHANEAGKGGELSHHETSIITGAIDLTGKTAKDAMTPISETFSLDINSKFDICFAPNLSSINAVHLYILGTQEILLASYWVYESWQLYEILNQFQKVHSHMAVVLKSNKDTESTMGAPTFLNIITNKISNPSQVVVESDSSFVLEISQRSSVHESSVNSSDAEFRNPTLKNLMELDGEVHQESNQWEQENEYFSQEQIESLPDVKEVIDIIIMEDVMEELFQAFYIATLTSVISKTDVNESAVTFL

SEQ ID NO: 127531 - protein, 54 aa, Glycine max
  Coding DNA Sequence Number=SeqID_35846
MKLWILYTVTTVTVPDFGEEGEGEAEAEVSAKGRVDGAVGGGGGVGLFSVGEGE

SEQ ID NO: 127532 - protein, 530 aa, Glycine max
  Coding DNA Sequence Number=SeqID_35847
  Gene Ontology: Mol. function=receptor activity; Cellular component =integral to membrane
  Homolog annotation: Hit_ID=Q9SU18; Match level="QueryCoverage=93%, HitCoverage=83%, E-value=1e-116, Identity=48%"; Hit description =Putative uncharacterized protein T20K18.30
MAPAGALIGPIAFAIIVIGNSAIILGLWSAHAVWTYYCVARLYFLSKLQRLCSSLDLSLQFLFTLLKTLAFDNRKNRFGLVFKLVVLMGLPVPLLLWPIVGIVGSLLGGIGYGFFAPLLATFQAVGEGENVNQKFYHCFIVSVNFCLCNVSFSAPFGHLTLLVEVSFNSNPFHDLELLDLSRMQEALMPLNSDIRMVVGQQLKEAAQCPYMLFKGWKRLLEDLIGIKGPFLETECVPFAGLAIILWPLAVVVAVLAATIFSFFMALYSGVVVHQINSVEMGFIYIVSVVSLFDEYVSDLLYLREGSCFPRPIYRRNMSHAVEGKNLGGGDNDLKNRRDGSQNSKHSIQQSRSMKWGIQQCRPVQSCEVNGRILLRGGLISVGEVEKCILKGNCKKLSIKLPAWSLLQCLLTSAKSNSDGSVISYEVVLTRTNGPKDRVFEWFIGPLLIMKEQLKNLELEGTEETCLKELVMKCKNEVLEESDSTGFPSDNTVRRAQLQAIIRRLYHNLMHPKLLIACVYNTELTQALLYV

SEQ ID NO: 127533 - protein, 374 aa, Glycine max
  Coding DNA Sequence Number=SeqID_35848
  Homolog annotation: Hit_ID=A4PP05; Match level="QueryCoverage=45%, HitCoverage=48%, E-value=1e-15, Identity=33%"; Hit description=IMP dehydrogenase/GMP reductase, putative
MEMVEGKEHQDGCGGSDNNLGDDVVVRVDNRASSSFVGVLVCVMSSLLGASIAGFEELSTTTMPFPSSRFRSSSFHLSIGEVAITRDDLLEVNGDEARAEIVQCHGAHSGSYAWGAAALVHMYDNLNDACKGDGRQLAEYITLLQGIRWIYEHFPSIVKAFTNSDYEERSPRAFRWTSTKTLLASTYGKRLDRLTTADICWMPYGNHYAQFGYVQTIPPRSSGSRLSFEDIDNKWMHFSKYLAPVGQICVVPRQCASDYIYWFYMISHQFMTLTQLGDPPRHPPIMQDETYVEPDMPEFPMATTAIEEAAAHAPSDVDQPRHVVEACQAIAKRLEWLLNLRIVTEGTKAHDVMQDCLRIAKGVTVQRNVYVRSR

SEQ ID NO: 127534 - protein, 267 aa, Glycine max
  Coding DNA Sequence Number=SeqID_35849
MGPQPSLSQYADYDPGNIACLTPTKRISSQQTSSDFDSDEYTQYQLSTSKHIKAEWLLLYEGCSLQYAFETNVSNNSFIVLPTPKSNSARTMSSVISTAFTVVRRDGNKFYFADGLKDFRRVLGIHEGLVVHFAAPDRNTSFYLHFMPPLDRQTSGRPYSTTRTYVFIVDITNHIISTPTPLVLPPDAVDIIGYRSQYLTVEPPRGRQIWWMSIQDGLQTLTTPWYQFLKDNNLMARDEVIFYYQPNQGVWEIILRKEIGWNEDEST

SEQ ID NO: 127535 - protein, 375 aa, Glycine max
  Coding DNA Sequence Number=SeqID_35850
  Homolog annotation: Hit_ID=Q8L7G1; Match level="QueryCoverage=42%, HitCoverage=70%, E-value=2e-24, Identity=35%"; Hit description =Putative uncharacterized protein At4g25330
MLATVKEGRTTTSVVAAEEYTTEFRAYNDDAWYTVRVLLEGERLIVKYQNFSDENDEAFEPSRFGDCEDLEDFKERFRPLSRQLQDAECRRFGPGARVCACHSFAPDDVRFYDAVIDGVQENEHSWEIGEEECLCTFLLYWLHGPNARNLTAEPIDNICEVQSAWELDPAVTSFLDMAGKKIHLFSSRYVLASSGVSGLEMGPYCNGSSNTTHRMSYFERMEKATQRAMQSVDNVCSPGVSKKGFEMMPYCPKSSNTTHRMTYSGQMIKASSMKENVLGGLLSMHVHMKLMNDPRERHMQVVDRILQYMKASPGKGLLFRREGSLSMEIYADAYYARTVIDPGSNQNTLSSVIECDSSGHQQSGALHKSQPTWAA

SEQ ID NO: 127536 - protein, 214 aa, Glycine max
  Coding DNA Sequence Number=SeqID_35851
  Gene Ontology: Mol. function=endonuclease activity
  Homolog annotation: Hit_ID=Q2HUP4; Match level="QueryCoverage=26%, HitCoverage=28%, E-value=2e-11, Identity=46%"; Hit description =Endonuclease/exonuclease/phosphatase
MAVHGGKPKIHHKNMADGVAENGRRHDGSAVAAAVIAVRARMRGALMRGAVSRAWCWCGVPSSPSWCRSGQPNTYPAKNKKNSRNSAIAMAAAMAPPSTTRNATAIWWRFFKFPQRYSAMAPPWSLFDNTDSVKRARAVASVQKCSVKCARTLTFSWTNLGFKLWYTGKVRGKNGVGTMVDKTINIINAYAPQVGTEAHVKEKFWGRLGGIDIP

SEQ ID NO: 127537 - protein, 80 aa, Glycine max
  Coding DNA Sequence Number=SeqID_35852
  Subcellular localization annotation: CTP_CleavageSite=48; ConfidenceScore=5.68e-01
MSSSMSLLESKHASLTFCIINTNSKKNSFMASSSSSLTTLFNKGMKARGERVPKGRGVWVERRRGISIEEKRKEKVKEKE

SEQ ID NO: 127538 - protein, 52 aa, Glycine max
  Coding DNA Sequence Number=SeqID_35853
MGEYGGDHALSAKFALRMPSSFFVGLLRVKLELVAKRGIALGVSCALSKMLS

SEQ ID NO: 127539 - protein, 341 aa, Glycine max
  Coding DNA Sequence Number=SeqID_35854
  Gene Ontology: Mol. function=hydrolase activity; Cellular component =cytosol; Biological process=response to other organism
  Homolog annotation: Hit_ID=A7Q2Z1; Match level="QueryCoverage=78%, HitCoverage=96%, E-value=3e-94, Identity=61%"; Hit description =Chromosome chr12 scaffold_47, whole genome shotgun sequence
  Pfam annotation: Domain name=NUDIX; Domain location=172-302; Score =100.3; E_value=5.8e-27; Accession=PF00293.19; Description=NUDIX domain
  Subcellular localization annotation: CTP_CleavageSite=64; ConfidenceScore=5.71e-01
MAARVHGPWLMNSAARFISSKLLLKSSSRAPPLQISALVGSMVPKIQGPKNSSGFPRSYMSATLASLAKEEEVPSKAIDTLRAVEDQHGGVIVNIEEPMDSSVFASLLEDSILQWREKGKKGVWIKLSREHSNLVDSAVKAGFRFHHAEPDYLMLVNWIPNTPDTLPANASHRVAVGAFVMNANREVLVVQESNGRFSGQGIWKLPTGGVDEGEDICTAAVREVKEETGIDTQFVEVIAFKERHKSFFRKSELFFVCMLQPHSFKIQRQVSEIEAAQWMAIEDYMAQPFVRENELFDFLTKIGLSKFDGKYNGFSTVLSSTSSRKKSYFYFNNKDAGHMLA

SEQ ID NO: 127540 - protein, 49 aa, Glycine max
  Coding DNA Sequence Number=SeqID_35855
MEVEEPWLGLWLPLHYQVDMGAGLMGDLGVAFVVDWVFLADRVVGNEKG

SEQ ID NO: 127541 - protein, 79 aa, Glycine max
  Coding DNA Sequence Number=SeqID_35856
MAWNFLFKCKYVHDEMAPRKLASKRSRKDAAAAGTSAAPEFDSHRFRSAEHQQRFEAIKGWSFHRERRVQLRDDEYTDF

SEQ ID NO: 127542 - protein, 216 aa, Glycine max
  Coding DNA Sequence Number=SeqID_35857
  Homolog annotation: Hit_ID=Q6WAY6; Match level="QueryCoverage=87%, HitCoverage=37%, E-value=1e-19, Identity=30%"; Hit description =Putative uncharacterized protein
MASQEKWGPFADVLALLILGVVLFPNVDGLVDLAAIDAFLAYHHSKESPVVAILADLFDTFDRRCEKNSARIVCCLPALCGAARSIGFPRWKEGKEGVLFLCGDYPNVPLIGTRGCINYNPALAIRQLGYPMRGVPTEESLSPFLVRDLGAQGLKVIQRIHKAWRSPLRKDKELRGIRNGVIGGYHGWLRIHTRGLDWLSKLKVIDEGELRSSGGR

SEQ ID NO: 127543 - protein, 175 aa, Glycine max
  Coding DNA Sequence Number=SeqID_35858
  Homolog annotation: Hit_ID=A5ATL8; Match level="QueryCoverage=34%, HitCoverage=46%, E-value=3e-11, Identity=67%"; Hit description =Putative uncharacterized protein
  Subcellular localization annotation: CTP_CleavageSite=53; ConfidenceScore=5.57e-01
SANSVPAAAVRQRMQALSGMIGRKASVGGFLSSPSNPRAQPWTGGGNYQAGVRSERTPTAKALCWADTDTERRKLGERMGLDTPVVLAVNDGILGAVLIDPCNAVANALSIPPGEGGAFGNADTGGAWLSSARAVRLAGDKPEEGEDDVKSFMPLMPWATHVATMDGTKDRDPAR

SEQ ID NO: 127544 - protein, 252 aa, Glycine max
  Coding DNA Sequence Number=SeqID_35859
  Homolog annotation: Hit_ID=Q6UUU1; Match level="QueryCoverage=21%, HitCoverage=36%, E-value=6e-17, Identity=81%"; Hit description =Putative uncharacterized protein
ASRITGTPGLFILRSDLPSHWPLFLSAVPPVQLLTGWCVTAKAPPDISAGKCSGRVPFAIQAAQLLGRAIGAGLFAITPAGERGMCCKAIKLGRIGAPPAVAAALELVDPPGCRNSMSFDHWINSMTIKKYPGKPIWVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKMAYERAEISWEMPGDT

SEQ ID NO: 127545 - protein, 63 aa, Glycine max
  Coding DNA Sequence Number=SeqID_35860
MKMLGARVIYKRGWTTQNIHHTTYFTNDAILPPRALDRRLQEDWAKDARKGPRVLMSLRGSIM

SEQ ID NO: 127546 - protein, 88 aa, Glycine max
  Coding DNA Sequence Number=SeqID_35861
  Homolog annotation: Hit_ID=A5BBN5; Match level="QueryCoverage=82%, HitCoverage=8%, E-value=2e-12, Identity=50%"; Hit description =Putative uncharacterized protein
MSEEDRKRVHTLKPKTYTSALGMDEYFRVSNCKSAKEMWDTLRLTHEGTTDVKRSRINALTHEYELFRMNTNENIQRTRDGTIEIAPK

SEQ ID NO: 127547 - protein, 84 aa, Glycine max
  Coding DNA Sequence Number=SeqID_35862
  Subcellular localization annotation: CTP_CleavageSite=12; ConfidenceScore=5.10e-01
MLMRTIRTRLFAAARVKSCPGMHSRCVIASLSGCARTVGRPPISGGEDVSPLMARTYSPLKVIGTSTQGSTFMRKQEIGSSRGP

SEQ ID NO: 127548 - protein, 134 aa, Glycine max
  Coding DNA Sequence Number=SeqID_35863
SPNPFHSPQSFLKEIELPPFFSCRGRPFHRQNYWRCCDVGLRQRAWCRPFGDRGIKLDIPPSIILRVFMDFVVGRNDGGSFSWTGRSNVAFARSWQEGVEWCHRAPVGTWDPFPALLCLREVGALSCQESRVLN

SEQ ID NO: 127549 - protein, 306 aa, Glycine max
  Coding DNA Sequence Number=SeqID_35864
  Gene Ontology: Mol. function=nucleoside-triphosphatase activity; Cellular component=chloroplast
  Homolog annotation: Hit_ID=Q2PMM5; Match level="QueryCoverage=94%, HitCoverage=13%, E-value=1e-130, Identity=75%"; Hit description =Protein ycf2
MQLGGFDERTSIQILDFRIERDIERNQEFSLFLRFMDPIQFSGIFHSYFFPSREFYKTLGLPNLEYPTFTQFTGFNSNRYFTIKLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFREKIPKEVEGFFKQQGTGSIIQSNDIEHVSHLFLRNKRAISLQNCAQFHMWQFRQDLF

SEQ ID NO: 127550 - protein, 101 aa, Glycine max
  Coding DNA Sequence Number=SeqID_35865
  Subcellular localization annotation: CTP_CleavageSite=66; ConfidenceScore=5.13e-01
KIKSKYFRNASVSDSVEILHRSSSFFTVLHPFFVLQREQKPRFCRPPQEIVNGPNALTFLSFHPKRSLMVQCLNVSLLSPQEIVNGPMPLTFLSFQNQKTV

SEQ ID NO: 127551 - protein, 72 aa, Glycine max
  Coding DNA Sequence Number=SeqID_35866
  Homolog annotation: Hit_ID=A0PAV3; Match level="QueryCoverage=72%, HitCoverage=24%, E-value=3e-07, Identity=61%"; Hit description =Restriction endonuclease
MVKVGTSYVPINVSFSPKVGPGLPGINRDTRIYLFCEVIFRHSCINESANARGEAVCVLGASGVYTGLLCWH

SEQ ID NO: 127552 - protein, 146 aa, Glycine max
  Coding DNA Sequence Number=SeqID_35867
MHALYVGLIFCHGKSEGPCQLHTWGTAPPNAQVRRDDFPGSRVRKCIHIIHRISISSWHHDEHIVPAFVRYHIPSCFRTARLGKLGGNLLTVFPINRQKGVVPNIPHPPGYEFQLFWVKKIVSVKKIEAEVLPYRFRDVSVSKSVK

SEQ ID NO: 127553 - protein, 194 aa, Glycine max
  Coding DNA Sequence Number=SeqID_35868
MSHLPRYLKHLMLLVLAWELVLGVDFSMVLPLSSLGFEVVAPFLYKVGLAHLGPYMEGFHLLSIFFNTHSPLSKPLELVHKLPFIVRGNVPLPKGTLKIILILYWRIPMNHFFPNKGSPPIEGIPLKAKGSQWNFVEAKLHDESKLIQRVQEKNQEEFKIQEESLESRIKVQDLKNQDQDSRLKTQDSRLKIQE

SEQ ID NO: 127554 - protein, 114 aa, Glycine max
  Coding DNA Sequence Number=SeqID_35869
DCHHKNGGDCGSNIFQGYFDDAKESRVKQNPKIQESSFKNQDSRFKNQDSRLKIQESREDSIKISIKKFFKTLSSTRNFHKIITEEFYSLVIDYQKVVIDYQCFKTLDFKFQQF

SEQ ID NO: 127555 - protein, 119 aa, Glycine max
  Coding DNA Sequence Number=SeqID_35870
MSGFTRNSPQISASPHQLDLAPYASKPYNAQWNAPGLLRDKHTLRSSRILGEMEVDEPWLGLWLPLNYQVDMGSSLAYDNGIWGEPYRLFAAKFTSWLVFLVCAKGGVRHWKCGRQTLW

SEQ ID NO: 127556 - protein, 85 aa, Glycine max
  Coding DNA Sequence Number=SeqID_35871
MDMAWGSAEHANSLSSLAEMRNCPIGGVSWYRANHGEYSVDAIINNSRPTKTAGKVMDSSDIRLIVYNGRQLIVYILILGTSQEI

SEQ ID NO: 127557 - protein, 160 aa, Glycine max
  Coding DNA Sequence Number=SeqID_35872
MVDYEYLKIVVGGGVSSGNNFISVDPDDTDATTFEPENRTVGIEEFSYDPNSDTFITPNNYEPAYQPPSPNQPSPPSHPPLDSEVPIEKQNCHKRRRSEYGGSSSAVGINNQGNVLENLSVGIGTIAVNFEKISNMMEKREKDRDRGYYLECYKRNSKFG

SEQ ID NO: 127558 - protein, 52 aa, Glycine max
  Coding DNA Sequence Number=SeqID_35873
MTKFDPEIVLEFYANAWPTEEGVWDMRSWVWRLLGISLDSGKFQQGPLGFRH

SEQ ID NO: 127559 - protein, 167 aa, Glycine max
  Coding DNA Sequence Number=SeqID_35874
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=P00722; Match level="QueryCoverage=32%, HitCoverage=5%, E-value=1e-22, Identity=92%"; Hit description=Beta -galactosidase
  Subcellular localization annotation: CTP_CleavageSite=29; ConfidenceScore=5.57e-01
MIFLSSKLTLTKGNKSWYRAPPGGRRSTRGSTAFARVYGACWRSNSCSPGDPLVLERPPPGRCSDSPYSESDYNSLAVALQRRDWENPGVTLLNRLAKHPPFASWRNSEEARTDRPSQQLRSLNGEWDAPCSGALSAAGVVVTRSVTATLASADVRRCFCRYAPPRQ

SEQ ID NO: 127560 - protein, 73 aa, Glycine max
  Coding DNA Sequence Number=SeqID_35875
RPKRTLWAQRASTAKCSFSALSVTRESGRAQVSRLHAKHEINSLSEIAAYFGTDFKNNALEAAKRSSCVEKAK

SEQ ID NO: 127561 - protein, 52 aa, Glycine max
  Coding DNA Sequence Number=SeqID_35876
MTMLTKATIRSFQEWTREGSKLVYQMGLGTSSPLVLVKVPAPELGRGDDIGY

SEQ ID NO: 127562 - protein, 179 aa, Glycine max
  Coding DNA Sequence Number=SeqID_35877
MDDNITLILHHGGRFTPVPVMERSCTTDGDILHLVRDAFENENEINVYFHHEVDPILEVPQMLYLECHPIPEAVENKDDLDDVPIAGHEEDVGGGEREVGDGEQRDVGEQRDADASEQRDVGEQMDADADFSCMRNEVEVEVERDGYHSEELKIPISSDDEDEDVEVYPQYSQSSGFGQ

SEQ ID NO: 127563 - protein, 185 aa, Glycine max
  Coding DNA Sequence Number=SeqID_35878
MLNEGSVGKLFCKNEKDNVQLLMCISQCSPTINHNNNPATSFQSTPPSHGTLSIDDSERCSKRHAVNNAKLAVYYPDEHQRPTDTTQHDQFVGYDSSNSSDDDVNMTQENIDIEYSLNDPTIDDLDDYDEQTFLSASSTYQNTGGTYIDIGDPVWECPHCKAMMWYDERINRQTNKQTKVFIMLF

SEQ ID NO: 127564 - protein, 56 aa, Glycine max
  Coding DNA Sequence Number=SeqID_35879
MHDAIKEQARGVSATMHHQKRKTLDEASLLSSKSETQHDHRSTSTPYGSHRPGYKA

SEQ ID NO: 127565 - protein, 92 aa, Glycine max
  Coding DNA Sequence Number=SeqID_35880
GCPIGCLDDGGGSQRSFEAIKSLFASVIKVKLHLLLQQVGQWKGYFAKIPYKAPVESCMTKKRLHLSHTRGVPGGIAQAERHPPIGKSAEGA

SEQ ID NO: 127566 - protein, 83 aa, Glycine max
  Coding DNA Sequence Number=SeqID_35881
MHLRDQGGLVHARALSALIDEDMFKSKGKDPLEGLGGPMTRARARKAKEALQQVLSILFEYKPKFQGEKSKVVSCIMAQMEED

SEQ ID NO: 127567 - protein, 176 aa, Glycine max
  Coding DNA Sequence Number=SeqID_35882
KDRELRGSSNGIIGGYHKWLRVRKQGLDWLPNLKTVRDDEVKASEESDEVQAQKAELERAWVVEEKFKAAIVSSSSEEAKGIITGQRHDLEGRAKGNMWAIIDKCKEKLNLAATHEQRLEDEYAKISAEREESRTSPIASQGKAVADTYSAPEEIHGLLSYCQHMIDSMDHMIRNR

SEQ ID NO: 127568 - protein, 17 aa, Glycine max
  Coding DNA Sequence Number=SeqID_35883
MGVDEKRLELQEPRERE

SEQ ID NO: 127569 - protein, 293 aa, Glycine max
  Coding DNA Sequence Number=SeqID_35884
  Homolog annotation: Hit_ID=Q6WAY6; Match level="QueryCoverage=68%, HitCoverage=38%, E-value=9e-13, Identity=27%"; Hit description =Putative uncharacterized protein
MDGLVDLAAIDAFLAYHHSKESPVVAILADLFDTFERRCENNSARIEGKEGVLFSCGDYPNVPLIGTRGCINYNPALAIRQLGYPMRGAPTKGSLSPFLVRDLGAQSLKVIQRVHKAWRSPLKKDKELRGLRNSIIGGDEEVRALKLELGKARLAKEKFKSAATHIRKECTDNNELKLRREERDRSQVHGMILKEELAACARSKRSLAQHLEATEQSMLAIIGQYKEELNQSVAHEQKLAEDFAQVYTEKEARGRVIDALHQEATMWMDRFTLTLNGSQDLLLLLAKAKAMAE

SEQ ID NO: 127570 - protein, 49 aa, Glycine max
  Coding DNA Sequence Number=SeqID_35885
MTKARQKGVRKENEGGACHPTRPGELGCFLENFLEGPSGPGCYLHPPIY

SEQ ID NO: 127571 - protein, 125 aa, Glycine max
  Coding DNA Sequence Number=SeqID_35886
  Homolog annotation: Hit_ID=Q6WAY4; Match level="QueryCoverage=65%, HitCoverage=15%, E-value=1e-09, Identity=40%"; Hit description =Putative uncharacterized protein
MGSSKTPSLKKRFYQVKVKSLGITSLKELGQLMGQLQRQAFHKAYGKIWDLAMAEVSTEVIASLAQYYDQPLRCFTFGDFQLSPMMEEFEEILGCPLGGRRPYLFSGFYPSLARISKIVQILAQE

SEQ ID NO: 127572 - protein, 43 aa, Glycine max
  Coding DNA Sequence Number=SeqID_35887
MKLLMLFTNLPRLFQMDVKNTFLNGYIEEEVYVDQPPSTKILV

SEQ ID NO: 127573 - protein, 115 aa, Glycine max
  Coding DNA Sequence Number=SeqID_35888
MSFAAKKKPVEFTQIPVSYVDLLPCPLDNAVVAINPARFPQSPFFRGYDSNATCARHEEASGRSIEHCRALKRKDFQVQAIGQFAQATCAPEFGLPRPFNHRLLVLHIGGGAVKQ

SEQ ID NO: 127574 - protein, 117 aa, Glycine max
  Coding DNA Sequence Number=SeqID_35889
MIFKNHPFDPEKRRTTPGTTPSICSSCMWRSTPGCLMNDNSISHLPAVNDMVCMQRDSRNLNTLQYMFWGWSAMYIINIILDSSKEQLHGMNMKALNEYMLSGIIHVCDLWNFKNIF

SEQ ID NO: 127575 - protein, 183 aa, Glycine max
  Coding DNA Sequence Number=SeqID_35890
  Homolog annotation: Hit_ID=Q6WAY3; Match level="QueryCoverage=24%, HitCoverage=1%, E-value=9e-08, Identity=53%"; Hit description =Gag/pol polyprotein
GVQEQMKVDLSALKDQMASISEVMLKLQKTIEDKATATASSTVREAEPVLQPALNLGLDRNTAVFGRRYSPQAYPYDLPPDFTPRATPEDLNQAPTFEGQLPPYEDYPGQDDGEGDTHLGPCSTSKIRPRMNYPNRTYLAGAAVAWYTNLEASQIRSWKDLATAFIRQYQYNTDMAPDRNHLQ

SEQ ID NO: 127576 - protein, 59 aa, Glycine max
  Coding DNA Sequence Number=SeqID_35891
MAGRKIGGEGFRERKELQGRVVIDYTNLYFNDARPLEPERLKALRIQWAKYYLKVRNET

SEQ ID NO: 127577 - protein, 217 aa, Glycine max
  Coding DNA Sequence Number=SeqID_35892
MSLKLPVYSELVKAFYSNLEIHEDVLMSKIYGIKMVIDQSLFYDLTKLPSEGVPLEGALIDEWKFDFSVHDARRLVCTNQADMTGRLLAGSLAFESRILHYLIVRILLPRSSNLAQVSEEDLIVMWAFHKEHDGSWIKKGAKNVGEEGHEGEDSSLLSKILERFDGLQTFVGERFDTLELQVDMRFNEMESRMTKVEEDVSYIRSSFDLPPPPPPSS

SEQ ID NO: 127578 - protein, 448 aa, Glycine max
  Coding DNA Sequence Number=SeqID_35893
  Homolog annotation: Hit_ID=Q6WAY6; Match level="QueryCoverage=86%, HitCoverage=64%, E-value=4e-24, Identity=27%"; Hit description =Putative uncharacterized protein
MANQGDWVPFMDVLALLIFGVVLFPNVDGLVGLAAIDAFLAYHHSKESPVVAVLADLFDTFNRRCEKSSARIICCLPALCVWLVSHLFQQDTRHPCPLQSHRSCTEKRRIDWDQLLAGIGGRTINWFPRWKEGKEGVLFSCGGYPNIPLIGMRCCINYNPALAIRQLGYPMRGAPTEESMSPFLVRDFGAQNFKAIQRIHKAWETPLRKDQELRGVRNGIIGGYHEWLKLKVVSEESFEASEEDEEVQALKSELGKAKLAKEKFKLTATHVRKECAGLREENAITARALEQETKRARKEEYGRNKFRGALWGSNSELKLRREERDQSRAHSMVLKEELIACSRSKRSLSQRLCETKTNMLAIITKYQEELGLAMAHEHRIADEYAQVYAEKEARGRVIDSLHQEATMWMDRFALTLNGSQELPRLLAKAKAMADTYSTPEEIHGLLGY

SEQ ID NO: 127579 - protein, 98 aa, Glycine max
  Coding DNA Sequence Number=SeqID_35894
  Subcellular localization annotation: CTP_CleavageSite=87; ConfidenceScore=5.19e-01
MSVIIRPSQPDLNFQSQNQVINGNHLHSMNHPFTLNSTKNIKQYSISPATSGSIMYLIQRLPPVRIQTLNITGPTAFHLLKLRTVIRFSTRKKTIALK

SEQ ID NO: 127580 - protein, 225 aa, Glycine max
  Coding DNA Sequence Number=SeqID_35895
MALRKLASKRSRKDKAAEGTSSAPEYDSHRFRSVEHQQRFEAIKGWDDEYTDFQEEIVRRRWASLVIPMAKFDPDIVLEFYANASPTEEGVRDMRSWVRGQWIPFDADAIGQLLGYPSVLEEGLECEYGQRRNRSDGFDEEAIAQLLCIPGQDFARTAAGRRVQIMRTNMTTLTQIWMTLLLSNILPSDHNFDLPLPKCQLVYAILTRMRIHVAQLIADAIYILQ

SEQ ID NO: 127581 - protein, 69 aa, Glycine max
  Coding DNA Sequence Number=SeqID_35896
MVAITPTKVPQPPFLREYDSNATCAYHGGAPRHSIEHCKALKHKVQGLIDAGWLKFEENRVIFKFMPLL

SEQ ID NO: 127582 - protein, 87 aa, Glycine max
  Coding DNA Sequence Number=SeqID_35897
MASRVFEGAKDMGNAKSEGPLGPSRRFLQKAVASGGSNPARLGELGSKHLPYFAINRGGSEVEKGSAPEALLSLSNLLGKIVSVKKI

SEQ ID NO: 127583 - protein, 94 aa, Glycine max
  Coding DNA Sequence Number=SeqID_35898
MDSGRFQVSVPGNSYPSKTFLEEIPLVLVKVQHLELGGVRSHWVLGSQHSSVLGSSHQNCPNGGLLVGETEGLTTRFSKVVFVIGSGRQALWLI

SEQ ID NO: 127584 - protein, 140 aa, Glycine max
  Coding DNA Sequence Number=SeqID_35899
MASGNRLPRVGNRLQGLKSEDRKLRWPLVIDYQGVQHVVEASGNRLPGCVIDYTGEHATGNRLPVPRGSLGDPRRQHEVSISGHDSIYSYFIVQVIEVTSSEEDPEEDPEEVPPEPAVDALDFLEGDEDPLPEWILPRTS

SEQ ID NO: 127585 - protein, 76 aa, Glycine max
  Coding DNA Sequence Number=SeqID_35900
MGTIKCNDHGQIKAPKHPHSECLDSLTTLVRHEWAVQQGQSNPPMNIPNMHMSMHFQDQSTFHFHIILNINIISSQ

SEQ ID NO: 127586 - protein, 143 aa, Glycine max
  Coding DNA Sequence Number=SeqID_35901
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=75%, E-value=3e-24, Identity=65%"; Hit description=LacZ protein
  Subcellular localization annotation: CTP_CleavageSite=37; ConfidenceScore=5.21e-01
MKHFTDTLISANISIVKNSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 127587 - protein, 104 aa, Glycine max
  Coding DNA Sequence Number=SeqID_35902
SAKRNTHGLSARKTLEEDELYRFTKRTASVHLLSEKAHAKPKFTNDSELCMSRVSREIKVQVLESFERFCCVKICRDKSLNGNWSDSKVLDSAGLSYCTITRNQ

SEQ ID NO: 127588 - protein, 104 aa, Glycine max
  Coding DNA Sequence Number=SeqID_35903
MVGYTPSSFADLDFAGRRIKAGLKRGKFNHPTWTNEKTGANEEGEDEGEAHAVTAIPIQPSFPPTQQCHYSANNKPFSLPTAQLSTKGHPLNQPTKFWSYRHFQ

SEQ ID NO: 127589 - protein, 272 aa, Glycine max
  Coding DNA Sequence Number=SeqID_35904
SRLFRFFRRFPRINVGGDSARIPFVEHASRESRVALPPKGRLRQLATPLGIVFRESGGESVIMLVSDLLDYSEPSSRAFLFENLLLLVVPTATYVLQGDDTSRTIREIYYLGIIAKSLALHMGSVLIPTVNKPTEGPCRLLKNVRWGISLPLDVVSKKGTNSPDPRIPRLHLCHMHSIMHSSIPPMRYRSFDLHQLLSHFSKHGNKSNRQEVLPSQGQKPRYHQHQGMRAVDGTPPNASLPQDLRKDLRVDHSRGVHRSHCITYPILRPAFE

SEQ ID NO: 127590 - protein, 89 aa, Glycine max
  Coding DNA Sequence Number=SeqID_35905
  Subcellular localization annotation: CTP_CleavageSite=18; ConfidenceScore=5.27e-01
MSKSCGFGMTGPLDESISCFLIRRTTRPCQQRAARPHLQRTTFTLTVERTTRPRLERTTRPHHQRAARPHLQRTTCPRLERATRPHLGY

SEQ ID NO: 127591 - protein, 118 aa, Glycine max
  Coding DNA Sequence Number=SeqID_35906
MHCRRRRTATTHQADPVGSLGMERYLQHLVRQQAANHRGQVQIHECLYQLSLSQQGQGFAPFACPTPDQFKAEVAWPGDWPEAQAGEAPAGAPGDAEEARMDEEMTDLLGFLGGSGAT

SEQ ID NO: 127592 - protein, 191 aa, Glycine max
  Coding DNA Sequence Number=SeqID_35907
YIMNSIITVLYFNGRVYEDNDGVIFEGSKKVIQIKRGISFNALKKKIGDKVVRCFHAANSVTSCGRNVSHHESELPRNISNLHDDEDDDSNSYVEESFDEDDSDDGISDTDDEVTDIVEPVSIVHPSEGVPQIQNPFWNDAMHYNNINWSHPDEEDICDLDIPTTFNVGQELYVGMDFDSKDAVKNALNNM

SEQ ID NO: 127593 - protein, 105 aa, Glycine max
  Coding DNA Sequence Number=SeqID_35908
MAKKRGFQSLPYSNIPNITNTYRDEEEKLEKQKKKKDSKALSSKAKRKEKEEKDSSKNIVNKENHFATKCDIKRALLLKQSFYLLLSRETSLSTTIPLELELFLK

SEQ ID NO: 127594 - protein, 187 aa, Glycine max
  Coding DNA Sequence Number=SeqID_35909
  Homolog annotation: Hit_ID=A0ST23; Match level="QueryCoverage=14%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPLFQPLTIFPALACKADPRRKKDSHLGQKGKEDIRRNFIGEKDLGIKLIDTVDLEGGPVGKPVVPAALMNRPTRGERRFAYWALAECILAYYVGTDEGVSEVLHVAGEKRLH

SEQ ID NO: 127595 - protein, 80 aa, Glycine max
  Coding DNA Sequence Number=SeqID_35910
GRRQVRQVATTTPERSLEATLEPPTPVVDLPSPESTADPSTPILEIPEDPTTPVLAMDTSPLATQVLYLTDKEDVQTQDT

SEQ ID NO: 127596 - protein, 111 aa, Glycine max
  Coding DNA Sequence Number=SeqID_35911
MCVAGYLARMHAGNGFEKLSAKRSRRDAAAEGTNAAPEHQQCFEAIKGWSFHRERRVQLRDDEYTDFQEEIARRRWTLLVTPMAKFDPDIVLEFHANAWPTEEGVRDMRSW

SEQ ID NO: 127597 - protein, 136 aa, Glycine max
  Coding DNA Sequence Number=SeqID_35912
MTDLHSNLHACHSSCIESEFVLNHMSEFDAESESKFDIDYMSGDVLPFEIDFLESDRTNHVSGSTYTSDFFYEVQAEKLSLSTTIQPPTPELKPQPPTYAYLDDSKSFPVIIFASLVDEQEEKLLSVLKKHKKAIG

SEQ ID NO: 127598 - protein, 89 aa, Glycine max
  Coding DNA Sequence Number=SeqID_35913
MIIKFHDDPTVNGFEIVVFLRQIWWAAGKRKGFERRRGKTKMRPKRRFQLTIQILFITFGSRSTHSISISAGGQQLGCCSQTYIHSPPT

SEQ ID NO: 127599 - protein, 146 aa, Glycine max
  Coding DNA Sequence Number=SeqID_35914
  Gene Ontology: Mol. function=cation transmembrane transporter activity; Cellular component=integral to membrane; Biological process=potassium ion transport
  Homolog annotation: Hit_ID=P0AGJ0; Match level="QueryCoverage=100%, HitCoverage=31%, E-value=3e-72, Identity=97%"; Hit description=Trk system potassium uptake protein trkA (K(+)-uptake protein trkA)
  Pfam annotation: Domain name=TrkA_C; Domain location=71-140; Score =55.6; E_value=1.7e-13; Accession=PF02080.12; Description=TrkA-C domain
MSAMLAKRMGAKKVMVLIQRRAYVDLVQGSVIDIAISPQQATISALLSHVRKADIVGVSSLRRGVAEAIEAVAHGDESTSRVVGRSIDEIKLPPGTIIGAVVRGNDVMIANNNLRIEQGDHVIMFLTDKKFISDVERLFQPSPFFL

SEQ ID NO: 127600 - protein, 61 aa, Glycine max
  Coding DNA Sequence Number=SeqID_35915
MDLTTVINEFDTSNDFKKTVIDYTKAKLHGESKVIQRCFDDNNDDDKGDDKKLKINQEQLK

SEQ ID NO: 127601 - protein, 148 aa, Glycine max
  Coding DNA Sequence Number=SeqID_35916
MPPTRHPLDPDKSNRALGFPALITGLCQSFGVPATPSKVIRPPITRAFIEKYCTPKQAQAPDAPPPPPQADPAGSFDTERYLWHLSQGFPPFPCPTPDQFRAEVAWLGDWPEAQAGEAPAEAPGDADEARMDKEMTDLLDFLGGSGAT

SEQ ID NO: 127602 - protein, 70 aa, Glycine max
  Coding DNA Sequence Number=SeqID_35917
CMRESLDIYSSQDEATTSPSSSESEEAKREESSEEIYPQEDGQPLVVKEKCKEALASIATPLGLEFIPHV

SEQ ID NO: 127603 - protein, 55 aa, Glycine max
  Coding DNA Sequence Number=SeqID_35918
MVMLGNGDITSASSSSSYSSSSESESECDVQPLLAIFFLEGLGNMIRDVVHKEQK

SEQ ID NO: 127604 - protein, 177 aa, Glycine max
  Coding DNA Sequence Number=SeqID_35919
LPSQGAPFEGTIVDDWKFDYSSHDAHCMIDWAHLVMYQMHKALRANAPLPYPQLVTLFLRHFQIPLDDEPFVQVKRSFAIGAGAVTLFGYSKDRDGQWLKKDTLPLQDERTLSPPPQRDDSSALMNEVLSELRGLRTYVGERFDSLDGRFEGMDTRITQLEEDVTYLRRCFDLPPLS

SEQ ID NO: 127605 - protein, 43 aa, Glycine max
  Coding DNA Sequence Number=SeqID_35920
MAEPSKKCKGSSSRIQWHSEAQDTPIPSFISSSSLFSLEEQRI

SEQ ID NO: 127606 - protein, 186 aa, Glycine max
  Coding DNA Sequence Number=SeqID_35921
EEYQDSSNSEEDAENFNLTLRKFGKFLRKSKDKKFFKSSKKVDNSNNNSYTCFECAYIAWEDSASTPCNSLSDEEIANVCLMEKSMNDPSTSEEIEVNFDFEELSEAFNEEAQRLPVLNKMLKSELKLHDNNSTQEELNKMKQENEKLVSECKAITCDYTSNSFNMDDYKFLLAEFENFKKDRPVE

SEQ ID NO: 127607 - protein, 291 aa, Glycine max
  Coding DNA Sequence Number=SeqID_35922
  Homolog annotation: Hit_ID=Q2M404; Match level="QueryCoverage=79%, HitCoverage=27%, E-value=2e-26, Identity=32%"; Hit description=CRN -like CRN9
MISNGICQLQDDGRVIIPFHIIVQVLKRPLNERVGLNQFETALLSSLNSLSLDVGYPFFGIPCWLLWEYFGASFYCIRINSFLVLGISIVSLSDILHGSRFDSGIFNTQVHIRIAEVFQSNEQYGPDMPRMITRKHDSYYSVDWVDGETLQIVLNGENGPGVDIYFILKRAKYSGYIIVLDQRKRLGSDITNSDLTTFRSKLPNPPACLNKFKLDSVFGLMSIYSEININHVPDSTYFVSASDSLYFHGSLYDHPRCSMAIDVNSALKISIKQIFCGTNHEQTDLANKVIE

SEQ ID NO: 127608 - protein, 126 aa, Glycine max
  Coding DNA Sequence Number=SeqID_35923
  Subcellular localization annotation: CTP_CleavageSite=50; ConfidenceScore=5.38e-01
IWPELFGRFPRITHPFATLFSTVPTSWARQATFTLGASFPSAQLPENNVRLACVKHIASVPSEPGSNSYFEYDWALQWANHTSTQNAEDPQTRSYTRFHGIHQDTGLIVLAGYWTRLYWQYRNMPR

SEQ ID NO: 127609 - protein, 89 aa, Glycine max
  Coding DNA Sequence Number=SeqID_35924
  Subcellular localization annotation: CTP_CleavageSite=77; ConfidenceScore=5.16e-01
MVKVGTSYVPINVSFSPKVGPGLPGINRDTRIYFFLRSDLPSQWLLFLSAVPPVQLLTGVVRNGKSTAGHQRWQSVAVTAARNHHTRRA

SEQ ID NO: 127610 - protein, 172 aa, Glycine max
  Coding DNA Sequence Number=SeqID_35925
  Pfam annotation: Domain name=G-patch; Domain location=43-82; Score =22.6; E_value=0.00035; Accession=PF01585.14; Description=G-patch domain
MPDVEAAEESLETAFQSFEVVSISSVDSFSGQACLSDAAVMMARVMLGNGYEPGMGLGKDNGDITSLINAKGNRGKYGLGYKPTQADMKRSIAGRKSGGQSSQLRQESEGSPPCHISRSFISAGLGDEGQVVAIYEDDVLSTLDLVRPCPPDFQLGNWRLEERPGIYATSIM

SEQ ID NO: 127611 - protein, 242 aa, Glycine max
  Coding DNA Sequence Number=SeqID_35926
MAKFDPDIVLEFYANAWPTEEGVRDMRSWVRGQWIPFDADAISQFLGYPLVLEEGQECEYGQRRNRSDGFDEEAIAQLLCIPGQDFARTAAGRRVRIMRTNMTTLTQIWMTLLLSNILPSDHNSGPPSAEVSAGMAPTRHPRPGSVQRALGFPALIIGLCQSFGVPVAPSKVIRPPITRAFIEKYCTQRQAQGDARRPQTRRHLIRLAQLDHLIRSSIYGIWFASRRPTTGRMYRPMIVFTS

SEQ ID NO: 127612 - protein, 57 aa, Glycine max
  Coding DNA Sequence Number=SeqID_35927
MGAYAKDEELLIHSFQENLTGVAVTWMQQQNMCKKGHRSLKEYAQRRSDLAAQVAPQ

SEQ ID NO: 127613 - protein, 109 aa, Glycine max
  Coding DNA Sequence Number=SeqID_35928
ITPTRHLVDPKKSNRAPGFPALVMGLCPSYRAPVPPASSCHRDIGITPARHSVDLEKSNRVLGFLALIMGLCQFYGVPVTRSKVIKPPTNRAFIKKYCVPKQAQGETPQ

SEQ ID NO: 127614 - protein, 134 aa, Glycine max
  Coding DNA Sequence Number=SeqID_35929
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=41%, HitCoverage=70%, E-value=4e-11, Identity=55%"; Hit description=LacZ protein
MHIGGIKNHSRRVRLRPHPLLHVCLVLTFGIELHIYRSASNSCSPGDPLVLERPPPRWSSNSPYTHPPFASWRNSEEARTDRPSQQLRSLNGEWDAPCSGALSAAGVVVTRSVTATLASADVRRCFCRYAPPRQ

SEQ ID NO: 127615 - protein, 83 aa, Glycine max
  Coding DNA Sequence Number=SeqID_35930
  Homolog annotation: Hit_ID=A7P146; Match level="QueryCoverage=96%, HitCoverage=18%, E-value=4e-10, Identity=39%"; Hit description =Chromosome chr19 scaffold_4, whole genome shotgun sequence
MKLGWNLVTGLERFLSSSKNENDPSKVDYSLKFDLRGYPQIFGYEGDTIRFGVDSWNGLALEMLDLRSYFFIFLGQKMDIGNT

SEQ ID NO: 127616 - protein, 132 aa, Glycine max
  Coding DNA Sequence Number=SeqID_35931
  Homolog annotation: Hit_ID=A2Q1D6; Match level="QueryCoverage=62%, HitCoverage=13%, E-value=1e-10, Identity=43%"; Hit description =Ovarian tumour, otubain, related
MDEDQWRYDFAMSQEVHMDYDYDNQEECGVNEPHVDCSNAFNTSQVFATRDNVLQWARTVAHENGFVALIMRSDTETGSRGRSSFVLIGCERSGTYKCRNKEFVRKDTGSRKCGCPFRLSWETSCMEGKVGW

SEQ ID NO: 127617 - protein, 21 aa, Glycine max
  Coding DNA Sequence Number=SeqID_35932
MVKVGTSYIKLIDTVDLEGGP

SEQ ID NO: 127618 - protein, 100 aa, Glycine max
  Coding DNA Sequence Number=SeqID_35933
MTKARQKGVWKENEGDACHPARPGEQGGFLHKQPPSRGIFWRDQVGLNLADYIIIPFLTYGMLRNVTNCATMLSFEFRHVTELHELPNDGCQVPQNGTVK

SEQ ID NO: 127619 - protein, 133 aa, Glycine max
  Coding DNA Sequence Number=SeqID_35934
MVVVVGKEALHLSAFQRVYHQLLGMPASVAYSQGSKSARLKCAPPWFERYVPDRLGFSMSIGVELLRFSSGIWDQALAYDTGTGGIYRFSRCKIHFLVGALGMAFVDNWVVGKEEVCYWLSNDIVGLVGNLAV

SEQ ID NO: 127620 - protein, 97 aa, Glycine max
  Coding DNA Sequence Number=SeqID_35935
MERSMIDAASGGALGDMTPVEARNLIEKMASNSQQFCARNDAIVLRGVHEVATDSSSSAENKKLEGKLDTLVNLITIQIFVLLCSNRESMNNLKLML

SEQ ID NO: 127621 - protein, 213 aa, Glycine max
  Coding DNA Sequence Number=SeqID_35936
  Homolog annotation: Hit_ID=Q5XM22; Match level="QueryCoverage=51%, HitCoverage=78%, E-value=9e-33, Identity=57%"; Hit description =Resistance-like protein HAAS-2
ERPDLKLVSHGRKVALIGRPVPEIEGLVAATGLSPLIDCSVIYWRSWTDIRIRGEVGTRLAQFPCSFYGGGQIFSNRVARGVCRGGQSRDNTHTWGISRAYLLHLVGCALFANKSATYVHVVHLDAFRDLAQSGGYAWGVAALVHIYDQLDEACRITTRQLAGYLTLLQIYEHFPSVHQCVTDDTYQETSPRASRWLTSKAHMNRIPAARGIH

SEQ ID NO: 127622 - protein, 41 aa, Glycine max
  Coding DNA Sequence Number=SeqID_35937
MSKRLQEDWARAAEEGPRVLMNLRVGYPRNIGFSALVFLGT

SEQ ID NO: 127623 - protein, 37 aa, Glycine max
  Coding DNA Sequence Number=SeqID_35938
STVSISLIRQVIRRPAKDVKEALLGGNLVPFESMLVI

SEQ ID NO: 127624 - protein, 61 aa, Glycine max
  Coding DNA Sequence Number=SeqID_35939
MSACYWALSLQIANETFSLSRSEDVDILGKANETLSQSRLEDANISGKGVGDDVSHFAIGL

SEQ ID NO: 127625 - protein, 45 aa, Glycine max
  Coding DNA Sequence Number=SeqID_35940
MLCLNRVCENKNNRETRLAIPKDLDSALAIPKDLVLVEAEVNIHM

SEQ ID NO: 127626 - protein, 179 aa, Glycine max
  Coding DNA Sequence Number=SeqID_35941
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=48%, HitCoverage=72%, E-value=1e-24, Identity=68%"; Hit description=LacZ protein
MKEKKMSMTCDASSIGACRPRIFFINGFLCFLEDEWQRNGERERERRRHFKEKMTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 127627 - protein, 117 aa, Glycine max
  Coding DNA Sequence Number=SeqID_35942
MLFNGNGPEEACLKRSRKDKALRNQFRSEYDNHHFRSAEHQQRFEAIKGWSFLRERRAQLRDDEYTDFQEEIVHRAAGHHWVNPMVKFDPDIVLEFYANAWPTEEGVRDMRSWVRGQ

SEQ ID NO: 127628 - protein, 242 aa, Glycine max
  Coding DNA Sequence Number=SeqID_35943
ESPLRKDKELRGIRNGIIGGYHEWLRVHTRGLDWLSKLKIINEENFEAPEEDEEVQALKTELGKARLAKEKFKLVATDIRKECVELREENAATARALERETKRTRKEEHGRDKFQGALWGSNNELKLRREERDQSRVHGMVLKEELAACSRSKRSLVRHLEATEQSMLAIIGQYKEELNQSLTHEQKLVEDFAQAYAEKEARGRVIDALHQEVTMWMDRFALTLNGSQDLPRLLAKAKAIAE

SEQ ID NO: 127629 - protein, 151 aa, Glycine max
  Coding DNA Sequence Number=SeqID_35944
MHSQGLALPPEPKVGPSGARVSTKESCVAPSGNDPETSDSDKYGLYIEENPSRLVALGRLYEGSTAVHNVPLLHGQVKVGVEEVKDAEAFVPIPTDEATVSPEKPPESPDHEVDDPLYLMTLTIPQLFLKPLQVMWDATMFGCLIKISRYT

SEQ ID NO: 127630 - protein, 387 aa, Glycine max
  Coding DNA Sequence Number=SeqID_35945
  Gene Ontology: Mol. function=2,5-didehydrogluconate reductase activity; Cellular component=cytoplasm; Biological process=L -ascorbic acid biosynthetic process
  Homolog annotation: Hit_ID=A8GA70; Match level="QueryCoverage=56%, HitCoverage=82%, E-value=1e-102, Identity=87%"; Hit description =Aldo/keto reductase
  Pfam annotation: Domain name=Aldo_ket_red; Domain location=1-215; Score=182.2; E_value=1.4e-51; Accession=PF00248.12; Description =Aldoketo reductase family
IYENEAAVGQAIAASGVPRDELFITTKIWIANLTKGALIPSLRDSLAKLQTPYVDLTLIHWPSPNDEVPVAEFMAELLEAKRLGLTRQIGVSNFTIDLMQQAIDAVGADQIATNQIELSPFLQNEKVVAFARQHGIAITSYMTLAYGKALQDETIKSIAARHNATPAQVVLAWALKLGYAVIPSSTKRENLESNLLAQQLTLSDEDMAQIAALESNGRLPLADKIDKAAQAVTDSAIAVVHRVDRHFEWQRVSYQKGNQVPAFDVFITHKVRQAGDAVAVQAQVALGFTAVGGQPRNDLQLSTIGTGQRPAVQIGQIVKADAAMVLQVGYRLWRAILRQVGGGGQDASIAGHQLARFQRRVRQLADADCDIHFSFDQIDEVFRRDQR

SEQ ID NO: 127631 - protein, 30 aa, Glycine max
  Coding DNA Sequence Number=SeqID_35946
IRFIRKGERLSSIGAILMGYPNYLIASAGL

SEQ ID NO: 127632 - protein, 131 aa, Glycine max
  Coding DNA Sequence Number=SeqID_35947
MAPRKLASKRSRKDKAAEGTSSALENDSHRFRSAVHQQRFEAIKGWSFLRERRVQLRDDEYTDFQEEIGRRRWASLVTPMAKFDPDIVLEFYANAWPTEEGVRDMRSWVRGQWIPFDADQAYRYRRPRGGA

SEQ ID NO: 127633 - protein, 119 aa, Glycine max
  Coding DNA Sequence Number=SeqID_35948
MGTVGLAAPGGRVDNDHRCEALRVRFTADREADASEGAGGGGGEDGGGGEADNYQHQEFFMCVCVSFSLCVCVCLCVYVCVAMCPFADERGEAHGCAFQRRKRCAESPPMFICGKHREN

SEQ ID NO: 127634 - protein, 108 aa, Glycine max
  Coding DNA Sequence Number=SeqID_35949
MEADIPIGWKPLNLEWDDRTTDPDEHLDAFLTQGNLYTNDNAILCCVFPMFLKGVALTWRISTRRYPSSYLGPVLPGRGWTTTKHEQDLKDTKRISIGITMRIEEETK

SEQ ID NO: 127635 - protein, 105 aa, Glycine max
  Coding DNA Sequence Number=SeqID_35950
MKKILGLQAPMELASISMALYSVSALLVATMFCVLALVTKLPHTRGKSGYPSQKILREPKSEPQIRQNIPLGVIGAIVDPALIAGKSIVPKPPTQVFISLIQKIL

SEQ ID NO: 127636 - protein, 132 aa, Glycine max
  Coding DNA Sequence Number=SeqID_35951
MPISPCGSINWSVSFRRRDRATRHPVGPGEVQQGPGVSSSRIAPARHPVDPKKSNKVLEFPTLITGLCQFYGVPVAPSKVIRPPTNRAFIKKYCTPKQAQGETPQQPGDGRQWATDAPPPPLEFTSAHPQKG

SEQ ID NO: 127637 - protein, 156 aa, Glycine max
  Coding DNA Sequence Number=SeqID_35952
MLVRMVRTLLFVAARVKSCPSMHSSCVIASLSGCARIVGPPPISGGVDGAHLKVRTRSPLKVRACSPTVRGRVVLSSPLMARACNPLKVRTCSPLMARACSPLKVRTRSPLMARACSPLKSSEDQGTSTRGSILMRKQEIDSSREPVIPNSKDLDI

SEQ ID NO: 127638 - protein, 117 aa, Glycine max
  Coding DNA Sequence Number=SeqID_35953
  Subcellular localization annotation: CTP_CleavageSite=62; ConfidenceScore=5.18e-01
MVKVGNLLRADQRLIFAKKLAQGFPVSTGTPGFIYSAKVIFRHSGFCFLSAVPPVQLLTGVVRNGKSTAGHQRWQAAQLLGRAIGAGLFAITPAGERGMCCKAIKLGNASVFPVTTL

SEQ ID NO: 127639 - protein, 256 aa, Glycine max
  Coding DNA Sequence Number=SeqID_35954
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMRVSAGIEELLQAEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127640 - protein, 278 aa, Glycine max
  Coding DNA Sequence Number=SeqID_35955
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIDSIRNVSCSGSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127641 - protein, 211 aa, Glycine max
  Coding DNA Sequence Number=SeqID_35956
MSLSEELGDYYEGRHKSHLRPHSHRREKERKPQEANINLPYFHGKDNVEANLDWEIRVEQQLKRKSTSKYYGSYSYLKKDQGQGILGVTPSKPEDDTGKTIENQPLKASMQEKTSSTKCFKCLGRWHITSQFPNKKTMIMRGQDIYSSQDEATTSPSSSESEEVKGEQSSEKIYPQEEGQPLMVKEECKEVSVSSKRLAKKDRIPAARGIH

SEQ ID NO: 127642 - protein, 396 aa, Glycine max
  Coding DNA Sequence Number=SeqID_35957
  Gene Ontology: Mol. function=transcription factor activity; Cellular component=cyanelle; Biological process=regulation of transcription, DNA-dependent
  Homolog annotation: Hit_ID=A8GJY7; Match level="QueryCoverage=75%, HitCoverage=99%, E-value=1e-159, Identity=97%"; Hit description =Transcriptional regulator, LysR family
  Pfam annotation: Domain name=HTH_1; Domain location=9-68; Score=61.4; E_value=3e-15; Accession=PF00126.18; Description=Bacterial regulatory helix-turn-helix protein, lysR family
  Pfam annotation: Domain name=LysR_substrate; Domain location=92-296; Score=60.4; E_value=6.2e-15; Accession=PF03466.11; Description=LysR substrate binding domain
  Pfam module annotation: Pfam domain module=HTH_1::LysR_substrate; Domain location=9-68::92-296
MARDRALTLEALRVMDAIDRRGSFAAAADELGRVPSALSYTMQKLEEELDVVLFDRSGHRTKFTNVGRMLLERGRVLLEAADKLTTDAEALARGWETHLTIVSEALSPPSLLFPLVDKLALKANTQVSIFTEVLAGAWERLEQGRADIVIAPDMHFRASSEINTRKLYKVMSVYVAAPDHPIHQEPEPLSEVTRVKYRGIAVADTARERPVLTVQLLDKQQRLTVSTIEDKRLALLAGLGVATMPYPMVEKDIEAGRLRVVGPEYSREADIIMAWRRDSMGEAKAWFLREIPRLFAQPEALVAAVRLVQILRRPDGNDAVRVDGGVAAVVVVANVRQADRLGDARHLVDVAQETVQVQVVADAVFVALEVGDVHRIEAHQRGPQAQVGFGQPIAGQ

SEQ ID NO: 127643 - protein, 193 aa, Glycine max
  Coding DNA Sequence Number=SeqID_35958
MGEVEEIQEKMKADMEAIKEKMATMMEVMMSVKKIIGSHAVAIAATSVVAKAKIWEVRAAPMMCKFKTSTPSRHMACLPNYTPPNVAYIPNEDVKNSTSILIKSQQPQSDHAHVSRPMEETHGMPHHNLADFEPCLGYATEGQAVGGIPLQNTLEGPQCHPQPQPSRSTAVKNPHDYGRNGKVGSSRGKAQGH

SEQ ID NO: 127644 - protein, 356 aa, Glycine max
  Coding DNA Sequence Number=SeqID_35959
VARLICRRGGKLVASLVNIALRTPAPVAIAVYGDATHFGGRLIINAVINNNHVVCRTGAAEYRTRIVRRFAIGNRAGYLAHAVGDGRCIRRGRCVGINGDGHRLGRGAFIARAILVGDGEGDVIGAVIQRGRWRPAPVAVAAYRDLINFDAADIDSDGITRLPGAAQRWGGIAGHFSRIQRDLGSAAVRIDGYGRGIRRSRRDGVHHQLERIGDGGVPGGIRGMDGDRMRAIGERSRWCKAPAAIAVEVSGTEQGIAVIDGDNGTRWRAALQLRQGVIRGIATAERALHVAHAIGHGGDGRGRRRRDIDGKAPCAVAVGDRRANAVTVQTNGNRRARFGGTVERRGRVVGGFTHVK

SEQ ID NO: 127645 - protein, 349 aa, Glycine max
  Coding DNA Sequence Number=SeqID_35960
  Gene Ontology: Mol. function=transferase activity, transferring phosphorus-containing groups; Cellular component=cytoplasm; Biological process=phosphorylation
  Homolog annotation: Hit_ID=A1FRW7; Match level="QueryCoverage=99%, HitCoverage=40%, E-value=0.0, Identity=99%"; Hit description =Phosphoenolpyruvate synthase
  Pfam annotation: Domain name=PEP-utilizers_C; Domain location=19-347; Score=217.3; E_value=3.6e-62; Accession=PF02896.9; Description=PEP -utilising enzyme, TIM barrel domain
MAQQVTVSCAEGDTGFIYEGKLGFERTTTDLGHMPPAPLKIMMNVANPERAFDFGQLPNAGIGLARLEMIIASHIGIHPNALLEYDRQDAATKKKIDEKIAGYGDPVSFYVDRLAEGIATLTASVAPNPVIVRLSDFKSNEYANLIGGSNYEPHEENPMIGFRGASRYVDPSFSAAFALECKAVLRVRNEMGLDNLWVMIPFVRTLEEGRKVIEVLEQNGLKQGENGLKIIMMCEVPSNALLADEFLEIFDGFSIGSNDLTQLSLGLDRDSSIVAHLFDERNPAVKKLLSMAIKAARAKGKYVGICGQGPSDHPDLAEWLMQEGIESVSLNPDTVVDTWLRLAKLKANG

SEQ ID NO: 127646 - protein, 95 aa, Glycine max
  Coding DNA Sequence Number=SeqID_35961
MRLPGKESLLMGSLSYPNFVRGPLLDDVRPFFGPREHPGPFGPSRRFLQKAVAFWRKQPCSPGRAELAWASWAATTFLYFAINRGGKQEERGPAP

SEQ ID NO: 127647 - protein, 182 aa, Glycine max
  Coding DNA Sequence Number=SeqID_35962
  Subcellular localization annotation: CTP_CleavageSite=40; ConfidenceScore=5.16e-01
MEKGNVGENRGGPIRSYSSSRTVTWDLGNKGTTAKTRETNSSSESNSVKSTGAYRGRPFSRLSNAEFQERVEKGLCYRCDGKFGLGHICPNNQFQDLILGEGQDGEDEKEEGARNEKQLQIVKQQQIPITPTKPYTVEVGDGRKIRCEGVCKNFKLQIQGMEIQQDLFVFEMTGVDVVLGME

SEQ ID NO: 127648 - protein, 80 aa, Glycine max
  Coding DNA Sequence Number=SeqID_35963
MVMEEQEENVGEEGEEAGNFWRKEREEKSGPFWMLKSCLDLHVVSPILVLRVSLHPSGPVFKGRQYIYQNAQNEVLSVIQ

SEQ ID NO: 127649 - protein, 51 aa, Glycine max
  Coding DNA Sequence Number=SeqID_35964
LSLAHQWAKHASTAKCSFSTLSTTEESGKALISRPRAKHEISALSATVVLR

SEQ ID NO: 127650 - protein, 50 aa, Glycine max
  Coding DNA Sequence Number=SeqID_35965
MGDTQSYLYLCYCVFLLPDHTLHLLASFPCTDIIQMIALSRPCRAKRVHP

SEQ ID NO: 127651 - protein, 140 aa, Glycine max
  Coding DNA Sequence Number=SeqID_35966
MELLFLREGLREEQRTSIVRFLSGLNMCHTLMSSGDHRLMSCNLRLTALRVASGGSNPARMGELGGNLLPLFPINRRKGAVPNIPQPPGYAFQLFLGEKNCFREENPSRGASLTLPRRFRERIREGFPSFFTVLHPFFVL

SEQ ID NO: 127652 - protein, 73 aa, Glycine max
  Coding DNA Sequence Number=SeqID_35967
MERYLPSKGVGGLGIKDISSFNAALLGRWLWALASTQDQLWARILISKYGGWADLNNGSDTPWHSHWWKDIRK

SEQ ID NO: 127653 - protein, 347 aa, Glycine max
  Coding DNA Sequence Number=SeqID_35968
  Gene Ontology: Mol. function=aminoacyl-tRNA ligase activity; Cellular component=cytoplasm; Biological process=tRNA aminoacylation for protein translation
  Homolog annotation: Hit_ID=Q6D7L6; Match level="QueryCoverage=100%, HitCoverage=40%, E-value=0.0, Identity=87%"; Hit description=Leucyl -tRNA synthetase
MATMEKKGMATGLHAIHPLTGEEIPVWVANFVLMEYGTGAVMAVPGHDQRDWEFATKYDLNIKPVVLNLDGTAPDISAAAMTEKGTLFNSGEFDGLDHDAGFNAIADALAAKGVGVRKVNYRLRDWGVSRQRYWGAPIPMVTLEDGTVMPTPEDQLPVILPEDVVMDGITSPIKADPEWAKTTVNGQPALRETDTFDTFMESSWYYARYTCANYNEGMLDPAAANYWLPVDQYVGGIEHAIMHLMYFRFYHKLLRDAGLVNSDEPAKRLLCQGMVLADAFYYVGANGERNWVSPVDVNVERDEKGRITKAIDNQGREVIYAGMSKMSKSKNNGIDPQLMVERYGADT

SEQ ID NO: 127654 - protein, 64 aa, Glycine max
  Coding DNA Sequence Number=SeqID_35969
SQPEDADICGKGAPRRLLPIANETFSQSRPEDADTSKKGAGDDIANETFSQSRPEDADISGKGA

SEQ ID NO: 127655 - protein, 159 aa, Glycine max
  Coding DNA Sequence Number=SeqID_35970
MDPRARSGPLDASPKTEIRSWWTLGDSVGRRGYVGKLPLLGTICRGSARIIGNSFPILRGGTVMSPEWVWARTATGMPMWGMSPGNLEEGMHHQDSGQIGHGPDHVSQCFTNVGIMFEEEVGGNRRRSSTRSAEFRATVPSQFPTGELARDEPVGSLYR

SEQ ID NO: 127656 - protein, 110 aa, Glycine max
  Coding DNA Sequence Number=SeqID_35971
  Pfam annotation: Domain name=zf-CCHC; Domain location=8-25; Score =23.8; E_value=0.00038; Accession=PF00098.14; Description=Zinc knuckle
TEESSQIPKCFECNQPRHLRADCPIFKRKIEKFEKKTIGDKKAKKAYITWEDNNLELFDDSQKEMINLCLMGKNYESDEEVSQHALLRASEARLTGALSKGGKMRGVATN

SEQ ID NO: 127657 - protein, 88 aa, Glycine max
  Coding DNA Sequence Number=SeqID_35972
MSAQVFLGSFVSAISWRAKSLIATSWVGDPSCCFGFWVDDPNWVGDPDFEGEIFFEDGSGRANLNPFPELLPPRKEVLDALGDMTIFL

SEQ ID NO: 127658 - protein, 73 aa, Glycine max
  Coding DNA Sequence Number=SeqID_35973
MNPSSFKNIWDILIRVLDAQAFIRMCKIRMLKIIMLKIRMFKITNNENAQIRQLWNAQNDQKDQRVVSQMDCL

SEQ ID NO: 127659 - protein, 203 aa, Glycine max
  Coding DNA Sequence Number=SeqID_35974
  Subcellular localization annotation: CTP_CleavageSite=73; ConfidenceScore=5.18e-01
MARPPPSNRNNDLPNMEGQPTQTSVSNANINSGIGPIPDQTVGTISSTASTVMNQTGVTSPMTNMTLASSTTSASAFAPWNNPSLGNPSGSPFRPPQNPLYGMPTSLMVGLQNSQPNIENLNMSSPSGSVAGNQGRAPVQEIQMPNNPGMQMAQAPQPAARIEPPVQQVEPNPGIVLTVLPRGVKSLSLPLSGRDNESTVDTC

SEQ ID NO: 127660 - protein, 80 aa, Glycine max
  Coding DNA Sequence Number=SeqID_35975
  Homolog annotation: Hit_ID=A5AZI7; Match level="QueryCoverage=73%, HitCoverage=15%, E-value=3e-15, Identity=57%"; Hit description =Putative uncharacterized protein
MVLDNPMIEVPQAVESDNVDQVALYLQESDYNIGAENDPETFSQAMSSKESNLWYNAMRDEMVILWHLTKFGISLSYLLV

SEQ ID NO: 127661 - protein, 74 aa, Glycine max
  Coding DNA Sequence Number=SeqID_35976
GQQVRWWVKIPYGHLRLSSTEGNEFGSFSLSSSENIKVQRRVEFFSVGQRRLGAMAKGSVVVVQLCRFQNTEVY

SEQ ID NO: 127662 - protein, 30 aa, Glycine max
  Coding DNA Sequence Number=SeqID_35977
MAFGNHHRLITEEAKCLIFTFLPSPIKAFA

SEQ ID NO: 127663 - protein, 50 aa, Glycine max
  Coding DNA Sequence Number=SeqID_35978
MEEIHGENDEKQGIKALDLLHQWSILLLEDQWQWNREGGKVIGDATSRRG

SEQ ID NO: 127664 - protein, 137 aa, Glycine max
  Coding DNA Sequence Number=SeqID_35979
  Homolog annotation: Hit_ID=A5B472; Match level="QueryCoverage=37%, HitCoverage=20%, E-value=6e-07, Identity=58%"; Hit description =Ubiquitin carrier protein
  Subcellular localization annotation: CTP_CleavageSite=91; ConfidenceScore=5.03e-01
PQDFEEILAKWAFLSRGLSKPKPKFKSGAISESTTALNVDQTNTSVISGDIKTTPASAALPVPVLATTTTRGNNQEQAAAVNGSSAATVISAASAPPKKEGGQAKAQADKKKIDARKKREGVGMWSPGFNICFIKRV

SEQ ID NO: 127665 - protein, 128 aa, Glycine max
  Coding DNA Sequence Number=SeqID_35980
MAKKERRRYSPFKSPHHQMQERKRKEEDSDDEEDFFFSLLRNFKNSSRKEELTGVRTSIMDENHKMILKSLGVTNATKLVTSRPTVLQMKNGQRKVKRKDLMKEELRKHTLHGMTMIHSMVQKRRLIF

SEQ ID NO: 127666 - protein, 34 aa, Glycine max
  Coding DNA Sequence Number=SeqID_35981
DLAGLRVEEVVASSEDRRVLWIREENRIDTGLMP

SEQ ID NO: 127667 - protein, 38 aa, Glycine max
  Coding DNA Sequence Number=SeqID_35982
RGTSETFPKRFRNIFREEFREGFRPFFDVLHSFFDLQQ

SEQ ID NO: 127668 - protein, 187 aa, Glycine max
  Coding DNA Sequence Number=SeqID_35983
MQMADRGRGSGRRTFNRGTRRDTHSLRAPITANPSPSSIHISTSESMIHVVAQTPNTLPTAQDQPNPTFVRESIPTTPVRDASPSAPDDSVTPEYPTNPNYEHIVNERPFIRAYKGEFQPTYGCCNIISNVIRAKFDELAPSWLNVSVDLRDRWFGEFKKEYRWHPQEERAIRAVFETKGSCILKVQ

SEQ ID NO: 127669 - protein, 68 aa, Glycine max
  Coding DNA Sequence Number=SeqID_35984
MEEGIGLILDLTPKEEKMIECFKRLKNSLLAITLVKREKFHWLPLASKGMPFIGGLPFLRKEGFMGIF

SEQ ID NO: 127670 - protein, 217 aa, Glycine max
  Coding DNA Sequence Number=SeqID_35985
MDEKRNTREHQAEFTENSSLSVNPPSPVSGHVKWKMARTKRYGQMTSTATQEISDKIDFVSHGHDDILNTAIGRVRVARTGVTISQYFGQASRGSNTSSASITRQQMAEIISNLKEESRKQSTQLVALEKVYDSSSTIHNVPYADDVVRDSPKHLPKPVGYAEMDNVVATVDPLGELVKNLFDVYQKPIELSWDGSKFGIPNVKDGFFITRVDVKLR

SEQ ID NO: 127671 - protein, 229 aa, Glycine max
  Coding DNA Sequence Number=SeqID_35986
  Subcellular localization annotation: CTP_CleavageSite=48; ConfidenceScore=5.93e-01
MGSPPGSTTPPPSPPPPPPPPPSPPSPPRPPPTLDASASTSAVKRTRKASRLRSLSTRPPGVERPVVHVDPATGKADGPHKKKLRTYLGIVARDKVDITYENWKEVPTAQKDLIWEDIQPIRTVSRTLSVTKYGISKEKWAQFARLAETLLGRMCASEGTGHPEAEYCPPRLSRGVYDYLEQKLLAEKTKKKLEEAAQSRSIDGVIDPSSSVRRHVKWKMTRTKEDRGL

SEQ ID NO: 127672 - protein, 188 aa, Glycine max
  Coding DNA Sequence Number=SeqID_35987
  Homolog annotation: Hit_ID=A7MRE2; Match level="QueryCoverage=92%, HitCoverage=17%, E-value=9e-12, Identity=31%"; Hit description =Putative uncharacterized protein
  Subcellular localization annotation: CTP_CleavageSite=81; ConfidenceScore=5.30e-01
MNASLTAGRIYAWLITAAFFWGITPSASALSNGCATVNALSGSTSLSYSANRYPASDFTAGDALTLSFTDSGSAVGGTPMNADSLSVARFDLSNAQTYNAVNSTTTSSHTVTITVPSGSLEANGLAVRVTTSHGQISNLVFNCTSATSSSSDATLSGLSLSAGALSPSFSAATSNYSASVAFDVSSVT

SEQ ID NO: 127673 - protein, 126 aa, Glycine max
  Coding DNA Sequence Number=SeqID_35988
  Homolog annotation: Hit_ID=Q2PEW8; Match level="QueryCoverage=77%, HitCoverage=26%, E-value=8e-24, Identity=50%"; Hit description =Putative uncharacterized protein
  Pfam annotation: Domain name=SURNod19; Domain location=1-126; Score= -226.2; E_value=0.036; Accession=PF07712.3; Description=Stress up -regulated Nod 19
MQANRGFSRFKENGRVYHSSWWWGDSPHVQKANIPMENGGYLIYGTAHMHFRMEGLYVHQHQKYGTGKKAGNEKGYLIGMSVCYPQPGSIKIHDGEILTLESRYKNEFRTGAMGHFYIYLAEELPQ

SEQ ID NO: 127674 - protein, 86 aa, Glycine max
  Coding DNA Sequence Number=SeqID_35989
  Pfam annotation: Domain name=zf-CCHC; Domain location=14-31; Score =24.6; E_value=0.00029; Accession=PF00098.14; Description=Zinc knuckle
MKHQSKGEDSSLAPKCYECDQPGHMRFNCPIFKRIMEKSDKRNFKEKKEKKTYITWEDNDMDSSSDSENEIINLGLMAKDYESGEE

SEQ ID NO: 127675 - protein, 305 aa, Glycine max
  Coding DNA Sequence Number=SeqID_35990
  Homolog annotation: Hit_ID=Q2HW90; Match level="QueryCoverage=50%, HitCoverage=37%, E-value=6e-12, Identity=27%"; Hit description =Putative uncharacterized protein
MGQLQRQAFRKAYGKIWDLARVEVSMEPIASLSQYYDQPLRCFTFEDFQLVPTMKEFEEILGCPLGGRKPYLFSGFYPSTTRVAKVVKISAQELDRVKQNRNGVVGVPRKCVLFPNMEGLVDLAVIDAFLAFHHGKESPVVTILAMHDTFDQRCEKSGARIVCLYTGSLCVAGFTPFSPRRILSSCEGCPMRGVPSDESIMPFIARGFSDPNARDRELRGSSNGSIGGYHKWLRVRTQGLDWLPNLKTVRDDEVKASEESDEVQALKAELERAWVVEEKFKAAIVSSSSEEVKGIITGQRHDLEG

SEQ ID NO: 127676 - protein, 34 aa, Glycine max
  Coding DNA Sequence Number=SeqID_35991
MIVLMMEFKIHFGVMLSIITISIGVILMRRTFVI

SEQ ID NO: 127677 - protein, 209 aa, Glycine max
  Coding DNA Sequence Number=SeqID_35992
  Subcellular localization annotation: CTP_CleavageSite=51; ConfidenceScore=5.61e-01
MPSPFKGLHVLAFRGLHSPRLQRTTRPYLQRTTRPPRQKGYMSSPSQGYTPSSSGGYMSSLFRGLHVLAIRGLHVLAFRGLHTLTFRGLQPPRQRVNVLTFIGLHCPHLEKATRPPLQIGTSHVLGPQRATRLHLSEGLHRVAHALTFRGLHVLCLKRATSSLQRVARPRLRRAIRPPFRGLHVFPSKDWTSSPSEGYTPSPLEDCGIL

SEQ ID NO: 127678 - protein, 121 aa, Glycine max
  Coding DNA Sequence Number=SeqID_35993
MTRGNPSNLQPFDPEIDRTFHRLVRHSVHPTFPKHFVPFEHPEHFVTGESVHFVVGDFEHPDFEHSNFEHFDFEHSENMAQPPPRERTLREMAAPDFTYESLCIQYPDEDVPYVLKTGLIH

SEQ ID NO: 127679 - protein, 182 aa, Glycine max
  Coding DNA Sequence Number=SeqID_35994
MAERNSGEHCGVATMSSSSEERKETGHRCDEKDSARGRSDCLLAQILCDGMVSPTYSNKTQDRPLLFKVIKSHAPKVVSNLPQPRGPLRQSRVPHDGERPIEESLSPFLVRDLGAQSLKVIQRVHKAWRSPLRKDKELRGIRNGVIGGYHGWLRVHTRGLDWLSKLKVINEENFEAPEEDEE

SEQ ID NO: 127680 - protein, 77 aa, Glycine max
  Coding DNA Sequence Number=SeqID_35995
MGMTMSSCRMRTIVPVATYPSTGGRRETHGLRVPRKEYARSRHQRLFEESVGKTGKDAIYELLSERFGSCIYARGRC

SEQ ID NO: 127681 - protein, 43 aa, Glycine max
  Coding DNA Sequence Number=SeqID_35996
VRPRSLGKILKLTNDLTTHAYEDQKVFKDCNGAKDKVGKKNME

SEQ ID NO: 127682 - protein, 126 aa, Glycine max
  Coding DNA Sequence Number=SeqID_35997
  Homolog annotation: Hit_ID=A5BX59; Match level="QueryCoverage=97%, HitCoverage=52%, E-value=9e-12, Identity=33%"; Hit description =Putative uncharacterized protein
MEIFIQSIDPGAWNAIVKGPFIPTKKVNGELIPKEWDEMRDDEKRKVQDDQKAKNILTSGKTFEDEELNIKILNFLTRTLEPKITTIKESKNLATMTMEALFGKFLAFEHELTQLSYAEEIEKRRK

SEQ ID NO: 127683 - protein, 166 aa, Glycine max
  Coding DNA Sequence Number=SeqID_35998
  Homolog annotation: Hit_ID=A2Q142; Match level="QueryCoverage=81%, HitCoverage=53%, E-value=2e-14, Identity=29%"; Hit description =Ovarian tumour, otubain
QGLCETEVTIKEEIEVISKRFDELDVAGKVNLKSKLREIAYPDHNSMCPPPSKVNTKGAPKKPMKRSQTSTKRDPSYWEYVDAFHSVQSSNSPGFIRDVVDVKADGNCGYRSIGALLGMGEDSWPLVRNELLKELGRWSHEYMNLFGGTERFEQLRLSQHVDGLSK

SEQ ID NO: 127684 - protein, 52 aa, Glycine max
  Coding DNA Sequence Number=SeqID_35999
  Subcellular localization annotation: CTP_CleavageSite=27; ConfidenceScore=5.32e-01
MKGTMHKPQANLRADQKFSPSRFPATRSSRKTTIGTSKPYTGAMRGIVHEPQ

SEQ ID NO: 127685 - protein, 311 aa, Glycine max
  Coding DNA Sequence Number=SeqID_36000
MAKFDLEIVLEFYANAWPTEEGVRDMRSWVRGQWIPFDADAIGQLLGYPLVLEEGQECEYGQRRNRSDGFDEEAIAQLLCIPGQDFARTSARRRVRIMRTNMTTLTQIWMTLLLSNILPTDHNSDLPLPKCQLVYAILTQMSIHVAQLIADAIYIFAGLCQSFGVPVAPTKVIRPPITQAFIEKYCTQRQAQEDAPQAADAPPPHQAGQAGSFDIEQYLWNLVRQQAANHRAHVQTHDCLYQLSLSMQSQGFASFSCPTPDQFRAEVAWPGDWPEAQAGEAPPEAPDDGEEAHEDEEMADLLDFLGGSGAT

SEQ ID NO: 127686 - protein, 38 aa, Glycine max
  Coding DNA Sequence Number=SeqID_36001
PSAPPSEPEQPIVQDPPATLVLDLNEHAEDQQQDDQEF

SEQ ID NO: 127687 - protein, 210 aa, Glycine max
  Coding DNA Sequence Number=SeqID_36002
  Homolog annotation: Hit_ID=Q84VI1; Match level="QueryCoverage=94%, HitCoverage=32%, E-value=1e-75, Identity=68%"; Hit description =Envelope-like protein
MAQKKSGPITPATSRRSKVAIPSKKRKEISSSDSDKDVELDVSTSKKAKTSGKKVPGNVPDAPLDNISFHSIGNVEKWKYVYQRRLAVERELGRDALDCKEIMDLIKAAGLLKTVSKLGDCYEGLVREFIVNIPSDISNRKSDDYQKILNVSEHQIAKGNHCPNRVPALAKGKGKLSAGKLSVKYAILHRIGAANWVPTQSYFHCCHRFG

SEQ ID NO: 127688 - protein, 80 aa, Glycine max
  Coding DNA Sequence Number=SeqID_36003
MGKRKLELGFEDQKIDFALFVENKPAPEHNVCLQVMEGEPRAKHIFGHVLNRESQALNTQPLHLRLIWSAKLAKDELRQL

SEQ ID NO: 127689 - protein, 126 aa, Glycine max
  Coding DNA Sequence Number=SeqID_36004
MGEESWSLVCNHLHKELTSWSEEYINPVGCIDKFEELKRSLLVDGLSMVRYYGQVDEYYGYGICHCFTIQRDHCFFYASRNMHWSYVWKSFCTGFFMRPLSFTTIGIVVEYTLSFSGKAVVHPVHR

SEQ ID NO: 127690 - protein, 164 aa, Glycine max
  Coding DNA Sequence Number=SeqID_36005
  Pfam annotation: Domain name=G-patch; Domain location=2-41; Score =25.4; E_value=0.00016; Accession=PF01585.14; Description=G-patch domain
MARVMLGNGYEPGMGLGKDNGGITSLINAKGNRGKYGLGYKPTQADMKRSIAGRKSSGQSSRWRQESEGSPPCHISRSFISAGLGDKGQVVAISEDDVPSTLDLVRPCPPDFQLGNWRVEERPGIYATSIISDDESPEGTNTWDPPIDFEQEMSQTEDEGNEDV

SEQ ID NO: 127691 - protein, 98 aa, Glycine max
  Coding DNA Sequence Number=SeqID_36006
  Pfam annotation: Domain name=zf-CCHC; Domain location=19-36; Score =14.9; E_value=0.0085; Accession=PF00098.14; Description=Zinc knuckle
  Subcellular localization annotation: CTP_CleavageSite=58; ConfidenceScore=5.10e-01
MTIEKYTPKTSSQKRSSNIKCFKFLGRGHIASQCPTKKTMIMRGQDIYSSQEETTSCPSSSGSEDEVRGEESSEEVYPHEEDYCAVSKRLDDLSLGTN

SEQ ID NO: 127692 - protein, 103 aa, Glycine max
  Coding DNA Sequence Number=SeqID_36007
MKIQKKGVPMNPKRIKVIPEWPTPPTPLIELVRNHVPSWEDAQEMGFQTLPYFNIPNTTNTYVFVLFTGVKEKSPEFQKPQDLRSIPFQGGGNDAILPHKGIG

SEQ ID NO: 127693 - protein, 69 aa, Glycine max
  Coding DNA Sequence Number=SeqID_36008
MGARDNSFMHKKNKWEILSWLLLCRCLLILGWCKLAMRPRIPGALCCGHISCIICINNAILLLKDLQNW

SEQ ID NO: 127694 - protein, 84 aa, Glycine max
  Coding DNA Sequence Number=SeqID_36009
  Subcellular localization annotation: CTP_CleavageSite=29; ConfidenceScore=5.46e-01
MHTPGFTIPQFLRIGLTHKKVPSGVANCRSMPFCGRAKARLTGALSKGGKMRGVATNVYLWETSEKPKETGQDENSKFGSCIYA

SEQ ID NO: 127695 - protein, 73 aa, Glycine max
  Coding DNA Sequence Number=SeqID_36010
MQQRIQSQMMILMPPHDHQTFILFAFGACPFEQLIVIADRRCCSELLPSRIFTSQQQEHGDRGSRKLMSREMS

SEQ ID NO: 127696 - protein, 87 aa, Glycine max
  Coding DNA Sequence Number=SeqID_36011
MRGIGFGSILGIIDSLLKVKSKLSPRGMAFQVLERINNNLASQKSDLAIIGGGTIVCAFFKSFQGGGHDEFLPKGHSPEHEQETPKF

SEQ ID NO: 127697 - protein, 190 aa, Glycine max
  Coding DNA Sequence Number=SeqID_36012
  Homolog annotation: Hit_ID=Q6UUU1; Match level="QueryCoverage=31%, HitCoverage=40%, E-value=2e-18, Identity=78%"; Hit description =Putative uncharacterized protein
RVPFAIQAAQLLGRAIGGGLFANRPAGERGTCCKAIKLGNARVFPVKTGANWSSTAVAAALELVDPPGCRNSISKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 127698 - protein, 59 aa, Glycine max
  Coding DNA Sequence Number=SeqID_36013
MKLLRVQHKNNKIKVTTVSFAGCLSYQKPIDFGRWIFVRDGKSVELPMVNPPTPRIAWY

SEQ ID NO: 127699 - protein, 162 aa, Glycine max
  Coding DNA Sequence Number=SeqID_36014
  Homolog annotation: Hit_ID=Q6WAY4; Match level="QueryCoverage=40%, HitCoverage=12%, E-value=2e-08, Identity=46%"; Hit description =Putative uncharacterized protein
MGTNQTSKRFYQVKVKSLDTTSIKELGRLMEPLQMQAFRKTYGKILELTIAEVSIEAIASLTQYYDQPLRCFTFGDFQLVPTIEEFGGNSRIERFGPHKTDSKWHSGPTTEVPRRQGEGVVLFPNMDGLVDLVAIDAFLAYHHSKESSVVAVLADLFDTFDR

SEQ ID NO: 127700 - protein, 352 aa, Glycine max
  Coding DNA Sequence Number=SeqID_36015
  Homolog annotation: Hit_ID=Q8LCM1; Match level="QueryCoverage=94%, HitCoverage=71%, E-value=2e-11, Identity=26%"; Hit description =Glycoprotein homolog
DEGESPVESDETKVQTWSSQHYRNEPVVVVAAPRLQKYSSFDDQSGEKPLLLPIQSFKSRLSKEVIDVQSQNMSMSSKRFSSYSNRKAEVKAVDVDVDVQYLNRNAEVEADGVDTDVQSLNRSTISQGFSSNSNRKAEVIMLSSNTYVIMLSLNTEDSVRKKGFYKSCPPPPPPTMFQKSVFMKPRFDGSSNEAPSFNKELKRSFTSERTTPVGKKSHEENKSMQGTLFRSNKFMGHASVRLMSQPAEKESLLVESDDDDDDDDTETKDQDIEGGRTVAQNNDRGKGPPVIGGESSKTDGDEGPDVDKKANEFIAKFIEQPRLQRIESIKRSARNSSSTTCISKIALGGDYS

SEQ ID NO: 127701 - protein, 76 aa, Glycine max
  Coding DNA Sequence Number=SeqID_36016
MGENGNLYDDKGDDKKLKGQSKNEFNMFKIESRTLQDSRGKLKNTSRFKRKVDFKNQESRFKDQAPRIKIKIQESR

SEQ ID NO: 127702 - protein, 222 aa, Glycine max
  Coding DNA Sequence Number=SeqID_36017
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=A2WTV8; Match level="QueryCoverage=81%, HitCoverage=36%, E-value=1e-63, Identity=60%"; Hit description=ATP synthase subunit beta
  Pfam annotation: Domain name=ATP-synt_ab; Domain location=116-222; Score=-60.4; E_value=0.00078; Accession=PF00006.16; Description=ATP synthase alphabeta family, nucleotide-binding domain
  Pfam annotation: Domain name=ATP-synt_ab_N; Domain location=49-107; Score=9.4; E_value=0.027; Accession=PF02874.14; Description=ATP synthase alphabeta family, beta-barrel domain
  Pfam module annotation: Pfam domain module=ATP-synt_ab::ATP-synt_ab _N; Domain location=116-222::49-107
KHERPRKDRKGWFAVFPVRRWPQLPWSCLSPLCSVWTDEFIGKGAIGQVCQVIGVVVDVKFDEGLPPIMTALEVLDHSLRLVLEVAQHLDTEHYLPIHREAPAFVEQETAQQILVIGIKVVDLLAPYQRGGKIGLFGGAGVGKIVLIMELINNVAKAHGMYVVSLCLLVLESGVIKLDDKQTESKCALVYGQMNEPPGAHARVGLTGLTVGEHFRDIKDAMT

SEQ ID NO: 127703 - protein, 122 aa, Glycine max
  Coding DNA Sequence Number=SeqID_36018
MPISPYGRVTPKGHPVDPEKSNRALGFPARVTGLCQSYRVSVPPARLYQRDIGIVPARHPVDPEKSNRVLGFLALITGLCQFYEVPVAPNKVIRPPINRAFIKKYCALRQAQGEIPQQPGDG

SEQ ID NO: 127704 - protein, 33 aa, Glycine max
  Coding DNA Sequence Number=SeqID_36019
MTLLRRNHSQGNGLGGISGGKKTLFELDSSPTL

SEQ ID NO: 127705 - protein, 101 aa, Glycine max
  Coding DNA Sequence Number=SeqID_36020
VDSRGSHDSLLSYPNFVRGPSVVGMRPSFDHFEDVPPEGGCFWREQPSSPGRVELTWASWVASSSPIFPINRGRNKGEKCSAPSDFQPFFIRSSSFFGLQP

SEQ ID NO: 127706 - protein, 58 aa, Glycine max
  Coding DNA Sequence Number=SeqID_36021
MAFVDNWAVGKEKNTGHVSTITVIISLSVIGGATWAAWSLHLWVYSLKDSCPLFAHVL

SEQ ID NO: 127707 - protein, 206 aa, Glycine max
  Coding DNA Sequence Number=SeqID_36022
  Homolog annotation: Hit_ID=Q6WAY6; Match level="QueryCoverage=76%, HitCoverage=32%, E-value=5e-10, Identity=28%"; Hit description =Putative uncharacterized protein
GVLFPNVDGLVDLAAIDVFLAYHNHKESPLSRWGWFHTFFSKKAGPPIRYKEGRIKILSSCEGCPNVPLMGTRGCINYNPVLTIRQLGYPMRGAPLDESITPFIARGFSDHNARDRELRGSSNGIIGGYHKWLRVRTQGLDWIPNLKTVRDDEVKASEESDEVQALKAELERARVVEEKFKSIAIKGSNSKLKLRRGERNHHGSKA

SEQ ID NO: 127708 - protein, 26 aa, Glycine max
  Coding DNA Sequence Number=SeqID_36023
MHARDEMCLPSPWPWLIIGEVLDSRS

SEQ ID NO: 127709 - protein, 247 aa, Glycine max
  Coding DNA Sequence Number=SeqID_36024
MNLIIVIKRKEHTLRCPYQTRARARVMGEVEEVQKQMKADMEAMKEQMATMMEAMMSMKKIMEANAVAVAATSAVAKVNPMPPSGLNQMNHPTSAMVGKDLGSTSGLYYVQIQNKHAFPLYGLPPKYTPPNVAYTPSEDVNNSAPILIESRQPQIDHAHVSQPMGETHEMPHHNLADFELCLGYATEGQAIGGIPLQNTLEGPRYHPQPHPSHSTAVKNPHAMAEMGKLDHLEERLRAIEGGEDYAF

SEQ ID NO: 127710 - protein, 169 aa, Glycine max
  Coding DNA Sequence Number=SeqID_36025
MVILHLLSSRGGEPYDMRRQIMVIRTPFWHPRTIDSDGTQRQIMVILHLLSSRGGEPDDMRRQLMVIRTRFRHLETIESDDSQRQIMVIMHLFSSRGVELDDMRRQIMVIRTPFRHPETIESDGTQRQIMVILHLLSSRGGEPDGMRRQIMVILHLLSSRGDKPHYMRR

SEQ ID NO: 127711 - protein, 60 aa, Glycine max
  Coding DNA Sequence Number=SeqID_36026
MWTTTGEVVAAQLAQASSARPGELSSPRRARLLPPEATAFWRNILEGPSGPGCYLHPHFY

SEQ ID NO: 127712 - protein, 293 aa, Glycine max
  Coding DNA Sequence Number=SeqID_36027
  Gene Ontology: Mol. function=motor activity; Cellular component=cell projection
  Homolog annotation: Hit_ID=UPI00016621D1; Match level="QueryCoverage =89%, HitCoverage=41%, E-value=1e-18, Identity=34%"; Hit description =UPI00016621D1 related cluster
MTSPLDESISCFLIRVDPWVLVPITFRGLHVLTFVGLHALTFRGLHVLANRGMHTLTLRRLHVFANRGLHALTLRGLHVLANRGLHALTLKRTTRLHALTFRGPHVLTFRGLHALAIRGPHVLTFVGLHALTFRGPHVLTFRELHALAIRGPHVLTFRGLHALAIRGLHVLTFVGLHALTFRGPHVLTFRGLHALAIRGPHVLTFRGLHALAIRGLHVLTFRGPHALAFRGLHVLTFRGLHVLAFRGLHVLAFKGSCTFTFKGLHILAFKGSCTFNFRGLHVLVVKGSCTFTL

SEQ ID NO: 127713 - protein, 39 aa, Glycine max
  Coding DNA Sequence Number=SeqID_36028
RAIDTPPSPLKFTSAYPQKGLSIAYATWPTNRRPSPKPK

SEQ ID NO: 127714 - protein, 117 aa, Glycine max
  Coding DNA Sequence Number=SeqID_36029
MLVATPRIFLSWKTHMRAPRRPPAEGQVATPTVEELDHRKQVKNGVVGVPRKCLEAKARILAGRGEWAPFIDILALLIFGGFLFPNVDGLVDLAAIDAFLAFHDRMESSVVAILADL

SEQ ID NO: 127715 - protein, 186 aa, Glycine max
  Coding DNA Sequence Number=SeqID_36030
MADFPEDWPNVKTNPLANHGGGAVNVVESDRPRRSKPLRDVATPRRFIFEALQKGGVIPHSGRKEDSCLLHSGELHDMETCLGSTDGSSVAKPKPLVIYFTKGAASQKTGHPLATKPVPFPYQNSHAVPWRYTPPREKEEEATNVSSLSAKVTNITGLSGVTRSGRVFAPPDLPVQPANVKGKAKV

SEQ ID NO: 127716 - protein, 182 aa, Glycine max
  Coding DNA Sequence Number=SeqID_36031
MVQRKDKELRGSSNGPIGGYHRWLKAYAQGLDWLPSLRTTKEMEGEALEKDEENAELRDVNIATTKALEQEAKRARKEEHGRNKFRGALWGSNSELKLQREERDQSRLDGVILKDELKTCLRSKRSLSQRLGEIETNMLAIINKYKEELSLAIAHEHKVADEYTRVYAEKEARGKVIDSLHQ

SEQ ID NO: 127717 - protein, 41 aa, Glycine max
  Coding DNA Sequence Number=SeqID_36032
MTRGKCVNRDDREGIKWKQKLKAPNEGMRIAWASVQKFGAP

SEQ ID NO: 127718 - protein, 394 aa, Glycine max
  Coding DNA Sequence Number=SeqID_36033
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Cellular component=endoplasmic reticulum; Biological process=protein metabolic process
  Homolog annotation: Hit_ID=A7P402; Match level="QueryCoverage=97%, HitCoverage=97%, E-value=1e-128, Identity=59%"; Hit description =Chromosome chr1 scaffold_5, whole genome shotgun sequence
  Pfam annotation: Domain name=2OG-FeII_Oxy; Domain location=85-181; Score=4.6; E_value=0.051; Accession=PF03171.11; Description=2OG -Fe(II) oxygenase superfamily
MAVVEFEPQQLRLFIPNFLSLDECKELEFIHKSSSTVGYRPNVFSTTLSHLIATNSSHFIIPFIPIRERLKDKLEEFFKCEYELFIEFTGLISWSRGASIGWHSDDNRPYLKQRHFSAVCYLNTYGKDFSGGLFHFQDGEPKSIVPKAGDVVMYTADDRNIHSVDEITEGERLTLALWFSRDGSHDEDMKLISLLSQHLLHENVADSYLPLPASSNMYWFSKDQASNYQFGFNISWARLHVLGYDIYISQDSSCESDVFELLVKPVRLVRDNELLDQEFVNIMHALQVVHFYCWKGSALLNNMSNIDSKVLKVTEVQREKISGLNSVLLNDNDFASKVFCNMPSEEKGCICFDWSEVLAAVAAWEDYASNLSKQIHLQLPYWRMHESIYNVQLE

SEQ ID NO: 127719 - protein, 723 aa, Glycine max
  Coding DNA Sequence Number=SeqID_36034
  Gene Ontology: Mol. function=potassium ion transmembrane transporter activity; Cellular component=membrane; Biological process=potassium ion transport
  Homolog annotation: Hit_ID=Q5J884; Match level="QueryCoverage=100%, HitCoverage=100%, E-value=0.0, Identity=79%"; Hit description=KUP -related potassium transporter
  Pfam annotation: Domain name=K_trans; Domain location=56-723; Score =807.5; E_value=7.9e-240; Accession=PF02705.7; Description=K+ potassium transporter
MESRVHLPCSNDVVVHVNGDSAPDARRFHPTNDAFPPQQQQQQHQEHGKERRGSLVLAYKTLGVVFGGLVTSPLYVYPSMPLKSPTEDDYLGIYSIMFWTLTLIGVVKYANVAIRADDHGEGGTFALYSLLCRHVNIGILPSKHVGLNTTKDVQKSTSLARFFQTSVVARRLLLFVAMLGTCMLIGDGILTPAISVLSAMDGLRAPFPSVSKTLVETLSAIVLIVLFLLQKFGTSRVSFLFSPIMGAWTLSTPLVGIYSIIHHYPSIFKALSPHYIFRFFWRNGKSGWLLLGGTVLCITGSEAMFADLGHFNQKSIQIAFLFTIYPSLVLTYAGQTAYLIKHPNDHDDGFYKFIPTSVYWPIFVIATSAAVVASQSLISATFSVIKQSVVLDYFPRVKVVHTSNNKEGEVYSPEVNYILMILCVAVILIFGDGKDIGNAFGVVVSIVMLITTILLTLVMIMIWRTPAILVALYFVVFFVMEGVYVSAVFTKFAEGGWIPFAISLILAFIMFGWFYGRQRKIDYELTHKITFERLEELLADRSVQRVPGLCFFYTNIQEGLTPILGHYIKNMKSLHKVTIFTTLRYLLVPKVAPHERIVIKKSNLEGVYCCVIQYGYADALNLEGDHFVNQVITSLTQHIQNSPDKLSSDSREIEETSYLEEARCAGVVHVRGKTKFYIGLNCGWFDKFVLRFYEVMHNNCRSALPALGVPPQQRIEVGMLYEA

SEQ ID NO: 127720 - protein, 59 aa, Glycine max
  Coding DNA Sequence Number=SeqID_36035
MASGTSAPRLIPERGQVLKRVLKMHLRVSEFVLVLTFDHSSNWTLRSSNNNVVHLRDQP

SEQ ID NO: 127721 - protein, 526 aa, Glycine max
  Coding DNA Sequence Number=SeqID_36036
  Homolog annotation: Hit_ID=Q9ZUM1; Match level="QueryCoverage=94%, HitCoverage=86%, E-value=3e-93, Identity=46%"; Hit description =Expressed protein
  Pfam annotation: Domain name=Remorin_C; Domain location=445-523; Score=9.3; E_value=0.00033; Accession=PF03763.4; Description=Remorin, C-terminal region
MDYERIQKPQGGGGFSPGKLRSMLLGVEKKRKEEEELDSTFTTRSQNSDMDESGGSSSDHCKDVDVVSVLPEYSTSAIVRTSSVEAVGGDRFVKANAGVNSRSRILEDPSSDYDSGHDNMSMSSSMFEFQKAERAPQRVPVGPFSKPAPSKWDDAQKWIASPTSNRPKTVQSQGQGGQSGHVGPRKVGSLGYGSRQSSMKVVVEVPDQKEIALDEPDTKQIDTDQTKMETGGQKFVSWEADPYAIASSCDVSGSSPGYANALNTWRESFAAYSSPIWLKQPPMEDTCDLDQKNLGLKLRFTWSPFSLSQHNSSLAIQNETTFVPPPSTARSVSMRDMGTEMTPIASQEPSRTGTPVRATTPMRSPNSSRPSTPPRASPASTLTDLHSDNLNLNMNELSEKELQMKTRREIMVLGTQLGKMSIAAWASKEEEDKDASTSLKTKTEPPKSVVVARAAAWEEAEKAKYMARFRREEMKIQAWENHQKAKTEAKMKKIEIFGTSLWTLTSNPNMEESLSQPNNSNICVRS

SEQ ID NO: 127722 - protein, 293 aa, Glycine max
  Coding DNA Sequence Number=SeqID_36037
  Gene Ontology: Mol. function=binding; Cellular component=chloroplast envelope; Biological process=photosynthesis, light reaction
  Homolog annotation: Hit_ID=A7PNJ3; Match level="QueryCoverage=62%, HitCoverage=58%, E-value=9e-61, Identity=63%"; Hit description =Chromosome chr1 scaffold_22, whole genome shotgun sequence
  Pfam annotation: Domain name=TPR_1; Domain location=204-237; Score =2.3; E_value=2.8; Accession=PF00515.19; Description=Tetratricopeptide repeat
  Pfam annotation: Domain name=TPR_1; Domain location=238-271; Score =13.6; E_value=0.12; Accession=PF00515.19; Description=Tetratricopepti de repeat
  Pfam annotation: Domain name=TPR_2; Domain location=130-163; Score =12.6; E_value=0.81; Accession=PF07719.8; Description=Tetratricopeptid e repeat
  Pfam annotation: Domain name=TPR_2; Domain location=164-197; Score =11.1; E_value=1.3; Accession=PF07719.8; Description=Tetratricopeptide repeat
  Pfam annotation: Domain name=TPR_2; Domain location=204-237; Score =14.8; E_value=0.33; Accession=PF07719.8; Description=Tetratricopeptid e repeat
  Pfam annotation: Domain name=TPR_2; Domain location=238-271; Score =19.2; E_value=0.015; Accession=PF07719.8; Description=Tetratricopepti de repeat
  Pfam annotation: Domain name=TPR_2; Domain location=96-129; Score =0.1; E_value=29; Accession=PF07719.8; Description=Tetratricopeptide repeat
  Pfam module annotation: Pfam domain module=TPR_1::TPR_1::TPR_2::TPR _2::TPR_2::TPR_2::TPR_2; Domain location=204-237::238-271::130 -163::164-197::204-237::238-271::96-129
  Subcellular localization annotation: CTP_CleavageSite=92; ConfidenceScore=5.79e-01
MLTSASSSSSIFSFTPKTLTIPPQQPRFTVRAHSKPPILPNLKTLAGAAVFAAVALQFPSTARASPPPPLETDHRLNVEESLSPLSDLLETNAEALAALKSLLQQKLELGEDDEALAILKRLIAAQPDAADWKFLAARLTAETGDSDSARGYYEEVLAANPLSFEALFENALLMDRCGEGEAAMRRLEEALRVAEEDKMAKEARDVKLIMAQIMFLQKNVDEALVIYNQLTKEDPRDFRPYFCRGMIYSLLDRNEEAKEQFAKYRELSPKKFEVDGYLRTPLSRMKLFSTDES

SEQ ID NO: 127723 - protein, 469 aa, Glycine max
  Coding DNA Sequence Number=SeqID_36038
  Gene Ontology: Mol. function=glutamate decarboxylase activity; Cellular component=cytoplasm; Biological process=carboxylic acid metabolic process
  Homolog annotation: Hit_ID=Q1I1D8; Match level="QueryCoverage=97%, HitCoverage=95%, E-value=1e-177, Identity=66%"; Hit description =Glutamate decarboxylase
  Pfam annotation: Domain name=Pyridoxal_deC; Domain location=33-357; Score=373.1; E_value=4.6e-109; Accession=PF00282.10; Description =Pyridoxal-dependent decarboxylase conse
MVFPRPPSESDLFLHSNFASRYARDSLPRFSMPEDSMPKEAAYQNIHDELQLDAIPKLNLASFVTTSMEEECNKLIMESINKNYVDMDEYPITTDLHNRCLNMIARMFHAEIGENENAIGAGTVGSSEAIMLAGLAFKKKWQNKRKAEGKPYDKPNLVTGSNVQVCWEKFARYFEVELREVEVREGYYVMDPAKAVELVDENTICVAAILGSTYNGEFEDVKLLNDLLLEKNKQTGWDTPIHVDAASGGFIAPFLYPELEWDFRLPWTKDDLPEDLVFHINYLGADQPTFTLNFSKGSSQIIAQYYQLIRLGQEGYRNIMENCRENAMVLKEDLEKSGHFNILSKDDGVPVVAFSLKDRSRYDEFKISEMLRRHGWIVPAYPMPPAAQHINVLRVVIRAEFSRTLAERLVLDIHSVLDELEKVHPSKVTKNTKEENKLLVENGVKNTALDAHSEIIAQESNKRQKIMVA

SEQ ID NO: 127724 - protein, 122 aa, Glycine max
  Coding DNA Sequence Number=SeqID_36039
  Gene Ontology: Mol. function=nucleic acid binding; Cellular component= nucleus; Biological process=biological_process
  Homolog annotation: Hit_ID=Q67XI5; Match level="QueryCoverage=85%, HitCoverage=70%, E-value=3e-28, Identity=58%"; Hit description =Putative uncharacterized protein At4g20030
  Pfam annotation: Domain name=RRM_1; Domain location=14-86; Score =67.7; E_value=4e-17; Accession=PF00076.13; Description=RNA recognition motif. (a.k.a. RRM, RB
MYMWQLGIGVGNYAMVGNNLPYSTGETTLQKEFSNFGKIAEVKMVKDMNTKRSKGIAFIQYTCQDDAMLALETMDQKDFYGRTIGVEIARLGWDDFGASPRASGPPKKWDLPEQGEVVDCWY

SEQ ID NO: 127725 - protein, 528 aa, Glycine max
  Coding DNA Sequence Number=SeqID_36040
  Gene Ontology: Mol. function=ubiquitin protein ligase binding; Cellular component=cullin-RING ubiquitin ligase complex; Biological process=ubiquitin-dependent protein catabolic process
  Homolog annotation: Hit_ID=A7Q145; Match level="QueryCoverage=92%, HitCoverage=59%, E-value=0.0, Identity=89%"; Hit description =Chromosome chr10 scaffold_43, whole genome shotgun sequence
  Pfam annotation: Domain name=Cullin; Domain location=3-454; Score =652.9; E_value=2.7e-193; Accession=PF00888.13; Description=Cullin family
MFTALGIYVETFEKPFLECTSEFYAAEVMKYMQQSDAPDYLKHVETRLQEEHERCLLYLDASTRKPLIGIAEKQLLERHIPAILDKGFIMLMDGNRIEDLQRMHSLFSRVNALESLKQALSSYIRRTGQGIVMDEEKDKDMVSSLLEFKASLDTIWEESFFKNEPFSNSIKDAFEYLINLRQNRPAELIAKFLDEKLRAGNKGTSEEELEATLDKVLVLFRFIQGKDVFEAFYKKDLAKRLLLGKSASIDGEKSMISKLKTECGSQFTNKLEGMFKLLTTMSQIVVNQDIELSKEINESFKQSSQARSKLASGIEMSVHVLTTGYWPTYPPIDVRLPHELNVYQDIFKEFYLSKYSGRHLMWQNSLGHCVLKAEFPKGRKELAVSLFQTVVLMLFNDAEKLSLQDIKDATGIEDKELRRILQSLACGKVRVLQKMPKGRDVEDDDSFVFNDGFTAPLYRIKVNAIQLKETVEENTSTTERVFQDRQYQGMKWIGMELDRNRMHSSIFYDFHPIPLSPVSIYLGKWDGS

SEQ ID NO: 127726 - protein, 665 aa, Glycine max
  Coding DNA Sequence Number=SeqID_36041
  Gene Ontology: Mol. function=nucleoside-triphosphatase activity; Cellular component=integral to membrane; Biological process=protein catabolic process
  Homolog annotation: Hit_ID=Q2PEV7; Match level="QueryCoverage=99%, HitCoverage=98%, E-value=0.0, Identity=76%"; Hit description =Putative zinc dependent protease
  Pfam annotation: Domain name=AAA; Domain location=269-425; Score =257.6; E_value=2.7e-74; Accession=PF00004.20; Description=ATPase family associated with various cellular activities (AAA)
  Pfam annotation: Domain name=AAA_2; Domain location=266-366; Score= -37.3; E_value=0.0077; Accession=PF07724.5; Description=ATPase family associated with various c
  Pfam annotation: Domain name=AAA_5; Domain location=269-375; Score= -15.2; E_value=0.041; Accession=PF07728.5; Description=ATPase family associated with various
  Pfam annotation: Domain name=FtsH_ext; Domain location=98-243; Score =145.9; E_value=1.1e-40; Accession=PF06480.6; Description=FtsH Extracellular
  Pfam annotation: Domain name=Peptidase_M41; Domain location=432-642; Score=407.5; E_value=2.1e-119; Accession=PF01434.9; Description =Peptidase family M41
  Pfam module annotation: Pfam domain module=AAA::AAA_2::AAA_5::FtsH _ext::Peptidase_M41; Domain location=269-425::266-366::269-375::98 -243::432-642
  Subcellular localization annotation: CTP_CleavageSite=53; ConfidenceScore=5.26e-01
MAASSACLVGNGLSTRGNRITLKKDFNGRRYLYSSWRFSLLNNNKASKAFSIKASLEQRQEEGRRGFLKLLLGNLGVGLPALLGSGKAYADEQGVSSSRMSYSRFLEYLDKDRVKKVDLYDNGNTAVVEAVSPELGNRSQYVRVQLPGLNQELLQKFREKNIDFAAHSPQEESGSLLANLIGNLAFPLLLIGGLFLLSRRSGGMGGPGGPGFPLAFGQSKAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIATNRADILDSALLRPGRFDRQVTVDVPDIRGRTEILKVHASNKKFDADVSLEVIAMRTPGFSGADLANLLNEAAILAGRRGKTAISSKEIDDSIDRIVAGMEGTVMTDGKSKSLVAYHEVGHAICGTLTPGHDAVQKVTLVPRGQARGLTWFIPNDDPTLISKQQLFARIVGGLGGRAAEEIIFGEPEVTTGAAGDLQQITSLAKQMVTTFGMSDIGPWSLMEPSAQGGDVIMRMMARNSMSERLAEDIDAAIKRISDEAYEIALEHIRNNREAIDKIVEVLLEKETLSGDEFRAILSEFVEIPAENRVAPSTPVPATV

SEQ ID NO: 127727 - protein, 674 aa, Glycine max
  Coding DNA Sequence Number=SeqID_36042
  Gene Ontology: Mol. function=catalytic activity; Cellular component =nucleus; Biological process=metabolic process
  Homolog annotation: Hit_ID=A7PJL6; Match level="QueryCoverage=95%, HitCoverage=98%, E-value=0.0, Identity=69%"; Hit description =Chromosome chr12 scaffold_18, whole genome shotgun sequence
  Pfam annotation: Domain name=PPR; Domain location=105-139; Score =19.1; E_value=0.016; Accession=PF01535.11; Description=PPR repeat
  Pfam annotation: Domain name=PPR; Domain location=167-201; Score =33.8; E_value=6.1e-07; Accession=PF01535.11; Description=PPR repeat
  Pfam annotation: Domain name=PPR; Domain location=202-236; Score=3.5; E_value=3; Accession=PF01535.11; Description=PPR repeat
  Pfam annotation: Domain name=PPR; Domain location=268-302; Score =31.0; E_value=4.4e-06; Accession=PF01535.11; Description=PPR repeat
  Pfam annotation: Domain name=PPR; Domain location=369-403; Score =40.5; E_value=6.1e-09; Accession=PF01535.11; Description=PPR repeat
  Pfam annotation: Domain name=PPR; Domain location=404-438; Score =10.6; E_value=0.43; Accession=PF01535.11; Description=PPR repeat
  Pfam annotation: Domain name=PPR; Domain location=440-474; Score=9.8; E_value=0.54; Accession=PF01535.11; Description=PPR repeat
  Pfam annotation: Domain name=PPR; Domain location=506-540; Score=4.1; E_value=2.6; Accession=PF01535.11; Description=PPR repeat
  Pfam module annotation: Pfam domain module=PPR::PPR::PPR::PPR::PPR::PP R::PPR::PPR; Domain location=105-139::167-201::202-236::268-302::369 -403::404-438::440-474::506-540
  Subcellular localization annotation: CTP_CleavageSite=50; ConfidenceScore=5.25e-01
MGRFVVSRTRFSVPIVFQNSIFRFSTISFKTHFQNGRFSDGNEQFATLCSKGHIREAFESFLSEIWAEPRLFSNLLQACIPLKSVSLGKQLHSLIFTSGCSSDKFISNHLLNLYSKFGELQAAVALFDRMPRRNIMSCNIMIKAYLGMGNLESAKNLFDEMPDRNVATWNAMVTGLTKFEMNEEALLLFSRMNELSFMPDEYSLGSVLRGCAHLGALLAGQQVHAYVMKCGFECNLVVGCSLAHMYMKAGSMHDGERVINWMPDCSLVAWNTLMSGKAQKGYFEGVLDQYCMMKMAGFRPDKITFVSVISSCSELAILCQGKQIHAEAVKAGASSEVSVVSSLVSMYSRCGCLQDSIKTFLECKERDVVLWSSMIAAYGFHGQGEEAIKLFNEMEQENLPGNEITFLSLLYACSHCGLKDKGLGLFDMMVKKYGLKARLQHYTCLVDLLGRSGCLEEAEAMIRSMPVKADAIIWKTLLSACKIHKNAEIARRVADEVLRIDPQDSASYVLLANIYSSANRWQNVSEVRRAMKDKMVKKEPGISWVEVKNQVHQFHMGDECHPKHVEINQYLEELTSEIKRQGYVPDTSSVLHDMDNEEKEQILRHHSEKLAIAFALMNTPEGVPIRVMKNLRVCSDCHVAIKYISEIKKLEIIVRDSSRFHHFKNGTCSCGDYW

SEQ ID NO: 127728 - protein, 123 aa, Glycine max
  Coding DNA Sequence Number=SeqID_36043
  Homolog annotation: Hit_ID=Q3E9Y5; Match level="QueryCoverage=65%, HitCoverage=71%, E-value=6e-08, Identity=46%"; Hit description =Uncharacterized protein At4g19980.1
  Subcellular localization annotation: CTP_CleavageSite=63; ConfidenceScore=5.86e-01
MWPLSSQKNTNTTSTVKMQHESANSTPTTTVATKSMVSTCRCCCLVTKLMRKLKRRNRKLRPKSASRQGSFQCRYDPLSYSLNFDTTGMDEDYYKFCAFSSRFVANPRTSCPAVQVQGTPINQ

SEQ ID NO: 127729 - protein, 197 aa, Glycine max
  Coding DNA Sequence Number=SeqID_36044
  Gene Ontology: Mol. function=carboxyl- or carbamoyltransferase activity; Cellular component=chloroplast; Biological process='de novo' pyrimidine base biosynthetic process
  Homolog annotation: Hit_ID=A7P0K7; Match level="QueryCoverage=90%, HitCoverage=44%, E-value=1e-61, Identity=71%"; Hit description =Chromosome chr19 scaffold_4, whole genome shotgun sequence
  Pfam annotation: Domain name=OTCace_N; Domain location=65-197; Score =129.7; E_value=8.4e-36; Accession=PF02729.12; Description =Aspartateornithine carbamoyltransferase, carbamoyl-P binding domain
  Subcellular localization annotation: CTP_CleavageSite=28; ConfidenceScore=5.14e-01
MAASSSLFSSSMHMEMFAPKTSKSLSMNMSSKWEQTDRRDALHCRALKIEPAPSFSVGQKFQFDDIIEAQQFDRDILSAIFEVARNMENVEKDSPGSQILKGFLMATLFYEPSTRTRLSFESAMRRLGGEVLTTENAREFSSAAKGETLEDTIRTIEGYSDIIVMRHFESGAARRAAAIADIPIINAGDGPGQHPTQ

SEQ ID NO: 127730 - protein, 183 aa, Glycine max
  Coding DNA Sequence Number=SeqID_36045
MSNGFRLGHRIWELHRIINIRYKMISDVSEVLAEMENSNKREKGKSEFLRATALPTITSLPLSNIIQKFSVPNNFGPTLINLKRLISNKALFPNIRQFSSSLCWIALGIGNFGIRVKLPIILAEKLLIKAKGQNLTSTMARAASDRLGEMSSKSHLKYRSRKSGNGIVRTFRKSRREHIQNAN

SEQ ID NO: 127731 - protein, 327 aa, Glycine max
  Coding DNA Sequence Number=SeqID_36046
  Gene Ontology: Mol. function=protein binding; Cellular component =cytoplasm; Biological process=protein transport
  Homolog annotation: Hit_ID=A7P8V6; Match level="QueryCoverage=84%, HitCoverage=90%, E-value=1e-84, Identity=58%"; Hit description =Chromosome chr3 scaffold_8, whole genome shotgun sequence
  Subcellular localization annotation: CTP_CleavageSite=66; ConfidenceScore=5.17e-01
METLARDKRRSVGDGAELVKSNIKTPPRPKRRRQPLKSWPVTFSPFARALALSRITSLSPPNPTPTLSAKKPQPSHGSVHADLSQPEHSESSDEDFDGVVQADFSFFDPKPNDFHGAKTLLQTYLDDQEWDLSAFVDLILAQTTVGSVVKIEDDEDEGLFALVTALNLYRYREHKCIATVKDFLLHKVRQEKSVHDQLKLLLGEQAHDVGLLVSQRMVNLPPQLLPPLYDALFDEVSWATEDEPTEELQNSFKFKHYIILTKIYVLKNVEQKRKQSNGSDEAIIYIKLEDEIFHKLSSWSFCFPLQTQQLAPHEASFMFLQSQLPFL

SEQ ID NO: 127732 - protein, 273 aa, Glycine max
  Coding DNA Sequence Number=SeqID_36047
  Gene Ontology: Mol. function=sequence-specific DNA binding; Cellular component=nucleus; Biological process=regulation of transcription, DNA-dependent
  Homolog annotation: Hit_ID=Q2HRQ1; Match level="QueryCoverage=86%, HitCoverage=85%, E-value=1e-27, Identity=32%"; Hit description =Transcription factor, MADS-box
  Pfam annotation: Domain name=SRF-TF; Domain location=9-61; Score =52.6; E_value=1.3e-12; Accession=PF00319.9; Description=SRF-type transcription factor (DNA-binding and dimerisation domain)
MGRGRIPMELIKEEKACEKTFHKRKKGLLKKAYEFSTLCAVDVGVIIYAPKYLNEPETWPQDKDSREVKRVIQKYHNTTSDRHPKVYDVQEYFNDRMKKIESEISKVHKEEIKLMYPTWNESYNTLGEKQLRMFVGILDAKLDACNQRMNMLKQDSKGKGIAKSDKIETLTPYMASNLGSHLNFMSQTQLFTPSDNNQVAFYPFQLSQSSQPSTFHGGQSCVQLMEKNAMVDWANQVGVGANCDPKMGVLKEDQSNKTQNSSPCYYNGNMQTT

SEQ ID NO: 127733 - protein, 168 aa, Glycine max
  Coding DNA Sequence Number=SeqID_36048
  Subcellular localization annotation: CTP_CleavageSite=49; ConfidenceScore=5.64e-01
MSFTFNLHVPKALPPLPSSSRGTTSLFFSSKQKSYHNNTSPCQSLLITCRSHKPNYDDTSLKYTSLALQVGALLALLSVAVTGENNRPELIWVLTQWGVVLFGYFLVVPQYLKLSCEMVLLWAPFLNFRKFPRDTSLQYPWSVPEDPSKIRSSYAKYPYAEPEDYDNL

SEQ ID NO: 127734 - protein, 350 aa, Glycine max
  Coding DNA Sequence Number=SeqID_36049
  Homolog annotation: Hit_ID=A7PGX7; Match level="QueryCoverage=100%, HitCoverage=100%, E-value=3e-66, Identity=42%"; Hit description =Chromosome chr17 scaffold_16, whole genome shotgun sequence
  Pfam annotation: Domain name=DUF789; Domain location=88-342; Score =204.3; E_value=3e-58; Accession=PF05623.3; Description=Protein of unknown function (DUF789)
MLGTALQFSGVRGEDRFYIPVKARKNQNQRKQSHRAKNNEPENADLASKNKVDVSENSNNNSNIKSKSDSNLNQSLKPTLSPSVEAVSNIDRFLEFTTPSVPAQYFSKTTMRGWKFCDVEYQSYFTLSDLWESFKEWSAYGAGVPLVLDQSDSVVQYYVPYLSAIQLYAHSAEKSSAKPRYTSEDSEGDYYRDSCSEGSSDYEYGKRTEFMTQRSSQHLTGGVSLKMDTLSMHDKCSTVQEGFSSDDSETGNPQDLLFEYFEQDPPYSRSGRTHAPTLVYPSQMDVVPKISMPTFAMASYKLKGSIWMKKGVSESQQVSSLLQAADNWLRLVQVHHPDFQFFKSHGTYHR

SEQ ID NO: 127735 - protein, 55 aa, Glycine max
  Coding DNA Sequence Number=SeqID_36050
EQNRLRRWSNTEPNPKTETNRGTQGRMRVKARPMIDKSLSHVQLRTSGKRCWEAA

SEQ ID NO: 127736 - protein, 84 aa, Glycine max
  Coding DNA Sequence Number=SeqID_36051
MTKISACQRVRLPLVDKRTCGAADKSEALAPTYPQFVMRITIRYPRMSSDPPSLDDKGADDNVSLFVSTGSLASGLTKGAEDDV

SEQ ID NO: 127737 - protein, 349 aa, Glycine max
  Coding DNA Sequence Number=SeqID_36052
  Gene Ontology: Mol. function=two-component response regulator activity; Cellular component=integral to membrane; Biological process=two-component signal transduction system (phosphorelay)
  Homolog annotation: Hit_ID=A8GFM2; Match level="QueryCoverage=100%, HitCoverage=64%, E-value=1e-106, Identity=55%"; Hit description=EAL domain protein
  Pfam annotation: Domain name=EAL; Domain location=94-330; Score =318.0; E_value=1.7e-92; Accession=PF00563.11; Description=EAL domain
MTNYLLEPQLPWVERAIFNVGGQSLEYGNPLIEHTVPSDDEVAYDQASLRYPYSITLYGPSPARLALNTLPSQLPLAVLLSLLLGYIVWLATANRMSLSWQISYGITANEFMVYCQPLINARSGDCDGIELLLRWHNPRQGWIAPDVFIPLAERQNLIAPLTRFVIARVVAELPNLPQCPTFHIAINVAASHFRDRLIVEDLQRYWWPANPLPKLVVELTERDALPVIDQTVVAQLHEIGVRLAIDDFGTGHSSLAYLKDLKPDVLKIDKIFTAAIGTDAINATVTDMVISLAQRLNIALVAEGVETAEQAHYLRERGVDHLQGYYYARPMPIEDFPQWLAQHQAQLGA

SEQ ID NO: 127738 - protein, 74 aa, Glycine max
  Coding DNA Sequence Number=SeqID_36053
MIYVNPDPGSQAAGGGFYSRLPETFKPDDTRDSSLLGGDDQAIACGNVMVIPFYHFQGTEVLLTLMMPFAFLSE

SEQ ID NO: 127739 - protein, 197 aa, Glycine max
  Coding DNA Sequence Number=SeqID_36054
MVCNDQADMTGRLLAGSLTFDYRIMHYIIVHILLPRSSNLAQTFEENLILMWAFLTGHQIDWAHLIWYQMHKELRANAPLPYPHLVTLFLHYFKIPLDDEPFIQVKRSFANGADLPQPIPDERTPSPPPQRIDSSSLLNDVLTELYGLRAFVGDRFDAMDTHLDAMDARFDGMDTRITRLEDDMSFIRHCFDPPVDH

SEQ ID NO: 127740 - protein, 86 aa, Glycine max
  Coding DNA Sequence Number=SeqID_36055
MACTQFRIYTRFSSNFSQHQLDLAPYASEPYNAQWDAPRLLRDKHTLRSSRILGEMKVDEPWLGLWLPLNHQVDMGASQHRTLELG

SEQ ID NO: 127741 - protein, 249 aa, Glycine max
  Coding DNA Sequence Number=SeqID_36056
  Homolog annotation: Hit_ID=Q2HW90; Match level="QueryCoverage=95%, HitCoverage=57%, E-value=2e-26, Identity=28%"; Hit description =Putative uncharacterized protein
MEPLQMQAFRKTYGKILDLTIAEVSIEAIASLTQYYDQPLRCFTFGDFQLVPTIEEFEEILGCPLGGRKPYLFSGCLPSLSRIATVVKDSARDGLVDLAAIDAFLAYHHSKESPVVAVLADLFDTFDRRCEKSSARIICCLPALCVWLVSHLFQQDTRHPCPLQSHRSCAEKRRIDWDQLLAGVGGRTINWFSRWKEGKEGVLFSCKGYPNIPLIGTRGCINYNPALAIRQLGYPMRGAPMEESKSPFL

SEQ ID NO: 127742 - protein, 152 aa, Glycine max
  Coding DNA Sequence Number=SeqID_36057
FHKFFREQEMLPAEEGSAGSFVGSAEDIVLSLEPAEEPPEPSSAGSSGRTFGTFFCRNAWKNLLRFLPQVPAEELLLPLQYPTAPPTCAEEGSSGGRTFVFNLSHHTSLMSSILRPLTLPNEDTRRRRKKTNLFGRKEKNETKEEEACGEVA

SEQ ID NO: 127743 - protein, 96 aa, Glycine max
  Coding DNA Sequence Number=SeqID_36058
MSGFTRDSPQISASPHQFDLAPYASEPYNAQWNAPGLLRDKHTLRFESYSRRNGGMAFVDNWAVGKEKERQSQHGFLPHPHPLYLPQFSHSSKQDD

SEQ ID NO: 127744 - protein, 142 aa, Glycine max
  Coding DNA Sequence Number=SeqID_36059
MEEGFSHGSVPIILGRPFMKIARTKIDVYAGTLSMEFGDIVVHFNILDAMKHQSEDHSIFCAEIIDQIIDDYMFDFDSVLHGKRRNLLLSPTLVPPTVQPPPHTGVEALTSNPQICLLGGQGKISNDHLCPSLLLSKRRSCC

SEQ ID NO: 127745 - protein, 101 aa, Glycine max
  Coding DNA Sequence Number=SeqID_36060
  Gene Ontology: Mol. function=protein kinase C binding; Cellular component=cell projection; Biological process=keratinization
  Homolog annotation: Hit_ID=Q9JKS4-3; Match level="QueryCoverage=77%, HitCoverage=13%, E-value=4e-15, Identity=47%"; Hit description =Isoform 3 of Q9JKS4
MSNLFEFGMTSPLNESFSCFLIRVDPWVLVPSPSEGYTLSPSEDYTPSPSEGYTSSPLEGCTPSPSEGYTPSPSEDYTPSPSEGYTPSPSKGYTPSPSEDY

SEQ ID NO: 127746 - protein, 71 aa, Glycine max
  Coding DNA Sequence Number=SeqID_36061
MELQRLNQHEENDKKKKGIALKASSSIQDESDIEDSIDLDEDEDLSLFVKRFNKFIRMRGNQRRQNFKSKR

SEQ ID NO: 127747 - protein, 109 aa, Glycine max
  Coding DNA Sequence Number=SeqID_36062
MPFRGRARRGSRVRFPKKERCEESPPTFICGKRRKNRRKPVKMKILSLGVVFTFEEGRQRVGLLRLRTLHQRGNQTYVVLSFKGESSDSFYLKGDDFKALDLKNDPFTW

SEQ ID NO: 127748 - protein, 94 aa, Glycine max
  Coding DNA Sequence Number=SeqID_36063
MHVQYAIIGANIPIGHSISSSEGRVLAEKTLVQGHESCPPSDLPFLHQTVQIGTHDAILPQRALDRRLQEDWARDVREGLRVVMSLRVDFGPMD

SEQ ID NO: 127749 - protein, 86 aa, Glycine max
  Coding DNA Sequence Number=SeqID_36064
GLKLNVPPFKGGSDPDAYLDWEMKIEHKLQRLSQESLTMEEYYKEMEMALEYVELDDLLHKFVRVEQQLKRKTVARRNSLNTFNQN

SEQ ID NO: 127750 - protein, 80 aa, Glycine max
  Coding DNA Sequence Number=SeqID_36065
MKPTCAFQILPPKGGCFWWKQPGFAWGELCGKLLPYFAINMGGMKKEGVQPSWHFYSLEMLRKIVSVKKIQPRRFRNVSV

SEQ ID NO: 127751 - protein, 208 aa, Glycine max
  Coding DNA Sequence Number=SeqID_36066
MIQEEIMSGASLFHSLEKWNPRLHIGYRLTWVQCWGILLIAWDTTQIQKILAAIGDMVEVDDDVEEVRRVDRARENGYSTGTCNCRFRSALRSSEEIESDESDIGTPVPEMLCASEKEDEPKNEDGNTTIPSGLNGKERPHGKNIGPWVQRFNQKGSRADSTMDIDEEQETHKNREEQHVGNINPTKWEKQLHENGNQESGRSCEVFG

SEQ ID NO: 127752 - protein, 137 aa, Glycine max
  Coding DNA Sequence Number=SeqID_36067
MIIRGQDIYNSQDKAITSPSSSESEETKGEESSEEIYPQEEGQPLMVKEECKEVSVSSKRLVKKTLVSTATPLELEVIPQVKELLDEGLVRKSLTLCALLVPKIGTMRHQIPMIGGMMNVLSGATLFCKSPMHPTSS

SEQ ID NO: 127753 - protein, 30 aa, Glycine max
  Coding DNA Sequence Number=SeqID_36068
MDPKRIKVIPEGLLHQVLRKELMSFKNLGI

SEQ ID NO: 127754 - protein, 104 aa, Glycine max
  Coding DNA Sequence Number=SeqID_36069
  Subcellular localization annotation: CTP_CleavageSite=26; ConfidenceScore=5.75e-01
MASPSASPPPPPSPPFAPSDASALPSAVKRTRKASRLRSLSTRPPGAERPVVHVDPATGKADGLHKKKLRTYLGIVARDKVDVTYENWKKVPTAQKGLTWEDIQ

SEQ ID NO: 127755 - protein, 62 aa, Glycine max
  Coding DNA Sequence Number=SeqID_36070
MPHTTYRNMPFCGRAKARLTGALSKGGKMRGVATNEGISTSHVDKSGAFAPTYPPSKRKSDL

SEQ ID NO: 127756 - protein, 87 aa, Glycine max
  Coding DNA Sequence Number=SeqID_36071
MKGTGFGSILGRINSLLRGNPSLVLEDGPFQEEPTDLRSNPLQGGGDDTILPKKGSVTRAMSKRLQEDWARAAKEGPRVLMNLRIDF

SEQ ID NO: 127757 - protein, 232 aa, Glycine max
  Coding DNA Sequence Number=SeqID_36072
MLGKLSWSMRTLDTMKFTMMMETTTGIVLVDEIDAPEVLLSGLVGLSFIGKASSDGVDYTSDVLADSYSGEGLAPAWEWSGLLTNWAKYPACISSSILPFKAQQSLVLCQYRGETCSTWLRLTLASEISFGVAGQVPPGRRLPQESWYDWPSMLVPLVRLVQVGLGVCFAPFTLLFDLVDFIPEFGHFFYLDVTLGSFMRLIHATRVEISDLDDCAPKFANELSEGFIVCLS

SEQ ID NO: 127758 - protein, 131 aa, Glycine max
  Coding DNA Sequence Number=SeqID_36073
  Subcellular localization annotation: CTP_CleavageSite=39; ConfidenceScore=5.35e-01
MSSASDSSISSGSLRFLQIFSSSCSDRIPKRQRGREGIEASTCTVTMRFIFLPPQILSHKSQLHNNEIPNSENAHNWVANVVLKFHNEPTMNESEIVVFLRQVRWPAGKREGFGRREKKQHCETEEAEESV

SEQ ID NO: 127759 - protein, 132 aa, Glycine max
  Coding DNA Sequence Number=SeqID_36074
  Pfam annotation: Domain name=zf-CCHC; Domain location=8-25; Score =14.2; E_value=0.011; Accession=PF00098.14; Description=Zinc knuckle
MQEKISSIKCFKYLGRGHITSQCPTKKTMIMKGQEIYSSQDEATTSPSSSGSEEAKEEESSEEIYPEEEGQPLMVKEDWRSVRRQPPHFLLCKKTLVSIVTPLGLEFIPQVKELLDEGLVHKSLNPCALLVP

SEQ ID NO: 127760 - protein, 80 aa, Glycine max
  Coding DNA Sequence Number=SeqID_36075
MAAKFIEETGLISVQQQGADSWIWKQHSSGIYLTNTAYKFLMEEIRGDPMDGSFVFLWKLKIPPKAKIFTWRLIKDRLPA

SEQ ID NO: 127761 - protein, 19 aa, Glycine max
  Coding DNA Sequence Number=SeqID_36076
GGYLSNVGFFSSCILGHRD

SEQ ID NO: 127762 - protein, 299 aa, Glycine max
  Coding DNA Sequence Number=SeqID_36077
  Gene Ontology: Mol. function=protein-N(PI)-phosphohistidine-sugar phosphotransferase activity; Cellular component=1-2nm peptidoglycan -based cell wall; Biological process=phosphoenolpyruvate-dependent sugar phosphotransferase system
  Homolog annotation: Hit_ID=Q8FAJ3; Match level="QueryCoverage=98%, HitCoverage=63%, E-value=1e-161, Identity=95%"; Hit description =Ascorbate-specific permease IIC component ulaA
  Pfam annotation: Domain name=SgaT_UlaA; Domain location=1-299; Score =507.5; E_value=1.6e-149; Accession=PF04215.3; Description=Putative sugar-specific permease, SgaTUlaA
MSEVYGINGAISDTYASMMATIDRMGEAYSWVGYAVLLALALNICYVLLRRITGIRTIMLTGHIMFQQAGLIAVSFFIFGYSMWTTIICTAILVSLYWGITSNMMFKPTQLVTDGCGFSIGHQQQFASWIAYKVAPYLGKKEESVEDLKLPGWLNIFHDNIVSTAIVMTIFFGAILLSFGIDVVQAMAGKTHWTVYILQTGFSFAVAIFIITQGVRMFVAELSEAFNGISQRLIPGAVLAIDCAAIYSFAPNAVVWGFMWGTIGQLIAVGILVGVGSSILIIPGFIPMFFSNATIGRLC

SEQ ID NO: 127763 - protein, 267 aa, Glycine max
  Coding DNA Sequence Number=SeqID_36078
MAWRAVATSGILAAWNVGKLVAARISPAKSRCGAFGHALNGDDVGQARVGIDMAPDDIEIIDQAAILQASGDFDALGLPGAALKTFVGGIAHTEDEIVAHAFAHRPEDIETEAHAVFERTAIGAVQFVGQRRDELVDEMAIGFQLHPVHSACLHAFGGVGEVLDDTLDIPVLDLLRKSPMRRFAVMGWRKDRQPVALVPAGATAEMRELDHDRRTLFMHGVGHFPDPWDDLILVGEQVVEDGRAVPGDGGGTRRHRERNAALRRSTV

SEQ ID NO: 127764 - protein, 246 aa, Glycine max
  Coding DNA Sequence Number=SeqID_36079
  Homolog annotation: Hit_ID=Q3ECZ9; Match level="QueryCoverage=95%, HitCoverage=63%, E-value=2e-12, Identity=26%"; Hit description =Uncharacterized protein At1g40087.1
MLGVSLHTVWTVEAIDSEETIKKIKVKVKGVNSLPRELRIIVNFDDQGQAIGEAQALLAGFLGTLAADCKLFPMDYDRWSGPSGVPKAYFDDCFETILKPQFYFKINEAGAKRYCKLSMGRKWAANRQSLWNEFNNPTKTRDEIIKNVPIGIDKDQWARFVHYRHKPSNIAPQKLGSYQLPRQLYIETHKRKDGSFVNEAAKTIAEQIEVGLTQSIVDESEVSLLDVVGRVLGLEHSGRVRCSGIL

SEQ ID NO: 127765 - protein, 161 aa, Glycine max
  Coding DNA Sequence Number=SeqID_36080
MAPKKLSVKRSRRDAAVERTSAAPEFDSHHFRSAKHQQRFQAIKGWSFHRERRIQLRDDEYTDFQEEIAHRHWMSLVTPTAKFDPDIVLESYANAWPTEEGVRDMRSWVRGQWIPFDANALSQFLGDPLVLEEGQECEFSQRRNRADGFDEEAIAQLLCIP

SEQ ID NO: 127766 - protein, 68 aa, Glycine max
  Coding DNA Sequence Number=SeqID_36081
  Homolog annotation: Hit_ID=A7QL08; Match level="QueryCoverage=45%, HitCoverage=42%, E-value=3e-07, Identity=90%"; Hit description =Chromosome undetermined scaffold_116, whole genome shotgun sequence
MVGAGLKKDLRVSRVVPGGSLNAFLFLLIGVIFTKTCHGAMIYFHGARSLVQVQDGPAASRKRIEKLT

SEQ ID NO: 127767 - protein, 34 aa, Glycine max
  Coding DNA Sequence Number=SeqID_36082
VLSSQNQELRVTRFTKGGAINGSTSTARPSAKPM

SEQ ID NO: 127768 - protein, 16 aa, Glycine max
  Coding DNA Sequence Number=SeqID_36083
MVRSQDELTAEVNQGT

SEQ ID NO: 127769 - protein, 178 aa, Glycine max
  Coding DNA Sequence Number=SeqID_36084
MAPRKLASKRSRKDKAAEGTSSAPEYDSHRFRSAVHQQRFEAIKGWSFLRERRVQLRDDEYTDFQEEIGRRRWTSLVTPMAKFDLEIVLEFYVNAWPTEEGVRDMRSWVRGQWIPFDADAISQLLGYPLVLEEGQECEYGQRRNRSDGETSANHAHQHDHPDRDMDDVAPQQHPAQRS

SEQ ID NO: 127770 - protein, 81 aa, Glycine max
  Coding DNA Sequence Number=SeqID_36085
  Homolog annotation: Hit_ID=A5AV98; Match level="QueryCoverage=100%, HitCoverage=10%, E-value=4e-15, Identity=48%"; Hit description =Putative uncharacterized protein
MTIADSIKTTLPETDNAKEFMRLVRERSQPADKSLARTSMSTLITMKFDGSCTIHGHVIEITNITTRLETLGMTANENFLV

SEQ ID NO: 127771 - protein, 138 aa, Glycine max
  Coding DNA Sequence Number=SeqID_36086
MDHHGKIGEVLAAQLAQASQVASSRSNNLLEESSGGPITETYEFRNNTCFLSVMLWNLMDYIIIPFLTYGMLRNLNSCATMLHLISGVSRNLTDCASIFSFVFRHVPEFHKLPNDGCQAPYKDQTKVACHQEKVPERN

SEQ ID NO: 127772 - protein, 56 aa, Glycine max
  Coding DNA Sequence Number=SeqID_36087
MDQPWRGKEACFQLSDSTNKSFKVNEHRLKSFFTNPSLVDVVVEETSLLHPTLPPP

SEQ ID NO: 127773 - protein, 141 aa, Glycine max
  Coding DNA Sequence Number=SeqID_36088
  Gene Ontology: Mol. function=transcription corepressor activity; Cellular component=nucleus; Biological process=regulation of transcription, DNA-dependent
  Homolog annotation: Hit_ID=Q1EP20; Match level="QueryCoverage=86%, HitCoverage=9%, E-value=2e-27, Identity=49%"; Hit description =Transcriptional repressor protein-related
  Pfam annotation: Domain name=PAH; Domain location=18-64; Score=57.0; E_value=6.7e-14; Accession=PF02671.12; Description=Paired amphipathic helix repeat
MDALQYIKEVQCAFHDSTEKFDKFMDVMKDYKFHRIDVGIVVEKMEEILKDHGDLILGFNKFLPKGYEILLLDEGEDGFGNASKYLKKIQDRFENKDHVYKSFLNILLKYKNNGVTLYDTYHEDKQKVVTSLNRSKTNQLC

SEQ ID NO: 127774 - protein, 44 aa, Glycine max
  Coding DNA Sequence Number=SeqID_36089
MEDRVTIDRSSSLPGVGQAENVAARLARLGELSSPRRATPAPKI

SEQ ID NO: 127775 - protein, 50 aa, Glycine max
  Coding DNA Sequence Number=SeqID_36090
TLWIAQQCFLSTSGMSRNFTDCLTMGVKYLEAVKRRLHATKQWSPDEIRV

SEQ ID NO: 127776 - protein, 147 aa, Glycine max
  Coding DNA Sequence Number=SeqID_36091
QTQEHRSLEQMDQWFALNSGFTCDSPQILASPHQLDLAPYASGPYNAQWNAPGLLHDKHTLCSSRILGEMEVDEPWLGLWLPLNYQVDMGARMAFVDNWAVGKEKVGYWLSNDIVGSTSIISPAKTKSAKLEGATWAARFSTFGRIL

SEQ ID NO: 127777 - protein, 232 aa, Glycine max
  Coding DNA Sequence Number=SeqID_36092
  Gene Ontology: Mol. function=motor activity; Cellular component=cell projection
  Homolog annotation: Hit_ID=UPI00016621D1; Match level="QueryCoverage =82%, HitCoverage=40%, E-value=1e-17, Identity=34%"; Hit description =UPI00016621D1 related cluster
  Subcellular localization annotation: CTP_CleavageSite=46; ConfidenceScore=5.30e-01
MLSHKSGPLGTSTLSFRGLHVVTFRGLHILTFRGSCTFTFRGLHVLASRGLHVLAFKGLHVLAIRGLHVLIFRGLHVLNFKGLHVLAFRGLHVLAFRGLHVLPFRGLHALAFRGLHVLAFRGLHTLTFRGLHALAFVGLHALTFRGLHVLTVGGLHALAFSGLHALAFRGLHVLAIRGLHVLAFRGLHVLTFRGLHTLTLERTTRPHLRRATRPRLRRTTCPPFQRATRPRL

SEQ ID NO: 127778 - protein, 205 aa, Glycine max
  Coding DNA Sequence Number=SeqID_36093
  Gene Ontology: Mol. function=membrane alanyl aminopeptidase activity; Cellular component=plasma membrane; Biological process=proteolysis
  Homolog annotation: Hit_ID=P04825; Match level="QueryCoverage=100%, HitCoverage=23%, E-value=1e-116, Identity=98%"; Hit description =Aminopeptidase N
MENKGLNVFNSKYVLARTDTATDKDYLDIERVIGHEYFHNWTGNRVTCRDWFQLSLKEGLTVFRDQEFSSDLGSRAVNRINNVRTMRGLQFAEDASPMAHPIRPDKVIEMNNFYTLTVYEKGAEIIRMIHTLLGEENFQKGMQLYFERHDGSAATCDDFVQAMEDASNVDLSHFRRWYSQAGTPIVTVKDDYNPETEQYTLTISQ

SEQ ID NO: 127779 - protein, 64 aa, Glycine max
  Coding DNA Sequence Number=SeqID_36094
MSELPSKRETRAGDNGGCRNLPFGGRATRGSRVRVPRKEYARSCHQSLFEENVRKTGKDVIYEF

SEQ ID NO: 127780 - protein, 64 aa, Glycine max
  Coding DNA Sequence Number=SeqID_36095
MKKQQWKRSGRQRRRGERRRHPLRNKPWKKELHHQDEPWIRSLERMLQWRKRKRERKREGGARN

SEQ ID NO: 127781 - protein, 487 aa, Glycine max
  Coding DNA Sequence Number=SeqID_36096
  Gene Ontology: Mol. function=transporter activity; Cellular component= outer membrane-bounded periplasmic space; Biological process=transport
  Homolog annotation: Hit_ID=A4WAN4; Match level="QueryCoverage=46%, HitCoverage=73%, E-value=1e-111, Identity=86%"; Hit description =Extracellular solute-binding protein, family 3 precursor
  Pfam annotation: Domain name=SBP_bac_3; Domain location=322-486; Score=16.0; E_value=5e-09; Accession=PF00497.11; Description =Bacterial extracellular solute-binding proteins, family 3
GCGTPVEGDAFVRNKESGQFFDPAKLHTLDHRGDFFQVAGPLNIGRTPQGRPIVFQAGASDDGKKLAAKHADAIFTHHETLDEAKAFYRDVKQQLETHGRRPSDLHIFQGVSVIVGKDADDVENQYQTTAALVSINDALNYLGRYFEHHDFSQYPLDEPFPDIGDLGKNSFRSTTDEIKRNARERNLTLRQVALEAASPRPRFSGRHAGHLPALCGPGRAGSAGTRPVPHRLPGHHAARKPGSGPTEKSLYTTIKENTAMQKTSLILALALAFTPAVWAENVNINGTGVSIEANKTPINTAKNGDAIARLPKDYRFAVPGKFTVAVAGLNQPPLTVFSDDNKTLLGSEVDVARLVADSLGLELNVVPTSWEDWPLGVASGKYDAAISNITVTKERKQKFDFATYRKDSLGFYVKSTSPITSLQKAEDIAGLRIIVGSGTNQESILLAWNAENLKKGLKPFTPIYTKDDAAQTLALQSGRADAYFGPN

SEQ ID NO: 127782 - protein, 106 aa, Glycine max
  Coding DNA Sequence Number=SeqID_36097
MYPPLELIHKRCTLSCSQSNPSRCTIYLYHKGCTLQCVKTKISGGRRETQKEFRRLVLGEFFLAKGEENEKMNNTSFQGLENQKTSESFWYKEEEEVQRDSRLVKD

SEQ ID NO: 127783 - protein, 135 aa, Glycine max
  Coding DNA Sequence Number=SeqID_36098
MGKAEEVQEKMKADMEAMKEQMATMMEAMMIMKKIMEASAVSVAATSTVAKVNPMPPSSLNQMNHPTSGIVGKDLGSTGAPHDVQIQNEHAFPPYGFASQLYATQCGVHSPMRMSITTPKPVESQQPQTDHAHVS

SEQ ID NO: 127784 - protein, 32 aa, Glycine max
  Coding DNA Sequence Number=SeqID_36099
VSDRQVIRRPAQDVKEALLGGDLVPFKFLPAI

SEQ ID NO: 127785 - protein, 74 aa, Glycine max
  Coding DNA Sequence Number=SeqID_36100
MDHFQVFLRFFRRFPQINVSGDSVRIPFVEHASRESRVARPQKGTLRHPLITKLTSLRNFLEKLELSYTHPSKS

SEQ ID NO: 127786 - protein, 179 aa, Glycine max
  Coding DNA Sequence Number=SeqID_36101
LGYPMRGVPSDESITPFIARGFGDHNARDKELRGSSNGIIGDYHKWLRVRTQGLDWLPNLKTVRDDEVKASEESDEVQALKAELERARVVEEKFKFIAIKVKGIITGQRHDLEGRAKVQREAKSSGDSRAKAERMSTPRYQQKGKQGKGSQELPPFLAKAKAVADTYSAPEEIHGLLSY

SEQ ID NO: 127787 - protein, 49 aa, Glycine max
  Coding DNA Sequence Number=SeqID_36102
MWTPGIMRTNNLRMMVDDPVNSISSHAMIPIAKKWIEAMNEEYKFHARQ

SEQ ID NO: 127788 - protein, 47 aa, Glycine max
  Coding DNA Sequence Number=SeqID_36103
VPVAPSKVSRSPTNRAFIKKYCAPRQAQGETPQQPGDGRQQTHHHHL

SEQ ID NO: 127789 - protein, 268 aa, Glycine max
  Coding DNA Sequence Number=SeqID_36104
  Gene Ontology: Cellular component=mitochondrion
  Homolog annotation: Hit_ID=Q6YSR1; Match level="QueryCoverage=17%, HitCoverage=40%, E-value=4e-21, Identity=97%"; Hit description =Putative uncharacterized protein orf115b
VDSRGSHTRNWKDKQTHPVDCRATSPTTQERDSLKSQGRGWPRGPTWRLGISAGNAKAYLIIGNTLTLGTGAWPKSRVAQSSIKEIPVLEYSSKVIKPTRTTKEEEEKKAYDEHLFESINHPLHHPYTGSLVPLMIILCVLSGLESGYTLHMMDPAGGQPAANPAAEQPSNVPSGASTSGWRSFEEGVLLESSNESSEASVNQQPVIPELEPPLLDDNTRRAELAVRLRANWWGIAYNERILDSFVRSQLAIERHIEAALVADGYSPQ

SEQ ID NO: 127790 - protein, 91 aa, Glycine max
  Coding DNA Sequence Number=SeqID_36105
  Gene Ontology: Mol. function=structural constituent of ribosome; Cellular component=chloroplast; Biological process=translation
  Homolog annotation: Hit_ID=Q32703; Match level="QueryCoverage=46%, HitCoverage=100%, E-value=4e-15, Identity=92%"; Hit description =Putative uncharacterized protein
MNSQYICFYLMPFFVHGSIFWCPRRRGTTPIHPELGGYSGEQISSGDDGVGPVAQRIRARGYEPRCRGFESLLAHNRPKREGFFPLGVGKS

SEQ ID NO: 127791 - protein, 174 aa, Glycine max
  Coding DNA Sequence Number=SeqID_36106
MCSGGGSMLFLRINIIGESSNDESFNNHISSNVGSDNESNVPNGDFTTTGGVATSGSIICPNIEEEEVESPLPIPLQNVIDLDLEAIVVHVLVLHPIIHPSTLPPSKPKTTTKEYPPLTLIEESNKVVSKDKHCFKINTRLLQQTKPCFKINSRSSLASKQSVSKTSKALVIDY

SEQ ID NO: 127792 - protein, 65 aa, Glycine max
  Coding DNA Sequence Number=SeqID_36107
MITKDDDKGDDKKLKDRIKNTSIFKRKVDFKNQESRFKRSRVQESRFKIKGRLNQDKYEKVFLKN

SEQ ID NO: 127793 - protein, 95 aa, Glycine max
  Coding DNA Sequence Number=SeqID_36108
MGQTTTLRGLLIGLDDVPQPKSKASARWIVVKCNRQKGSTECGYYVMHWMSTIILGTFRNNWEAYFNNPRPLEPERLKALRIQWAQFYLRVRDQA

SEQ ID NO: 127794 - protein, 104 aa, Glycine max
  Coding DNA Sequence Number=SeqID_36109
MILVNLVRLSRRLPFKGGGRDMTRVITHDRRHLYPKWGLLMCPSVLLSRPTAFGRGWCVVAGRVGSASAAELTAAAVATLFSISCLIPNMASIMEAICSFKADT

SEQ ID NO: 127795 - protein, 160 aa, Glycine max
  Coding DNA Sequence Number=SeqID_36110
MQEQYVHYDAEEMFMRCMIRMHLRTREPRKIISSDLHTWGCSAPCFTIPHFLRIGLTHKKVPSGVANCRNVPFCGRAKARLTGVLSKGGKMHGVATNVYLWKTSEKPKVDKSETFAPTYPPSKRKSDLRSSFLRVNHTISFYWKGDHLKVLDLKNDPLTW

SEQ ID NO: 127796 - protein, 74 aa, Glycine max
  Coding DNA Sequence Number=SeqID_36111
MALGVRLLEPTEVIITVNLKDTRLPCSGVSACPKLGRDDDLSVVTLASICVRSEVPESRKQQCVANRDRVVVLP

SEQ ID NO: 127797 - protein, 71 aa, Glycine max
  Coding DNA Sequence Number=SeqID_36112
MGSKIYPKVHENPRAFFRSSSPSLLESSIQYAWGVGLHHPRTSLLNRRAYRTNPQEIKEIESQVKELLEKG

SEQ ID NO: 127798 - protein, 81 aa, Glycine max
  Coding DNA Sequence Number=SeqID_36113
MVIILPKDNVVIWFCSLHDRPDNYLKSIINSALKGFNDNQGSKFKVAARCIVVKYFVDQRLLKPERMKGNLHSMGNILFKS

SEQ ID NO: 127799 - protein, 99 aa, Glycine max
  Coding DNA Sequence Number=SeqID_36114
MSNHKSTESALKNFKVQKNPKEECKAVMTRSKRFVENEEEKSVGLKKKAVEEKGIDGRKNDVRGENNQEKEKQIMVNKKELNDQEKEKEVEKEKENKKN

SEQ ID NO: 127800 - protein, 99 aa, Glycine max
  Coding DNA Sequence Number=SeqID_36115
  Gene Ontology: Mol. function=peptidyl-prolyl cis-trans isomerase activity; Biological process=protein transport
  Homolog annotation: Hit_ID=A8GAQ8; Match level="QueryCoverage=100%, HitCoverage=22%, E-value=5e-47, Identity=95%"; Hit description =Trigger factor
  Pfam annotation: Domain name=Trigger_N; Domain location=1-99; Score =91.2; E_value=3.2e-24; Accession=PF05697.4; Description=Bacterial trigger factor protein (TF)
MQVSVETTQGLGRRLSITVPADTIKQAVKKELINAAKSVRIDGFRKGKVPMNIAEQRYGASVRQDVLGEAMQRSFVDAIIKEKINPAGAPNYVPGEYKE

SEQ ID NO: 127801 - protein, 94 aa, Glycine max
  Coding DNA Sequence Number=SeqID_36116
YLQHLVHQQAANHRGQVQTHECLYQLSLSLQSQGFAPFACPTPDQFRAEVAWPGDWPEAQAGEAPAEALDDADEARMDEEMTDLLDFLGGSRAT

SEQ ID NO: 127802 - protein, 199 aa, Glycine max
  Coding DNA Sequence Number=SeqID_36117
MASSVLKIINEENFEAPEEDEEVRPLKIELGKARLAKEKFKLVATDVRKECVELRKENAATARALERETKRARKEEHGRDKFRGALWGSNSELKLRREEKDQSRAHSMVLKEELAACSRSKRSLSQCLCKTETNMLAIINKYQEELNLATVHEHKVADEYARVYAEKEARGRVIDSLHQEATMWMDRFALTLNGSQKLP

SEQ ID NO: 127803 - protein, 83 aa, Glycine max
  Coding DNA Sequence Number=SeqID_36118
MSRNLMDYAIVPSLAFGILRNFMDYALTLPFDSQHVVELHGLPNNGCQVPRSGQAKVASQQTDGARTKLGYDNCLSLLVFYWR

SEQ ID NO: 127804 - protein, 161 aa, Glycine max
  Coding DNA Sequence Number=SeqID_36119
NGPKEAASKRSRKDKAAEETSSAPEYDSHCFRSAEHQQRFEAIKGWSFLRERRVQLRDDEYTDFQEEIVHRRWASLVTPMAKGQWIPFDADALSQFLGYPLVLEEGQECEYGQRRNRADGFDEEAIAQLLCILGQDFARTAAGRRVQIMRTNMTTLTQIWM

SEQ ID NO: 127805 - protein, 97 aa, Glycine max
  Coding DNA Sequence Number=SeqID_36120
MERYSQHLVRQQAANHKGQVQIHECLYQLSLSQQSQGFAPFACPTPDQFRAEVAWPGDWPEAQAGEAPTEAHGDAEEARIDEEMKNLLGFLGGSGAT

SEQ ID NO: 127806 - protein, 85 aa, Glycine max
  Coding DNA Sequence Number=SeqID_36121
  Subcellular localization annotation: CTP_CleavageSite=65; ConfidenceScore=5.20e-01
MRGDCFTIFPSHPIFGAQNCVFVYVSSTFEFGAMRSDCLDQFSILTLFRSPMNCVLVHVSSTFKFAAMRSDCLVQFSILNLFGAP

SEQ ID NO: 127807 - protein, 148 aa, Glycine max
  Coding DNA Sequence Number=SeqID_36122
MANHIISSRDSGGITLETSSTKDQGGPSNKPQQQGPSLYDRTMKLEKNLAQFMQVSMSNPKSTESTIKNLEVLVGQLEKQLVDHLSSSFGANTEKNPKEECKAVMTRSRLVAMKESENGIGADKQQLVSNLALEPVVEFLSEFEEELE

SEQ ID NO: 127808 - protein, 143 aa, Glycine max
  Coding DNA Sequence Number=SeqID_36123
MAAQLIHDRVVMECLEGVWETLEGNERCRFRGTIRLTATSLVHPEEPARTLQQPVEWILPTPTPYRLVEPIQVIEVSSSDEDPEEDPEELPPEPAVDALDFPEDDEDPLPDVDSPEDIMSASEADSTEESGPGGTTNSEDYSS

SEQ ID NO: 127809 - protein, 147 aa, Glycine max
  Coding DNA Sequence Number=SeqID_36124
  Gene Ontology: Mol. function=binding
  Homolog annotation: Hit_ID=A7Q1F1; Match level="QueryCoverage=93%, HitCoverage=9%, E-value=1e-51, Identity=72%"; Hit description =Chromosome chr7 scaffold_44, whole genome shotgun sequence
  Pfam annotation: Domain name=HEAT; Domain location=55-91; Score=22.3; E_value=0.0018; Accession=PF02985.13; Description=HEAT repeat
  Subcellular localization annotation: CTP_CleavageSite=36; ConfidenceScore=5.15e-01
MEFCLASPCKIQVSSPTIIVERAGFFAWTSKSWRVREKFARTVTSVIGLFSSTELPLQRAILSPILQLLNDLNPAVREATILCIEEMYTQAGSQFRDELQRHNLPSSLVKAINARLEGIQPNVCSSDGISSGYNAGEIKPVGVNPKK

SEQ ID NO: 127810 - protein, 172 aa, Glycine max
  Coding DNA Sequence Number=SeqID_36125
MGEWWRQFKFDLTSKWALVADKESVDDTRPFMGGCVRATGAGVTIKQYFGPAPRTSRTSSYMAPEDLEQLTQQIRDQLEESIIEKFQSQMQSQGLALPPEPEVGPSATRVSTKESYVNPLGNDPDTGDSDKCELYIEENHPRLVALGRVCEGSTIVHNIPLLHDQVKVRVEK

SEQ ID NO: 127811 - protein, 62 aa, Glycine max
  Coding DNA Sequence Number=SeqID_36126
MKNIPDSGVIFTFEEGRQKRGSCSYVPSIEEEIQTYVVLSKGRIKRFFFTWKVVLLRRWTLK

SEQ ID NO: 127812 - protein, 190 aa, Glycine max
  Coding DNA Sequence Number=SeqID_36127
MVIDQSLFYDLTQLSSEGVPFEGTLDDDWKFDFSMHDARRLVCTNQADMTGRLLAGSLASESRILHYLIVRILLLRSSNLAQVSEEDLIVMWAFHTYRQIGWAHLVQSFLIGAAVVASFGYCKERDGSWVKKGAQPNDDKGQLPVEGDSSLLQSILDKFDGLQTYVGERFDALERQVDMRFDAMDSRITK

SEQ ID NO: 127813 - protein, 215 aa, Glycine max
  Coding DNA Sequence Number=SeqID_36128
  Homolog annotation: Hit_ID=Q84VH5; Match level="QueryCoverage=99%, HitCoverage=28%, E-value=5e-76, Identity=71%"; Hit description =Envelope-like protein
  Subcellular localization annotation: CTP_CleavageSite=21; ConfidenceScore=5.30e-01
MATSPKATASPGSPSVPSSPSSTKAPSNQEQPEFHIQPIQMIPGQAPVPEKLVPKRQQGVKTSENPSLATSPREVDTEMDKKIRSIVSNILKNASVPDADEDVPTSSTPNVSVPDADEDVPTSSTPNVSVPDADKDAPTSSTPNAEVLSSSSKERSTEEEDQATEKTPAPRAPEPAPGDLIDLEEVESDEEPIANKLAPGIAERLQSRKGKTPIT

SEQ ID NO: 127814 - protein, 157 aa, Glycine max
  Coding DNA Sequence Number=SeqID_36129
MALRKLSAKRSRKDAAAEGTSAAPEFDNHRFRSTEHQQRFEAIKGWSFHRERRVQLRDDEYTDFQEEIAHQHWTSLVTPMAKCRNMPFCGRARRGSQVRFPKEERCAESPPTFICGKRRKNRRKPVKTKFLSLGVVFTFEEGISTSHVCLKGQQPIF

SEQ ID NO: 127815 - protein, 45 aa, Glycine max
  Coding DNA Sequence Number=SeqID_36130
MGKDWGPSTADVGYTGRSSHSTALGPYGSSPAGQPNAACRVPSFA

SEQ ID NO: 127816 - protein, 92 aa, Glycine max
  Coding DNA Sequence Number=SeqID_36131
MSASSPSQAKEQDDDTKPLWTYVTKIKKVRAHLLKMTRKRVRVCQKVTVAKLIDLKKIDNEATLRVERSKTKSVSLPPGSTQHQMDTNTLGG

SEQ ID NO: 127817 - protein, 79 aa, Glycine max
  Coding DNA Sequence Number=SeqID_36132
AKVQRGLRLCLNGIFYHGNPNLDIWGETNLGVKGEVGIMVAGQDVAEQQSHPYLSQGGHVGAHDPHPSPGSSPGQNLAP

SEQ ID NO: 127818 - protein, 164 aa, Glycine max
  Coding DNA Sequence Number=SeqID_36133
DRAYKTPSGPEEVQQGPGVSSSGYGPLSVLQGARPPARSCHRDIGIAPTKTPSGPGEVQQGPGVSNSGYGPLDRAHKGTQWTRRSIAGSWSCQALIMGLCQFYGVPVTSSKGIRPPTNRAFIKKYCVPRQAQGEIPQQPGDDRQRATDTPPSPLEFTSAHPQKG

SEQ ID NO: 127819 - protein, 88 aa, Glycine max
  Coding DNA Sequence Number=SeqID_36134
MVSQDFGSRLVEWLDMIHVRVWFGSRIKRDAPHYFHDTNAKMMIWKFYAKLVVHAPMRTLKCQIFMRYLQQVTDAQDFGGNSKGRRPL

SEQ ID NO: 127820 - protein, 79 aa, Glycine max
  Coding DNA Sequence Number=SeqID_36135
MMTKVMTKSSKVNQRMSSRFKRKVDFKNQESRFKRSRIKIQEIKIQDSRFMKKLNQDKYEKCLSTLKFKFKCEESHPFT

SEQ ID NO: 127821 - protein, 46 aa, Glycine max
  Coding DNA Sequence Number=SeqID_36136
MRRYPSGYPYKRFFLILTREVRRRIPSGYPYKHSFAIRQTQSPVAC

SEQ ID NO: 127822 - protein, 94 aa, Glycine max
  Coding DNA Sequence Number=SeqID_36137
MITKDDDKGDDKKLKGQSKNEFKIFKIESRTLQVSKGKLISRIKNQDSRDQDSRLKIDSRIKRRLNQAVNRFSQCFGNRLPVPLNVESFQIHDM

SEQ ID NO: 127823 - protein, 89 aa, Glycine max
  Coding DNA Sequence Number=SeqID_36138
MTQSENSFDCSPFPNTKSVQSLRSLSQHIGGYILCGTSRGYIYLGLTKNKRGYISCGSVLVEGTSTRFKENKGGYIPCGSLLVKGFLQD

SEQ ID NO: 127824 - protein, 147 aa, Glycine max
  Coding DNA Sequence Number=SeqID_36139
MGKRRKLNIIQNDGQSQAKEQSIESSTEVNQNNNSILEENAQFEGEQHIPEDSHVQSHTSLESASESSTKGKKRTRGYTHMLDVWDLPDGEFILVEVDHWGNPMGWEGKTLNVIRSLVRRHQCAPINFLSWKDMPKDYITDMVELIQ

SEQ ID NO: 127825 - protein, 261 aa, Glycine max
  Coding DNA Sequence Number=SeqID_36140
MQSQFQSEMQSHGLALPLEPEVGPSAARVSTKESYVDPSGNDPDMGDSDKCGLYIEQNPPHLVALGRVYEGSTTIHNIPLLHDQVKVGVEEVKHADAPIPVPTNEGVVGPAKLADRSDHEVDDPLYLMTLTIPQLFLKPFQVMWDATVFRVFNEDFPLYIKHEDLSEIAHGGQCLNISVIQLWILHLTETSIRAGNSDVYGFLEPHALKGLDDTPQPKSKAGARWIVVICNRQKGNTECGYYVMHWMSTMILGSFRNNWET

SEQ ID NO: 127826 - protein, 127 aa, Glycine max
  Coding DNA Sequence Number=SeqID_36141
MLRVGGWWEPRKEAMWDSFLGKEVLKSKYGGWQNLGLNNPTYKSSCWWKDLGKVVGTLARGGWFDVHTRSSCGEDHTLSGEKCYIMSLWMLSLMSRLRGINMIAYYGILMPQALSQWPPPIGSFFNP

SEQ ID NO: 127827 - protein, 68 aa, Glycine max
  Coding DNA Sequence Number=SeqID_36142
  Subcellular localization annotation: CTP_CleavageSite=55; ConfidenceScore=5.42e-01
MLSLAHQWAKRASTAQRSFCALSTTEESGRASTSRLRAKRKISALSVAIVFSQAQCMIGAKLKSSYSR

SEQ ID NO: 127828 - protein, 113 aa, Glycine max
  Coding DNA Sequence Number=SeqID_36143
  Subcellular localization annotation: CTP_CleavageSite=54; ConfidenceScore=5.08e-01
MTLGKHHPHVEQLSTGKGHPNQPANSISLFPWFPASFSCIINKFGHIFSISKISSMMPVLCQFLDYLSNKQAVDFLGGNKDVQLPVHAHALGMQKSSNMLQEPTHTWRMKNKI

SEQ ID NO: 127829 - protein, 84 aa, Glycine max
  Coding DNA Sequence Number=SeqID_36144
MKDKRDEEKIEKQKKKMDSKALAPKVKEKEKEGRCSYKKFVKKESHFATKGDIKRALLLKQSFYLLLSRETSLSTATILPLETY

SEQ ID NO: 127830 - protein, 106 aa, Glycine max
  Coding DNA Sequence Number=SeqID_36145
MHLPVKPLPHKTSNYKFWKKELWKGVNNVCMRRSSVGELVPLDLEIEATFRRNNAERKRKLLHDRTIASILEEDHFSESSSSNSPTSRESQTEEFEVEVMAEEQPQ

SEQ ID NO: 127831 - protein, 208 aa, Glycine max
  Coding DNA Sequence Number=SeqID_36146
  Homolog annotation: Hit_ID=A5BMH4; Match level="QueryCoverage=92%, HitCoverage=20%, E-value=1e-14, Identity=29%"; Hit description =Putative uncharacterized protein
GGITIPKERLIEKSGNVAACKKTPPNAVEELKEYMVNKKSGTTYNSSGSGNMANIRYFEFGEPIGCDGSEDEFADSCNATAKTKCGTKKGAMDKFCKNPKNAINRRKMEMLRQMNIRESMDKNEVLKVHQYIARFWYQAGLSFNLIKLKSFENMVVVIGQYGPYLPIPSYYDIRVPLLKKEVEYTKNLMKGHRAMGQVWLYYYVRCMD

SEQ ID NO: 127832 - protein, 85 aa, Glycine max
  Coding DNA Sequence Number=SeqID_36147
MVDALATLASMFQLTPHGDLPYIEFRCRGRLAQYCLVEEERDGLGSSSSMDSFASWKMNGSGMEKEEREETPLQGEDESRRSSPP

SEQ ID NO: 127833 - protein, 234 aa, Glycine max
  Coding DNA Sequence Number=SeqID_36148
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=67%, HitCoverage=22%, E-value=3e-12, Identity=29%"; Hit description =Gag/pol polyprotein, 3'-partial, putative
  Pfam annotation: Domain name=G-patch; Domain location=101-145; Score =17.9; E_value=0.0013; Accession=PF01585.14; Description=G-patch domain
MPKSTLEKLPFNASHLKPSSMVVRAFDGTRQELSFGTPVDPLDGGHLVIVSGEEDILVSCPTSMPYVEATEESLETTFQSFEVVSIASVDSFSGQPCLFDTAMMVAWVMLGNGYEPEMGLGRNNGGRTSLISTRGNHGKFGLGYKPMQADIRKSVAGRKSGSQGSQLGREVEGGPPCHISRSFISMGLGHEGQVVPICKNDSPSGSVLVRPCPPGFRLGNWRVEERPDIYATSI

SEQ ID NO: 127834 - protein, 52 aa, Glycine max
  Coding DNA Sequence Number=SeqID_36149
MRRNSPAYSRDTSFLPQPSFFFGRPFTGTSSGCKHATAAGHAAQPRDIGYLG

SEQ ID NO: 127835 - protein, 77 aa, Glycine max
  Coding DNA Sequence Number=SeqID_36150
MPPVFGVVNPDFPLYIKHEDFSEIAHGGQCLSISVLQLWILHLTETCMRAGNSDIYGFLEPQSIQKIQMMKKTSHSL

SEQ ID NO: 127836 - protein, 90 aa, Glycine max
  Coding DNA Sequence Number=SeqID_36151
MALKERSLEMGKLVHDGLPSLNKSTAGEGTDCKPDQHQSVVPEVDSRGSPVILTEITMHQSEKILQQEAQLKKVIADLEAEKKAHKEERA

SEQ ID NO: 127837 - protein, 84 aa, Glycine max
  Coding DNA Sequence Number=SeqID_36152
MPPSSPRRARLLPPEGTRPSGSELYEFRNDTCFPSVMLWNLTDYVITPFLAFGMLRNLTDCVTMLPFDFRHVTELHGSCNNALF

SEQ ID NO: 127838 - protein, 72 aa, Glycine max
  Coding DNA Sequence Number=SeqID_36153
VDSRGIPRQPKVTAITKSRDLTNMSLATLFGKLQKHEMELIRLNQHEKNDKKKKGMHLRLHLQFKKQVIKEI

SEQ ID NO: 127839 - protein, 214 aa, Glycine max
  Coding DNA Sequence Number=SeqID_36154
  Homolog annotation: Hit_ID=A5BEY3; Match level="QueryCoverage=87%, HitCoverage=17%, E-value=2e-23, Identity=35%"; Hit description =Putative uncharacterized protein
  Pfam annotation: Domain name=zf-CCHC; Domain location=110-127; Score =13.8; E_value=0.012; Accession=PF00098.14; Description=Zinc knuckle
MGKAWAAVEELRMFLVADSLEEVNRKLDKFYMVLILRSLHSDFDHVCDQVLAGDQVPSMYFLITRLLRVPHALKDENLTDAVETSAMVAPRGRGGGRNSKGGRDGRSGCPQCTYCKRMGHTQENCYSLHGFPDKVAQVSESEKSESNFFDEEYQEYLKLKSEKFSNQASSSSVPCFSTACVSKSIRSPSPWILDSGASDHISGTWDGSTDWKKT

SEQ ID NO: 127840 - protein, 167 aa, Glycine max
  Coding DNA Sequence Number=SeqID_36155
  Homolog annotation: Hit_ID=Q9AVH2; Match level="QueryCoverage=28%, HitCoverage=16%, E-value=5e-20, Identity=97%"; Hit description =Putative senescence-associated protein
MTEGCGEGFCLANLPGDAFSLWGNFFEAKKQMMADAKFAGLLGEGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 127841 - protein, 188 aa, Glycine max
  Coding DNA Sequence Number=SeqID_36156
MERSMIDAASGGALGDMTPAEARNLIGKMASNSQQFSARNNAIVLRGFHEVATDSSSSTENKKLEGKLDALVNLITIQIYILLCSNLESMSNLKLMLQTFIIDLLSSKTNNNRIIMTFQAIDTIQVKGIIQILDGQVLHKQRQPVPHFQNVVGPSKPYVPPPIQQQQQQSQQRQPATEAPPQPFLRKS

SEQ ID NO: 127842 - protein, 222 aa, Glycine max
  Coding DNA Sequence Number=SeqID_36157
  Gene Ontology: Mol. function=structural constituent of ribosome; Cellular component=ribonucleoprotein complex; Biological process =translation
  Homolog annotation: Hit_ID=A8UES7; Match level="QueryCoverage=88%, HitCoverage=86%, E-value=3e-78, Identity=64%"; Hit description=30S ribosomal protein S2
  Pfam annotation: Domain name=Ribosomal_S2; Domain location=9-191; Score=211.3; E_value=2.2e-60; Accession=PF00318.11; Description =Ribosomal protein S2
MAKANVKDLLEAGVHFGHMTRKWNPNMAPYIFMEKNATKKQAKEVVAKHASELNMPYITERWPGGMLTNFVTIRKAVKKMNSIDKMKKDGTFETLSKKERLQVDRQRANLEKNLGSISDMVRLPSAIFVVDILREHIAVTEAKKLGIPVFGIVDTNSDPRKVDFVIPGNDDASKSIDMILNVVSDSIREGQSQRKADKEKSKEEGEKVSADTDADFDAEGIL

SEQ ID NO: 127843 - protein, 106 aa, Glycine max
  Coding DNA Sequence Number=SeqID_36158
VIRPPITRAFIEKYCTQRQAQGDAPQAAGAPPPPHQAGQVGAFDIEQYLRHLVRQQAANHRAHHGPEIGPRPKQERRPRKLPGDGEEAHEDEEMADLLDFLGGSGD

SEQ ID NO: 127844 - protein, 109 aa, Glycine max
  Coding DNA Sequence Number=SeqID_36159
MYGTSLKYATMLQALTNCLMMGAKHLTRTKEWSHVIEQRFPDEIRQNRGGGCRPARPGELSSPRRAQLAQASSARPGEQGCFLQKQPPSGGIFLEGPNGPGCYLHPHFY

SEQ ID NO: 127845 - protein, 55 aa, Glycine max
  Coding DNA Sequence Number=SeqID_36160
MEQVRFTQFGVLLRPIALKVVGPLLLDSNSSRDGTNPPSNSLYGNPQTRKQRDKQ

SEQ ID NO: 127846 - protein, 54 aa, Glycine max
  Coding DNA Sequence Number=SeqID_36161
MAAQLIHDRVVMGCLEGVWETLEGNEMCRFRGTIRITATSLVHPKEPSRTLQQP

SEQ ID NO: 127847 - protein, 169 aa, Glycine max
  Coding DNA Sequence Number=SeqID_36162
  Gene Ontology: Mol. function=motor activity; Cellular component=cell projection
  Homolog annotation: Hit_ID=UPI00006A2D9E; Match level="QueryCoverage =98%, HitCoverage=85%, E-value=9e-19, Identity=17%"; Hit description =UPI00006A2D9E related cluster
MSTSTLNFRGLHVLTFKGLHVLAFRGPHVLAFRGLHTLAFRGQHALTFRGLHAFAFRGLHALAFRGLHVLTLRGLHALAFKGLHVLPFRGLHALAFRGLHVLAFRGLHILTFRGLHALTFRGLHVLTFRGLHALAFIGLHVLTFRGLHVLAFRGLHVLTFRRLHVFSFR

SEQ ID NO: 127848 - protein, 146 aa, Glycine max
  Coding DNA Sequence Number=SeqID_36163
MSGKGLQHVRKSLSQYQRLRACLEIKWDTNWERGFLNSKTSTSLPSGTLERWQRHSKRHDFGYVAVVGAAGPLQLQVLHGGKQNVKVVAGRSSRRDEVVQAIAGALGFWRDSVPTSTVFDDFHQNYNDGVIDKCRCTTNAPHKKLI

SEQ ID NO: 127849 - protein, 22 aa, Glycine max
  Coding DNA Sequence Number=SeqID_36164
EYVGVIEAVPESNKHENAVTRK

SEQ ID NO: 127850 - protein, 195 aa, Glycine max
  Coding DNA Sequence Number=SeqID_36165
MDTMMEAMMSMKKIMEANAVAVAATSAVAKVNPTSPSGINQMNHPTSDMVGKDLGSTSGPYYVKIQNKHAFPPYGLPPNYTPPNVAYTPKEETHEIPHHNLADFEPCLGYATEGQAVGGIPMPNTLKGPQFRPQPQPLHFAVGRSPPAMAEKGKLDHIEKRLKDIEGGEDYAFANLEELFLVPEHGHSQVQGAGL

SEQ ID NO: 127851 - protein, 69 aa, Glycine max
  Coding DNA Sequence Number=SeqID_36166
MRPDEVVPLEPIVPTIHEIVEAGSRSSYTSTGETSKSSYTYDGDARRPYHANPKTFIHSFNYPSSTSDR

SEQ ID NO: 127852 - protein, 172 aa, Glycine max
  Coding DNA Sequence Number=SeqID_36167
MAKFDPEIVLEFYANAWPTEEGVRDMRSWVRGQWIPFDPDALSQFLGDPLVLEEGQQCEFSHRRDMADDFDEETIAQLLCIPCMAPTRHPLEPDKSNRALGFLVLIMGLCQSYGVPVTSSKATGAPPPPWQVDPAGPLGVEHYLQHLVCQQAANHHGQVQIHECLYRFCLGQ

SEQ ID NO: 127853 - protein, 43 aa, Glycine max
  Coding DNA Sequence Number=SeqID_36168
MARIAKVVKISAQELDQVKQNRNGVVRIPRKHLEEKAKALEDQ

SEQ ID NO: 127854 - protein, 158 aa, Glycine max
  Coding DNA Sequence Number=SeqID_36169
  Homolog annotation: Hit_ID=Q3BKI2; Match level="QueryCoverage=39%, HitCoverage=100%, E-value=2e-24, Identity=87%"; Hit description =Putative uncharacterized protein
MVELSGIEPLTPCLQKQVLSQLSYSPIQLDHPGLINQARQQFASTNSLNPNPHSHMQMVGPGRLETSDPTLIKPREGSSCSRQASYQFHSFLRKEVIQPQVPLRLPCYDFTPVADPTVVSCLLAVSALPSGKTNSHGVTGGVYKARERIHRSMLICDY

SEQ ID NO: 127855 - protein, 96 aa, Glycine max
  Coding DNA Sequence Number=SeqID_36170
MFAFNNALKGLNDTPQPKSKDGARWIIVKCNRQKGSTECGYYVMHWMSAIILGSFKNNWEMRKVKSREEGNKHTRVFILVQQQPVPTSSPQVTCGP

SEQ ID NO: 127856 - protein, 57 aa, Glycine max
  Coding DNA Sequence Number=SeqID_36171
MAYERGGDFLEDARKILNREDYKDTSVSPWRLPRALSGPAFRLTGHSAVMAALLIHA

SEQ ID NO: 127857 - protein, 58 aa, Glycine max
  Coding DNA Sequence Number=SeqID_36172
MGVQIATRPIWALQKIPPEGGEECKKKKIPQPFRNLAKVFNRSSTFSIRSSSFFDLQR

SEQ ID NO: 127858 - protein, 62 aa, Glycine max
  Coding DNA Sequence Number=SeqID_36173
MALWVKLTQRGEEYLDCLSHYQVGVVVEWVISKQRSSFDDAKSLLDENRLNQVKEQDQENLR

SEQ ID NO: 127859 - protein, 98 aa, Glycine max
  Coding DNA Sequence Number=SeqID_36174
MEFSPQIEMTHFIVSDIVATRRVVTMVTPIICGGGDDCALLILSTPAEDKRRRGERRHHPLKNKPWKEKLHHQESDLDKKLREEALMEEENEGGGHGN

SEQ ID NO: 127860 - protein, 68 aa, Glycine max
  Coding DNA Sequence Number=SeqID_36175
  Subcellular localization annotation: CTP_CleavageSite=32; ConfidenceScore=5.28e-01
MPISPYRCINWDRAHKTPSGPERSPNRALGVSSSGLRAFCQSYRGARPPRIAPTKTPSGPGEVQQGPG

SEQ ID NO: 127861 - protein, 59 aa, Glycine max
  Coding DNA Sequence Number=SeqID_36176
MFNPSWYLRITLKLVRKIVSREENPSRGASVTLPRRFRGRFHEDFPPFFIVLRRSSVFN

SEQ ID NO: 127862 - protein, 103 aa, Glycine max
  Coding DNA Sequence Number=SeqID_36177
MVEDPRRVTLEDYSSSTVPQFFTSIAQPEVQAQSVEDTVMASTLNSCLCRSSHSKISQNSLELGPFSLSRTFMHAELLKKGAKLPSQNLISGLNRWPCLCSCA

SEQ ID NO: 127863 - protein, 121 aa, Glycine max
  Coding DNA Sequence Number=SeqID_36178
MRLMRLSPRANVPVIQETVEAGESQLRQEATTLKRTSQTPEGPLSPGMDLSFAQQVVDPSTPIQERQADPPTPIMEMPEDPTTPVLRLSSTPLATPILHLINEEDMQDQDTQGTQDQSQEF

SEQ ID NO: 127864 - protein, 133 aa, Glycine max
  Coding DNA Sequence Number=SeqID_36179
  Gene Ontology: Cellular component=membrane
  Homolog annotation: Hit_ID=Q0UTU6; Match level="QueryCoverage=48%, HitCoverage=30%, E-value=7e-11, Identity=53%"; Hit description =Putative uncharacterized protein
MPVSANPDSLLANTTTELPDRLGADYDSVTRKQRAIAVGVAMLGVLEPLAPIRLFAGLANVPIPFSIVNYFGAWCTIVSIVAMRAHTRGRLFTSKQPRRLVLPDIPWYMRLHHGTFHSFLLQNYSTDIPSNFS

SEQ ID NO: 127865 - protein, 95 aa, Glycine max
  Coding DNA Sequence Number=SeqID_36180
QSGVNEQPEAYAANIYNRPPQQQNPQQQNNYDLSSNRYNPGWRNHPNLRWTNPPQQQQSVPPFQNVVGSSKPYVPPPMQQQQQQQQRQQATETPP

SEQ ID NO: 127866 - protein, 100 aa, Glycine max
  Coding DNA Sequence Number=SeqID_36181
  Gene Ontology: Mol. function=transferase activity; Cellular component= endoplasmic reticulum; Biological process=metabolic process
  Homolog annotation: Hit_ID=Q0UU38; Match level="QueryCoverage=95%, HitCoverage=27%, E-value=6e-39, Identity=86%"; Hit description =Putative uncharacterized protein
IRSPPQSAEPNDPSLKEERQHLTVLLLSEHDGRDTIVDLTRTLAEMAQKGDVRQEQINMDLIDAQLNDHVSSEPDLLILFSPTVQLKGYPPWQLRLTEIL

SEQ ID NO: 127867 - protein, 57 aa, Glycine max
  Coding DNA Sequence Number=SeqID_36182
MEGEMFAIAEWHGAGQHSDKWYPKAQNTVTTGPPPMGARHLRSLKGRHGPVLLQQAA

SEQ ID NO: 127868 - protein, 231 aa, Glycine max
  Coding DNA Sequence Number=SeqID_36183
  Homolog annotation: Hit_ID=Q84VH5; Match level="QueryCoverage=95%, HitCoverage=36%, E-value=1e-110, Identity=84%"; Hit description =Envelope-like protein
MDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVLTNHTSTVATESFAVKLPIAFPTVLCGIMLSQHPNILNNIDSVKKRESPLSLHYKLFEGTHVPDIVSTSGKAATSGAVSKDDLIAELKDTCKVLEATIKAKHKEENWSWNA

SEQ ID NO: 127869 - protein, 76 aa, Glycine max
  Coding DNA Sequence Number=SeqID_36184
MQKTTLVSACYQAFRLTDSKRKFIRITTRVRDNRKGVSAGYQLLGHGNKRRCGPTKSEALAPTYPPMRNSDLRSSG

SEQ ID NO: 127870 - protein, 28 aa, Glycine max
  Coding DNA Sequence Number=SeqID_36185
MGNSPSKWLIRRVNSQCDAAIRSTILLL

SEQ ID NO: 127871 - protein, 256 aa, Glycine max
  Coding DNA Sequence Number=SeqID_36186
  Homolog annotation: Hit_ID=A7Q2R9; Match level="QueryCoverage=29%, HitCoverage=26%, E-value=1e-25, Identity=75%"; Hit description =Chromosome chr1 scaffold_46, whole genome shotgun sequence
MKFMKLGTRPDTFYSEQATSTMYYVISSFPYLKIQNLLADDMEEREPLKFPTKYNIQMGMRWLIQGSQSGDSLLMSSDCLDRQLGPRLHGRTDDSGVNNRFTYKTTSYQDPVVEINYERADIIILKLKMTIASLSPDCLLQQSSTVEDSISFKFSYGITESVPCSYTEFAERLVLPQYKNLPDTEVKEFHRRDGFEVASADKMAKSCMVYFEMHLSLRKKIITKAFNGTIIVVEDDKGAERGMPSFNSQLPNSNSW

SEQ ID NO: 127872 - protein, 74 aa, Glycine max
  Coding DNA Sequence Number=SeqID_36187
MDRSTAAGEEKQMGNNKLDLKERKNKKSKLDVQGCYLPHRSPLSSTQCEQAEELTARKKRCELPTPILSLLELG

SEQ ID NO: 127873 - protein, 90 aa, Glycine max
  Coding DNA Sequence Number=SeqID_36188
MTETVCTDNRLGISARHLTSWVKMTKTVCTDNRMGISIRHLTSRVRMTETVCTDNRLGISVRHLTSRVRMIETAKDDVSLRVSTGLLAPD

SEQ ID NO: 127874 - protein, 254 aa, Glycine max
  Coding DNA Sequence Number=SeqID_36189
  Homolog annotation: Hit_ID=Q84VH5; Match level="QueryCoverage=100%, HitCoverage=38%, E-value=4e-88, Identity=70%"; Hit description =Envelope-like protein
MATSPKETSAPGFTLCTIISNQERLEFNIQPIQMIPGQAPVPEKLVPKRQQGVKISENPSLATSPREVDTEMDKKIRSIVSNILKNASVPDADEDVPTSSTPDVTVPDAEKDVPTSSTPNTEVLSSPSKEESTEEEDQATQETPAPRAPEPAPGDLIDLEEVESDEEPIANKLAPGIAERLQSRKGKTPIKRSGRIKTMAQKKSTPITPTSSRRSKVAIPSKKRKEISSSDSDDDVELDVSTSKRAKTSGKKVP

SEQ ID NO: 127875 - protein, 16 aa, Glycine max
  Coding DNA Sequence Number=SeqID_36190
MASMDTSAKVNSKMFS

SEQ ID NO: 127876 - protein, 94 aa, Glycine max
  Coding DNA Sequence Number=SeqID_36191
MVSAKCTYQNLELTDVKVPSVRRIRGGTYKTKDFDAQVKKRLSHEVLKVIVELSSSVGLSSHPSLSAASACLARQKNLAEHQYQGRALSARSVC

SEQ ID NO: 127877 - protein, 151 aa, Glycine max
  Coding DNA Sequence Number=SeqID_36192
  Homolog annotation: Hit_ID=Q1RSH0; Match level="QueryCoverage=79%, HitCoverage=62%, E-value=8e-10, Identity=33%"; Hit description=H+ -transporting two-sector ATPase, alpha/beta subunit, central region, related
HSNWEWQLNWRRHLFDSEIARADSFLGDISQQQLHPLREDTWIGKREPAGDYSTKSGYDLIWGELMEARQEQDYGAIWKLKIPTKTAVFTWRLLRDTLPTKQNLRRRQIPIDDMLCPLCRNKEEGLNTCSSIVAKPSLYGGNQCPRLILSL

SEQ ID NO: 127878 - protein, 96 aa, Glycine max
  Coding DNA Sequence Number=SeqID_36193
MGRIKRILRLCRFEFFGKGEGRHKRIQAVSPSFFWKREKRDTKRIQRLVLGEFFLAKGERRKMIAQVSRLENQKLWKVLVQRRRRSSKRFKACKGL

SEQ ID NO: 127879 - protein, 163 aa, Glycine max
  Coding DNA Sequence Number=SeqID_36194
NLTFRELHVLAFRGIHVFPFRRLHVLSIRGLHVLAIRGLHVLASKGRHVLAFRGPHVLTFRGPTFSPSEGYTSSPSEGYCPRLQRKTRPHLQRTTRPHLQRATRPHLQRTTRPRLQRTTRPPLQRTTSPQVQRATHPHLQKTTCPLLPRTTRPHLQRTTRPPL

SEQ ID NO: 127880 - protein, 92 aa, Glycine max
  Coding DNA Sequence Number=SeqID_36195
MERSHNFNNGKRSQEVSPTLKCYKCNQQCHSKENCLSNESWLEKNEKKIYKERRSKKAYIAWDDNDSSDGSDKEINLLSKDYEIDENITQED

SEQ ID NO: 127881 - protein, 69 aa, Glycine max
  Coding DNA Sequence Number=SeqID_36196
MKNYAKQANKKRKEVTYQGNPCGVCPDLSSFTGSGVYPDLSSFTGSGVYPDLSSFTGSGVIQIFVACIK

SEQ ID NO: 127882 - protein, 180 aa, Glycine max
  Coding DNA Sequence Number=SeqID_36197
  Gene Ontology: Mol. function=protein dimerization activity; Biological process=DNA integration
  Homolog annotation: Hit_ID=Q2R1C3; Match level="QueryCoverage=88%, HitCoverage=20%, E-value=4e-30, Identity=46%"; Hit description=HAT family dimerisation domain containing protein
MSRITEMFASSEYQDDDAPLWVKAHLLRIYGSGIATCPKVTNAYLVDLRRVCEEAENRLKSKNVPLPIDKRTPTPPTLPPKRRKSSNIESAFNIEDRNHLRAEIARMFYSAGLSFHLARNPHFVSSYSFAANCNLSGFLPPSYNALRTSLLQQERSHIERLLQPIKSLWSLKGVTLVADG

SEQ ID NO: 127883 - protein, 162 aa, Glycine max
  Coding DNA Sequence Number=SeqID_36198
  Gene Ontology: Mol. function=galactose transmembrane transporter activity; Cellular component=1-2nm peptidoglycan-based cell wall; Biological process=galactose transport
  Homolog annotation: Hit_ID=A1S5F4; Match level="QueryCoverage=99%, HitCoverage=39%, E-value=2e-26, Identity=43%"; Hit description =Glucose/galactose transporter precursor
MGYQKGMVIGFALAALGCLLFYPAVLLHTYALFLAALFVLASGIVLLQVAANPCVAIIGPKETASSRLTMAQAFNSLGTFVAPFFGAYFILSGLTNSVYAEGVVYPYFLIAGVLIVIALVLSKINLSGMESAQADESRWQDVLKDKGLLLGVIGIFALRGGR

SEQ ID NO: 127884 - protein, 105 aa, Glycine max
  Coding DNA Sequence Number=SeqID_36199
MVPVGEVCIVPGACSSDYIDWFFCISHPFMTPGHVLDPLPHGHAPQPRVVSQAPQTDIPRVPEPRASSTSAEDPRHVVEVCDDIAERLERHLSLGVARLAHRHLR

SEQ ID NO: 127885 - protein, 53 aa, Glycine max
  Coding DNA Sequence Number=SeqID_36200
FRVEVAWPGDWLKAWAGEAPAEAPAEAPDEADEAREDKGMADLLDFLGGSGAA

SEQ ID NO: 127886 - protein, 132 aa, Glycine max
  Coding DNA Sequence Number=SeqID_36201
  Homolog annotation: Hit_ID=Q2HW90; Match level="QueryCoverage=56%, HitCoverage=14%, E-value=5e-10, Identity=46%"; Hit description =Putative uncharacterized protein
MASQEKWVSFADILALLIFGVVLFPNVDSLVDLAAIDAFRAYHHSKESPVVAILADLFDTFDRRCEKNSSRIVCCLPALSVWLVSHLFQQDIRHPCPLQSYHSEAAQSIGFLDGRKEMREFFSHVGTTLTFR

SEQ ID NO: 127887 - protein, 170 aa, Glycine max
  Coding DNA Sequence Number=SeqID_36202
HVTCTLVSSRGGGPDDTRRYLTVIRTLLSSRGGGPDDKQRPKTKFGHSAPLYHPEAAGPMIRGDTLRLSAPFCHPEAAGPMTSRDQVWSFCTLVSSRGGGPDDTRRYLTVIRTLLSSRGGGPDDKQRPSLVILHPCIIQRRRADDTRRYLTVIRTLLSSRGGGPDDKQRP

SEQ ID NO: 127888 - protein, 63 aa, Glycine max
  Coding DNA Sequence Number=SeqID_36203
MWVQAIGLFAQATCAPEFGLPRPLNQRLLILHVGGGTVKQRRSELSRIGCWTNGLSFLKKKEG

SEQ ID NO: 127889 - protein, 136 aa, Glycine max
  Coding DNA Sequence Number=SeqID_36204
  Homolog annotation: Hit_ID=A2Q186; Match level="QueryCoverage=50%, HitCoverage=17%, E-value=3e-08, Identity=34%"; Hit description =Reverse transcriptase-beet retrotransposon, putative
MNANRNRNSIRGVFIDGSWTDDPHKVKEEVKSFFFHRFQEPIGQQPKIDGIRFQTVNLQQNNELLAPFMDEEIQKAIFKAAAKFFMKEGNSQKDCMDLMEISMLTKRKGWLGHQGYRNIQPHTTWKMEVAINARKW

SEQ ID NO: 127890 - protein, 105 aa, Glycine max
  Coding DNA Sequence Number=SeqID_36205
  Subcellular localization annotation: CTP_CleavageSite=12; ConfidenceScore=5.10e-01
MLVRMVRTLLFAAARVKSCPSMHSSCVIASLSGCARTVGPPPISGGAQEPLKGNYCPLKVRTRSPLKARACSPLKFRTCRLSKARECSPMMARMCNPLKVRACPP

SEQ ID NO: 127891 - protein, 122 aa, Glycine max
  Coding DNA Sequence Number=SeqID_36206
  Pfam annotation: Domain name=zf-CCHC; Domain location=49-66; Score =18.3; E_value=0.0026; Accession=PF00098.14; Description=Zinc knuckle
MAAQDEESEDEEDFSLFVKKFHKFVKNRRIERRQNFNHGKRFQEGSPTLKCYNCNQLGYIKANCPSNEQWPEKSDKKSHEERRTKKAYIAWDDNDSSEGSEKEEINILTKDYESEEDITQRD

SEQ ID NO: 127892 - protein, 166 aa, Glycine max
  Coding DNA Sequence Number=SeqID_36207
MSHPTFSTWAYCNRGVRRRGFTGIHHATCQLVPPAVERILARAYRPSALAAMMASLNAGHLIEPCYAHAVPDSTRSGNASGLVVPPGLPWQIAPRPASAQVFPHVGGKGGRCCCLIGGVSAREFSGGDVAGASASSFLFSALRHTFLAPVFYYPAHAGCVKLAPCP

SEQ ID NO: 127893 - protein, 68 aa, Glycine max
  Coding DNA Sequence Number=SeqID_36208
MGNCTKQSYGAWLQARGWRTHERKRNSWGSEKGLRMENCTKQSLRMVQTRGWRTLERKRNLHGAPKKG

SEQ ID NO: 127894 - protein, 57 aa, Glycine max
  Coding DNA Sequence Number=SeqID_36209
MRKKKDHSGVGSGERRRKEEKPQSREKWRKKKNCKRKKNRKRKKKNHNHEEEEETQP

SEQ ID NO: 127895 - protein, 197 aa, Glycine max
  Coding DNA Sequence Number=SeqID_36210
  Homolog annotation: Hit_ID=Q2HW90; Match level="QueryCoverage=47%, HitCoverage=19%, E-value=8e-11, Identity=36%"; Hit description =Putative uncharacterized protein
MGTNQTGKRFYQVKVKSPDTTSIKGLGRLMEPLQMQAFRKTYGKILELTIAEVSIEAIASLTQYYDQPLRCFTFGDFQLVPTIEEFEEILGCPLGGRRPYLSSGVSLFEQNCNCGQGFSKMFGPHKTDSERHGGPTTGVPRRQGKGYGQSRRLGPIYGCVSFANFWGRPLSKRGWFGGPSSNRRFPCMGGVARKVRW

SEQ ID NO: 127896 - protein, 205 aa, Glycine max
  Coding DNA Sequence Number=SeqID_36211
  Gene Ontology: Mol. function=transcription factor activity; Cellular component=intracellular; Biological process=regulation of transcription, DNA-dependent
  Homolog annotation: Hit_ID=A9CKR8; Match level="QueryCoverage=100%, HitCoverage=49%, E-value=6e-68, Identity=66%"; Hit description =Transcriptional regulator, ROK family
  Pfam annotation: Domain name=Crp; Domain location=30-59; Score=21.3; E_value=0.0037; Accession=PF00325.11; Description=Bacterial regulatory proteins, crp fami
  Pfam annotation: Domain name=MarR; Domain location=15-95; Score=-3.4; E_value=0.078; Accession=PF01047.13; Description=MarR family
  Pfam module annotation: Pfam domain module=Crp::MarR; Domain location= 30-59::15-95
MDMSGGANQIGVRAYNERLVLSLVRRHGGLSKAEIARLCGLSAQTVSVIMRSLEKDGLLIRGERLRGRVGQPSTPNAPQSRRRVLLRCQDRPAQRRSGVDGFCRPHQAQASQGPTPIPLPEWILPFVIEGMAELESKLSPAERQKIAGVGIAAPFELWNWAQEVGAPQIEMERWRDVDIRAGIAENVSYPVFLQNDATSACGAEL

SEQ ID NO: 127897 - protein, 124 aa, Glycine max
  Coding DNA Sequence Number=SeqID_36212
MAPTRHPLDPDKSNRALGFPALITGLCQSFGVPVAPTKEAANHRAHVRTNETLYQLSLSMQSQGFASFSCPTPDQFRAEVAWPGDWPEAQTGEAPPEAPDDGEEAHEDEEMTDLLDFLGGSGAT

SEQ ID NO: 127898 - protein, 404 aa, Glycine max
  Coding DNA Sequence Number=SeqID_36213
  Gene Ontology: Mol. function=nucleoside-triphosphatase activity; Cellular component=cytoplasm; Biological process=proteolysis
  Homolog annotation: Hit_ID=A4WGE1; Match level="QueryCoverage=100%, HitCoverage=81%, E-value=0.0, Identity=83%"; Hit description=ATPase associated with various cellular activities, AAA_5
  Pfam annotation: Domain name=AAA_5; Domain location=1-96; Score=34.2; E_value=4.7e-07; Accession=PF07728.5; Description=ATPase family associated with various
GPLSIQALKDEGRYQRLTEGYLPEAEIVFLDEIWKAGPAILNTLLTAINERRFRNGASEEKIPMRLLVAASNELPEADSSLEALYDRMLIRLWLDKVQDKSNFRSMLVSQQDENENPVAPSLQVTDEEYHQWQQDIGKIKLPDAVFELIYLLRQQLDLLPSAPYVSDRRWKKAIRLLQASALFSGRDAVAPIDLILLKDCLWHDAEGMNLMQQQLEVLMTGHAWGQQAMLNQLGAIAQRRIQLQQQQSDKTALKVNRLGGMFARKPHYELPAELTSPTLTLLLQQPLKLHDMQVVHITLEREALAQWLDKGGEIRGKLNGIGFAQPLNMEVDSSQHLVIRDVSLQGSRLALPGTASDSVPEEIKQQLEALDTEWHQQHTRFSEQQKCLFIHSDWLGRIEASLQD

SEQ ID NO: 127899 - protein, 129 aa, Glycine max
  Coding DNA Sequence Number=SeqID_36214
MAKFDPDVVLEFYANALAYRGGCARYVILGEGQFLGYPFSAGGGPGVRVWLEEEPGRWDFARTVAGRRVRIMRTNMTTLTQIWMTLLLSNIQPSDHNSDLPLPKCQLVWCPPGTLWTRISPTGPWDFPH

SEQ ID NO: 127900 - protein, 140 aa, Glycine max
  Coding DNA Sequence Number=SeqID_36215
ALWGSNSELKLQREERDTLRVDGLILKDELRVCLRSKRSLSQWLCETETNMLAIISKYQEELNLATAHEHKVAGEYARVYAEKEARGRVIDSLHQEATMWMDRFALTLNGSQELPRLLAKAKAMADTYSTPEEIHELLPY

SEQ ID NO: 127901 - protein, 86 aa, Glycine max
  Coding DNA Sequence Number=SeqID_36216
MDPVKYIFEKSALTGRIARWQGSALADIWPSNPLQDIGDAPRVPDEDIMALFEEKRTHEDIDKWIVALMGRQMFGSRSRGSPCIPG

SEQ ID NO: 127902 - protein, 95 aa, Glycine max
  Coding DNA Sequence Number=SeqID_36217
  Homolog annotation: Hit_ID=A5B326; Match level="QueryCoverage=100%, HitCoverage=7%, E-value=2e-08, Identity=33%"; Hit description =Putative uncharacterized protein
  Pfam annotation: Domain name=Retrotrans_gag; Domain location=4-72; Score=-1.9; E_value=0.082; Accession=PF03732.8; Description =Retrotransposon gag protein
MEGKAFVWQRHYTTHNNNKMKSWQQILQDVALRFDMGNYDDPVSELSKLRQEARVDVTKEMAISFFLGGLHASLEKSVCIHNPSSLQDAMRLARL

SEQ ID NO: 127903 - protein, 76 aa, Glycine max
  Coding DNA Sequence Number=SeqID_36218
MAPRKLSNKISRRDAAAEGTSAAPEFDSHRFRSADHQQRFEAIKGWSFHRERRVQLMDDEYTDFQEEIARRRWTSL

SEQ ID NO: 127904 - protein, 77 aa, Glycine max
  Coding DNA Sequence Number=SeqID_36219
KECNEQCVNHEDFDDIKKNLLEKEGDVNHASFDGVEKKSNFIIIKKGENVNVCIHDFDDVKEESNKAASNDEHLLQE

SEQ ID NO: 127905 - protein, 137 aa, Glycine max
  Coding DNA Sequence Number=SeqID_36220
MQEQPEREAITQLLCIPGQDFTRAAAKRQVRFVSTNMTTLTQIWIVPARHPVDPEKSNKVLGFPALITSLCQFYRVLIAPNKVIRPLLTGLSSRSTVPPGRRRARHHSSGQQMHRHHLWSSPQLIHKKVRVLPRTHG

SEQ ID NO: 127906 - protein, 115 aa, Glycine max
  Coding DNA Sequence Number=SeqID_36221
MRLPGKESMLMKSPITVNEILDVSISFLNDHLEETLGSTKIEENHSKCINLAQDFPWKRVLLVGFSAFEFFGFFLFCFPLTQGEQVTDAQDFGDNSVLFRYCLVKRPFCTFLLLL

SEQ ID NO: 127907 - protein, 77 aa, Glycine max
  Coding DNA Sequence Number=SeqID_36222
  Subcellular localization annotation: CTP_CleavageSite=46; ConfidenceScore=5.13e-01
MACNLWLTASRYLAPFIAQYVKMFLQKAVASGGSNLARLGGGVKVMQSYPARALARRLQVDWARDPRKGPRVLMSLR

SEQ ID NO: 127908 - protein, 118 aa, Glycine max
  Coding DNA Sequence Number=SeqID_36223
MAPEDQEQLTQQIRDQLEESITEKVTQQMMLSFSHMQFQFQSQMQSQGLGLPPEPKVGPSPARVNIKESCVNPSGNDPDTGDSDKCRLYIKENPPRLVALGRVYEGSTTVHNIPLLHG

SEQ ID NO: 127909 - protein, 59 aa, Glycine max
  Coding DNA Sequence Number=SeqID_36224
MRIPESFISMKYCRVLAIKIAIPWVMGLKQDHAFYVKVHQVKLKHESNHLAKIGAKDGS

SEQ ID NO: 127910 - protein, 70 aa, Glycine max
  Coding DNA Sequence Number=SeqID_36225
ALDLEQSQVTLMKIVEAMPSKIILMMPKNQELSKFQRFKNQVSSFKNQDSRIKFQESRFKNQVSRIKIQE

SEQ ID NO: 127911 - protein, 116 aa, Glycine max
  Coding DNA Sequence Number=SeqID_36226
  Subcellular localization annotation: CTP_CleavageSite=59; ConfidenceScore=5.52e-01
MVKFFFSSFFFLLFLFHFLSLFTIISCPKYESFTKYIVSSRAKVSTVVVSQCALRGRARARLTGALSKGGKVDKSGAFAPTYPPSKRKSDLRSSFLCVNQVILFYLKGDHFKGVGP

SEQ ID NO: 127912 - protein, 209 aa, Glycine max
  Coding DNA Sequence Number=SeqID_36227
MGALLIVPPIEIPLPLVLANASAPRYMYVSPSYLSSSLDHILPDVNVPIGDFLELSWSRVSHPKVLSRMVFESFDMKPYSIGVHEQIVAPIKVNAPGILILGQAAFFPSESVIPRCSSRMVYNPSSIGPRAFVMWHSRIQRCRYHHLLKSLEEYLVKLLVVFLIVEFGQENHHYHYLTRDTDHPPTVQPSCPVLQPSSCPVSWVLSELV

SEQ ID NO: 127913 - protein, 354 aa, Glycine max
  Coding DNA Sequence Number=SeqID_36228
  Gene Ontology: Mol. function=nucleic acid binding
  Homolog annotation: Hit_ID=Q1SKZ9; Match level="QueryCoverage=45%, HitCoverage=39%, E-value=8e-09, Identity=23%"; Hit description=Zinc finger, CCHC-type
MVTFRVLHNLTKELDHLDCSKKKGKVGGVNVSGLSKGHESQGIVDDYVSKDKEVLLSVDMALEPKSILRPRVKVPKDQIKEACRPWKKAIVVKLLRKKLSMRFLRVRLPKLWQPLGEMEMIDLESDYFLIRWSMNGHGPVFVGSEMDPDFFPYERQMRKMDSNMLRAKKDMELGNYVTKRAKFARICIEVDLNMAQKEVCLLEGHEINGVGVGSSIMSFQKGPKFEVLQEDDNDGLPNQRAHRDNANKKDKNNFSACAKTFKVFLQELILHPEDLYNTFTARSMQDQILSTSVRGDAPNGKGKSLPKILVGVENMASNEITTEAPIMATELDTDPAAPASGAGAGAGTGDCPET

SEQ ID NO: 127914 - protein, 373 aa, Glycine max
  Coding DNA Sequence Number=SeqID_36229
  Gene Ontology: Mol. function=nucleotide binding; Cellular component =intracellular; Biological process=defense response
  Homolog annotation: Hit_ID=A7R3R8; Match level="QueryCoverage=45%, HitCoverage=21%, E-value=1e-40, Identity=50%"; Hit description =Chromosome undetermined scaffold_560, whole genome shotgun sequence
  Pfam annotation: Domain name=LRR_1; Domain location=195-217; Score =8.4; E_value=8.5; Accession=PF00560.24; Description=Leucine Rich Repeat
  Pfam annotation: Domain name=LRR_1; Domain location=219-241; Score =14.2; E_value=0.49; Accession=PF00560.24; Description=Leucine Rich Repeat
  Pfam annotation: Domain name=LRR_1; Domain location=243-265; Score =12.6; E_value=1.4; Accession=PF00560.24; Description=Leucine Rich Repeat
  Pfam annotation: Domain name=LRR_1; Domain location=267-289; Score =15.1; E_value=0.26; Accession=PF00560.24; Description=Leucine Rich Repeat
  Pfam annotation: Domain name=LRR_1; Domain location=291-312; Score =5.0; E_value=37; Accession=PF00560.24; Description=Leucine Rich Repeat
  Pfam module annotation: Pfam domain module=LRR_1::LRR_1::LRR_1::LRR _1::LRR_1; Domain location=195-217::219-241::243-265::267-289::291-312
MDIKCPIFKVMKKQLSDWDFCLGKLREVQCTQCILKPLVHDDAITLFRHYASLEESCSSISEEVIQKVVKNCKGLPLSIKVIGSSLCNQPFELDLGLFPEDQRIPFTSLIDMWAELYGLDDDGIEAMSIINKLDSMNLANVSVESDLPFIIFTTDAIWVAFADENCTSDWPLMMQLAQVEAFENNHMLIPNAFPNLEELNIDHCKDMVALPKGLCDITSLKKLSITNCHKLSALPQEIGNLMNLELLSLSCCTDLEGIPASIGRLSNLRLMDISNCISLPSLPEDFGNLSSLQNLYMRSCARCELPFSVANLENLKVVVCDKEIAASWDDFKPMLPNLKIDTFDNLENLKVVIGDEETAASCEDFKPMLPNLK

SEQ ID NO: 127915 - protein, 346 aa, Glycine max
  Coding DNA Sequence Number=SeqID_36230
  Gene Ontology: Mol. function=nucleic acid binding; Cellular component= intracellular; Biological process=regulation of transcription
  Homolog annotation: Hit_ID=A7PWB2; Match level="QueryCoverage=99%, HitCoverage=99%, E-value=1e-106, Identity=55%"; Hit description =Chromosome chr8 scaffold_34, whole genome shotgun sequence
  Pfam annotation: Domain name=zf-C2H2; Domain location=186-208; Score =20.1; E_value=0.008; Accession=PF00096.17; Description=Zinc finger, C2H2 type
  Pfam annotation: Domain name=zf-C2H2; Domain location=270-292; Score =23.7; E_value=0.00069; Accession=PF00096.17; Description=Zinc finger, C2H2 type
  Pfam annotation: Domain name=zf-C2H2; Domain location=296-319; Score =9.2; E_value=1.2; Accession=PF00096.17; Description=Zinc finger, C2H2 type
  Pfam module annotation: Pfam domain module=zf-C2H2::zf-C2H2::zf-C2H2; Domain location=186-208::270-292::296-319
  Subcellular localization annotation: CTP_CleavageSite=45; ConfidenceScore=5.65e-01
MTDPKSNLYTETFNFMPLYSHLSSFSTSQSNLFSSYSNNNTFAIQSETSSSYAPPSPPLREALPLINNISLRKQKEKNEPSKSGGGMVEEEGGKKRDMDETTLLMTSTTTEEGDAETVTVALQIGLPSVAASDDLNGSRKIPAACAQMNEKEDARSVISGHPFDRLNKVQYWIPTPSQILIGPTQFLCHVCSKSFNRYNNLQMHMWGHGSQYRKGPDSLKGTQPSAMLRLPCFCCAPGCKHNIDHPRARPLKDFRTLQTHYKRKHGIKPYMCRKCDKTFAVKGDWRTHEKNCGKIWYCLCGSDFKHKRSLKDHIKAFGHGHGAVDIDCMQEDEAASEIEHDGDISM

SEQ ID NO: 127916 - protein, 685 aa, Glycine max
  Coding DNA Sequence Number=SeqID_36231
  Homolog annotation: Hit_ID=A5APU0; Match level="QueryCoverage=30%, HitCoverage=10%, E-value=2e-12, Identity=59%"; Hit description =Putative uncharacterized protein
MMSESGVKVCVFNNGDTLCGGAEGITFNSDNKKCIIVQLDITISELKHIVDSIFCIKDDGSPLGGQLSAHTSNMTFCDSSSSPSTTLTQTQNPSDPQIIVPNRKRRVKASSDTQFKENWLASLSYPFPEKTHLLSGEHEPTHQNDGSKWVLGIDPDVSGAVALLKTHGSVCSAQVPCFFLSLLAKVLSFSVLCYITWFGCGFIVLDIVGNCGQSGCNCGRGDPKSLILQLKLRGATCGRGHGFAAILDIVGNCQMPTNSAATVVAKTLKTLMLVFDSPHVKILVGKNKRTRRRLDAKSVVELVRGFDAPIAEVEFEKGKDRVVMNVQMASKKRENDVQKSWKEYKWENNRMWGEELKDGGYLGELRGISLGLKDYCILGKYAVVRIYGGGKGELVLEMEEARVKGELPAFVGHGGCCNALVLHLEPKDPGFRLGVIFHNLIKRFGDSYGSHFFDRLTTLKQEEQIETKTRIEKKGDFHNVLEIEDQHFLAETHMLRKILNEVADYENSMDGSGSDCCEAESSSWTAKVELPTFDGGTKWGTNLKGSNFESDEETKNDETKLARETKIEKVMMDGEVDPLMKRETAKENRVKNEGCEEDFLDNPITELIKMEVEGGDATKPHCFQYSDFHKKVVMMKQKSLLDPDSIMKVVGTSTVLESWNFNLLGEPFVLNFVASMTDSLAVELR

SEQ ID NO: 127917 - protein, 138 aa, Glycine max
  Coding DNA Sequence Number=SeqID_36232
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=A7Q2B1; Match level="QueryCoverage=84%, HitCoverage=46%, E-value=6e-34, Identity=62%"; Hit description =Chromosome chr13 scaffold_45, whole genome shotgun sequence
  Pfam annotation: Domain name=OSCP; Domain location=3-129; Score=58.7; E_value=2e-14; Accession=PF00213.9; Description=ATP synthase delta (OSCP) subunit
MFFLLSVKLDNRDRWSAPDHFSNVLDHWRVIVAENGRLKNIDTIAKRFAQLSMAYKGEVQATVTTVVPLPPEEEKALKETLQEIIGSGAKVHLEQKIDPSILGGLVLEFSQKVFDMSIKTRAQQMERILREPVSIANI

SEQ ID NO: 127918 - protein, 146 aa, Glycine max
  Coding DNA Sequence Number=SeqID_36233
  Gene Ontology: Mol. function=catalytic activity; Cellular component =chromatin; Biological process=auxin mediated signaling pathway
  Homolog annotation: Hit_ID=P33079; Match level="QueryCoverage=63%, HitCoverage=100%, E-value=3e-35, Identity=73%"; Hit description =Auxin-induced protein 10A5
  Pfam annotation: Domain name=Auxin_inducible; Domain location=1-91; Score=167.1; E_value=4.5e-47; Accession=PF02519.5; Description=Auxin responsive protein
MGFHIPGIIRQTLFSATKATQKGLEVPKGYLAVYVGDKMKRFVIPVSYLNQPLFQELLSQAEQDFGYDHPTGGLTIPCKEDDFLNLTSHLNELDDYIRTLPQLDSTSLGMKVGSSMIWGSQTASFSLQCRLQDSPLAPPQLLKMFG

SEQ ID NO: 127919 - protein, 622 aa, Glycine max
  Coding DNA Sequence Number=SeqID_36234
  Gene Ontology: Mol. function=pyridoxal phosphate binding; Biological process=metabolic process
  Homolog annotation: Hit_ID=A7QB64; Match level="QueryCoverage=94%, HitCoverage=94%, E-value=0.0, Identity=61%"; Hit description =Chromosome chr4 scaffold_73, whole genome shotgun sequence
  Pfam annotation: Domain name=Aminotran_5; Domain location=93-545; Score=-15.5; E_value=6.2e-11; Accession=PF00266.10; Description =Aminotransferase class-V
MEVLEHPLLAEIPVLAEPCMDQSVDKTNNEVGVLSKTSISSHDFCNHSESFKKLVEMGLPCNESVEEKLHWLRLQIIGNEAEFDSPFGKRKVVYADHTASGRSLHYNENFIIKHLLPFYGNTHTCDSYVGSRTTKMVHEASEYIKKCLGGGEDDALILCGSGTTAAIKRLQEVMGIAVPSVLRERVLKSLSTEERWVVFVGPHEHHSNLLSWRQSLAMVVEIGLDDKGLLDMDALKLQLEAYKDTNRPMLGSFSACSNVTGIYSDTRAIAQLLHRYKAFACFDFAASGPYVEIDVRSGESDGYDAVFLSPHKFLGGPDSPGVLLMNKALYLLGSSPPSTCGGGTVTYVNAFNEQDTLYLENIEERETGGTPPIIQTVRAALAFWVKEYISYEDIEKREQLYINKALERLGSNPNIEVLGNLKAKRQAILSFLIYSTTTNSCSAGEWSDGNKENEGELDLWAETGNQRGKPLHGPFVAALLNDLFGIQARGGCACAGPYGHELLHINKSHSLAIRSAVQEGYIGVKPGWTRVSFPYYMSEEDFEYILKAIEFIAVYGQRFIPLYSFNLINGSWRLKTQKFEAQTKEGTDKFEVAKCVASSLRKFPSQGILQEEVDPNIFCFRI

SEQ ID NO: 127920 - protein, 277 aa, Glycine max
  Coding DNA Sequence Number=SeqID_36235
  Homolog annotation: Hit_ID=A7QR98; Match level="QueryCoverage=90%, HitCoverage=95%, E-value=1e-33, Identity=39%"; Hit description =Chromosome chr13 scaffold_149, whole genome shotgun sequence
MMPYSQIFQNNRNYAVWPPYPPENAAVFPHPTAFNPHPGRVTGNKRKDFYRTGSGPPVIRSGAKGCRINHPKRILGRGGAANRLTPPFAPRNTTSFIIRTKNCGGMVSPPTPEAATSSPAILPAASLSPATFDEKAAKEQWGFNGYGSMKGLIRLRPGNCDSGAGRFEMVYPNSGEEHKNLDKRVAEQDTHIAQLEEQNLTLKERLLFMERQLDDMRRRVQFLETYGTTSRGGEGGAENFPAAGDVCSVKSYINNSGVDGDNNNVDENNNWEDILQW

SEQ ID NO: 127921 - protein, 189 aa, Glycine max
  Coding DNA Sequence Number=SeqID_36236
MNCRETTVAVEDVAAAVVALVVGAGDGAAAAASQHRWLPPPHSKEFPWLQQISTCTTKQRTGKASTCHTTGPSARAGASPRGCRVRKSSRWEPAESLLRFRLPVETLTVKSRIASWPLSESESSAIMLKTLMHEFSALDSGVEKALTLVAGWVPEAVAAEGERGGGRGGGGGRRFVSLGGGGWLRVSRA

SEQ ID NO: 127922 - protein, 100 aa, Glycine max
  Coding DNA Sequence Number=SeqID_36237
MDLSCTWVAMLGGEWRIGCKGFSRLIVNQRLVTVFATNPNSVGEKSPTEGSDVNETSNAAQGPPLLTILAGFFVLFVVCWSIWSIITWLISLIVNVPAPK

SEQ ID NO: 127923 - protein, 567 aa, Glycine max
  Coding DNA Sequence Number=SeqID_36238
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9AUE0; Match level="QueryCoverage=100%, HitCoverage=29%, E-value=0.0, Identity=70%"; Hit description=Callose synthase 1 catalytic subunit
  Pfam annotation: Domain name=Glucan_synthase; Domain location=210 -567; Score=-229.9; E_value=0.036; Accession=PF02364.6; Description=1, 3-beta-glucan synthase component
MDLMLVPYSADRSLNLIQWPPFLLASKIPIAVSMAEDSLGKGQELEKRLSRDKYMKSAVEECYASFKSIINFLVLGERETMVIQNIFQRVDVHIENKAVLNELNLSAVPSLYERFVKLIERLLENKEEDKDSIVILLLDMLEIVTRDIMDGDIEGHGGSYGKDERFTPLEKQYTFFGKLQFPVKTDIDAWTEKIKRLHLLLTVKESAMDVPSNLDARRRISFFSNSLFMDMPPAPKVRNMMSFSVLTPYFKEPVLFSLSHLGEPNEDGVSILFYLQKIFPDEWKNFVQRFDNKSEEKLRVENEEELRLWASYRGQTLTKTVRGMMYIRQALELQAFLDMAKDEELMKGYKAAELESKESTTGERSLWTQCQSLADMKFTYVVSCQQYSIHKRSGDPRAKEILKLMIKYPSLRVAYIDEVEEHSKGSSRKTDKVYYSALVKAALPAKSNDSSEAVQSLDQVIYKIKLPGPAILGEGKPENQNHAIIFTRGEGLQTIDMNQDNYMEEAFKMRNLLQEFLKQHDGPRMPTILGLREHIFTGSVSSLAWFMSNQEHSFVTIGQRLLAYPLK

SEQ ID NO: 127924 - protein, 516 aa, Glycine max
  Coding DNA Sequence Number=SeqID_36239
  Gene Ontology: Mol. function=nucleoside-triphosphatase activity; Cellular component=endoplasmic reticulum; Biological process=cell division
  Homolog annotation: Hit_ID=A7QR87; Match level="QueryCoverage=95%, HitCoverage=96%, E-value=1e-179, Identity=66%"; Hit description =Chromosome chr13 scaffold_149, whole genome shotgun sequence
  Pfam annotation: Domain name=AAA; Domain location=232-430; Score =30.7; E_value=3.5e-08; Accession=PF00004.20; Description=ATPase family associated with various cellular activities (AAA)
MEILSQMWSLLGLLTVLQNVLPSQLLSLLHSLYESLQDLLSPYSYFEIPEFNGYCGVELNDLYRHVHLYLNAANHAPAAACRRLTLSCSPSSNRISFAVAPNHTVHDAFRGHRVGWTHHVETAQDSLEERRSFTLRLPKRHRHALLSPYLAHVTSRAEEFERVSRERRLFTNNTTASGSFESGWVSVPFRHPSTFETLALEPELKKQIKNDLTAFADGKEFYKRVGRAWKRGYLLHGPPGSGKSSLIAAMANFLCYDVYDLELTKVSDNSELRSLLIQTTNRSIIVIEDIDCSVDITADRTVKVKKSQGAKLSLRSSNKKGQTGCEESGRVTLSGLLNFTDGLWSCCGEERIVVFTTNHRDSVDPALLRCGRMDVHVSLGTCGTHAFRELARNYLGVDSHVLFEAVEGCIRSGGSLTPAHVGEILLRNRGDVDVAMREVLAAMQGRMLVATAAADQPENEEASTAAGVRSPESVLMMGSPENWDVKRKEQHGCNNLDKKVKFFVRLRSLTRSDPGR

SEQ ID NO: 127925 - protein, 346 aa, Glycine max
  Coding DNA Sequence Number=SeqID_36240
  Homolog annotation: Hit_ID=Q2HV76; Match level="QueryCoverage=65%, HitCoverage=60%, E-value=7e-18, Identity=31%"; Hit description=F-box protein interaction domain; Galactose oxidase, central
MKREVTHPQTLPDELIHEILLRFKSVHKSWLSLISEPGFAKSHFDLAAAPTTDFFSSASILILKLIILMLIWSLTFHFHYLLWEACMNTDNNDFFDFVITGQRIQRQTNHVCIHPQMSGIGNDSLADDYVVAILQLSLDQDLPSYPKVDFFSSRTNSWSRIEGTLPCYFSGQKNVRHKFVHKFMHMFLNGALHWMIESYNDLGLIIEFDVRERRLSDIPLSRYLTIEWEYKLHHLTVMEGLVCLCLSDYMDDLGTTEIWTMKEYKVQESWTKLFVLPNNSYHCLPLFVLIRFIKTGEILGSNGANILLLRPYNKGEEGLQLCARGQTHFSLTCMYRESLLSLPVEF

SEQ ID NO: 127926 - protein, 48 aa, Glycine max
  Coding DNA Sequence Number=SeqID_36241
MKKTIVDGVTITKEITGEEGGKGKGCNGFLGGGYPQKKVEKYIKMSMW

SEQ ID NO: 127927 - protein, 394 aa, Glycine max
  Coding DNA Sequence Number=SeqID_36242
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A2SY66; Match level="QueryCoverage=97%, HitCoverage=80%, E-value=1e-156, Identity=64%"; Hit description =Vicianin hydrolase
  Pfam annotation: Domain name=Glyco_hydro_1; Domain location=1-391; Score=435.4; E_value=7.9e-128; Accession=PF00232.9; Description =Glycosyl hydrolase family 1
MLQSDIKLVKDIGLDSFRFSISWTRIFPKGKGAVNGLGVEFYNNLIDEVLSNDLKPFVTLFHWDFPQALEDEYGGFRSSNVVEDFRKYADFCYKTFGDRVKHWVTINEPLSYSINGYNGGTFAPSRCSKYVANCSAGDSSIEPYIVGHYLLLAHEAAATLYKKKYQARQKGQIGITLPTHFFLPKSNSVADKQAANRALDFFFGWHARPVIFGDYPESMKSSVGSRLPKFTKAQSEGLKSSIDFLGVNYYTTYYAENAAPTDLDWLYIYPKGIHLLMVHIKDKYKNPNIYVNENGIAEARNDSIPVDEALNDGIRIRYLKSHLRLLLQAIKEGVNVKGYYAWSFSDSFEWDAGYTVRFGHVYVDYNNNLKRYLKSSAFWLKKFLLNDNNKVLSY

SEQ ID NO: 127928 - protein, 188 aa, Glycine max
  Coding DNA Sequence Number=SeqID_36243
  Gene Ontology: Mol. function=transmembrane receptor activity; Cellular component=intrinsic to membrane; Biological process=innate immune response
  Homolog annotation: Hit_ID=Q5JBT4; Match level="QueryCoverage=50%, HitCoverage=9%, E-value=1e-15, Identity=46%"; Hit description =Candidate disease-resistance protein SR1
MEAAQGWKYQILLYRSKYSRVVRSTKQGGPSTAFWFHNKFPARVLCLLIAPVLYFKRPKVFINGEVQESCFDRGDQKEVRLSELDNTYLFGLQKISFVDKLFQVPFELEWNHVEVTYESHKSSLYKPNVNLEQHLQNTYVLLSFPRYKNSNRAIRGGALESTRDATIANREHLSDYLEVRDELLTLGD

SEQ ID NO: 127929 - protein, 75 aa, Glycine max
  Coding DNA Sequence Number=SeqID_36244
MVEERIQIHLKKKKKNSNSVSLPCRAIGSFYIKLIVQFEEECGVGGDDNAAGRRWRDDIGKERKGEEEGEEEDEG

SEQ ID NO: 127930 - protein, 262 aa, Glycine max
  Coding DNA Sequence Number=SeqID_36245
  Gene Ontology: Mol. function=transferase activity, transferring glycosyl groups; Cellular component=endoplasmic reticulum membrane; Biological process=GPI anchor biosynthetic process
  Homolog annotation: Hit_ID=A7P7I3; Match level="QueryCoverage=33%, HitCoverage=19%, E-value=8e-36, Identity=81%"; Hit description =Chromosome chr9 scaffold_7, whole genome shotgun sequence
MASLDIHSLLLFSAIFRVILIVYGEWQDAHMEVRYTDVDYLVFSDAAALMAVGDSPYKRTTYRYSPLLAFLLIPNSFIHRSWGKFLFSASAEIRPQCCLAWAKLLVETRPHIEMKDASDILVRDEGLICWGSASVSLGFSNVGTLEAPGMEILGSMPILDYKDALAMLVMLDEGLPKSYLQSRYEAAMEAAKEAKTKAGQGDHKQLRQLSNTPSHVVGLWVRSGNAVGVGLDTLCIMKPEAAMKWRVNCKSYFYAYAYIAEL

SEQ ID NO: 127931 - protein, 29 aa, Glycine max
  Coding DNA Sequence Number=SeqID_36246
MAQSTPQIGKAASEYGRWLTPLLVGYWIR

SEQ ID NO: 127932 - protein, 260 aa, Glycine max
  Coding DNA Sequence Number=SeqID_36247
  Gene Ontology: Mol. function=transferase activity, transferring glycosyl groups; Cellular component=endoplasmic reticulum
  Homolog annotation: Hit_ID=A5BAG8; Match level="QueryCoverage=95%, HitCoverage=39%, E-value=9e-53, Identity=41%"; Hit description =Putative uncharacterized protein
  Pfam annotation: Domain name=C2; Domain location=1-65; Score=22.4; E _value=0.0012; Accession=PF00168.21; Description=C2 domain
  Pfam annotation: Domain name=PRT_C; Domain location=191-259; Score= -54.6; E_value=0.00046; Accession=PF08372.1; Description=Plant phosphoribosyltransferase C-ter
  Pfam module annotation: Pfam domain module=C2::PRT_C; Domain location= 1-65::191-259
MKKKNRTYAYCVAKYGPKWVKTRTIIDSLSPKWNEQYTWEVYDPCTVITIVVFDNGKLHSLLSAYKPAHTRSQEDGGNSIGLFCKLMHNLCFQGCTLSIFQLDSLRNQVAAITTLRFKRAEAPLSKEVVEYMLDAGENVWSMRRGRAQFHRIAVLLNVLVFVAKHFDEKKITTVLSYFMFLYVVFCPWIILPSTILFLLLVGIWCYRTWPRYPSHTDIKLSHVDTTTVEELEEEFDNPFPSKFSGDNLRTRLTLPHSSLW

SEQ ID NO: 127933 - protein, 1017 aa, Glycine max
  Coding DNA Sequence Number=SeqID_36248
  Gene Ontology: Mol. function=binding; Cellular component=eukaryotic translation initiation factor 3 complex; Biological process =translation
  Homolog annotation: Hit_ID=A7QWW8; Match level="QueryCoverage=94%, HitCoverage=72%, E-value=0.0, Identity=68%"; Hit description =Chromosome chr13 scaffold_210, whole genome shotgun sequence
MAGKSGKGRNRKGSHNASSASESAVHSDVPVKDNVEVTLESAKADAAEVAAGGDSIVANPEVKENETATEGSQQKQGDLQLYPVSVKTQTGEKLELQLNPGDSVMDVRQFLLDAPETCFITCYDLLLHTKDGSTHHLEDYNEISEVADITTGGCSLEMVSAFYEDRSIRAHVHRTRELLSLSNLHASLSTSLALQNEIAHNKSANSGDTLKPEVPELDGLGYMEDIAGSLGNLLSSPLKDIKCVESIVFSSFNPPPSYRRLVGDLIYLDVITLEGNKFCITGSTKMFYVNSSSANNLDPKPSKATFEATTLVALLQKISPKFKKAFREVLEGRSAAHPFENVQSLLPPNSWLGLYPVPDHRRDAARAENALTLLYGNEPIGMQRDWNEELQSCREFPHTSPQERILRDRALYKVTSDFVDAAINGAIGVISGCIPPINPTDPECFHMYVHNNIFFSFAIDADLEKLSKKRVDANSKTWSSGNSQSSSDKASTLLHGESQVPNGGKDDGSSSEDLNGTEITQDVSPEAQLAENEQATYASANNDLKGTKAYQEADVPGLYNLAMAIIDYRGHRVVAQSVLPGILQGDKSDSLLYGSVDNGKKICWNEDFHSKVSEAAKRLHLKEHLVLDGSGNLFKLAAPVECKGIVGGDDRVTPRDANYTGPGSRFCILRSELISAYCRAQAAEILKSKEKNPQEADNLVTDSQNAAEADHLVNDSQNAADADQLVNDSQNLTDADKLDSTKEEKTEDVKVLASVTTKASDGCEDIVFNPNVFTEFKLAGSPEEIAADEDNVRKVSQYLTDVVLPKFIQDLCTLEVSPMDGQTLTEALHAHGINVRYIGKVAGGTKHLPHLWDLCNNEIVVRSAKHIIKEHAGQRSPGKHSKGQARWKGRASLRKTQPLYASISSEVLWSDIQEFAMVKYKFELPDDARSHAKKISVIRNLCLKVGVTVAARKYDLSSATPFQTSDVLDIRPVVKHSVPSCSEAKELVETGKLQLAEGMLSEAYTLFSEAFSILQQA

SEQ ID NO: 127934 - protein, 283 aa, Glycine max
  Coding DNA Sequence Number=SeqID_36249
  Gene Ontology: Mol. function=RNA methyltransferase activity; Biological process=RNA processing
  Homolog annotation: Hit_ID=A7QWV8; Match level="QueryCoverage=16%, HitCoverage=18%, E-value=9e-17, Identity=87%"; Hit description =Chromosome chr13 scaffold_210, whole genome shotgun sequence
  Subcellular localization annotation: CTP_CleavageSite=70; ConfidenceScore=5.84e-01
MDITAFKSLNIPFPTFPSKFSPFRPFSFFHFKPFRTPSSPRFISHCSLNGSAEITSKEGTLPRGVGEAVNEASSSKILQVVLVSPQDLAELVKRLELDYGLCLLPLPVRIHEVGTKGIVVKCMLDESGAFVDSLQKYFFFANALNILDMLSMLEEFSRASLLEVFPVEKLSKALLPLYPNSVNTTAQDLTGDEDHPVQMYECVQLFVTEIMYVCVGHWVGYKSGDSIGVIGREYESNEIPGNTGCIARTCAASAVGLHLVGPLGFQVDDTKLKRAGLDYWPYP

SEQ ID NO: 127935 - protein, 122 aa, Glycine max
  Coding DNA Sequence Number=SeqID_36250
MENGFHLPHQQPLHAQHDQVQRLGIPLTKSLLGAKLYIRRKYRRSRKPKLKQSSTEEVPIQTVISLFQVKFKDHTPFLLFGFSHSMNNFLENNNIVHSPSLRNKTTLKKAYQALKKGSHPVH

SEQ ID NO: 127936 - protein, 221 aa, Glycine max
  Coding DNA Sequence Number=SeqID_36251
  Homolog annotation: Hit_ID=A5BSR3; Match level="QueryCoverage=36%, HitCoverage=25%, E-value=8e-11, Identity=48%"; Hit description =Putative uncharacterized protein
MLHWFDLFNLGSNFVIIGSHTTFLLGLIPIANPRWKQFKSDLTRKWALAADQDGVEDTVCEKYDISKEKWAQFCHTRRDPSWEDVRKKAQAIQKQNTTPHVLSRGDYDYLEQKLLAEKMKKKLEEAAQSGSVDGIIDPPSPVRRHVKWKMARTKKIGEMTTEAAKEIAEKIDFFKEQATQGSFVPHGRQDVLVAAIGRPEQPGRVRATGVGVTINGGCASR

SEQ ID NO: 127937 - protein, 167 aa, Glycine max
  Coding DNA Sequence Number=SeqID_36252
  Gene Ontology: Mol. function=protein serine/threonine kinase activity; Cellular component=integral to membrane; Biological process=protein amino acid phosphorylation
  Homolog annotation: Hit_ID=A7PN67; Match level="QueryCoverage=57%, HitCoverage=11%, E-value=2e-26, Identity=59%"; Hit description =Chromosome chr1 scaffold_22, whole genome shotgun sequence
MDDITAITIQHQMQDTMVCKADPSGFYSTKSEYRLLMTFNRPIPQRRILQTIEACNAHKKFSIETKWGTMMGSYPFLEEQPIPLTGRSHVYSFGVVLLELLTGRRPVGNFGEEGIDIVQCTKLQTNWSNDKVVKILDERLCHIPLDEAKQEQSVERPTMREVVEMLA

SEQ ID NO: 127938 - protein, 136 aa, Glycine max
  Coding DNA Sequence Number=SeqID_36253
  Pfam annotation: Domain name=Transposase_23; Domain location=51-121; Score=9.2; E_value=0.00012; Accession=PF03017.5; Description =TNP1ENSPM transposase
  Subcellular localization annotation: CTP_CleavageSite=34; ConfidenceScore=5.27e-01
MASFSQMQSQIQSQMQSQGLALPPNPLVGPFGPWVSTKGSCVDPLGNDPETSDSDRCGLYIEADPARLVAMGRVYEGSIVVHNTPLLPGQVKVSVEEVTDADAPVPVPTDEVSLVGQALHTFLAWPTHLVKSLSQQ

SEQ ID NO: 127939 - protein, 102 aa, Glycine max
  Coding DNA Sequence Number=SeqID_36254
MVFLGYHETGGYKLFDPRSKQIAISRDVEFDEFKNWRLELESTSRNARFLIEADYSGNNVVVTAVTPDQGILRKSTRVTQVPQSLRDYEVYKDDQITEGGDL

SEQ ID NO: 127940 - protein, 126 aa, Glycine max
  Coding DNA Sequence Number=SeqID_36255
MGDQEETQEQMKADMSALKEQMASMMEAMLSMKQLIEKKRGHRRRCQDTLGHDGSPHLGYNRAAYPYGLPPNYSPPVLQEDAGHIASPVHEREPPQQPDEVHKDPQDYARRDVEFYPPIPEGPAPG

SEQ ID NO: 127941 - protein, 189 aa, Glycine max
  Coding DNA Sequence Number=SeqID_36256
MVQQAVIVGFGWWPWVKIMEGDSVIHTVAYADDVVRVSVETVIDPEAEVPYATSEIQYVKQAVDTFVAWPTHLVKAVLDEVPQSIPHNEDAHVPKPTNVDADDPLRGLIKFLGIVDASASIFITYSDVSEIIAGDKSLNISVIQLWLMYIHEWSQIFSQGFMYAFLEPQSLMTLSPETKAVAPKWIEVK

SEQ ID NO: 127942 - protein, 148 aa, Glycine max
  Coding DNA Sequence Number=SeqID_36257
MSGRHRPTDTFAGGRLALRSLGRMLLSSNVIYICVRVVMLVRMIRTRLFAVARVKSCPGMHSSCVIASLSGCVRTVGPPPISGGGPGTVRMWSTLKMRTRSPLKVRACSPLKARMCSPLEVRACSPLLARTCSPLQGEGVQPSIGEDV

SEQ ID NO: 127943 - protein, 344 aa, Glycine max
  Coding DNA Sequence Number=SeqID_36258
  Homolog annotation: Hit_ID=Q6WAY4; Match level="QueryCoverage=95%, HitCoverage=59%, E-value=5e-18, Identity=28%"; Hit description =Putative uncharacterized protein
MLADLYDTFDRRCEKSSTRIVCCTPALYVWLVSHLFRQEVRHACPLESHRSCIEKEGANWDQLLASKEGASVNWFPRWKEGRTGVLISCGGFPNVPLMGTRGCISYNLVLAIRQLGYPMRRAPLEDELVPVISQGFNKTNMETLQKVRKAWEVLQKKDKELRGCNNGPIGGYRNWLKAHVQGLVWLPSLRTDKREEVEAPEEDEEVQALRAELEQAQTVKERFKSAALKIQTKNAELRDTNIATTKALERETKRARREEHGRNKFRGALWGSNSELKFRREERDQSRVDSLILRDELKACSRSKRSLSQRLCETETNMLAIITKYQEELNLATAHEHRVADEYA

SEQ ID NO: 127944 - protein, 146 aa, Glycine max
  Coding DNA Sequence Number=SeqID_36259
MQLPQKPLNKKPRGLARKSMAVKNSMERCGATTRLCETETNMLAIIIKYQEELSLATTHEHRVVDEYAQVYAEKEARGRVIDSLHHEATMWMDRFALTLNGSQDLPRLLAKAKAMADIYSAPEQIHGLLDYCQHMIDLMAHIIRNR

SEQ ID NO: 127945 - protein, 208 aa, Glycine max
  Coding DNA Sequence Number=SeqID_36260
  Subcellular localization annotation: CTP_CleavageSite=38; ConfidenceScore=5.23e-01
LHVLALRGLHALTLGTTYPHRQRTTRPRLERTTRLHVLAFKGSCTFNFRGLHVLAVKGSCAFIFVGLHALTFRGLHVLTFRGLHVLASEDYMFPIFKGGHALTFRGLHVLAIIGLHSLVFERRHVLNFRGLHALAFRGLRVLTFRTSSFLLMVPGPPPDIGGGPTVRAQPEREAITQLLCILGQDFTRAAAKRRVQTMRTNMTTLTQI

SEQ ID NO: 127946 - protein, 88 aa, Glycine max
  Coding DNA Sequence Number=SeqID_36261
MAESQRRNSINSQKDLPMAFAWNKFDRLEVQDVTWSIFGHLHETVFEGDIRFEEEDKPKNQANLALQVKADSEAVYLMVQPQVSRNLH

SEQ ID NO: 127947 - protein, 113 aa, Glycine max
  Coding DNA Sequence Number=SeqID_36262
MNPPVVGKFYMRKILIPRLMVAVATYPSTGGRREGSRVRLPRKENARSRHQRLFEENIEKTEKRRGLRTLSVKGSGVVFTHGEVTKLCVGFRLFQKSTFNQIKAKRTIQGVGP

SEQ ID NO: 127948 - protein, 159 aa, Glycine max
  Coding DNA Sequence Number=SeqID_36263
  Subcellular localization annotation: CTP_CleavageSite=58; ConfidenceScore=5.16e-01
MNLGIPTVMWLRMPPVSWDTVTKSGVIDKSRAFAPTGNTGSNKDRRKSLKVYQSHTVRGEKVASAQDFVSNQRERTTLGRGFLFLGYLVTILYCSDIVWSKDLSGWQGLTFSPWVKVYDKLGFWLKACRTAGHDICQGLASGSGIKGMSYIISMIHMQQ

SEQ ID NO: 127949 - protein, 94 aa, Glycine max
  Coding DNA Sequence Number=SeqID_36264
  Homolog annotation: Hit_ID=Q6UUU1; Match level="QueryCoverage=67%, HitCoverage=42%, E-value=2e-21, Identity=80%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPGPPFPLLWDAFVSFHA

SEQ ID NO: 127950 - protein, 170 aa, Glycine max
  Coding DNA Sequence Number=SeqID_36265
MANTAARQVEERVEIETYQESIFQVTSIHHQMITEEETFEVSSTPEYSCSAAVGYAMKHSDIGDACSKEEEVEHEIVLTTSTMIQHFPLEKELGDEIDNLVDNEECDDLKDNCVDRVVFEKLEKMRPPEKPRAELKTLPTHLKYIFLEDDETKPVIISNSLKKEEEDQLV

SEQ ID NO: 127951 - protein, 218 aa, Glycine max
  Coding DNA Sequence Number=SeqID_36266
VLTIRGLHGLAIRGLHVLTFVEATRPHLRGPHILTFRGLHALAIRGLHVLTFLGLHALTFRGLHVLANRGLHALTLRGLHVLALQRTTRPNHQRAARPHLQRTTRPCLERATRPRLGGLHALAIKGLHVLTFLGLHALTFRGHTSSPIQRAARPRHQRTCPYLRSPRSEDYTSSESLRGLHVLTIRGLHALTSRGLHILVLALRGLPALALGTSYPHL

SEQ ID NO: 127952 - protein, 74 aa, Glycine max
  Coding DNA Sequence Number=SeqID_36267
MGTLEPYTGAMKGTMHKPQANLRADYPLLTQWVPSYKVMTKDNDWYLKALHWGNERHHAKTSSEPRGRLEVLTQ

SEQ ID NO: 127953 - protein, 33 aa, Glycine max
  Coding DNA Sequence Number=SeqID_36268
MAAVVVTTDDNGVMVVVATLTKVMAVDNGGGDG

SEQ ID NO: 127954 - protein, 65 aa, Glycine max
  Coding DNA Sequence Number=SeqID_36269
MQFGMCRNRPIGGRATRGLMAASSMGGKCAESPPTFIRGKRRKNRKGCFPCSYVFLNCDKEIRPT

SEQ ID NO: 127955 - protein, 119 aa, Glycine max
  Coding DNA Sequence Number=SeqID_36270
MVVLMGYEWKWCEFLGYSFTGTNPIRIGIPSGCGMEKLKDLIKQVAPTGVPPNGIHGSQLVRRLFFRQPGHSKYSENLIEYDITELKNDEDVLKVLAQSNYWKRFCTIEILAIFSKPVI

SEQ ID NO: 127956 - protein, 114 aa, Glycine max
  Coding DNA Sequence Number=SeqID_36271
VDPWVHALTFRGLHVLTYRGLHVLAIRGLHVLAFRGLHTLTFRGLHVFTFRGLHALAFRGLHTLSFSGLDTLAFKGPPPDIGGRPMVRAHPEREVIMQLLCIPGQDFTCAAAKR

SEQ ID NO: 127957 - protein, 27 aa, Glycine max
  Coding DNA Sequence Number=SeqID_36272
YAYTEKMHWRHLGDIRGNKPSAAEWLD

SEQ ID NO: 127958 - protein, 99 aa, Glycine max
  Coding DNA Sequence Number=SeqID_36273
SSQVKVGVEEVRDAQALVPVSTDEVTLVGQALNTFLAWLTHLVKPLSEQILKPFQVNWDATVFGVFNPDFPLYIKHEDLSEITHGGQCLSISVLQLWIL

SEQ ID NO: 127959 - protein, 221 aa, Glycine max
  Coding DNA Sequence Number=SeqID_36274
MGDQEETQEQMQADMSTLKEQMASMMEAMLGMRQLMEKNVATAASVSSAAEADPTLLATVHYPPPNAVGREMSTLGHSNNPHLGYNRVAYPYGLPPNYTPPVMHDDAGHVSSPILEGEPPRQPDEVHKDHRVYAQGDVDFYPPILVEGPPAPNTLPQHNLTAQPIFWSIEGPPPTAEERRKLDLIEERLKVVEGFGDYLFANMTDLCLVPDVVIPPKIQGT

SEQ ID NO: 127960 - protein, 180 aa, Glycine max
  Coding DNA Sequence Number=SeqID_36275
  Subcellular localization annotation: CTP_CleavageSite=50; ConfidenceScore=5.88e-01
MTPTPINSSPDHEFSTCLPSSSSSFSSSFSSSSCSFGRIDFPVCLKRTCKASRLRSLSTRPPGAERPVVHVDPATGKVDGPHMEKLRTYLGIVARDKVDVTYENWKEAEFDIPEAFESRTKRKLLQTVGERWRQFKSDLTRKWALVADQDGAEDTVCEKYDISKEKWAQFCQSRRDPSWE

SEQ ID NO: 127961 - protein, 189 aa, Glycine max
  Coding DNA Sequence Number=SeqID_36276
  Gene Ontology: Mol. function=oxidoreductase activity, acting on single donors with incorporation of molecular oxygen, incorporation of two atoms of oxygen; Cellular component=integral to membrane; Biological process=electron transport
  Homolog annotation: Hit_ID=A9HY82; Match level="QueryCoverage=33%, HitCoverage=17%, E-value=5e-25, Identity=88%"; Hit description =Putative uncharacterized protein
MGVDFAYMGTRFIASEEANASEGYKSAIVEASASDILYTPFFTGIPGNYLKASIAAAGLDPANLPQPGQRRLQFRLQPRQALEGHLGRGPGRGQHRQRAADAPDRRHAAPRVRRGQDPAGRQDLRMSAGLRVTRDGAVLTLVIDRQDRRNALDTATYAALTEQLALASADTSVSAVILAGAGEHFTGRQ

SEQ ID NO: 127962 - protein, 93 aa, Glycine max
  Coding DNA Sequence Number=SeqID_36277
MSHGSPIRAHNKLRRSKLNNECSRGIPMIITVATYPSAGGRRVTHGMRVPRKEYARSRHQRLFEENVGKTGKDAIYELLSERFGSCIYAWGRY

SEQ ID NO: 127963 - protein, 67 aa, Glycine max
  Coding DNA Sequence Number=SeqID_36278
MAFTLIQGRTKPMEFWGLHIQNPRKIRETTSCPSSSGSEDEVRGEESSGKVYPHEEGDLLMVRRLLG

SEQ ID NO: 127964 - protein, 119 aa, Glycine max
  Coding DNA Sequence Number=SeqID_36279
MSLHSSSSVNGRHRAHHRPHSHWREKERKLEEANINLLYFHGKDNVEANLDWEIRVEQQLKRMSTSKSYGSHSYQKKDQGQGILGMTPSKPKDDKGKTIEKKPLKASMQEKTSSIKCFK

SEQ ID NO: 127965 - protein, 46 aa, Glycine max
  Coding DNA Sequence Number=SeqID_36280
MEENLACGASMEAGSLSFNEVALMVIFHHGDAAEDKGEEVRGGTIH

SEQ ID NO: 127966 - protein, 117 aa, Glycine max
  Coding DNA Sequence Number=SeqID_36281
MWILHMTEISLRAGNADVYGFLEPRSIQRSVQSQFESESYIKNWMQNSKRGVYLGAYLNGALKEFDDTPQSKSKVAARWIAVRYFNDAKPLKLERLKALRIQWASYYLKVKNETISI

SEQ ID NO: 127967 - protein, 56 aa, Glycine max
  Coding DNA Sequence Number=SeqID_36282
MDKSLKVGEDDLRERERRGTKFMPQMSPLIQDQVQDSPLSVLRCHEACKHQDMHKV

SEQ ID NO: 127968 - protein, 138 aa, Glycine max
  Coding DNA Sequence Number=SeqID_36283
MHEYHIPFCLCSVNIVILCTFPHCVFCIGIAYGFFLIPTVNKPTEGPCRLLKNVRWGILLPLDVVSKKGTNSPDPRIPRLHLCHMHSIMHSSIPPMRYRSFDLHQLLSHFRRLMEPLQMQAFRKTYGKILELTIAECP

SEQ ID NO: 127969 - protein, 63 aa, Glycine max
  Coding DNA Sequence Number=SeqID_36284
MLGLAGTCQMASRKCKSIGSRPTTQYDTRRFYSFDALNRYMDNILGRNIVPERKVEIVGSSGL
